United States Patent 11,337,426 (BIOLOGICAL CONTROL AGENTS AGAINST FIRE BLIGHT) - sequence listing, part 6

SEQ ID NO: 33 - DNA, 157957 bp, Pseudomonas poae FL10F
tctgtactgctgtaacagtcagaatcgggctttgtccctcctcctcccttcaagtcctagcatacaagcgggcttgcccgcgatgacggtgtgtcagcaatacaccaggcggctgttactgtgctatcgcgggcaagcccgctcccacattttaaataggatctgcacgcccgatgcagcgagtttgcacaaaccccaggcaaaaaaaagacctcccgaaggaggtctttttcgttacgccgcgttaagcggcgctaccggatcagcagctgtagtacagctcgtattccagtgggtgtacgaaggtgcgtactttgatttcttcttcgcttttcagctcgatgtaggcatcgatgaagtcgtcgctgaatacgccgcctttggtcaggaacgcacggcccttgtccagctcttccagggcttctttcaggctgccgcacacttgtgggatctctttggcctcttcaggcggcaggtcgtacaagtttttgtcggcggcgtcgccagggtggatcttgttctggataccgtccaggccggccattaccagggcagcgaaggccaggtacgggttggctgctggatccgggaagcgcgcttcgatacggcgagcacgagggctggacacgtaaggaatacggatagaagcggaacggttacgagccgagtaggccagcattaccggagcttcgaagcctgggaccagacgcttgtaggagttggtcgacgggttggtgaagccgttcagggccttaccgtgcttgatgataccgccgatgaagtacagggcggtgtcggacaggccggcataaccttcgccagcaaaggtgttcttgccttctttggcgatggacaggtgaacgtgcatacccgaaccgttatcgccgtacagtggcttaggcatgaaggtagcggtacggccgtaggcatcagccacgttgtgtacgcagtatttcagggtctgaacttcgtcagccttggcaaccagggtgttgaacttcacaccgatttcgttctggccggcagtcgccacttcgtggtggtgaacttcgatgaccaggcccatttcttccatggcgttgcacatggaggtacggatttcgtggtcgtggtcgaacggaggaaccgggaagtagccgcctttgataccaggacggtggcctttgttgccgccttccacgtcctggtcggacatccacgaaccttgttcggagaagattttgaacatggagccggagatgtcggacttgaacttgaccgaatcaaagatgaagaattctggctccgggcctacgaatacggtgtcgccgataccggtcgacttcaggtattcctcggcacgcttggcgatcgcacgtgggtcgcggtcgtagccttgcatggtcgaaggctcgatcacgtcgcagacgatgatcagggttgggtcttcggtgaacgggtcgagaacggcagtgctgtcgtccggcatcaggatcatgtcggaggcttcgatgcctttccagccagcaatggaggaaccgtcgaacattttgccttcttcgaagaaagcatcatccagcgcgtcgcgagccggcatggtcacgtggtgctgagtacctttagtgtccgtgaagcgcagatcaatccatttaacgtcatgatctttgatgagttgaaccgacttcgacatggtgtcctccgggtggcttcgggctggggtagtggagttagcccttagaatgtgggtgatgccggcgcgaatactcgaccaaggcaacctgcctcacaagagagcaaattgcatgccagtgcgccaacatggcctttttgcttcaaaatggcccctataacggtgcaatccgctgaagcggaataaataacgcactgcaatgtagcgttaatttaagtaaatgacccgttttggtgcgcgcagagcgcaatgcatattaactggttaaaccttgagcgatttccgctataatccgcgcccccctttttcagcaggcccggcgcgcgctgtttccatgaaattaatcgttaaagtcttccccgagatcaccatcaaaagccgaccggtacggacgcgtttcatccgtcagttggccaagaacatccgtgccgtgctccgagacctggacccggctgtggtggtgaacggcgtgtgggacaatctcgagctggaaacccgtattaccgacgccaaagccttgaaggacatgaccgagcgcctgagctgcatgccgggcatcgcgcatttcctgcaggtggatgagtacccgctgggcgacttcgacgacatcaccgaaaagtgcaaacagcactacggcagcgagcttgaaggcaagattttttcggtgcgctgcaagcgtgccggcaagcacaccttcagctccatggacgtcgaaaaatacgtcggcagcaagctgcgtcgcgagtgcggcgccgccggaatttccctgaaagcgccgcaaattgaagtgcgcatggaaattcgcgaccaacggttgtttgtgattcacagccagcacaacagcatcggcggctacccgctgggcgccctggaacagaccctggttctcatgtccggcggtttcgattccaccgtggcggcctaccagatcatgcgccgcggcctgatgagccacttctgcttctttaacctgggcgggcgtgcacacgaattgggcgtgatggaagtcgcgcactttatctggaagaagtacggcagctcccaacgcgtgctattcgtaagcgtgccgttcgaggaagtgctcggcgaaattctcggtaaagtcgataacagtcatatgggcgtagtattgaagcgtatgatgttgcgcgctgcgtcccgaatcgccgatcagctgcagattgacgcactggtgaccggtgaagcgatctcccaggtgtccagccagacgctgccgaacctgtcgctgatcgactgcgtgaccgaaaagctggtgctgcgcccgctgatcgccagtcacaagcaggacatcatcgacctggccgaagaaatcggcacggcggatttcgccaagcacatgcctgaatattgcggggtcatttcggtgaaccccaagacccacgccaaacgcaaccgcgtggagtacgaagaacaacagttcgacatggcgattctggagcgtgcgctcgagaacgccaaaatggtgccgatcgatcgcgtaatcgacgaattgggccaagacgtgcaaatcgaagaagtcagcgaagccctggccggccagatcgtcgtcgacatccgtcacccggatgccgctgaagatgagccactggaaatcgctggcatcgacgtgcaaacgctgccgttctatgcattgaacgcgcgtttcaaggaactggataacagccgtcagtacctgctgtattgcgacaaaggcgtgatgagtcgcctgcatgcccaccatttgctcagtgaggggcatgccaatgtgcgcgtttatcgaccgagctaagagcccggggctgtttgcctgtggcctgcgtcaccggccccccgactctgccgtcaagctgtaacggcaaggcctgactctactgttaatcgctgccacgacctgtcagcacaccgaatcctctgatcgagatacacaagtgatcgaaaatctacgtaacatcgccatcattgctcacgttgaccatggtaaaaccaccctggtagacaaactcttgcgtcaatccggcaccctggagcgcaacgagctcaacgacgagcgcgtgatggactccaacgaccaggaaaaagagcgcggtattaccatcctggctaaaaacaccgccatcaactggaacggctaccacatcaacatcgtggataccccgggccacgccgacttcggcggcgaagttgaacgcgtaatgtcgatggttgactccgttctgctgctggttgatgcccaggacggccctatgccgcaaacccgtttcgtgaccaagaaggctttcgaagccggcctgcgtccgatcgtgtgcatcaacaaggttgaccgtccaggcgcacgtccggactgggttctggaccagatcttcgacctgttcgacaacctgggtgctaccgaagaacagctggacttcaaagtcgtctacgcctcggccctgaacggcattgccggtctggaacacaccgacatggctgaagacatgaccccgctgtaccagtcgatcgtcgacaacgtaccagcgccaaaagttgaccgtgaaggcccgttccagatgcaaatctcggcactggactacaacagcttcctgggtgttatcggtgttggccgtatcgctcgtggtagcgtcaagccgaacaccccagttgtcgccatcggcgccgacggcaagaaacgcaacggccgtatcctgaagctgatgggtcaccacggtctgcaccgcatcgacgttgaagaagcgtttgccggtgacatcgtttgcgtaagcggcatggactcgctgttcatctccgacaccctgtgccagccggacaacgttgaggcgatgaagcctctgaccgttgacgagccaaccgtttccatgaccttccaggtaaacgactcgcctttctgcggtaaagaaggcaagttcgtgacgtcccgtaacatcaaggaacgtctggacaaagagctgctgtacaacgttgctctgcgcgttgaagaaggcgactcggctgacaagttcaaggtttccggccgtggtgagctgcacctctcggtactgatcgaaaccatgcgtcgcgaaggcttcgaaatgggcgttggtcgtcctgaagtgatcatccgtcaggttgacggcgtgaagcaggaaccgtttgaaaacgtcaccatcgacacccctgaagaatcccagggcaaggtcatggaagagatgggcctgcgtaagggcgacctgaccaacatggtgccggatggcaaaggccgtgtacgtctggaatacaacatccctgctcgtggtctgatcggtttccgtaaccagttcctgaccctgaccaacggtgctggcatcctgacctcgatcttcgatcgctacgacaccatgaagtccggcgacatgtccggccgtcagaacggtgttctggtatcggtagaaaccggcaaggcgctgacctactccctggaaactctgcaggcgcgtggcaagctgttcgttgaacacggtcaagagatctacaacggtcagatcgttggtctgaacagccgtgacaacgacatgggcgtcaacccaaccaaaggcaagaagctcgacaacatgcgtgcttcgggtaaagacgaaaccatcgctctggttccacctgttcgcttcaccctggaacaggccctggaattcatccaggacgacgagctgtgcgaagttacgcctaagtcgatccgcctgcgtaagaagatcctggacgaaggcgagcgtacccgcgctgccaagaaagccaagaactgagttaactcaggctgaatgaaaaacgcccccggtcgaaaggccgggggcgtttttttatgcctgatcgttcccacgctccgcgtgggatatgcagcccaggacgctccgcgtccgcacttagaggcgggacgcggagcgtcccaagaggcattcccacgcagagcgtgggaacgatcatcagaacttgtcgagggtcttgaacttggtctcgcgcaccacttccttcggcttatacgcgcaataccccgggcgcggcccgattttcgggtggttgcggcacgtatccgggcgcttgtcataaatagtgcagaagcgcgtcttacgatccaggtacaagcaatcgttgttgctcatgcgctgcagggtaaaaatctcggatttggaattgaagcgctcgacgatgccttccttctgcaaacgcttggcgatgttcttcggcgggtcgccgcgttcgaattcatcgacgatgccaatgcggatcaggtccttgatcttcacctcaaccggcagcgtgcagcagctggacacgcagccaccgcacatgtgggcggaatatttctgccaagtctcgagacggtcgagttccgcagcggcgatcagttgaggcttcatcagggttccaaggtggggctatatccgggcgcgcgataataccgggattgatgattttttgaacaatattttgcggctttcagcccgaaggctgcgcaaaggccaatcgggcacgacccctgcattaaattccggcaaaggtgaatgagttaaaaaactgccgaaccagaccgtctaccgtctgtcagaccgactaggctctagcaactccttcaatctcgcccgaggtcgcaccgatgtctcaggaaccgcttgcacgagaagcagaggtagccgcattccgcgatgctgtcttgaccaaacttacctacgcggtgggcaaagaccccgaccacgccttcgaccatgactggttcgaagccattgccctggccgcgcgcgaccagatggtcgatcactggatggaccacacgcggcgtatctaccgcaaaggccagaagcgggtttattacctctccctcgaattcctgatcggtcgcttgctctacgacagcctgagcaacctgggcgtgctggagattgcgcgcgaagcgttgtccgagctcggcgtggacctggaacgcatccgcctgctggagcccgacgcggcgcttggcaacggtggcctgggccgcctggccgcgtgctttatggaaagcatgtcgaccttgggcattgccggccacggttatggcattcgttacgagcacggcttgttccgccaggcgattgtcgatggctggcagcaggagcagaccgaacgctggctggactttggcaacccgtgggaattcgagcgcgccgaagtgatttacccgatcggctttggcggcagcgtcgaaaccctggcggacgcctccggcaaaatgatccaagtgtggtcgccgaatgaaactgtgcgcgcggtggcttacgacaccccagtcgtcggctggcgtggcgccagcgtcaataccctgcgcctgtggcgtgcacgcgccgtcgaagacctgcacctggaacgcttcaacgccggtgaccacttgggcgccgtcgccgaagtggcccgcgctgaaagcatctcccgcgtgctttacccggccgacagcaccgaagcagggcaggaactgcgcctgcgtcaggaatacttctttgtctccgcctcgctgcaggacttgctgcgccgccacaaaaacatgcacggctcggtattgagcttgggcgaacacgccgccatccaactcaacgacactcacccgtcgattgccgtggccgagctgatgcgccaactggtcgacctgcatgacattccgtgggaagcggcgtgggacgtgacggttgaaaccctttcctacaccaaccacaccttgttgcccgaggcgttggagacttggcctgtaggcctgatggaacgcatgctgccacggcacatgcagatcatctacctgatcaacgcccagcacatcgactcgctgcgcgccaagggcattcacgacttcgacgtgctgcgcgccgtgtcgctgatcgaagaagacaacggtcgccgcgtgcgcatgggcaacctggcgttcctcggctcccatagcgtcaacggcgtgtccggtttgcacacccagttaatgcgcagcacggtgttctccgaactgcacaagctctacccggagcgcatcaacaacaaaaccaacggcatcaccttccgccgctggctgtaccaggccaacccgaagctcaccgagatgctggtggaagcgctgggcccggacattctcgacaccatggaaacccgcctcacggagctcgaaaccttcgccgagaagcagtctttccgcaaagccttcgccgatcagcgcctgcacagtaaacgtgcattggccgagatcatccacgagcgcctgggcatttcggtcaacccggcggcgatgttcgatgtgcaggtcaagcgcatccacgaatacaaacgccagttgctcaacctgctgcacaccgtggcgctgtaccaggcgatccgcgccgagccgggcaccgactgggtgccacgagtgaaaatcttcgccggcaaggcggccgcgagttatcaccaggccaagttgatcatcaagttgaccaacgacattgcccgcaccgtcaacaacgacccgactgtgcgcggtttgctcaaggtggtgttcctgcccaactacaacgtcagcctggcggaaagcatcattccggcggcggacttgtcggagcagatctccacggccggctttgaggcttcgggcaccagtaacatgaagttcggcctcaacggcgcgctgaccatcggcaccatggacggcgccaacgtggaaatgcacgagcgcgtgggcgccgatcacatgttcatctttggtctgagcgcgcagcaggtggaagcgcgcaagcacgccggtgaatttaatgccgggccggaaattgccgcctcccatcgcctcaacgatgtactgcaagcgattcgcggcggggtgttctcgccggatgatccgggccgttatgtgggcttgatcgacgggctgatcgactacgatcgtttcctggtgtgtgccgacttcgactcctactgggacgcccaggcgcgggtcgaggcgcattggcatgactccaaggcgtggtggcgttcagcggtgctgaacacggcgcggatgggctggttcagctcggaccgcacgatccgcgaatacgccaccgagatctggaaagccctcgactaaccactgctgatccaaatgtgggagcgggcttgcccgcgatagcgcagtgtcagtttgcaaatatgtcgactgatacaccgctatcgcgggcaagcccgctcccacaatggttcggtgtcgatatactgagcaacgcttacgcccgcctcgggctgcttagggatatcgaccatgcaatggattttcatgctgattggcctggtgctcggctggacgctcgatgagtcgttcaccgacgccggcttcggtgcgctgctggggttgggcattggccaggcgattcgcctgtcgatgctgtcgactcaagcgaaccagcaagcgcgtcagttggaaaccacacagaaggcgctgatcgcgctgggcgaacgcctgcggcagctggaagtgcctgcgccgacaagcagtgtcattgtcgaaccccccattcctgaacccgcccccgtcgttgcaaagcccgaacttgtctgggaactgcccgccgaactggcgcctgtcgccgtggttgccgaagccagtcagccgctgccggacgacgtctgggtggctgcgccgacaccacaacctgaagagcctgcgactcctcgcggccccaccctgatcgagcgcgccttcagcggcgcgcgcaattggctgttcggcggtaacaccgtgctgcgcgtcggcgtggtgctgttgttcctcggcctggccttcctgctgcgctatgccaccgaaggcgtggtggtgccgatcgagctgcgttacgccggggttgccgctgctgccatcggcctgttgggcctgggctggtggttgcggctgcgtaacagcaattacggcctgatgctgcaaggcaccggcattgcggtgttgtacctgacggtgtttgccgcgatgcgtttgcacccgttgatcgacccgagcgccgcccttggcctgttggtggcagtcacggtgttttcggcgatcctggcgatcacccaggacgccctcggcctcgcctgtgcggcggcgttgggtgggtttgccgcgccgatcctcacctctaccggcgccggcaatcacgtggcgttgttcagttacttcgcattgcttaacgccggcattctcgccatcgcctggttcaaggcctggcgcttgctcaacttgatcgggtttgtcggcactttcggcattggtttcgcctggggcatgcgctcctacacaccggaactgctgtggagcaccgagccgttcctgatcctgtttttcctgatgtacctggccatcggcctgttgtttgctcgacggaagttgcaagagatgggcgatgcgcccgaaggccgtgaagcattgctacgttggtcggccgccaagggggattacgtcgacggcagcatgttgttcggcccgccgctggtgggctttggcttgcagttcgccgtggtgcagcacctggaatttgccgctgccttcagtgcgctcggcttagggcttatctacatgggcctggcccgagtgctcagcggcgggcgcgccttgctgctggcggaaacctgcctggcgctgggcgtgatctttgccagcctggcgattcccctgggtctcgacgcacgctggacggctgccgcgtgggcggtggagggcgccgggatcttctggctcggcttgcgtcagcagcgatctttggcgcgcgcgtttggcttgttgttgcagttgggctcggcgctggcgtttctcagcgagctgcgcatcggcgaacacagcctgctcgacggtgcgccattgggcgcgctgttgctgggcgcggcgttgctgttcagcttcgatcagttgcgcagggccacggcagaacagtcggcgccctgggagcgcaaaggcatgccggtgctggccagcctgggcctgacctttttgtacctgctcgcaccgctgctgctacagacacaaggcaccgccatcagttgggcaatcgtcggtctggctaccctgtttgtcggcctgcgcataggctcgcgcaccttcctgttcaccgcctttgccgtgcagttgctgggcggtgcgctgttcctgctgcgcttgcagggcggtgatggggcggcagtcttcagtgccgggtggaccggcttgttgaccgcttcgctgattggcctggcgctggtcggcggcatgctcatggcggcacgtgacgacatggtgcgtagcgacgtacgtctactgcgcgcgctgtcggtggtgctgctcgcaggtttggtattgatcaatcttgcggtgctgttcgtgttgccatgggagagcgccagcggggtgtgggcggccagcggtttgttaatcatctggttgagcctgtacctgcaacagcgcgtcagctttgtgtttgggttgctgctgcaattggtcggtggcgcctcgttcctgctcgcgatgccggagttgctcgggccgttgacccgcgagggcttgcgcccgttggcgcacagcggtttctggacgccgatggtgctgggcttggccgcattggtcggcgcctggcgcttgcagcgtgaaccgcatgcgccggtgttcagcgtgttgaaactgcaacgcctgtccgatctgctgctggtgtggggcgcggcgtggtgggcgctggcgttgatcggcgaagtgctgcggtttacttcgcaagagctgcaggggccattgttgctcggcatcgcggcagtgagcgtggcgatctgggcgctgctggccgagcggttgcgctgggcatcgctgggcatgttgtgcaccttgctgatgccggcggcgggcgtggtattgctggcgtctgccaatgattactaccacccggcggcacacttcggctggctggcgtggttggcggtgtttgtggtgcatttcatctcgctgcgccgtctggctgcggtggtgccgagcaaggtgttgagcatcgctcatgtgctgggttgctggatgttgatcggcgtactggcgctggagctgcgttacggcctgttattgctgtccagcgagtacaacgcctggcgctggctgggttgggcgattctgccaagcctgtacctggtattggcggcggcaccgcgcagttggccgtggccggtgtcggcgtatccgcgtgaataccgtgtactcgccgcactgccgctggcggtgctgatgctcggctggttctggttggcgaatatcttcagtgacggcacggcgaagccactgccctatgtgccgctgctcaacccgctggaactgggcttgttgttcgcgctgctgggaatttacctgtggtcgcgcagcgttgcgccacagcgcgggccgcgtgctgaactgattgcccaaggtgtcgcgggtgtttcgctgtttgccttctttacagccttggtgatgcgcaccgcccaccattgggcaggcgtgccgttccaactggatgccttgctggcgtcgatgttggtgcaggccggtctgtcgattgtctggaccctgatcgccctcgggctgatgatcggcggccacctgcgccatcgtcgtgaagtgtggttgatcggcgctgcgttgattgcggtggtggtcgccaagctgttctttgtcgagttgagtaaccgtggcgggctggcgcggatcgtgtcgtttatcggcgtgggcgggctgttgctggtggtgggttactttgcgccgctgcctcccaagcgcgccgaaccggtgttggaaactgaaggagcaacctcttgatcggtaagttgagcgtgatcgcgctgggtttgtgcacgaccttgtcggtgtgggcgcaggaaacgcctgccgacttcaccacccaagtgccgttgacggtgagtggcagcggcccctggtatcgcctggagctgccgctgtctgtgcaattgagcgcgcgccaggccgatctcagcgatgtgcgcgtgttcaacgccgccggtgagccccaggcctatgcgttgtcgcgccaatccgcacaacgcaccgaaagccgcactgtggctgacgtgaagtggtttccgctgtacgccgccgatacgcgtgaaagtgtgccggacgtggtaatgaaatccaccgccgagggcaccctgctggaagtgcgcccgtccaaggccggcaagcaagtgctgcgtggctgggtgctggacgccagcgcgatcaaggcgccgctgcagcaactgagcctggactggagccgagagcaggacggctttcagcgtttcagcatcgaggccagtgatgacttgcagcactggcaatcctggggcgatggccaggtggcgcgcctgtcgtttgccgacgagcgtgtcgagcagcatgacgtgagtttgccggggcaatcggcgcgttacctgcgcctgctgtggcaaggccaggtcgcgccgacgttgacctcggccaagctggtcagtgcgaccagcagcagcttgccgacgccgttggtgtggtcgcagccgttgtcgggtacgcggctcaaggccggggaatacagctggcagttgccgacgggcctggccgtcgagcgtttgcgcatcgagctgaagcagcccaacacgctggcgccggtcaccctggcggggcgccgtgaagccaatcaagcctggcagccgctgagcaatggcgtgttgtaccgcctgactcagaacggccaggacgtggtgcaggacgaattgcacctgccgggtgtggccgttggcgaactcaaactgcaagtggatgagcgcggtggcggcctcggcgtggaagcgccggccctgcgctttgccgtgcgcaccacgcagttggtgtttctggcgcggggcgagccgccgtttaccctggcgctgggcaacggctcggtcaaggcggcgaacctgccgttggcgactttgatccccgactacagcgccgagcgcctcaagacgctgggccaggccagggtcacgggtgacgcggtggttaaaagcgctagcgttgccgcaccgcccgaagccggcaccgactggaagaaactcggcctgtgggccgtgctcctgttgggtgtggcggcgctgggggcgatggcctacagtttgttgcgccaacccgccgccaaaccgtgaactctattggcgttaaatcctctgattagaggaaataaccctcgactcgcgttaaactgcgcgggtttataagccccccattctccggagccttacatgtcccgcgttaccctgagtcgctatttgatcgagcagacccgcagcaacaacacgcctgccgatctgcgcttccttatcgaagtggtggcgcgtgcttgcaaggaaatcagccacgccgtatccaaaggcgcactgggtggtgtcctgggcagcatgggcactgaaaacgtccaaggcgaagtgcagaagaagctcgacgtactctccaacgagatcctgctcgaagccaacgaatggggcggtcacctggccggcatggcgtccgaagaaatggacaatgcctaccagatcccgggcaaatacccgaaaggcgcctacctgctggtgttcgacccactggacggctcgtccaacatcgacatcaacgcaccggtcggcaccatcttctcggtactgcgctgcccgaacgaatacctgagccagaacgaagccttgaacgaaaaggccttcctgcagccaggcaccgagcaggtggctgccggttacgcgatctacggcccgcagaccatgctggtgctgaccttgggcgacggcgtcaaaggcttcaccctggaccgcgaaatgggcagcttcgtgctgactcacgaagacatttcgattccggcttccacccaggaattcgcgatcaacatgtccaaccagcgccactgggaagaaccggttaagcgctacgtcaacgaactgatggaaggcgaagaaggcccgttgaagaagaacttcaacatgcgctgggtcgctgcgatggttgccgatgtgcaccgtatcctgacccgtggtggcttgttcatgtacccacgtgacagccgcgagccgtcgaagccgggcaaactgcgcttgatgtatgaagccaacccgatgtcgttcctggttgagcaagcaggcggcgcgtccaccgacggccaccagcgcatcctcgacatccagcctgaaggcctgcaccagcgcgtggcggtgttcctgggttcgaaggaagaagttgaacgcgtgaccggttaccacaagaagtaagattcggcgatcagttatccgccatgttgtgaggccgttcacccttaaagaagccccgaaacgtttcagcgttttcggggcttttttgtttttgctcgtcgggaaccagacacctcttttcccttctaagcttctggcagatacccaagctgcttcgtccctccaggagtttttccatgtcgttacgccgtctctctttgctggctttttgcgtgctattggccgcttgcagcaaggtcaaccaagaaaattacgcgaagttgtcggctggcatggccaaggctgaagtagagtcgttgctgggtaagccgaccgattgttccggcgcactgggtatgtccagttgcacctggggcgataaaaacagctttatcagcgttcaatatgccggtgacaaagttctgatgttttccgggcaaggcctgaagtaaaccggggcgcgagcctgcgggagaagaagaatgatgcgttttgttttgtgcctttgtgccagcctgtttttggcgggctgcgccagccattctggcgatgatctgcaacccaagacagcgagcaacgtcaacctcaagcgttaccagggcacctggtatgagttggcccgattgccgatgtacttccagcgcaactgcgcgcagtccgaagcccgctacaccttgctgcctgatggcgacatgtcggtgttcaaccgctgcctgacacctgagtggaagtgggaagaagccaagggcacggccacgccgcaagtgcccggcaagaccgacaagctctgggtggaattcaataactggttcacagcgctgctgccgggcgtcgccaagggcgattactgggtgctgtacgtgagcgatgactacaagaccgccatcgtcggcagcccgagccgccgctacatgtggatcttgtcgcgcacgccgacggtgaatgccgacacccgcgaagacctgctgagcagggcgcggcagcaagggtatgacaccacgcggctgatctggcgtacgtctgacaagcagatggcgaagacttcccagtaaccagaagtcaccctcaatctaatgtgggagctggcttgtgtgggagctggcttgcctgcgatgcagacacctcggtgtatcagttacaccaaggtgatgctatcgcaggcaagccagctcccacatttgttttatatcggcggttagcccaacagatctctcaagacttgcgtaaatgcccggctgctttcttcctcaccggcatggcgcccatcgcgcaccacccacttgccgttcaccagcacatcgcgcacttgccgatcaccaccggcgaacagccagcgattaagaatgccgtcctcggtcgccgtcgccaggtacggatcattaccgtccagcacgatccaatccgcgcgtttacccacttccaatcgaccgatcggctggcccaacgcctgggcgccgccgtccaacgccgcatcaaacaacgtacgcccgaccatcggctgatcactgcgatacaggcggttgcgccgctgatcacgcaggcgctggccgtattccagccagcgtaattcttccaccacgctgagcgacacattgctgtcggagccaatgcccatgcgcccgccctgggcgaggaaatccaccgccgggaaaatcccgtcgcccaggttggcttcggtggtcaggcacagcccggcaatcgcgcggctcttggccatgcgcgccacttcatcagcatccgcgtgagtggcgtgcaccaggcaccagcgctcatcgacgtcgacattgtcatacagccactgcagcggacgtttgccactccaggccaggcagtcgtcgacttctttttgctgctcggcgatgtggatatgcaccgggcaggccttgtcactggcggccaatacctcattgatttgttgcggcgtgacagcgcgtaacgagtggaagcacaggcccagctgctgcgccggttgcgcggcgaggatcggcttcaaacgcgcttgcaggtccaggtaattttcggtgctattgataaaccgtcgctggccttcattcggcgcctggccgccaaacccggagtgcgtatagagcaccggcaccagcgtcaggccaatcccgctgcttgcggccgcctggctgatctgccgcgacagctctgtgcggtcggcatacggttggccgctgacgtcatggtgcacgtagtgaaattcagccaccgaggtgtaaccggctttgagcatctcgatatacagctgacgggcgatgacctgcagttggtccgggttgatcttgccgaccatgcggtacatcaaatcgcgccaggtccagaagctgtcattcgggttgcccgccacttcggccagacccgccatggcacgctggaacgcatgggaatgcaggttcggcatgcccgccagcaccgggcccctgagccgttcggcgccgtctgcactggcgttgggctcaacgtgggtcagtacgccatcggcgttgacttcaaagcgtacatcgttggcccatccattaggcagcagcgcgcgttcggcaaagaaagcggacatgatcaaggcaccccggtcgtgtgtttatttgtatatacatatacagacgtttgcctgctcggtaaactccggcaatctatgcatcttttccccctgcaaggattccctgtgccgactccgcctgccaagtcttcgctggctgcccacatggacgaaagtccggcgcccttgtatgcccgcgtcaaacaaatgatcagccagcagatcctcaacggcaactggccgccgcattaccgcgtgccgtccgagagcgagctggtcagccagctgggcttcagccgcatgaccatcaaccgcgccctgcgcgaactcactgccgaaggtttgctggtgcgcatgcaaggcgttggcacgttcgtcgccgagcccaagagccagtcggcgctgtttgaagtgcataacattgccgatgagatcgcctctcgtggtcatcggcatacctgccaggtcatccacttgtgcgaagaggccgcaggctccgagcgcgccgtcgccctggaaatgcgcgaaggcgggcgggtgttccactcgctgatcgtgcacttcgaaaacgacatcccggtgcaaatcgaagaccgcttcgtcaacgccctggtggcgccggactacttgcagcaggatttcacccagcaaacgccttacgcctacttgaaccaggttgcgccgctgaccgaaggcgagcacgtggtcgaagcgattctcgccgacgcgcaagagtgcaagctgttgcagatcgagccaagcgagccgtgcctgttgattcgccgccgcacctggtcgggtcgccagccggtgaccgccgcgcgtttgatccaccccggttcccgtcatagcctggaaggacgtttcagtaaatgagtagcgtgaaagtctggcgcgccgccgattacatccgtatgccgtggaaaaacggcggcggcagcaccgaagaaatcacccgtgacgcaggcaccggcctggatggcttcggctggcgcctgtcgattgccgatatcgccgagtcgggtgggttttccaccttcgccggttaccagcgcgtgatcaccgtgatcaaaggcgcgggcatggtgttgaccgtcgacggcgaggagcagcgtggtttgttgccgctgcagccgtttgcgttcagcggtgaaagtgaggttttgtgccgcttgatcaccgggccgattcgcgatttcaacctgatttattcgcccgcccgttaccacgcacgttttcagtggattgacggcgtgcagcatttcttctcgacggcgcagacggtgttggtgttcagcgtggcggatgaagtgaaggtgctggaccagaagttgggccatcacgactgcctgcaagtggacggtaacactggcctgctggatatctcggtcagcggccgcagctgcattatcgaactgaccgcgcgcggttaaaaaattgtgggagctggcttgcctgcgatggcggtgtatcagcacaggatgtgctgactgacacaccgccatcgcaggcaagccagctcccacattggttttgtggtgttcacacgggctgttcccagcgcgcaccaatttgttaccgaatgccccagcgtggcgcaatgccgtgttgttgtgaacaatctccctccctgcaaaacacccccgtaagaaatttcaccaagcctccaagcctcaattttcaaggcttacacacgcctttcaaaagattctcaacagcacacccgcaaagttggccgctcgattgcatatgcttgtatgtacaagtaaagatgtgtgcgtaagactctccttcgcaccatcaatgttcgcgcatcacgccgaggagtcctgttgtgaccgatttttctaaagccaagcctacaaaataccgtgacgtcgaaatccgtgccgctcgcggtaacacgctcaccgccaaaagctggctgactgaagcgccgctgcgcatgctgatgaacaacctcgacccgcaagtggccgagaacccgaaagaattggtggtgtacggcggtatcggccgtgcagcgcgtaactgggagtgctacgaccagatcgtcgagagcctcaccaacctgaatgacgacgagaccctgctggtgcaatccggcaagccggtcggcgtgttcaagacccacagcaatgccccgcgcgtgctgatcgccaactccaacctggtgccgcactgggccagctgggaacacttcaacgaactggatgccaagggcctggccatgtacggccagatgaccgccggcagctggatctacatcggcagccagggcattgtccaaggcacctacgaaaccttcgtcgaagccggtcgccagcattacaacagcgacctcaccggccgttgggtactcaccgccggcctgggcggcatgggcggtgcgcagccgttggccgcaaccctggccggcgcctgctcgctgaacatcgaatgccagcaggtcagcatcgacttccgcttgagcagccgctacgtcgacgagcaagccaccgacctcgacgacgccctggcgcgcatcgccaagtacaccaaggaaggcaaggccatctccatcgccttgctgggtaacgcggcggaaatcctgccggaactggtcaagcgtggcgtgcgcccggacatggtcaccgaccagaccagcgcccacgacccactcaacggctacctgccggccggctggacctgggacgaataccgcgcgcgcgccaagaccgagccggctgccgtgatcaaggccgccaaacagtcgatggccgtgcacgtcaaagccatgctcgagttccagaagcaaggcatcccgaccttcgactacggcaacaacattcgccagatggcccaggaagaaggcgtggaagacgccttcgccttcccggggttcgtaccggcctacatccgcccactgttctgccgtggcatcggtccgttccgttgggctgcgctttcgggcgacccgcaagacatctacaaaaccgacgccaaggtcaaagagctgatccccgacgacgcccacctgcacaactggctggacatggcgcgcgagcgcatcagcttccagggcctgccggcacgtatctgctgggttggcctgggccagcgcgccaagctcggtctggcgttcaacgaaatggtacgcagcggcgagctgtccgcgccggtagtaatcggccgtgaccacctcgactccggctcggtcgcaagcccgaaccgcgaaaccgaagccatgcaggacggttccgacgccgtgtccgactggccactgctcaacgccctgctcaacaccgccagcggcgcgacctgggtgtcgctgcaccacggcggcggcgtaggcatgggcttctcgcagcactccggcatggtgatcgtctgcgacggcaccgacgaagcggctgagcgcatcgcccgcgtactgcacaacgacccggccacgggcgtgatgcgtcatgccgatgcgggttaccagatcgccatcgactgcgccaaggaacagggcctcaacctcccgatgatcaagtaactcaatgttggagcgggcttgtgtgagagctggcttgcctgcgatggcatcacctcggttctactcacagaccgagttgcccgcatcgcaggcaagccagctcccacaatgaccctgctgtgcgcactagacatgattcacctgcactaccgaaaaacaatccatcagaggttgaacacacatggctgcaaatgacgtacgtgcaagcaccaccccgttgatcgaaaggcgttcgatcgactacatcccggaagcggaaagacacggtcgtctattgagccagttcaccctgtggatgggtgccaacctgcaaatcaccgcgattgtcaccggggccttggccgtggtgctcggcggtgatgtgttctggtcgttgatcggtctgttgatcggccaactcatcggcggcggcgtcatggccttgcatgcggcgcaagggccaaagcttggcctgccacagatgatctccagccgggtgcagttcggcgtttacggtgcagccatcccgattgtgctggtctgtttgatgtacctcggtttcaccgcaaccgggaccgtgctgtcggggcaggcgctgggccagttgttcggggtcagcgacagcgtcggtatcctgatttttgccagtgtcatcgtattggtcaccgtactgggttaccgggtgatccactttattgggcgtgtcgccagcgtcattggcgtgattgccttcgtctatctgttcagtcgtttgatgagccagaccgacgttggtgcgcttttgcagatccgccacttcagctggagcagtttcctgctggcggtgtcgctcgcggcctcttggcagatcgccttcggcccttacgtagcggactattcacgttacttgccaagcaagacatcttcgctgaaaacctttctcgccgccggcgccggttcggtcattggcgctcaggtggcgatggtccttggcgtgtttgccgcggccatgtccaacgggcaatttgccggtcacgaagtcgcctacattgttgggttgagcggtacgggcgccaccgctgcgctgctgtacttcagcatcgcgttcggcaaggtcaccatctctaccctgaactcctacggcagcttcatgtgcattgcgaccatcatcagcggcttccgcggccgccttgaggtcacccgcctgcagcgtctggtgttcgtgctggtgattgtcggcactgcaaccctgatcgcgttgctcggccagcactcgttcctcggtgcgttcaagtctttcatcctgtttctgctggcgttctttacgccgtggagtgcaatcaacctggtggactactactgcatcacccgcgagcgctatgacgttccggctttggccgacccgaatggccgttacggtcgctggaacctgctgggtatcagcgtctatgtgttcggtgtgctggtgcagctgccgttcatctccaccaagttctacaccggccccttggttgctgcgctgggtgatgtggatatctcctggatcatcggcttggtactgccagcggccttgtattacgtatgtgcgaaaaaatggcacggcacggtgcccgatcaactgatcctgccaatagagcagggcgctgcaccaacgacaaacgggctggctgcacaagcctgatgggacgtggacagggcaggacgcctactgactgccgtaatccatttcaagattgggagcgtcacaacaatgaagatgaataagaccctgctggccactgtgttctctgcaagcgtgttggcgagtgccggcgcccaggcggccggttggtgcgaatccggcaagccggtgaaattcgccggcctgaactgggaaagcggcatgttgctcaccgacatcctgcaaaccgttttggaaaaaggctacgactgcaaaaccgacagcttgccgggcaactccatcaccatggaaaacgccctgagcagcaacgacatccaagtgtttgccgaagagtgggttggccgcagcgaagtctggaacaaggccgagaaggccggcaaagtcgtcggcgtcggcgccccggtggtcggcgcggtagaaggttggtacgtgccgcgttacgtgattgaaggcgacgccaagcgcaagctggaacccaaggcgccaggcctgaaaaacatcgctgacctggccaaatacgcctcggtgttcaaggaccaggaagaaccgtccaaaggccgtttctacaactgcccggccggctggacctgcgagctggacaacagcgagatgctcaaaagctacggcctggaaagcacttacaccaacttccgcccaggcaccggcccggcgctggatgcggcggtgctgtcgagctacaagcgtggcgagccgatcctgttctactactggtcgccaacgccgctgatgggccaggtcgacctggtcaagctggaagaaaaacccggtgtggataaacgcgtgagcatcaaggtcggcctgtccaagaccttccacgagcaagcgccggagctggtggccgtgctggagaaggtcaacctgcccatcgatctgctgaaccagaatctgggtcgcatggctaaagagcgaattgagtcgccaaaactggcgaaaattttcctcaaggaacatcctgaagtctggcacgcatgggtgagcgacgacgcagccaagaaaatcgacgcggccttgtaggtcaagcgtgtccgactaccctgaggggctagtcggacacccggccacaacccactggatcgagagcacgatatgtttcctgagagttttacgttttccatcgccgactgggtcaacggttgggtggactcactggtcaccaactacggtgatgtgttccggcacatctccgacaccctgctgtgggccatcgtcaacctggaagtgttgctgcgcgcggcgccttggtggttgatgctggctatcgtcggtggcatcgcctggcacgccacctgcaaggtggtgaccacggccgtcatcgtcggtttgctgttcctggtgggcgcggttggcctgtgggacaagctgatgcagaccctggcactgatgatggtcgccacggtgatctcagtgctgatcggcattccgctgggcattctgtcggcacgcagcaatcgcctgcgttcggtgctgatgccgctgctcgacatcatgcaaaccatgcccagcttcgtgtacctgattccggtgctgatgctgttcggcctgggcaaggtgccggcgattttcgccacggtgatctacgccgcgccgccgctgattcgtctgactgacttgggcattcgccaagtcgacggcgaagtcatggaagccatcaacgcctttggcgccaaccgctggcagcaactgttcggcgtgcaactgccgctggccctgccgagcatcatggccgggatcaaccagaccaccatgatggcgttgtcgatggtggtgatcgcctcgatgatcggcgcccgtggcttgggtgaagacgtgcttgtcggcatccagaccctcaacgtaggccgcggcctcgaagccgggctggcgattgtgattcttgcagtggtcatcgaccgcattacccaggcctatggtcgtccacggcatgaggcgagcaaatgactactgtcagcaaaattgaagtaaaaaacgtcttcaagatcttcggcaaccgctccaaggaagccctggcgctggtaggccagggcaagaccaaggaccaggtgctggccgagaccggctgcgtggtcggcgtcaacgacctgtcgctgagcatcggcaccggcgagatcttcgtgatcatgggcctgtcgggctccggcaagtccacgctggtacgccacttcaaccgcctgatcgacccgaccagcggcgcgatcctggtggacggcgaagacattctgcaactggatatggaagccctgcgccaattccgtcggcacaagatcagcatggtgttccagagcttcggcctgctgccccacaagagcgtggtggacaacgtcgcctacggcctcaaggtgcgtggcgaaaccaagcaggtctgcgccgaacgcgcgctgcactggatcgaaaccgtgggcctcaagggctacgaaaacaaatacccgcaccagctctccggcggcatgcgccaacgtgtgggcctggcccgcgccctggcggccgacaccgacatcatcctgatggacgaagccttcagcgccctcgacccgctgatccgcgccgagatgcaggaccagttgctggagctgcaaaagaccctgcacaaaaccatcgtgttcattacccacgacctcgacgaggccgtgcgtatcggcaaccgcattgcgattctcaaggacggcaagctgatccaggtcggcaccccgcgcgagattctgcattcgccggcggatgagtatgtggaccgttttgttcagcgccgcgcggcggtggtgtagctgatcgttcccacgctctgcgtgggaatgcatcccgtgacgctccgcgtcactttctgacagcgggacgcggagcgtcccaggcggcgttcccacgcagagcgtgggaacgatcaacttaagaggctagagatgtcccaggcagcaaaaatcatcatcgccgacgcccccctgcgttggcaggacgtggtcgccgtcgcccgtcacggtgcggtgctcgaactctcgggccacgcctgggcgcgcatcgacaatgcccaggccatcgtccagcgcatcgtcaccagcggtgagcgcgcctatggcgtgaacaccggcctgggcgcgctgtgcaatgtgtcgctcaagggcgagcaactcagccagctgtcgcgcaataccctgctgagccacgcctgtggcgtcggcccggtactcagcgacgagcagacccgcgcgatcatctgcgcggcaatcatcaactacagccacggcaaatccggcctgcacccgcaggtggtgcattcgctgctggcgctgctcaatcacggcatcacgccgcaagtgccgtcccagggttcggtgggctacctgacccacatggcccatgtcggcgtggccttgctgggcgtcggcacggtgagctatcgcggccagatcgtgacggcgcaagaagccttacacgcagaaggtttgcagccggtggtactcggcgccaaagacggcctgtgcctggtcaatggcacgccgtgcatgaccggcctgagctgcctggccctggccgacgcgcatcacttgctgcaatgggccgacgtgatcggcgccatgagtttcgaagcccagcgcggccagatcgatgcgttcgacgaagccatcatcgccctcaagccgcacccaggcatgcagcaggttggtatcaacctgcgcgcgctgctcgacggcagtgaagtgatcgccagcagcaaaggcattcgcacccaggacgccttgagcatccgctcgatcccgcaaatccacggcgccgcccgcgaccaggttgaacacgccacgcgccagatcgagaccgaactcaacagcgccaccgacaacccgctggtgctcggcacgccggacacctaccgcgtggtgtcccaggccaacccgcatgggcagtccgtggccttggcggcagacatgctcgccatcgccatggccgaaatcggctcggtggccgagcgtcgcctggatcgcctgatcaacccgcatgtcagcggcttgccggcgtttctggtcagcaaccccggcgtcaactccgggatgatgatcgtgcaatacgtcgccgcctcgctgtgcgggcaaaaccgccagctggcgcaaccggcggtgctcgacaacttcgtcacctcgggcctgcaggaagaccacctgagcatgggcaccaacgccgcgctcaagctgcaccagctgctggccaacgtcacccagattctcgccatcgagtacctgctggcggcccaggccttcgaatttctcaaggaccagcgtttcggcgcaggcactgacagcgcctggcgtttgctgcgcgaaaaagtcccggcctacgagcaggaccgctggctggcgccggatatcgccagcgccgctgcgttgctcaaagacaccgctttgttgcaccacgtattacctaatttgcactaagaataattcacaaggagcatgaatgtgactgcgctaaatctgattccaggccaactgagccttgcccaactgcgggccatctaccagcagccggtaaccctcagtctggatgacagcgccacggcgcagatcgaagccagtgtggcctgcgtggagcagattctcgccgagaatcgcaccgcctacggcatcaacaccggtttcggcctgctggcctcgacccgcatcgccagtgaagacctggaaaacctccagcgttccctggtgttgtcccacgccgccggcgtcggtgagccgatcagcgacgcgctggtgcggctggtcatggtgcttaaggtcaacagcctgagccgtggcttctccgggattcgccgtcaggtgatcgacgcgctgatcgcgttgatcaacgccgaggtgtacccgcacattccgcttaaaggctcggtcggtgcgtccggtgacctggcgcccttggcgcacatgtcgctggtgctgctcggcgaaggcaaggcgcgctacaagggcgaatggctggaggcgaccgaagcgctgaaagtcgcaggcctggcgccgctgacgcttgcggccaaagaaggcctggcgctgctcaacggcacccaggtgtccacggcctatgcactgcgcggcctgttcgaaggcgaagacctgttcgccgcggcactcgcgtgcggtggcctgaccgtggaagccgtgctcggctcgcgctcgccgttcgacgcgcgtattcacgccgcacgtggccaacgtgggcagatcgattcggctgcggcctaccgcgacctgctcggcgaaagcagccaggtgtcgcagtcgcaccagaactgcgacaaggtgcaagacccgtactccctgcgctgccagccacaagtcatgggcgcctgcctgacccagttccgccaggccgccgaagtactggtggtggaagccaacgccgtgtcggataacccgctggtgtttgcagccgaaggcgacgtgatctccggcggtaacttccacgccgagcctgtggccatggccgctgataacatggccctggccatcgctgaaatcggctcgctgagtgagcgccgcatctcgttgatgatggacaagcacatgtcgcaactgccgccgttcctggtcggcaatggcggggtcaactccggcttcatgattgcccaggtgacggccgctgcactcgccagcgagaacaaggccttgtctcatccgcacagcgtcgacagtttgccgacctccgccaaccaggaagaccacgtgtcgatggcaccggctgcaggcaagcgcctgtgggaaatggctgagaacacccgtggcatcctggcggtggaatggttggctgcgtgccagggcctggacctgcgcgacggtttgaaaacctcgccgaagctggaaaaagcccgtggcatcctgcgcgccaaagtcggcttctacgacaaggaccgcttcttcgccccggacatcaatgccgccagcgaactgctcgccagccgttgcctgaatgagctggtgccggccaagctcctgccgagcttgtaaccgcaacgcaagccagtgtgggagctggcttgcctgcgatagctatctttcagttgaaacatctgtgactgacctaccgccatcgcaggcaagccagctcccacacgtgggaacgatcttctcctcataagaataatagggacgagaaatgcaccagcaagaaaagggtttgaaacgcgggctcagcgcccgacatattcgcttcatggcactcggttccgcgattggcaccgggttgttctacggctctgcctcagcgatccagatggccgggcctgccgtgctgctcgcctatctgatcggcggcgccgccgtgttcatggtgatgcgcgcccttggcgaaatggccgtgcacaacccggtgtccggctccttcggccagtacgccagcacctacctggggcccatggccggtttcatcctcggctggacctacgcctttgaaatgatcatcgtctgcctcgccgacgtcaccgccttcggtatctacatgggcttctggtttcccgaagtcgcgcgctgggtatgggtgctcggcatcgtgtttttgatcggcggcctgaacctgtgcaacgtcaaagtgtttggcgagatggagttctggctgtcgctgctcaaggtcggcgccattgtggcgatgatcctcggcggcttcggcatcatgttgttcggcatccattcggccggcgaaacccaggccagcggcctcagcaacctgtgggcccacggcggcttcatgcccaatggcatcggcggcctgatcgcctcgttcgcggtggtgatgtttgccttcggcggcatcgaaatcatcggcatcaccgccggtgaagccaaagacccgcaacgggtgatccccaaggccatcaacgcggtgccgctgcgcatcctgttgttctacgtgctgaccctgttcgtgctgatggcgatctacccgtggccacagatcggcagccaaggcagcccgttcgtgcaaatcttcagcaacctgggcattggctcggcggcgaccatcctcaatatcgtggtgatctcggcggcggtctcggccatcaacagcgacatcttcggcgctggccgcatgatgtacggcctggcccagcaagggcaggcgcccaagggttttgcccagctgtccaggcaaggcgtgccgtggatgaccgtggtggtgatgggcgcagcgctgcttggcggcgtggtgctcaactacctgatcccggaaaacgtgttcctgctgatcgcctcgattgccacttttgccacggtgtgggtgtggctgatgatcctgttcacccaggtggcgatgcgccgctcgatgaccaaagaacaggtggccgagctgaaattcccggtgccgttctggccgtatgcgccagcggcggccatcgtgttcatgctgttcgtgtttggcgtgctgggttacttcccggacacccaggccgctttgctggtcggcgccgtgtggatcgtgctgctggtggtcgcctatctgctgtgggtcaaacctgctgccgggcaagcggccaaggtccattacgacccggctttgtctcatcgttaatttagggaggcgttgatgaaaacgctttggcaacactgccacgtcgcaaccatggcaggcggcaaatactcgatcatcgaggatgccgccatggtcaccgcaggcccgctcattgagtgggtcggcccccgcagccaagtgccaccggcggattacgccaaagtgcatgacctgcaaggcgcgtgggtcacccccgggctgatcgactgccacacccacacggtgttcggcggcaatcgcagcggcgaattcgagcagcgccttgaaggcgtgagctacgccgaaatcgccgccaagggtggcggtattgccagtaccgtgcgcgccacccgcgccgcgtccgaagatgaactgtttgccagcgcccacaagcgcctgcgcagcttgttgcgtgacggcgtgaccacggtggagatcaaatccggctacggcctggacctggtcaacgagcgcaagatgttgcgcgtcgcgcggcgcctcggcgaagcgttgccggtcagcgtgcgcgccacgtgcctggcggcgcatgcgttgccgccggagtacaaggaccgcgccgacgactacatcgagcacatctgcaccgagatgctgccggccctggccgcagaagggctggtggacgcggtggatgcgttctgcgaatacctggcgttttccaccgagcaggtcgagcgcgtgttcaaggttgcccagcaactgggcctgccggtgaagctgcacgccgagcagttgtcgtcgctgcacggctccagcctcgccgcgcgttaccacgcgctgtcggcggaccacctggaattcatgaccgaagaagacgccatcgccatggccgctgccggcaccgtcgccgtattgctgccgggcgcgttctacttcctgcgtgaaacccagttgccgccgatggacgctttgcgcaaacacggcgtgaaaatcgccatcgccagcgacctcaaccccggcacctcgccggcgttgtcggtgcgcctgatgctgaacatggcgtgcaccttgttccgcatgaccccggaagaagccctggccggcgccacgcagcacgccgcgaccgcgctgggcatgggcgatacccacggttcgctggaggtgggcaaggtcgccgactttgtcgcctggcagattgatcgccccgccgacctggcctactggctgggcggcgagctggataaacgcgtcgtgcgccacggcgtcgatgtcactgtttgaggagtacttttttgtggataaggttctgaacttcaaacaaggccgcgtaccgctgctgatcagcatgcctcacgccggcctgcgtctgacgcctgcggtcgaggccgggttgatccccgaggcacaaagcctgccggacaccgattggcacatccccacgctgtacgactttgccggggaactgggggccagcacgctgtcggccgagtattcacggtttgttatcgacctgaaccggcctgcggacgacacgccgctgtacgtcggcgccaccactggcctgtacccggcgactttgttcgatggcgtgccgttgttccgcgaagggttggcgccgtcccaggaagagcgcgccacttacctgcaaaagatctggggcccgtaccaccgtgccctgcaagaagaactggcgcggctcaaggccgagttcggctacgcgctgctgtttgatgcgcactcgatccgctcggtgattccgcacttgtttgaaggcaagctgccggacttcaacctcggcaccttcaacggggccgcctgcgacccggagctggccagccaactggaagccatctgcgctgcgcatccgcagtacacccatgtgctcaacgggcgtttcaagggcgggcatatcacccggcattacggtgacccggcgcgggacatccatgccgtgcagctggagttgtgccagagcgcctatatggaagagtttgagccgttccgttaccggccggatttggccgagccgacccgggtggtgttgaggcagttgctggaagggttgttaagctgggggcaaaggcgttacagctgacattgctatcgcaggcaagccagctcccacagtaggaatacatttcaaggtgggagctggcttgcctgcgatgaggccgtccctgtcgccgcagtgcaactgccggtcgccacaggtcgtgttaacagacatcccgctgggtaaggttgtgggcagggcgcgtcagacgccactccccacaataaagctgccgagtgagacctctttcatgaaaagactgttcaaccgttacctgttgaccctcaccggcgccgcgctgctcagtgcacaggccatggctgccgagccgacctcgtgcaaagcggtgcgcatgggtgtggtcagctggaccgacgtcatcgccacttccggcatggccgacgtgctgctcaacggcctgggctacgacagcaagcagaccagcgccgtgcagcagatcatctttgccggcattcgcgacaagcgcctggatatcttccttggctactggaaaccggcgatggacaacaacattgccccgttcctggccgccaaacaggtcaaggtcttcgacacgcccagcctctccgacgcccaggccaccctggccgtgccgcaatacgtggccgatgccggcttgaaaaccttcgctgacattgcgcgcttcaaggacaaactgggcggcaaaatctacggcatcgagcccggcagtggcgcgaacaccgatatccagaaaatgatcgacaccaaccacttcggcctgggcggcttcaagctggtcgcctccggtgaagcgggcatgctcgcggccgtccagcgtgcggtgaatcgcaaggagttcgtggtgtttgtcggctggacgccgcacccgatgaacatcaacatgaaaatgacctacctcaccggcagtgaagatgtgttcggtgccgatgaaggccgggctaccgtttccaccgtcaccgcgccggacttcgccgagcgttgccccaacgccaaccggctgctgaccaacctgaccttcaccgccgcccaggaaagccaactgatggtgccgatcatggagcgccagtcgccgcaggatgtcgccaagcaatggctgcgcgaccaccccgaggatttgcagcgttggctggcgggggttaccgcgtttgatggcagcgatggcgtcgcggccgttcaggccagcctcaggtagctcaagcaatgcaaagcaaatgtgggagcgggcttgcccgcgatggcggtgtatcaggtattcattcggtggctgacacaccgctatcgcaggcaagccagctcccacacttgatctacttcgattagggatatttgcgcatgtatccgatttcttcgcagctcgcggccttcgtcaccaaaaccgaatccttcaccagcgaagactcatcgatggccggcttgcgccagaattacgaccgcatgtgccaggcgttcacgccgtcgcagcccgatggcctgcaagtctcggacgccgcgctcggcggggtgaaggttcgctgctatcaacctgcaacggccactccagcgcaaggctggccatgcctcctttatatgcacggcggcggttgggtggtgggcgggctggattcccatgacttcatctgcttcgaactggccagcgccctgcaggtgttggtgatcgccatcgactaccgcctggcgccggaacatccgttcccggcggcgtacgaagattgccgcgctgtctggcaggcgatccaggccgggcaggggccgtacgccatcaacttgcagcgtctggtggtgatgggcgacagcgccggtggcaatctggcggcggcgttgtgcctgggcctgcgcgacgacggtcagccgctgcctcaggcccaggtcctgatttaccccggtttgggtgggccggccgatttgccgtcgcgtcgcgattgcatggacgcgccgctgcttagcagtgccgataccgactgctacctggcgctctacctgttgggcggcggcgagccttcggcctacgccatgccgctattggccgaggatttcagcggtttgcccaaggccttgatcgccgtggcccagttcgacccgctgcgtgatgacggcatgttgtatgccgaacgcctgcaagcagcgggcgtcgaagccgtgctgtatcccggcaaaggtttggtccacggctgtttgcgcgcgcgcggccaggcgccggaggtggatcggctgtacgactacctgctgtcttacctggggagcgaacagctgacacaggtctaagtgctcaaggacatgctcattgcacaattcgggtttatgatgccagacggcaagaataatagacgtcccctcagggatgaacccgacaccctacggagcgcgcaatgcagacttggtacccgcagatcaaaccctacgcccggcatgatctggcagtcgatgacacccacacgctgtacgtcgatgaaagcggcacccccgagggcttgcctgtcgtctttatccacggtggccctggctccggatgtgacgcccagagccgctgctactttgatccgaacctgtaccgcattgtcacattcgaccagcgtggctgcgggcgctccacgcctcgcgcgagcctggaaaacaacaccacctgggacctggtcgccgaccttgagcgcatccgcgaacacctgggcatcgacaaatgggtgctgttcggtggctcctggggctcgaccctgtcgttggcctacgcgcaaacccaccccgagcgtgtgcatggcttgatcctgcgcggcattttcctggcccggccgcaggacattcactggttctaccaggaaggcgcgagccgcatgttcccggattactggcaggactacctcgccccgatcccggcggacgagcgccacgacatggtcgccgcttaccacaagcgcctgaccggcaacgaccagatcgcccagatgcacgcggccaaagcctggtccggctgggaaggccgcatgttgggcctgtgcccgagcccgcagcacgtcgagcggttttccgagccgcagcgcgcgctctccatcgcgcgtatcgagtgccactacttcaccaacaactccttcctggagcctaaccagctgattcgcgacatgcacaagatcgcccatctgccaggtgtcatcattcacggccgctacgatatgatctgcccgctggacaatgcctgggagctgcatcaggcgtggcccaacagtgagctgcaagtcatacgcgaagcggggcacgcggcctccgagccaggcatcactgatgcgttggtacgtgcgaccggcgagatggcacggcgcctgcttgatttgccgccagaagaagcatgaagggcctgttgcaacgggtgcgtggcgcccgggtcgaggtggcgggcgaagtggtcggttcgattgaccagggtttgctggtgctggtagctgtcgagccttcagatacgcccgagagtgccgacaaactgctgcacaagctgcttaactaccgagtgttcagcgacgatgagggcaagatgaacttgtctttaaaggacatcggcggcggtttgctgctggtttcgcagttcaccctggcggcggataccaaaagcgggctgcggccgagcttctccacagcggccccaccggccctgggagcggcgctatttgagcacttgttgttacaagcgcaacaattgcatggcaaggtggcgtcagggcgttttggcgctgatatgcaggtgcatttggtcaatgatggccctgtgaccttcctcttacagacatgaatgtattaaaaacgactttaatgcctaaaaacgcagggtttcgctacaaatacttcgttgtccctgatgcgttgtttcgcgggctactagataatcgcgcgctacggggatcagcgttgtttggtccatttttgacttaggtagagacttgtccgacggccactggggaatcattttgacccaggggagtcggaacaatgctcgccaacctggcatatagatagctggccgttggttttttgatctgttttcggcgagggttgctcgtgattgttagtccctgtaatgcaccaaaattgtctgccaaacggttacgaaacgcactggtaacgggctccgccctgttttgcctgttcggcgcgggtcaactgtgggcattcagtctggatgatgtgtcggccaaggcaaaagagctggctgggcagaaatacgaagctccgcgcagcaatctgccgaacgaatttcgcgaaatgaaattcgccgactatcagaagattcgtttccgcaacgaaaaagccgagtgggccgatcagaacacgcccttcaagctgtccttctatcaccagggcatgcacttcgacacgccggtgaaaatcaacgaagtcaccgccgacagcgttcatgaaatcaaatacgacccgacgcgtttcgatttcggtgacgtaaagtacgatccaaagtccaccgaacaactgggttatgccggtttccgtgtgctttacccgatcaacaaagacgacaagcaagacgaaatcatgaccatgctcggcgcgagttacttccgcgtcgtcggcaagggccagtcgtatggcctgtctgcccgtggcatggcgatcgacacggcattgccgtccggtgaagaattcccgcgtttcaccgagttctgggtcgagcgtccaaaaccgggtgaaaagcagctggtgattttcgccctgctggattcgccacgcgccaccggcgcttatcgcctgaccatgcgcccaggcaccgacaccatcgtcgacgtcaaatcgcagatgttcctgcgcgacaaggtcagcaaactgggcgttgccccgctgaccagcatgttcctgttcggcgcgaaccagccgtcgaaggtgctcaactaccgtcgtgagctgcatgattccagcggtctgtcgatccatgccggcaacggcgagtggatctggcgccctctgaacaacccgaaacacctgtcggtcagcaacttcaccatcgagaacccgcgcggtttcggcctgctgcaacgcggtcgcgacttcagccactacgaagacctcgacgacaactacgacaagcgcccaagcgcctggatcgagcctgaaggcgactggggcaagggttccgtcgacctggtcgagattccgaccgccgatgaaaccaacgacaacatcgttgcgttctggagcccggccgagttgccgaaagtcggcgaaccgctggacatcagctaccgcctgcactggaccatggacgaaaaagccctgcacccggccgatagcgcctgggtcaagcagacgctgcgttccaccggtgacgtgaagcaatccaacctgatccgccagccggacggcagcgtggcttacctggtggacttcgagggtccgtcccttaaagctctgccgccagatgccccggtgcgcagccaggtgagcgtgggcgacaacgctgaaattgttgaaaacagcgtgcgctacaacgaacacaccaaaggctggcgcctgaccttgcgcatgaagatcaaagacgcaggcaagccgactgaaatgcgtgcggccctggtccaggatattccgcagccagagcctgaaaaggcttcgacccaagtgatcaaggccgacaaactcttggccaagcaacacgagaaacaggccaagaaggacgcgaaagaagcgaaagacgctaaagacgcgaaagatgccaaggacaaggacgccaagcagccagaagctgccccggccacgtcactctctaatccggagccgagcaagacagaacaagtcctgaccgaaacctggagctatcagttgcctgccgatgagtaattctcaagccacgccagagactctgtccgagtacctggcgcacctcccgatgaccgcagagcagcgcgccgaactggcgggctgcacgtccttcagcgagttgcatgaacgcttgtcgtccgcgactttcgacgcaccgaccgacgctgcccaagcctcggttggccgtcggctgaccctcaacaccgccgaagagctgcaagacgcagaaatgctcgcgctcgacgccagtggccgggtgtgcctgaaggcgacgccgccgattcgtcggaccaaagtcgtgcctgagccttggcgcaccaacattctggtgcgcggttggcgccggatgaccggtcgcaccaacccgcccaagccgcccaaagacgaacgtgtactgccggccgcgcgctggcgtaccgtcggttcgatccgtcgctacattctgctgatcttgatgctcggccagaccatcgtcgccggctggtacatgaaaggcatcatgccgtaccagggctggtcgctggtcgacttcgacgagattcgcaaccagaccctgctgcaaaccgcgacccaggtactgccttacgccctgcaaaccagcatcctgatcatgttcgggattttgttctgctgggtgtcggccggtttctggaccgcgttgatgggctttctggaactgctcaccggtcacgataagtaccgaatttccggcaaaagcgccggcgacgagccgattccgaaagatgcccgcaccgcgctggtgatgccgatctgcaacgaagacgtgccccgggtattcgccggtttgcgcgccaccttcgaatcggtggccgccacgggcgacctcgaccgcttcgatttcttcgtgctcagcgacagtaacgaagccgatatctgcatcgccgaacagcaagcctggctcgacgtgtgccgcgaagccggtggcttcggcaagatcttctatcgccgccgtcgccgtcgcgtcaaacgcaagagcggcaacctcgacgacttctgccgtcgttggggcggtgactacaagtacatggtggtgctcgacgccgacagcgtgatgagcggcgaatgcctgaccagcctggtgcgcttgatggaagccacgccggatgccgggattatccagaccgcgccacgtgcgtcgggcatggacactctgtatgcgcgcatgcagcagttcgccacccgcgtctacggcccgctgtttaccgctggcctgcacttctggcagttgggtgaatcccactactggggccacaacgcgatcatccgcatgaagccatttatcgagcactgcgccctggcgccgttgccgggtaaaggcgcgtttgccggtgcgattctctcccacgacttcgttgaagctgcgctgatgcgccgtgccggctggggcgtgtggattgcctacgacttgccgggcagctacgaagaactgccgccgaacctgctggatgaactcaaacgtgaccgtcgctggtgccacggcaacctgatgaacttccgcctgttcctggtaaaaggcatgcacccggtgcaccgtgcggtgttcctgaccggcgtgatgtcctacctgtcggcaccgctttggttcttcttcctggtgttgtcgacggcgttgctggcggtgaacaccttgatggagccgcagtacttcatggcgccacgccagctgtacccgctatggccgcaatggcatccggacaaggcggtggcgctgttctccaccaccatcgtgctgctgttcctgcccaaattgctgagcatcatcctgatctgggccaagggcgcgaaagagttcggtggcaagttcaaggtgaccttgtcgatgctgctggagatgctgttctccatgctgctggcgccggtgcggatgatcttccacacccgcttcgtgctcgccgcgttcctcggctgggctgcgacctggaactcgccgcaacgtgacgacgactccacgccatggagcgaggcagtcaagcgccacggcccgcaaactttgctcggcttcctgtgggcgctgttggtggtgtggttgaacccgagcttcctgtggtggctgattccgattgtcggctcgctgatgctgtcgattccggtgtcggtgatttccagccgcgtgaagctgggcctcaagtctcgcgatgagagcctgttcctgattcctgaggaatacaatccgccgcaagccctgctgtcgaccgagaagtacacccacgaaaaccgttggcacgccctgaatgacgggtttgtgcgttcggttgtcgacccgcagcagaacgccctggcctgtgccctggcgacctcgcgtcaccgtgaggccgagccgatcgagcacttgcgccaggagcgtgtgcgccatgcgttgaaagtcggccctgccggcctcaacaacggcgagcgcgtggcgttgctcagcgaccctgtagccctggctcgcttgcaccagcaggtgtggagcgaaggccacgccgaatggcttggcgcttggcgtgcatcgatcaaagctgacccgcacgcgccgttgctgccgctgcaaccgctatcgtcgcaggcccaaccggcctgattctgacgcccccgagggctcacctcgggggcgtttgaagcgctggtcctacagcgtttcacgcctcttcctgatccccctggcaccttgttatttcgaaacaaaagacccttgtccgaggcgtattgtcgtgcctgcggctgggttagcatcgccccccgaaattgactcgaacacagggggattcatgttcaaaaggtattgttcggcatggctgatcagcgctgccgcattgatttattcaggctggctgagcgccggcgcgcttgatgacgcggtgcggcgaggggtgcttaaagtcggcactacgcccgtctatgtccccttcgaaatgaccgacaaacagggccgcatcatcggcttcgaaatcgacttgctgcaaacgatgagccgcgccctgggcgtcgaacttgaactagtcgctgtgccctataccgatttggtgccggggttgatggcgaacaagttcgatctgatcggcagcggcatgacggttactcaagagcgcaacctgaagctcaatttcagcgactccttcattgtcgtcggccaaaccgtgctgttgcatccgagccttgccggcaagatctccagtatcgaagacctggacgaggcgagttaccggatcgtggccaccgaaggcactacgggcgagtccgccgcacaacgttttttgggggcagcccaattgagcagtgtcgcaaccccggaggagggcgtgcggcgggtggtggaaggcaaagccgatgcctttgttcatgacgcgccctacaacctgatcgccatgacccggccggagaaccacgcactgctggcgctggagcagccgtttacctttgagcccctggcgttcggcctgaaaaaaggcgattacgacagccttaactggatcaatcactttctcagccaggtggcccaggatggcacctacgatcggctgcacgacaagtggttcaaggacaccgcctggatggcggaaattgactgatcgtcataactacttacatatcaatgaattgccgcgcgctcgcccggacgtgtctatcagtgcgcttgcttgcacttttgtggggcttttccgacatacgccgttaacaattacccgcgaaacctttgtgacgggcaatgagtgggttaggatcgcaccccgaattggtgcagcccttttgcgcgccgaccttacaagaatcgttcaggggacttgatgatgaaaaagtatctttcgatgctgatgcttggcgtcaccgcgctggtcgcggccactgcggcgcatgccggcgccatcgatgatgcggtcaagcgcggcacgctgaaagtcggcatggacccgacctacatgccgttcgaaatgacagacaagcgcggtgaaatcatcggtttcgaagtcgacatcctcaaggccctggccaagtccatgggcgtcaagctggagctggtgtccaccggttacgacggcatcatcccggccttcctgaccggcaagttcgacatgatcggcagcggcatgaccctgacccaggaacgcaacctgcgcctgaacttcagcgaacccttcatcgtggtcggccagaccctgctgattcgcaaggacctggaaggcaccataaagtcctacaaagacctgaatgacgagaaataccgcctgacctccaagctcggcaccaccggcgagatggtggctaaaaagctgatctccaaagccaagtaccacggctatgacaacgaacaggaaggtgtgctggacgtggtcaacggcaaggctgacgcctttgtctacgacgcaccctacaacgtggttgccgagaaaaaggtcggtaatggcaagctggtgttcctggaagaacccttcacctttgagccgttggcgtttggcctgaaaaaaggcgattacgacagcctcaactacatcaacaacttcctgcaccaaatccgcaacgacggcacctacgatcgcatccatgacaagtggttcaagagctccgagtggctcaaggacatggaataagccaggctgaataccgagtcgctcccatcgcaggcaagccagctcccacctttgactgtgttcgcagatcaaagatgtgggagctggcttgcctgcgatgacggcctgacaggcgacatcaatcccggaacctgaaatgaaacagaaaaaagcccaatggccctggcacctgctgaccgtggtcgtgctggttggcctggctggcgcgttgtactacgccacctcgctgatgtcctatgaatggcgctggaaccgcgtgccgcagtacttcgcctaccaggccgaaacgtcccaacgtgccgccgacatctccaccgtcgttgagctggtgcgcaaaggcgacatcgccgaagtgaccctgcgcaatgacgccggtgccgagcagaagctgaccgtggccgacaacagcctgcaagtgtcgcgtggcgatgacgtggccgaaggcgatgtggtcggcgtgacccgccactgggcgctagggccgctgatgtggggtttgtggaccacgttatggctgtcggtggtgtccggcattcttggcctggcgatagggttggcaaccggcttgtgccgcctgtccagcaacccgacattgcgcgatctgtcgacgatctatgtcgaactggtgcgcggtacgccgctattggtgcagatcttcattttctacttcttcatcggcacggtgctcaacctgtcacgggaattcgccgggatcgcggcgctgtcgctgtttaccggcgcctatgtagcggaaatcgtccgtgccggtgtgcagtccatcacccgtggtcagaacgaagccgcgcggtcgttgggtttgagtgccagccagtcgatgcgccacgtggtgttgccgcaagcgttcaaacgcgtactgccgccgctggctgggcaattcatcagcctggtaaaggacacctccctggtgtcagtgatcgcgattaccgaactgcttaaaagtggccgtgaggtcatcaccacttcgttctcgccgtttgaaatcctgttctgtgtggcaggcctgtacctgctgatcaacctgccgctgtcgaaaatggccagccggcttgagcggaggctcgcgcaaagtgattgaagtccgcgatctggtaaaagtcttcgacacccgtggccaggtggtgcgcgcggtggaccacgtcaccactcaagtcgccaagggcgaagtgctggtggtgatcggcccgtcgggttccggcaaatccactttcctgcgttgcctgaatggcctggaagaatttgattccggctccgtcagcatcgacggcttgcagctggctgacccgaaaaccgacgtgaacgcctatcgtcgcgaagtcggcatggtcttccagcatttcaacctgttcccgcacatgaccgtgttggaaaacctgtgcctggcgcaaaaagtcgtgcgcaagcgcggcaagcaggagcgcgaagccaaggccctggcattgctggaaaaggtcggcattgcccagaaggccaatgaattcccctcgcgcttgtctggcggccagcaacagcgtgtggcgatcgcccgcgcgttggcgatggaacccaaggtgatgctgtttgacgagcccacctcggcgctggacccggaaatggtcggcgaagtgctggacgtgatgaagaccttggccctggaaggcatgaccatggtctgtgtcacccacgaaatgggttttgcccgcgaagtggcggaccgggtgctgttcttcgatcacggcaaactgctcgaagacgcggccccggccgaattcttcgacgcccccaaagacccgcgcgcccaggcctttctgcgccaagtcctgtaaaaatggcccttctggctagcggatttctgtggcgagcgagcttattgtggcgagcgagcttgctcgcgctgggctgcgcagcggccctaaaccagtcaacgtggtttaactgaaaaactgcgttgaattgattggggccgctacgcgccccagcgcgagcaagctcgctcgccacaagtgctgtaagcctcagagcttgaatctgccgaccaggttctgcaaatccaggctcaacttcgtcaactgagcactcgctgccgctgtttcttcactggcggccgcggtttgttccgacacatcccgcaccttcaacacgctgcgattgatttcctcggccaccgcgctctgttcctcggcagcggcggcaatctgtgggttcatttcctggatgatcgacacggtgcggataattgccgccagtgcatcccccgcatcgtgggtcagttcgacgctgtggtcggtcaacgcgcggctgccgtccatgatgtcggccacctgctgggtgccggtgtgcagccccaaaatcagcccttcgatttcttcggccgactcctgcgtgcgctgggcaaggctgcgcacctcatcggccactaccgcaaaaccccggcccgccgtaccggcacgcgccgcctcaatggcggcgttcagggcgagcaggttggtctgctgggacactgacttgatcacgtccagcacgccgctgattttttggctttcgcgctgcaaggcaatcatcgcctggctggagcgcgccatctcatgggccaggtggccgatctgttcgacggcctgcgccacgaccttgtcgccggcgctggcttgctggtcggcttcattggcggcaaccgaggcttgttcggcatgtcgggcaacctcctgggcggtggcgagcatttcattcatcgccgtggccacttgatcggtttcgtcgcgctggccgttaaccccggcgcgggtttgctcggtgacggtcgacaactgagtggcggcactggcgatctgccgcgcgctgtcaccgatgccgctgatcaggctgcgcaagctgcgggtcatttgcccgatgctttgctgcaactggcccagttcatcgtggcggtcctgcgcagtgttctggctcaagtcgccgtcagcaacccggtgcgcggccgtgagcagtgttcgcagcgggccgactatttgccgagtgatccaccacgcggccagaacaccgagtaacaaggccaccacggtgacgcagatgagtagcctgtgggtctgctcggcttcgctgtcacgcttggcggtctggccttcgctcaatcgatggctgtgctcgcgcaactcatcgagttgttgttcaaatcggttttgcacggtttcgatattgagctgagcttgcttgagcttgatcaactgttcgcgatagttggccaggtcagtcttgagcagtgccgcgtccaccggttgcgcggtcaccgctgtctgtgacgcgtccagggcgccgagggtctggctgagcgcctcggtgtaggcctgcagcgactcggcggcccaggcggggctctgggcgcgatcctccgcctgttccatggcctggcgcaggttttcgatggcatcgagggctttttcatcctcctggttgggcaagtcgctggagaattgtgccagggtgtcgctggcctgcagggcggacttcttgagcgcgaggcgggtgctctcgcgttgctcgaccaagggcggcaaggctgccacggccgccttgaaactggccaccaagcgtatcgcttcctgcagccgctgcaggtcggccgggtctttcagacgcgttgaaaggtcggccaggtgctggtcgatcttttcaatctgcgtggtcattttggtcaggctggcggcgtccgtcagggtgcggtacacgatccgatccgcccgcatggtctcggcgtccagcgccagttgagccaaggtcgtcaggctgttggagcgataaagcacggcgttcaaggcttgccagcccgtcgcggcgatcaggacacttaagatcagcacttggccgaaacccagtgcaagttttacacggacgctggcgttgaccagcaagcgggtcagccgaaacatggtgaacctccaaatcagggagcgcgcttggcaacagctcaaacgctaaatcgatttggggttatggcgggctgataactgcgtaggacgtttcacaagttgcggcggcccggtctggccgccgcgtaggatggatcaaatacggaaacgcccgaccagcgtctgcaagtagatccccaggcgcgccagctcggcgctggaagcggcggtttcttcactggccgaggacgtctgttcagacacatcgcgcacattcaacacgctgcggttgatctcttcggccaccgcactttgctgctcggcggcggtggcgatctgcgaattcattgcctggatggtcgagacggtgcgcgtgatattgcccagcgcgctgccggcacggcgggtcagctcgacactgctgtcggtgaggccacggctgttgtccatgatggtcgccacctgttgggtgccgctttgcaggccaacgatcagctcttcgatctcttcggtggacttctgcgtgcgctgggccaggctgcgcacctcgtcggccaccaccgcaaagccacgcccggcttcaccggcacgcgcggcctcaattgcggcgttaagggccagcaggttggtttgctgggccaccgacttgatcacgtcgagcacgctgccgatcttgtcgctttcgcgcttgagatggcccatggcttcggttgagttgccgacttcggtggccaggcgctcgatctgggcgatcgcttcactgaccaccttgtcgccttcacgggcctgctggtcagcggcgacggcggcttcggaggcttcttcggcgttacgcgccacttcctgcacggtggcggccatttcattcatggcggtggccacctggtcggtctcgaccttctggctattgaccccggcgctggtctgctcggtcacggccgacagttgttcggcggcgctggcgatttgcgtgacgccatcgctgatcccgccgatcagttcgcgcagtccgacggtcatgctttgcatggcgcgctgcaactggcccagttcgtcctggcgtgcggagttgaggttgtggctcaggtcgccggaggccacgcgctcagcaacgttaagggtctggttcaacgggatgacgatctgccgggtgatggcccaggcggcgaccatgccgaagatcagcgccagtacggtggccagcaacaacagctgcctggcttgcgctgcatcggcatcgcgcacggcggtttgcgaggtggtgagtttttcgctgtggccgagcaggatgtcgccttgctctgtcatgattttcagggccgcagcgctggcgacctgtgagtcgcggtactggctgacggcggcgcggtaggcctgcagcgacacgccggcttcttgcaggttggcctggtactgctccggcagttggccttggagttcggtgattttcttcagcgcattgtcgatggcatccagcgcgggctgctcggcttcggtcttgccgctgtaggtgtagccgcgcacctggaagcgcgattgctggatcagcttgctcaggtcgaccacgctgttgaactgggtgacgctgtcaccttgcagcaaggctttttcgacttcgttggttttggcgacggcgttgtcggcggtgtcgccgagcttactgcgtgcgccttcacgcttgaggccggcctggaccatggcggcaaaggccttcttgtattggcctaaagcctcgagctgttgctcgaccagggcgttgtcgtcgggttgctcgatcagggtctcggcggttttcaggccactgtccagtttggtgagcaggccgttgaccgcatccgtgccttgttcgccgcgccgcatttcgaagtccaggcgcgccaggcgcaggtctttggtcaggccgttgaggctggagataaagcccaacttgtcaccgcgactgatcacatcgcccaagccggtccaaccggtgaaggtgatcaacagcgtcaggatcaacaccaagccaaagccaatgctcagcttgcggttgacgctcacattccccagtttttcggctaaccaacgatacatgctgcgaactccctttgaacaaggcttggacttattcagaggctatcggccgcgtaggaagtttctgtagcaacactgatcttccctgtgggagctggctggccacagagagcctgctcccaggtaggtcagggtcagaaaaggcgggcgagcagggcggtcacggcggtttcgacgcgcaggatgcgtgcgccgagctgcacgggttgcaagccggccttggtcagcaggtccacttcgtagggaatccagccaccttccgggccgatggccagggttaccggcgtatccagcccgcgcgggcacgccgggtaatcgccagggtggccgatcaggccgagggtgcctgcggtcatggctggcaggcgatcttcaacgaacggcttaaagcgtttttcgatgatgatctcgggcagcaccgtgtcgcgggcctgctccaggccgaggataagctgctcgcggatcgcctcaggctccagaaacggggtttgccagaagctcttttccacccgatagctgttgaccaataccaccttcggcacgcccatcgatgccacggtctgcagcactcggcgcagcatcttcgggcgcggcagggccagcagcaacgtcagcggcagtttggctggcggcggcaggtcgaagctgacttgcagctcggcttcgctggcctccaggcgcagcacttgtgcattgcccatcagcccgccaatgcggccaacgcgcaggttgtcgcccaccgttgcgcggtggacttcctgcatgtgcaccaggcgccgatcacgcaggatcacgcggtcggccgcgataaagtcggcctcttcaagcagcagcaggttcacggctgggtcgctggcggctggtcgtcgtcgacgggttggtcatccgggtgatcgccacgcttgctgatcaggctgccgaacagaatgccgatctcgaacaacatccacatcggcacggccaacagggtctgcgagaaaatgtccggcggcgtcaggatcatgcccaccacaaagcagccgatgatcacgtacgggcgtactttcttcaggtatttgacgtcgaccacgccgatccacaccagcagcaccacggccaccgggatttcgaaggccacgccaaaggcgaagaacagcgtcatcacgaagtcgaggtaactggtgatgtcggtcatcatctccacaccggccggggtggcggcggcgaagaacttgaagatcagcgggaacaccaggaaataggcgaaggccatgccggtgtagaacagcaggatgctcgacaccagcaacggcacggcgatgcgcttttcatgcttgtacaggccgggcgcgataaagccccagatctgatgcaggatcaccgggattgccaggaacagcgaaaccatcatggtcagcttcagcggcgtcaggaacggtgacgacacgtcggtggcgatcatcgtcgcgcccgccggcaagtactggcgcagtggcgtagagacgaaggtgtagatctgctgggtgaaagcgaacagcccggcaaagatgatgaagatggccgctacgcaacgcagcaggcgggtacgcagctcggtgaggtgcgagaccagcggcatgtgctggtcgttttccggtttatcagcgctcatggggctcgcggcggcaatgtagggtcatggggagcggacgacgcaacgggcgtcggcgctggcgcggtcggggcgggctctgccggggtatgttctaccacaggagccgcttgggccacggcgggcggtgcgatgctgtgctcggccacgggctcggccggtttgctcggctcgttcaccggcgacagaatcttgcgcgcttcctgctccaacgacaggatatgttcgttgtgcagttgccggcggatctcgtcggcgccgatttcccgttcaacttcctgtttgatggcgttgaaactgcgtttcaggcgcccgatccataggccggccgtgcgtgcggcaccgggcaggcgttccggccccaataccagcagggccacgaggccgacgaggagcagttcagagaagctgataccaaacattagtcagtgctcacgagtctttgcgggtcggctcttcgactttttcagcctgcacgtcgaaggtccgacgctcagtgatcggctgggtcgcctgggggtgcacaggctgggccggaggcactgggttcacgacggggttgaccaccgggtcggccggcttttcgtcatcgttcatggctttacgaaagcccttgatcgactcgccgacgtcagtgcccaggttcttgagtttcttggtgccgaacaccagtaccaccactaccagaatgacgatccagtgtttccagtcaaaaatgcccatgctgcaattcctctgtaaaagttattcaggcggacgggcgcgaggccttttcggcgtgcccggacaagccgaagcgacggtccagttcatccagcacggcctgtggatgctgccccagttgggcgagcatgaccaggctgtggaaccataggtcagcggtttcgtagatcacatcgctgcagtcgccgctgatctgggcgtctttggcggcgatgatggtctcgacggattcttcgccgagtttttccagaatcttgttcaagcccttgtggtacaggctggcgacgtaggagctgtcggcgtccgcgcctttgcggtcttccagcacctgggccacacggttgagggtatcgctcatgttcagtgtcctgccgagtaaatggcgtgcgggtctttgagcaccggttcgaccaccttccattcgccgttctcgaacacgcgatagaagcagctgtgacgaccggtgtggcaagcgatgtcgccgatctgctcgaccatcaggatcaccacgtcggcgtcgcagtcgatgcgcatctcgtgcagggtttgcacgtgcccggactcttcgcccttgcgccacagtttgccacgcgaacgtgaccagtaaatggcgcgctgctcagtggcagtcaggctcagggcctcgcggttcatccaggccatcatcagcacgcgcccggttttgtagtcctgggcaatggccggcaccaggccgtcactgtcccacttgatctcgtccagccagtctttcatgttccgctccggcaatttgcgacagtgtataaccggatcggctatcgacgcacgatcagataaacacccacggcgaccatgatgccggccggccagtggcccagttggttcagcggcccgccgatggcgagcatcacgccgccaacgaggtgcgcggcgcccagcaggcgcaggaaccagtcgtccttgcgcttctgccacggcggcgcggggtctttggcgtggggctgggacatgcgctccagcaggtcgcgggtcatgttggccaggtgcggcagttgctccacttggctttgcaggttgcccagcaaggttttcgggctgacgcgttcacgcatccagcgctccaggaacggctgcgcggtgttccacaggtcgaggtccgggtacaactgacggccgaggccttcgatgttcagcagggttttttgcagcaggaccaactgcggctgcacttccatattgaagcgccgcgcggtctggaacaggcgcatcaacacctggccgaatgaaatatcttttaacggtttttcaaagatcggctcgcacacggtgcggatcgccgcttcgaactcgttgagcttggtttctgccggcacccagcccgaatcgatgtgcaactgcgccacgcggcggtaatcgcgcttgaagaaggcaaacaggttgcgcgccaggtaatcctggtcttccggggtcaggctgccgacgatgccgcagtcgattgcgatgtactgcgggctccacgggttgacggtgctgacgaagatgttgcccgggtgcatgtcggcgtggaagaagctgtcgcggaacacctgggtgaagaagatctctacaccgcgttcggcgagcatcttcatgtcggtgcgctggtcggccagggtggcgaggtcggtgacctgcacgccgtagatgcgctccattaccagcactttcgggcggcaccagtcccaatagatttgcggcacgtacaacagctgcgagccttcgaagttgcgcttgagctggctggcgttggcggcttcgcgcagcaggtcgagttcgtcgtagatggttttttcgtagtcggcgaccacgtccaccgggtgcagcaggcgcgcgtcggcagagaaacgctcggccgcgcgggcgaggatgaacagccacgccaggtcctggccgatgatcggcttgaggccggggcgaattaccttcaccaccacttcttcgccggtcttgagctgcgccgcatgcacttgcgcaaccgaggccgaggccagagggtcgacgtcgaaacggcggaacacttcgctgatcttcttgcccagctgctcttcgatcagcttcatcgactgctgggagtcaaacggcggcacgcggtcctgcagcagcatcaactcgtcggcgatgtcttccggcaacaggtcgcggcgggtggagaggatctgcccgaacttgataaagatcggccccaggtcctgcagcgccaggcgcaggcgcgcgccccggctcagctccagctgtttgcgcgggaaccagcgccacggcagcacgtagcgcaccgccagcaggaaccacggcaagggcagggcgaacagcaggtcatcgaggcggtagcgaattacgacgcgctggatacgaaacaaacggcggacggcgagcagcttcatgcgttatcgcttggatcaagggaacggctcaggcgctcgaagcgtgcctcaaggcgttccaggtcgattttggccttgtcgagttcacgaaagcgcgcttgcgcttcgcgttctccgaccagggtgcgcgattcttcgctcaggtattcggcgaggttctggctgaggctggcaaacccttgctgataccagcgcgagcggctgcgcaaatgcccgctgatcaactgggtgggcacggggccgatccagcgtgacagctcgtattcccagtccagttccaggtcttgcagcacggcggccaggtccatcagcaccgcgctgtcgccttccagctccacttcggggccgtggaggatggcggttttgttgcggctcagtgccaggtgcaacaggctcgacgccggcgcgcgcagggtgcagtcggcctcggcggcccactggcttgcgagcagcaagccttcatcgctgggcaggataaacagctgcatggcggggctggtgcagtcgacggcaatgaccttgccgttcaagtgcgcgagccgcgccagggcggtgctgtccaggcgcagtacacggttgaggccgtgttcgacgctggcgagaaggccctggaacaacatcagggcttgataccgcggtgcagggcgacgatgcccgaggtcatgttgtggtaggtcacgcggtcgaaaccggcttctaccatcatcgacttcagggtttcctggtcggggtgcatgcggatcgattcggccaggtagcggtagctctcggcgtcattggtgatcagcttgcccatcaacggcatgaaggcgaacgagtaagtgtcgtagaccttggacatcagcgcgttggtcggcttggagaactccagtaccagcaggcggccacccggcttgagcacgcgcagcatcgagcggatcgcgtcttctttatgagtgacgttgcgcaggccgaaggcgatggtcacgcagtcgaaatggttgtccgggaacggcagcttttccgcgtcggcctggacgaattcgatattgccggccacgcctttatccagcaggcggtcacggccgaccttgagcatcgagccgttgatgtcggccagcacgacctggccggtagggccgacgagcttggagaacttggccgccaggtcgcccgtgccaccggcgatgtccagcacgcggttgccggtgcgtacgcctgacagttcgatggtgaagcgcttccacaggcggtgcatgccgcccgacagcacgtcgttcatcaggtcgtacttggcggctacggagtggaacacctcagcgactttttccgctttctggctttccggaacgttcttgaagccgaagtgagtggtgggttcggcatcgctgcctttgcgctgatcagtcatatcgctgtcaccaaaagagaatgcgggacatgataatccccaaggcctgctttgtcttggcaaggctgaaggtaagataggcggtcaccgagaccttttgccgcatggcaggtgttctgagtcgttaaaaagaggagtcattgcaatggcccgtattaccgttgagcgtgcacattccctgggtaaagaagctgcgcgggcgaaggccgagaagttggcgaacaaactcaaggagcaatatggcctggagccgtcgtggtccggcgacaccctcaaccttaagcgttcgggggttaaaggcactgtgttagtcgccgatgattcgctgcgcattgatgtggaactcggcctgttgatgtcggccatgagtggcacgatcaagtccgaaatcgaaaaagccctggataaggcactggcctgatccgaatgcgcttagggtgccgattctaatttttcaccctactttgtgcccaagccctcaactcctgtgggccgttcctcgaccctaatctgcgtgaggtgcaccatggccaaagttattttgaagaaaaaaatcgacgttcagaccaccaccctgagtgacgttaaaagctatgcccgcaagatctggctggcgggtcttggtgcctatgccaaggtcggcagcgagggcagcgagtacttcaaagagctggttaagtccggtcaacatgttgaaagtaaaggcaaaaaagttgtggttgaacaacttgatgccgccaacagtcagattgaccaagtaaagagtaatgtctcaagcgtcaaaggtttggttgaagttcaactggataaagttgaaaaagcttttgacacgcgtgttgcaagtgccttgaatcggatcggcattgcgtctaaacatgacgttgagacactctctgctaagctcgaagagctgacggcattgctagaacgtgtcgcgcgtaaacactaaggagacatcgggatggctgttaaaaagactactcagaaagaaagcagctcgtggatcggggaagttgaaaaatattcccgtaagatctggcttgctggtttaggcgtgtactcgaaggttagcagtgacggcggtaagtacttcgagactttggtcaaagacggcgagaaggccgagaagttgaccaaaaccacagtgggtaaaaaagtcgaagcggcaaaggcaagtgcgggctccgccaagtcgaccatttcggatacctggggcaagttggaagaaactttcgacaagcgtcttaacagtgccatttcgcgactgggcgtgcccagcaaagcggaactgaagacgctgcacagcaaggtcgataccctgaccaagcaaatcgaaaaactcaccggcgctaaagtggcaccggctaaaaccgcagcggccaagcctgctgccaaacctgccgctaaaaccgctgccgccaaaccggctgcaaaatctgcggccaagccactggttaaagctgccgccaagccggctgccaaacctgcggccaaagcagcggctaaaccggctgccgagcctgccgctaaaaccgctgctgccaaacccgccgccaagcctgctgctaaacccgtggccgctaaagctgctgccaaaccagcggctaaaccggtagccaagacagcggcgaaacctgcggctaaaactgccgccgctaaacctgttgccaagccggccgctgcgaaacctgcagccaagcccgccgcagctaaacctgctgcaaaacctgcggctgccaagccagcggcaaaaccagccgccgccaagaagcctgctgtagcgaaaaaaccagcagcgccaaagcctgctgctgcggccaagcccgcaaccccggcgcctaccacgtcgacagccaactcggtgtccgcaccgacgcccgctgctaccccgactgcatcgccggcaaccccgacgccaaccagtcagtcctgattttttcagggcacaaaaaacgcccggcctgtgaaggtcgggcgttttttattggcgatcttattacccacatagttccaatgtgggagcgggcttgcccgcgattgcggtctgccgatgacataggtgctaactgacccaccgctatcgcgggcaagcccgctcccacaggtttaatccatgtcatccaggtacttgagggcgaatttttcggtcgcctgccgtgccggcaacagcaagtgcggcgccaccagcatcatgatctggtacaccaccacgcgcacctcgccctcccggtccagaatccgctggtaatccagggaaaacagcaaagtcatggtgatctgttccaccaattgccccagcgcctgggtatcactgaccagttgccccgccgccttcaaccgcgccagcaatgaagccagcgtgcgcttgagcgctgtcagcaagttgcgaatgcccttggccaacttcggcaaacgcccggccaggttcgacaagtcctgaaacagaaaccggtaatgggccatgcgctcgacgatcaagtgcaggaacagccagtaatcttcggctctcaactgcgcatctgcaggcggatcgagcagcggcgccagttcattttgaaagcgctcgaacaacccgagcaccagcggttccttgccatgaaagtggtagtagaggttgccggggctgatccccatttcattggccacctccatggtcgacacgttcggttcgcctttgtggttgaacaactgcagggcacattcaaggatacggtcgcgggtcttcatccagtcttcttaatgtgatcgttgactcagcgcacgcgcacgtaagtgcccggcgccgcttccatcggtgggtaattctggttgcccagggcggtcagggtttcgcgctgcgcgccggagcgttgttgaatccacgccagccactgcggccaccagctgccttcgacgtggttggcgtcgtagtaccaggcgcgcgggtcgctgctcagcttggggttttcgacgtaattggccttggggttgcccggcgggttgaggatgctctgcacatgcccgctgttggacagcacgaagcgccgctcgccgccgagcaattgcgtggagcgatacaccgcgtcccacggcgtgatgtggtcgttgatcccggccacgctgaagctgtccaccgtgaccttctgcaagtcgatcggcgtgccgcacacttccaggccgcccggatggctcaatgggttgtgcttgaaaaagtccagcaagtcgccgtgcagcgcggcgggcaagcgcgtgttgtcgttgttccagtacaggatgtcgaacgccggcggttccttgccgagcaggtagttgttgatccagtagttccagatcaggtcgttggggcgcatccaggcaaacactttggccatgtcgcgaccgtccagcacgccttgctggtaggagcggcgtttggcagcctccagggtttgctcgtcggcgaacagcgtggcggggctgtcgagctggctgtccagcaggctcaccaggtaactggcgctggagacgcgccgcagctggcgcttggcctggaggtggccttgcagcgcggcgatggtcaggccaccggcgcaggcgcccatcaggttgacctcgcgggcgccggtaatcgcccggcacacgttgagcgcttcttccagcgcggcgacgtaggtggacaggccccattcacggtggcgcacatccgggttgcgccagctgaccataaacgtctgcaggccatttttgagcgcgtactgcacaaagctgttggccgggctcaggtcgaaaatgtagtacttgttgatttgcggcggcacgatcagcagcggcttggcgtactgcttttcgctcatgggcttgtactggatcagctccagcagctcgttgcgaaacaccaccgagccgggtgtggtcgccacggtcttgccgacttcgaacgcatgtttgctgacctggcggggcaggccgttgttgtgcagcaagtcgtcaaacaggttgctcacaccgcgcaccacgctgttgccgccggagttgagcaactccttcacggccagcgggttgagcaaggtgttggagggcgacactgcatcattgagcagcgagaacgcaaaatgggcacgggcgcggtcatcggcgttgagggtgctgtcgtcgacccagtggcgggtctgtttttgccagctcaaataggcctgcaagctgcggcggtacagcgggttgagcttccaggtcgggtcgatgaagcgtgcgtcgttggggttgggctcatgcacggtttcgcccagcagcacgcggccgagctgcccgcccagcgctagggcatgacgcgcggtgtgcaccgggttgcgcaagccgtgggcagcgacgctgcgcagggtcgccagcaagtcccgaccacgcaggccggtgatcgcattttgcgcgttgatgaacacggcaggggtgggcgccgggttcgtcacgggtctttctcgcatgagccaacactccttcgtcaaggcaacaacgggcacgccaattcagaaccatagtcggttctcggcaagttgcgcggcggtgcagtccttacacggccggtcgcgggtgaatcacggcccgcaggcgctcctcttcgagaaacttcatgatgatcggcgccacggcttcggcccgggtaatcaggaacaagtggccgtcatcgatgatgtgcaactgcgcgttgggaatgcgccaggccagcatgcgcatgttgatcagcgggatcagcgggtcgtcgtcgccggccagcaccagggtcggctggcggatcttgtgcagccagtggatgctggtccagcccaggcctgcaaacagctgccagtagtaacccagcttgccggccgagcgcactttgctcgcatgctcggcggcaagctttgcatcgcggcggaacgagccgccataaatcatcggcgcgatgcgcaccacatgggacggctggatatagcgccgcgggctggccatcagccacaacactttgggcttgcccggcaccataaacgcaccggcggcggtggcggccaggatcagcttcttgcagcgctccgggtagtcataggcgaactgttgcgccagcgcgccgccccaggacacgcccacggcgttcacttggccatagtccaggtaatcgagcatgcgcgcggtgagtttggccaggccggggaatcgataaggccggttgggcgtcgacgaaccgcccacgcccggcacatcgaaggcgatcacttccaggtccgggtccagcgcctggacgaacggaaacaccaactcaaggttggcaccgatgccgttgaagatcagcagcggcgtcaagtgaggcttgcccgggcgtaccgccgtgcggatggtctggccatccaggtcgatggtacggaagatgaacggttgcggcatgctcaagccctgtgaagtggcgctatttatctgtgggaacgcggtctatgtgggagctggcttgcctgcgatagcaatctgtcagttagctcatcatctggctgacccaccgcaatcgcaggcaagccagctcccacattgatctcatttcaaccacacaacgtgcttatcgctcatgcacataagtacccggcgccgcctcagctgcggcataggttttgttacctaaactcgtaggtgccttcttcaatttccccgcccgctctgcctgccatgcctgccaatgcaaccaccacgagtcagtgtgcttggttgcattctcttgccactccagcggcttgcctgccaggccatcgctggtctggtagcgcgccttggggttgcctggcgggttgaggatgctctggatatgcccgctgctggacaacacaaattccactttgccgccaaacagctgcgccgacttgtagcaagattgccacggcgtgatgtggtcgttggtgccggccagggaatagatatcggcggtgacctgcttgaggtcgatcggcgtgccgcacacttccagggcgttggcgcgtaccagcgggttgttcttgaacagctcgatcaaatcgccatgaaacgctgccggtagacgcgtggtgtcgttgttccagaacagaatgtcgaacaccggcggctcgttgcccagcaggtagttgttcacccagtagttccagatcaggtcgttggggcgcatccaggcaaacaccttggccatgtcgcggccttccagcacgccggcctggtaggagtggcgcttggccgcttccagggtctgttcgtcgacgaacaacgccacctgggtgtccagggtggtgtcgagcacgctcaccaacagggtcagggcgttgaccttcttctcgcccagcgccgcgtagtggccgagcaatgcagtacaggtgatgccaccggagcaggcgccgagcatgttgatgtctttgctgccggtaatcgccgtgaccacgtcgaccgcttccttgagcgcctcgatataggtcgacaggccccactcgcgctgggccttggtcgggttgcgccagctgatgataaacgtctgctggccattgcgcaggcagaagcgcgccaggctcttctccgggctcaggtcgaatacatagaatttgttgatctgcggcggcaccaccagcagcgggcgctcgtgcacctgttcggtgatcggtttgtactggatcagctccagcacgtcgttgcgaaaaaccacggcgccttcggtggtgcccagggtcttgcccacttcaaaggcgcccatgttgacctggctcggcatgccgccgttgtgcaccatgtctttggccagatgggacaagccatcgagcaggctcttaccgccggtttcaaagaagcgtttgaccgccgccgggttggccgcgctgttggtcggggccatggcttcggtcatcaggttgatcacgaagtggccgcggctgatgtcctgttccgacaggttgctgtcaccgatccagtcgtgcagttccttgcgccacgccaggtaggtttgcaggtagcgcttgtagagcgggttctggctccacgccgggtcgttgaagcgacggtcatcgccttcgggcgccagcacggatttgccgaacatcacattcttcagctcgacgccaaaatgggcgacgtgtttgacgctgtgcaacggttgcttgatggcttgggtcagcaccatcttcgctgaggccaataaatcctttttgcgtaacgcgatgatcgggtttagccccagggtgttttccgaggcctggcgtttcaagtcatcgttattcttgttactcatctacgacgctccattgtccgaaagacgagtaccggcgattgctgcgcacccaatttcgatacacgacaccagcctggtactgcaactcgggtgaccgttgataccgcatcgtcaaatgcagggaacttgccagttccattggttacccgagtttaatttttttcgcaagcgggccaatcgttgaccacgcgacagggcattcaagcagatgaaattagaaaatgccctctaaagagcaagacgcctgagttagagcattagccgcacgaccgactcactcgggtcgcgggttttgccggccgctttgagttcagcaagatagtcggcccacagtgcttcttggcgcacggccaactggtagaggtagtcccaagtgaacagtccgctgtcatggccgtcgtcgaaggtcaatttcagtgcgtactgaccggccggttctatcttgatcagtcggacgttgagcttgccgaattgcaggatgggtttgccgtggccctgcacctcggcggaaggcgagtgagtgcgcaacagttcggcggggagctggtagacctcatcgggcccgtaggtgaggccgagggtgttggaggttttgtgcagatttacagcagtaggaaatttcgacattgatagtaatcctgaagaaaccggctcaaaaatgtaggagggcttctgtgggagccgggcttgcccgcgatgcagtcacctcggtgtttcagaaacactgaggtgatgctatcgcaggcaagccagctcccacaaaagccaggctcctacataagccatattctaaaaggcttacaggatataacgagacaggtcttcgttctgcgccaattcgcccagatggctattaacgtagtcagcgtcgatcttgatcgcttcgccattctgcgcaccggccatgtcgccagcgctgaaggacacttcctcaagcaggcgctcaagcaaggtgtgcagacgacgcgcaccaatgttctcggtcttctcgttgacctgccaggcaatctccgccaggcgcttgataccgtccggcaggaactcgatgcccaagccttcggttttcagcagctcacggtactgctcggtgagcgaagcatgcggctcgctgaggatgcgctcgaagtcgcctggggtcagcgccttgagttccacgcgaatcggcagccggccttgcagctccggcaccaggtcgcttggcttgctcaagtggaacgcgcccgaggcgataaacaggatgtggtcagtcttgaccatgcccagcttggtgttcacggtgcagccttcgatcagcggcagcaggtcgcgctgtacgccttcgcgggacacgtcgacgccgccggagttgccgcgcttggcgaccttgtcgatctcatcgataaacacgatgccgtgctgctcgacggcttccagggccttggccttgagctcttcctcattcaccaggcgcccggcttcttcgtcgcgcaccagtttcagcgcttccttgaccttgagcttgcggcttttcttcttgcccttgcccatgttggcgaacaggttctgcagctggctggtcatttcttccatgccaggcggtgcggaaatatcgacgccggaaacctcggccacttcgatctcgatttccttgtcatccagctggccttcacgcaggcgcttgcggaacagctgacgggtgttggaatcggacgacggtgcggcgtcttcgttgaaacccatacgcgccggtggcagcagggcgtcaaggatgcgttcttcggcagcgtcttcggcgcggtggctgaccttggtcatttcctgttcgcgcagcagtttcaaggcggcgtcggccaggtcacgaatgatcgactcgacgtcgcggcccacatagcccacttcggtgaacttggtggcttcgaccttgatgaacggggcattggccagtttggccaggcgccgcgcgatttcggttttaccgacgccggtcgggccgatcatcaggatgttctttggcgttacttcaacgcgcagctcttcgggcaattgcatccggcgccagcggttacgcagcgcaatggcaacggcgcgcttggcatcgtcctggccgatgatatggcgattaagttcatggacgatttcgcggggagtcatggacatagtgtttggcggcctcaagcggaataagcctacggcttactcggcgaggtcctgctcctcaatggtgaagttgtggttggtgaacacgcagatatcgcccgcaatgcccagggcagtctcgacgatttcacgggccgacaggtcggttttcttcagcagtgcgctggctgccgcttgggcgtagccaccgccggaacccatggcaatcaggccatgttcaggctcaaccacatcgccgttaccggtgatgatcaaggacgcatctttgttggcgacggccagcatggcttccaggcggctgagggagcggtcggtgcgccattctttggcgagctcaaccgcggcacgtacgaggtggccctggtgtttttccagctggccttcgaaacgctcgaaaagggtgaaggcgtcggcggtagcgccggcaaagcccgcgagaacctggccgtggtacaagcgacgcactttcttggcgttgcctttcatcacggtgttgccaagtgaaacctggccgtcgccgcccatgacgactttgccgtggcgacgtactgaaacgatggtggtcaaggggagagtctccacgcagcggggcgaaaatgccctgttggactctcatatgggggtggcgggggggatttcaaccgtaggaagggtgtgcggacgagtggtgtttatgggtcttaaacatttttcaggggcccataaaaccaatgtgggagctggcttgcctgcgatgacggtgtgtcagtcactgaaaatattgactgttacaccgccatcgcaggcaagccagctcccacttgggtactactgtgttctttgaatcaacggctctggcgttgttgtaacaacaggttactaaacccggcaccggccaattgcttctgcgccacggtcagctgttcacggttgctgaacggccccaccagcacgcgataccaggtcgcgtccttcaccgtgccggactccaccgtcaccgcctggcccaacagaataatctgcgcacgcacccgatccgcatccgcctgtttcgggaacgagcccgcttgcaggaagaatttggtcaccggcgcagccttggtggtcgccaccggcggcggcggtggcggggtgatcccggccaatgcggcttgggcacgggccgtgtcgatcttcgccgcttccgcaggggtgaccggcgtggtcggcacttgcggcgtcggcagggttttctccggcacggcgtcgggcggcacgatcacttccgattccggcagcagcgtatagaagtcgtacttcggcttcaccggtgcggtcgggcttggcgccgtcttgttggcttcggccattttcgtggccttctgctgctcttgcttgacgcgtttgacgtcatcgcccttgcccggctccagcttcatcaggatcacgacaaacgcaccgaccgccaggccgatggccatccacaaccagcccgggatcggcttcttcgccggggcttgatagcggctggcgccgcgcttgggtgcaggttttttcttggcagccaacttacatacgctccagggtttccaggcctaacaattccaggccttgcttgagggtccgtccagccagtgcggcaaggcgcaggcgactttgcttctgggcttcgtcgtcggcggtgaggatcgggcagttctcgtagaagctggagaacaggccggcgacttcgtacaaataggtgcacaggatatgcggcgtgcccttttcgccgacgctgttcagcacttcgccgaattgcgccagtttggccgccagttcctgttcgtgcggtgcatccagcacgatatggccgtcaacttcgctgaagtccttgcccagtttgcggaacacgccagccacacgggtgtaggcatacagcaggtacggcgcggtgttgccttcgaagttgagcatcagttcgaagttgaagctgtagtcgctggtgcggtgcttggacaggtcggcgtacttcaccgcgccaatgcctaccacgcgggcgatgttgcgcaggtcggcctcggccagttccgggttcttttccttcaccaggctgtaggcgcgttcctgggcttcggtcagcaggtcgatcagcttcacggtgccgccgtcgcgggttttgaacgggcggccgtcggcgccgttcatggtgccgaagcccatgtgttccatgtgcatcgggtgggtgacgaagcctgcgcggcgtgccacttcaaacacctgctggaagtgcagggcctggcgctggtcgacgaagtacagcgcacggtcggctttcagcacgccactgcggtagcgcacggccgccaggtcagtggtggcgtagaggtagccgccatcggccttgacgatgatcaccggcagcggatcgccgtcggcggtcttgaattcgtcgaggaacacgcactgcgcgccgttgctctcgaccagcaggcccgcggccttgaggtcgttgaccacgttgatcaggtcgtcgttgtaggcgctttcgcccatcacgtcggccatggtcagcttcacgttgagcagctcgtagatttcctggcagtgcgacagcgagatctcgcggaaacggccccacagcgccaggcattcctcgtcaccggcttgcagcttgaccaccaggccacgggcgcggtcggcgaattcttcggattcgtcgaagcgctttttggcggcacggtagaagttttccaggtcggccagctcgttgctggtgatcgggttttcctgcaggtaagccatcagcatgccgaactgggtgccccagtcgcccacgtggttctgacggatcacggtgtcgccgaggaactccagcacccgcgccacgccgtcgccaatgatggtcgaacgcaggtggcccacgtgcatttctttggccaggttgggcgctgacaggtcaaccgccacgcgctgcagcgggccggccttgcgcacgccgatcctggcgtcggccagggcggcgtccaggcgcgaagccagggcctgggtgttctggaagaagttgataaagcctgggccggcgatttcggccttggtgacgctctcgtcggcaggcagggcggcgatgattttttccgccaggtcgcgcggtttcatgcccgcaggcttggccagcatcatcgcaatgttgctggcgaagtcgccatgggtcttgtcgcgggtgttttccacctggatcgccggcgtcaggccttcaggcaacacaccttcgttgacgagttgggtgatggcttgttggatcagctggcgaatggtgtctttcatggtgttctctttcgaccgcaagcggcggcgcgcgatgcgcaggtggaaaaactgggcattatccgtggcgagggcgggcttgccaaccgttcagacgggttggtagacctgcgggcctcatcgcgggcaagcccgctcccacattttaatgggtgaatacttctacatgtgggagctggcttgcctgcgatagcggttttgctatcaatacaaatctaccgggtccacatccagcgaccatcgcacttgccggccgctgggcatttgctccagggcaagcaaccagctacttaatagccgatgcagtggtgcgcgggacgttgcctgcaagagtagctgagcgcgataacgcccggcgcggcgctccataggcgcaggcaccgggccgagcaattcgatgccggtcagacccagttcgccgagcaaacgttcggcggcgctgcaggcttcatccagaaaactttcggcctgcccgggtttatgtgcttcagcccgcagcagtgccaggtgcgagaacggcggcaggccggcggagcggcgttcgctcagcgcctgttcggcgaaggcgaagtagccttgttctgtcagctgaatcagcagcgggtggtcggccaggtgcgtctggataatcactttgcctggctcttcggcacgccccgcgcggcctgcgacctgcacgatcagttgcgccatgcgctcgctggcgcggaagtcgccggaaaacagaccgccgtcggcatccaggatcgacaccagcgtcacccgtggaaagtggtgccctttggcaagcatctgcgtgccgatcaggatgcacggctggcctttctggatggtggcgaacagctgattcatcgcgtctttgcgcgaggtgctgtcgcggtcgacccgcagcaccgggtaatccggaaacaggatccccaggcgttcttcggcgcgctcggtgcccgcgccgactgggcgcaagtccactttgccgcattgcgggcagtggcgcggcgtgcgctccacatggccgcaatggtggcagcgcaactcgccgtggcgttggtgcacggtcatgcgcgcatcgcagcgttcacactccgacatccagccgcagtcatggcacagcagtgtcggcgcaaaccctcggcggttgagaaacaccaaaacttgctggccggcggcgagggtctggccgatggcttgctgcatcggcccggaaatgccgctgtccagtggccgacttttcacatccaggcgcagaaagcgcggttgcttggcgccgccggcacgctcgttcaggcgcaggaggccatagcggccggtgtaggcgttgtgcaggctttccagagacggcgtggccgagcccaacacaatcgggatgtcttcctggcgcgcgcgtaccagcgccaggtcgcgggcgtggtagcgcaggccttcttgctgtttataggagccgtcatgctcctcgtcgatgatgatcagcccggggtttttcatcggtgtgaacagcgccgaacgggtgccgataataatgtcggcctcgccgtcccgcgccgccagccaggattccaggcgctcacggtcgttgaccgccgaatgcaccagggcgatgcgcgcgttgaagcgttgctcgaaacgcgccagggtttgcgggccgaggttgatctccgggatcagcaccagcgcctgtttgccggcttgcagggtttcgcggatcaactgcaaatacacttcggtcttgccgctgccggtcacgccagccagcaggaacgcgtggaaactgtcgaaaccggcgcgaatggcttcgtacgccgcgcgctgctcggggttcagtggcagttccggctgggccagccagtggtcgtggcgcgggtccggggcgtgcttgcggatctccacttgcaccaggcccttggccagcagtaggtcgaggctgtctttgctcagcatcagcttgcttaatagctgatgggccacgccgtgcgggtgttgggccaacgtcgccagggcttctcgctggcgcggcgcgcgggcgatgcgcgggtcatcgaggcgcgcgccgggcaccatcgaccagaagcgttcctgacgtgcttcggccaactcgccctggcgcaacaacaccggcagcgcccagctcaaggtgtcgccgaggctgtgctggtaatactgggaggtccacaggcacagcttgaacaaggccggtggcagcggcgccgtggtgtcgaggatggctatggcgggcttgagcttttctgcgggtacttcgctgtgatcggccacttcgaccagaatgccgatcatctctcggcgcccaaatggcacgcgcacgcgcatgcctggctgcaactgcgcccgcagcacaccggccggggcacggtagtcgaacaggcggcgcaggggcgagggcagggctaggcgcaaaatggcgtcgggcacgcggggagtctcatataaaggcaggcagtggcgcaggggcgggagcctagcagacctgcggtgggggtgtcctgtctgtggtgcacaaggcagcacttctgtgggagccgggcttgttgtggcaagcctgctcgccacaacaagcccggctcccacattgatcgtggtgaaccggcagtttttcggatgaaaggggctcatatgtgcccaatcgcccggaaccgccgcttgcgcgtttaaaaaggtctggtagaatccgcggcctaattacgtgcggtattcgacaatagtgtcgagtggcggcacgctagcccgaggaagtcaccatgaaagccgatatccatccagcgtacgaaaccatcgaagtcacctgcagctgcggcaacaagttcgaaactcgttcgaacctgtgcaagccactgggtactgacgtatgcaacgagtgccacccgttctacaccggtaagcagaaaactctggacaccggcggccgtgtacagcgcttcgcagatcgctttggtgctttcggcaagaagcctgctgctactccagcagagtaaggctcaaaagccctttgggtttttgccagctgttgaaaaaggcgtcccttgtgggcgccttttttgtgcctgcgatttggcagtacatcgatcaaatcgaatttaaacaaaaaattgtagacattttttaagtcgattgtgaacagttgagcccttgtatcccgtggctcttggccaaaagtcgtagcgcagggcccttgacacctgtgactgcccagtcttgtagggactttgcgacacgcgtatcctcggcggtccgtcgaccaacagtaaaagcggaatgccgatatgtctgatttgaaaactgccgctctcgaatatcatgcccatcctcgtccaggaaagctgagtgtagagctcaccaaagccactgccaccgcccgcgacctttcgctggcctacagccctggcgttgccgagcccgtacgtgaaatcgcccgcgaccctgaactggcgtacaagtacaccggcaaaggcaacctggttgcagtgatttccgatggcaccgcgattctcggcctgggcaacctcggcccattggcttccaagccagtcatggaaggtaagggcgtgctgttcaagcgctttgccggcatcgacgttttcgacatcgaagtcgattccgaaagcccgcaggctttcatcgacaccgttaagcgcatttccatcaccttcggtggcatcaacctggaagacatcaaggcacctgagtgcttcgagatcgaaaaggccctgatcgaacagtgcgacatcccggtattccacgatgaccagcacggcaccgcaatcgttaccgcggccggcatgatcaacgccctggaaatcgccggcaaaaccctggctgacgcgcaaatcgtctgcctgggcgccggcgctgcggccatctcctgcatgaagttgctggtgagcatgggcgccaagctggaaaacatcttcatggtcgacagcaagggcgttgttcagtccgagcgtactgacctgaaccagtacaaggcgatgtttgcccacgcgaccgacaagcgcaccctggctgacgccctcgacggtgcagacgtgttcgttggcctgtccggcccgaacctgctgagcgccgaaggcctgaaatccatggcggccaacccgatcgtgttcgcctgctccaacccggacccggaaatctccccggagctggcgcacgctacccgtagcgacgtgatcatggccaccggccgttcggactacccgaaccaggtcaacaacgtactgggcttcccgttcatcttccgtggtgccctggacgttcgcgccaagcgcatcaacgaagagatgaaagtcgctgccgccaacgccctgcgtgaactggccaagctgcctgttcctcaggatgtatgcgatgcgtacggcggtgctccactggcgttcggtcgtgagtacatcatcccgaaaccaatggataagcgcctgatcaccctgatctccgatgccgtggccaaagccgccatcgagaccggtgtggccaccctgccgtatccgaagcactacccgctgcaaagcgtggatgatgtgttcaacggctaagccgttgtagcgcaccaacaaaaagccccggctctcgcgagttggggcttttttgtggctgtttgaatacggtcttcaaacgtcgggtaaaccctgtgggagtcgggcttgcccgcgatggcggtgtatcaggcagaccgctatcgcaggcaagccagctcccacatgatcgaccccacgcagagcgtgggaacgatcagtggcggttagaacaaatcgatcggcgccgcctcatccgccggcagcgggctgcccggtgcaacgccattgcccagctcgttgaccgatggcggcgtgtcttcgctcttgaacagttcgaagtacgcattcggcgtgcttggcgatgcggctcggccacttaccgggtcaatgcgcaggctgagaatgccttccggctcaggctgggtgtgcagcggcttgtccttcaaggccgcgcccatgtagctcatccagatcggcagcgcgacggtgccaccaaactcacggcggcccaggctttccggttggtcgtagccggtccacacggtggtcacgtagtcgccgttgtagccggagaaccaggcgtccttggagtcgttggtcgtaccggtcttgcccgcaatgtctgcgcggcccaaggccagggcgcgacggccggtgcctttcttgatgacgtcttccagaatgctgttgaggatataggtggtacggccatccaccacacgctcggcgaccgcaggtgcttgcggctcggtcggcgcggtggcattggccgctggcgctgtgcctggcgtcggctcaatggtgatgtcgccgttgctcggtgccgcgatgccatcgggcgccgccacgccattgaccacgtcacccggcacgcgtggcgggttggcggtgaacagggtgtcgccattgcgactttcgaccttgtcgatcaggtatggcgtgatcttgtagccgccgttggcaaaggtgctccagccggtggcgatttccatcggcgtgagggtcgcggtgcccagggccagggacaggttgggcggcaggtcggacttggcgaagccgaagcgcgtcatgtagtcgatggtcttgcccacgcccatggcctgcagcaagcggatcgacaccaggttacgcgacttgtacaacgcctcacggatgcggatcgggccgaggaatgtgttggtgtcgttcttcgggcgccagaccttgtccaggtactcgtcgacgaacacgatcggtgcgtcgttcaccaggctggcggcggtgtagccgttatccagtgcggcgctgtagacgaacggcttgaagctcgagcccggctggcgcttggcctgggtggcacggttgtagttgctttgctcgaaggcaaaaccgccgaccagggcgcggatcgcaccgttctgcgggtccagggacaccagggcgccttgggcgacagggacctggctgaatttcaggctgtcgtctttctggcgttgcacgcggatcaaatcacccacctgtgccacgtccgacggctgcttgggcatcgggcccatgctgttggtgttcaggaagggccgcgcccacttcatgctgtcccacgacacatggccttcgccggtgcgggtgagtacttgcacgccatctttcttcacttgggtgacgatggctggctccaggccgctgatcgggcgctgtttgcccagttcagtggtccaggcgctcagggttttgcccggcaggcgtgattcggggccgcggtagccgtggcgctggtcataagtgacgaggccgtcgcgtaccgcattgttggcgatttcctgcaggttgctcggaatcgtcgtggtgacgcggaaaccttcggtgtaggcctcgctgccatagcggccgaccatttcggcccgcgccatttcagcgatatagggtgcgttcacttccggcgtcggcacgtggtagctggcattcagcggttcggccacggcgctttcataggcggcctgatcaattttgcccagcttgtacatgcgccccaggatccagtcgcgacgctctttgctgcgcgccgggttggccagtgggttaaagcgcgaaggggccttgggcaggccggcaatcattgccatttgcgccaggctggcatcacgaatcgacttgccgtagtagacctgggaggcggcttcgatcccgtaggcgcggttgcccaggtagatcttgttcacgtacagctcaaggatttcatccttggtcagctgacgttcaatctgcagagccagcaggatttcagtggctttacgcgaaaagctgcgttcgctggtgaggaagaagttcttcgccacctgcatggtgatggtgctgccgccggattgaatgtgtccgctttttaccaattgggtggctgcacgcaccaggctgctggggtctacgccgtagtgattggcgaaattatcatcttcagccgacagcagggcgttgatgaaattgggcggaatgtcggcgaaacggatcggtgtgcggcgcatttcgccgaactccgcgatcagtttttcatcgctgctgtagacccgcaaaggaatctgcaactggatacttctgagtgcctctacggagggcaaacccggactaaggtagaggtaggccccgctgagtacgagcagcagcccgcagacgatcgcgacaatggagtacccgaaaaacttcagcagacgaatcaaggcttttggatttccagagaaaagaatgagttacgcgtcggggcatgcataacaaacgatggatcgacccgagcagcagaaaaaagcgggaaaaaacgctgggcattaaagcattttcggcctggggcgtcattcgcaccgctcaaacaagtcgaccgaatgcacgatgcccggcggcaatcaggcaatgactgccggtatgacagacaaagttttagggagttttatgagaaagggatttttcaggcgaaaagtcgacaccacgctaggcgtcgacatcaatgacaccggcatcaagctcatcgagctaggccggtccgccagcggttacagcgttcagagctatgccacccagcagttgcccgccaatgcggtcgtcgatggcactttgctggaccttgaagccgtagggcaggtactgcaactggcgttgtctcggctgaacacctcggctcggcaggctgcggtggcggtggcgggtccatcggtcatcacccgagtgattgaaatggcagcagggctcagtgacgaggaaatggtctggatgatccagatggaagccgatcagtacattccttacccattggacgacgtcgccatcgatttccaggtacgcggcccatctgcccaggaccctgcacgggtcgaggtattactggctgcgtgcctcaaggagcaagtcgaagcccgcgaagcggttttggcctcggccgggctggtgacacaagtcgtcgatgtcgaagggtttgcattggagcgcgcttgcagtcaggatttcgccagcttcacgccgggccatcgtgttgatggcgcacaatgggccgtggatgcccacgggatgggaattgcttgcgggttggccctgaggagtttcgctggatgacacgaatcaatcttttgccatggcgtcaggcgctggcagagcggcggcgcaaatacttcctggtatttctgctggcgttcgcctgtgtggcgctcgcggcggtgtggctggcggaccaagtgatcgatcaggcgattgaccggcaggtgacgcgtaacaatcacctgagcaaagacgtcaccattcaggattcgcgcatcaagaccatcgacgacttgcaggagcaaagccagcaactggctgcgcgcatgaaggtcgtgcaagacctgcacgaatcccgctcggccagtgcccagctattggatcaattggcccgcgcggtacccgatggggtgcatctgcatgaggtggtggccaagggcaacaccgttaaggtcagcggcagtgctgagtccagccaggatatcgcccaattgatgcgccgcctggaagcctctgaaggcgcccacgccactcggctgcagcacgtgcgtgcggaaggtcagggtggcggtaacgaatttcaattgatggtgcgccaaggcgaatccactgaggcccagccttgagcctgcccaggctcgacgtgttcacgctttctcacaatgctgctaaatggcccttgccgagtaaggttctactcggctgtgcgctggcggcgtccgtctggctggtgggcgatacctggctactggccccggcacgtgagcggctgaacacgctggaaacgcaggcagcggcgctgcaacaggcgctgacgcaaaacgctggtctggcagacaccgtcgagggccaggcccgtcaggcgcaggcaatgcaggaacaggtggccgggcttttacgacaactgcccggcgagtcggacatgcctggcctgctcgaagacattgcacggctggcggctgccaatggtttggtggtcgagggtgtcgcggtgttggacgagcaatcgcagccgctctatgtcgaggaaccgctgcagctcggtgcttttggcgcctaccacgacctggcggcattcttgagtggtttgggcgggctgtcgcggatcgtcactgtgcacgacgttgtgcttcggtctgatgggccgttactgcgccttgattttctggccaagacttatcggagcacattgccgtccggcagggctggccgggctgtcgagcaggggccgcgatttgtctacgacgcggctttcttgcgcgatccgttccagccgcccacatcacaggccgatcacgcgcggggccggccgacacgtgcaccggatttagcgcgtaagcgtggggcgctggaagccgtgcccgtcgaccggttcgaaatggtcggcacgttatctcgtggtgtgcagaccttcgccctgctgcgcgcagcctctggcgtgcaccggctggcggtcggcgactacctgggccccaaccatggccgagtcatggccattcatgagggccacctcgaactggccgaactgttcccggatgaacaaggcgcctggctggagcgctcgcgaaccctggtgttaaacgtcaactcataacggaatcaaacaatgaaaaggactttctcgtccttcggtgtggcgctatggatagcgttcacggcaccgatggcccttgctgtgcccaaccgtgtagatctgatccaactgccgccgccgggtcgcgcggtgccaagcacctatagcggtgacaagctgaacctcaacttccagaacatcgagttgcgtgcggtattgcagcagatagcggatgtggccgggctcaacctggtcaccagcgacgaggtgcaaggctcgatcaccctgcgactcaaggatgtgccctgggatcaggcgctggacctggtgttgcaaaccaaagggttggacaagcgcgtgaaagccggcgttttgctggtggcgcccgccgaagaattggccgcccgtgagttgctggtgttggagtcgaacaagcagatggccgacttggcgccattgcgccgggagctgttacaggtcaattacgccaaggccgcggacctggccaagctgtttcagtcggtgacgaccctggatggcctcaccgacgagcgcggttcagtggcggtggatgaccgcaccaacaatatcattgcctaccagaccggcgagcggctcgaagagctgcgacggatcgtggcgcagctggatattccagtgcgccaagtaatgattgaggcgcgcatcgtcgaagccaatgtcgattacgacaaaagcctgggcgtgcgctggggcggacgccttaatcgtggcaattggggcgcgggcggcatcggcaagccgttggccgagggcgttgaaccaccggcgagcccgtccagctcgccgtttgttgacttgggctcactcaccggcactgcgggtttgggcattgcctatatcaccgacaacctgttgttggacctggaactgacggccatggagaaaaccggcaacggcgaaatcgtctcgcagcccaaggtcgtcacctccgacaaggagaccgcgcgcatcctcaaaggcaccgagattccctatcaggaagccaccggcagaggcgccacgtcggtgtccttcaaggaggcctcgctgtcgttggaggtgaccccgcaaatcacgcccgatggctgggtgatcatggaggtcaaggtcaccaaggatgagcccgactacctgaacaaactcaacgacgtgccgccgatcaagaaaaacgaagtcaacgccaaggtgctggtcaaggacggcgagaccatcgtcatcggcggggttttctccaatacccaaagcaaagtggtagataaagtgccatttttgggcgatgtgccgtatcttggccgccttttccggcgcgatgttgtggcgcaaagaaaatccgagctgctggtattcctgactccgcgtattatgaataaccaggcgattgctgtgagtcgttgattctgtgcgaaatttgattcttgtaggaccgatgggggctggaaaaagcaccatcggccgtttgctggccaaagagctgcgcctgccattcaaagattccgacaaggaaattgaattgcgcacgggtgccaatatcccatggatcttcgataaggaaggcgaactgggctttcgcgaccgcgagcaggcgatgattgccgagctgtgcggctgcgacggcgtggtattggccaccggcggcggcgcagtcatgcgcgatgaaaaccgccgggcgctgcacgccggtgggcgcgtggtctacctgcatgcgtcggtcgaacagcaagtgggccgcaccgcccgcgaccgcaatcgcccgttgttgcgcactgccgatccggccaaaaccctcagggatctgctgacgttgcgcgatccgctctatcgggaaatcgccgatctggtggtggaaaccgatgagcggccgccacgaatggtggttctcgacattcttgagcgcttgcagcagttgccaccccgttaaagccagacccgaaatgcgctattctcggcggcgcgctatcagccttcggggtgtggcgcagagccatcaggcgacgtcagatccgagcgttgccgatcgtacatatatcttcacgcggggacacatgcagacacttaaggtcgatctaggcgagcgcagctacccaatccatattggcgaaggtttgttggacctgcctgagctgctcgcaccgcatattgccgggcggcaagtggcgatcatctccaacgaaacggtcgcgccgctgtatcttgagcgtctgagccgcagccttgcggcgtactcggtgatttcggtgatcttgcctgacggcgaggcccacaagaactgggaaaccctgcaactgatctttgatggcctgctgactgcgcgccatgaccggcgaaccaccgtggttgccctgggcggcggtgtgatcggcgacatggccggctttgcggcagcctgctaccagcgcggcgtggactttatccaggtgccaaccaccttgttgtcccaggttgattcgtcggtgggcggcaagaccggcatcaaccacccgctgggcaagaacatggtcggtgcgttctatcagcctcaagccgtgctgatcgacactgcgaccctcaacaccctgccaccgcgcgagttgtcggcgggcctggccgaagtcatcaagtacgggttgatctgcgacgagccgttcctgacctggctggaagagcacatggacgccctgcgcgccctggaccaagtggcgctcactgaagcgatttcccgctcctgcgccgccaaggcgctggtggtgaatgccgacgaacgggagtccggcgtacgcgctacgctgaacctgggccacaccttcggccatgcgatcgaaacgcacatgggctatggtgtgtggttgcatggggaagccgtggcagctggcaccgtgatggcattggacatgtcgcagcgtctgggctggatcagcgcccaagagcgcgatcgcggcatccgcctgttccagcgcgccggtttgccggtcgttccacctacggagatgaccgaggcggatttcctcgaacatatggcaatagacaagaaagtgatcgacggtcgcctgcgactggtgctgctgcgccacatcggcgaagcggtagtgaccgacgattatccgaaagagattttacaggccacgctgggagcggattaccgcgccctggcccagcttaaaggttaataagatcccgatgactagtttgcatgccgacgaggcgttcctcggccattaccagttaagccacgacccttttgctccacgggtgccgggcttcaaatttttccctgcccagcgcaagccggtgctcggccagttgcaccatttggcgcgctacagccagttgctgctggtggtcactggcccgttgggcagcggcaagactctgctgcgccaggcgctggttgccagcaccaacaagcaatcggtacagagcgtggtggtgtcggcccgtggtgcgggtgatgcggcgggcgtgttgcgccaggttgcccaggcgctgaacgtggcgaccgccgagccgaacgcgatcctcaagcaagtggtgcaactgggcctaaccgggcaggaagtctacctgctggtggacgacgccgagcagctcgacgaatccgccctggaggcgctgctggcgctggcggcgggtacacctgaaggccgcccgcatgtgttcctgtttggcgagtcgtcgttgatcgccgatctggagcagatcagtggcgaccaggagctgtttcacgtcatcgaattgcagccgtatgaagaggaagaaacccgcgaatacctggctcaacgccttgagggcgctggggcgggtatcgaacttttctccgctgcgcagatctctgatattcacgaaagctccgacggctggcctggcaccatcaaccaggttgcccgggatgccttgatcgaagccatgattgcaagccgctctgcggttaagcgtccaaagatggggtttactatgcctaagaagcacgtattggctatttccgccgttgtcgtggtcgctgtcgccgccgcctggttgatcccaggtcgcagcaaggcacccgccaccgccggcgcgccaaccgaacaggcgcagttgccactgggcaagcccacgccaaatgtcgaattcgccaactccggccaaccgaccaatctgccaatggttggccagcctgtcatgcgcggcccgctcgccgaagaagccggtggcatctccgaaggcgacgacggcgtgccggtggaaggctccagcgccacgccgccgaccgtgaccacgaccgcgccgcctgcgggcgtacccgccggtcaaccagcggctccggttgccaagccgaccccggctccgaccgttgccaccgccaagccggcgccggttgccaagcctgttgcacctgcgccagccgccaaaccggcaccggctgccaagcctgctgagaaaccagcggccactgtcgccaaggccggcgccgctggcagcagctggtacaccagccagccgactggcaacttcgtggtgcagatcctcggcaccagctccgaagccaacgcccaggcgttcgtgaaagagcagggcggcgagtaccgttatttcaagaaagtactcaacggcaagcctctctacgtgatcacttacggcaacttctccagccgtaccgcagctgaatccgctatcaaggccttgccagcgaaggttcaggctggtaaaccttggcctcgcactgttgccagcgttcaacaagaactcgcaacaactcgctgaagattcggcggccttacccaggccgcctctcccggcacctcaaaaaaacgacaaagcgtgcagccctgaaggccgcgcgctttgtggtgtctgcgtcacgtagcttttgagtcgtagcggtcagaattaaaaaagttttgactagcacagcatatcgctttaaacctttcataaatgcgacatagatttgcgacatttcgtcgctaaatttgtgagcgttcgtgtcggtgtgtacaatgacctcccttttgcccccgctaagccggcgtacgttcggcgtggaaggtaaccggttgaattgaaaagaaatttgcctcggtataagaggcagcctggtgagaaagtgtctatgaaagcaggtctgtaccaacccgatgaattcaaggataactgcggtttcggcctgatagcccatatgcagggcgagcccagtcatacccttttacaaacggccatcgaggccctgacctgcatgacccaccgcggtgggatcaacgccgacggcaaaaccggtgacggttgcggcttgctgattcaaaagcccgaccagttcctgcgcgctgtcgcaaaacaacaatttgcagtcgacctgcccaagcagtacgccgtgggcatggtgtttttcaaccaggacccggtgaaagccgaagccgcccgcgagaacatgaaccgcgagatcctggctgccggcctgcaattggtaggctggcgcaaagtgccgatcgacaccagcgtgctcggccgcctggccctggagcgcctgccgcagatcgaacaagtgttcatcgcaggcgatggcctgagcgatcaggacatggcgatcaagctgttcacctcgcgtcgtcgctcgtcagtggccaacgctgccgacaccgatcactacatctgcagcttttcgcacaagaccatcatttataaaggcctgatgatgccggcggacttgaccgccttctatccagacctgagcgatgagcgcctgcaaaccgcaatctgcgtgttccaccagcgcttctccaccaacaccctgccgaaatggccgctggcccagccattccgcttcctcgcccacaacggcgagatcaacaccatcaccggcaaccgcaactgggctgtggcccgtcgcaccaagttcgccaacgacttgatggacctcgaagagctcggcccgctggttaaccgcgtgggttccgactcttccagcatggacaacatgcttgagctgatggttaccggcggcatcgacctgttccgtggcgtgcgcatgatcattccgcctgcgtggcagaacgtcgagaccatggacccggacctgcgtgcattctacgagtacaactcgatgcacatggagccgtgggacggcccggccggcgtggttatgaccgacggccgctacgcggtgtgcctgctcgaccgtaatggtctgcgcccggcgcgttgggtcaccaccaccaacggtttcatcaccctggcgtcggaaatcggcgtgtgggactacaagcctgaagacgtgatagccaaaggccgcgttggccccggccagatcctggccgtggacaccgaaaccgggcagatcctcgacaccgacgccatcgacaaccgcttgaagtcgcgtcacccgtacaagcaatggctgcgcaagaacgcgctgcgcatccaggcgaccatggaagacaacgaccacggttcggctttctacgacgtcgaccagcttaagcagtacatgaagatgtatcaggtcacgttcgaagagcgcgaccaggtgctgcgcccgctcggcgagcaaggctacgaggccgtcggctccatgggcgatgacacgccaatggccgtgctgtcccagcgcgtgcgcacgccgtacgactatttccgccagcagttcgctcaggtgactaacccgccgatcgacccgctgcgcgaagccatcgtgatgtccctggaagtgtgcctcggtgccgagcgcaacatcttccaggaatcgcctgagcacgcttcccgcgtaatcctcagctcgccggtggtttcgccggccaagtggcgctcgttgatgaccctggagcgcccgggcttcgaccgtcagatcatcgatctgaactacgacgaaagcctcggccttgaagccgctgtgcgcaatgtcgccgatcaggccgaagaggcggtgcgcgccggtcgtacccagatcgtgctgaccgaccgccacattgccccaggcaagctgccgatccacgcttcgctggccaccggcgcggtgcatcaccgcctgaccgaaaaaggcctgcgttgcgactccaacatcctcgtggaaaccgccactgcccgtgacccgcaccattttgcggtgttgatcggcttcggcgcctcggcggtgtacccgttcctggcgtacgaagtgctcggcgacttgatccgtaccggcgaagtgctgggcgacctctacgaggtgttcaagaactaccgtaagggcatcaccaaaggcctgttgaagatcctgtcgaagatgggcatctccaccgtcacgtcctatcgcggcgcgcaattgttcgaggccatcggcctgtccgaagaagtctgcgagctgagcttccgtggtgtgccgagccgcatcaagggcgcgcgtttcgtcgacatcgaagccgagcagaaagccctggcagccgaagcctggagcgcgcgcaagccgatccagcaaggcggcctgctgaagttcgtgcacggtggcgaataccacgcctacaacccggacgtggtcagcaccctgcaagccgctgtgcagcagggcgactacgccaagttcaaggaatacaccgcgctggtggataaccgcccggtgtcgatgatccgcgacttgttcaaggtgaaaaccctggacacgccgctggccatcagcgagatcgagccgctggaatcgatcctcaagcgcttcgactccgcgggtatttccctgggcgccttgtcgcctgaggctcacgaagccctggccgaagccatgaaccgcctgggggcgcgttccaactccggcgaaggcggcgaagacccggcgcgctacggcaccatcaaaagctcgaaaatcaagcaggtggcgaccggccgtttcggtgtaaccccggaatacctggtcaacgccgaagtgctgcagatcaaagtcgcccagggcgccaagcccggtgaaggcggccagctgccaggcggcaaggtcaacggtttgatcgccaagctgcgttacgcagtgccgggcgtgaccctgatttcgccgccgccgcaccacgacatctattcgattgaagacttgtcgcagctgattttcgacttgaaacaagtcaacccgcaggcgctggtctcggtgaaactggtagcagaagccggcgtgggcaccatcgccgctggcgtggccaaggcctatgccgacctgatcaccatctccggctacgacggcggcaccggcgcttcgccgctgacctcgatcaagtacgccggtgcaccgtgggaactgggcctggcggaaacccaccagaccctgcgcggcaacgacctgcgtggcaaagtgcgagtacaaaccgacggcggcctgaaaaccggcctcgacgtgatcaaggccgcgatcctcggcgcggaaagtttcggcttcggtactgcgccgatgatcgccctgggctgcaaatacctgcgcatctgccacctgaacaactgcgccaccggcgtcgccactcagaacgagaagctgcgcaaggaccactacatcggcaccgtcgacatggtggtgaatttcttcacctacgtcgccgaagaaacccgtgagtggctggccaagctgggcgtgcgttcgctggaagagctgatcgggcgtaccgacctgctcgacattctcgaaggccagaccgccaaacaaaaccacctggacctgacgccgctgttgggcagcgatcacatcccggcagacaagccacaattctgccaggtggaccgcaacccgccgttcgacaaaggcctgctggccgagaagatggtcgacatggccggttcctcgatcaacgacgccagcggcggcgaatttgccctggatatctgcaactgcgaccgttcgatcggcgcacgcatctccggcgaaatcgcgcgcaagcatggcaaccaaggcatggcgaaagcgccgatcacgttccgcttcaacggcactgccggccagagcttcggcgtatggaacgccggcggcctgcacatgtacctcgaaggcgatgccaacgactacgtgggcaagggcatgaccggcggcaagctggtgatcgttccgcctaaaggcagcatctacaagactcaggacagtgccatcatcggcaacacctgcttgtacggtgccaccggtggcaagctgttcgccgccggtacggccggtgagcgtttcgccgtgcgtaactccggtgcccacaccgtggtggaaggcactggcgatcactgctgtgagtacatgaccgggggctttgtcgcggtactgggcaagaccggttacaacttcggttcgggcatgaccggcggtttcgcctacgtgcttgaccaggacaacaccttcgtcgacaaggtcaaccacgagttggtcgagatccagcggatcagcggcgaagccatggaatcctaccggaaccacttgcagcacgtgctggatgagtatgtcgaggaaaccggcagcgaatgggggcgtaacctcgccgaaaacctcgatgattacctgcgtcgtttctggctggtcaagcccaaggctgccaacctgaaatcgttgctttccagcatccgtgccaacccgcagtgatatgcgcctgaacagtttgatgaggttttaacatggctgaacgtctgaataacgacttccagttcatcgatgtcgggcgcaaagatccgaagaagaaactgttgcgtcaacgcaagaaagagttcgtggaaatctacgaacccttcaaaccccagcactcggccgaccaggcccaccgctgcctgggttgcggtaacccgtattgcgaatggaagtgcccggtgcacaacttcattcccaactggctgaaattggtggccgagggcaacatcctcgccgccgccgagctgtcgcaccagaccaacaccttgccggaagtgtgtggccgggtgtgcccgcaagaccgtctgtgtgaaggtgcctgcaccctcaacgacggcttcggcgcggtgaccatcggttcggtcgagaagtacatcaccgacaccgcgttcgccatgggctggcgcccggacatgtccaaggtcaaaccgaccggcaagcgcgttgcgatcatcggcgcaggcccggcgggcctgggctgtgccgacgtgctggtgcggggcggcgtgaccccggtggtgttcgacaagaacccggaaatcggcggcctgctgaccttcggtattcccgagttcaagctggaaaaaactgtactaagcaaccgtcgtgaagtgttcaccggcatgggtatcgagttccgcctcaataccgaaatcggcaaagacatcaccatggaacaactgctcgccgaatacgacgcagtgttcatgggcatgggcacctacacctacatgaagggtggctttgccggtgaggacctgccgggcgtgtatgatgcgctcgacttcctgatcgccaacgtcaaccgcaacctgggctttgaaaagtcgccggaagatttcgtcgacatgaaaggcaagaaggtggtggtgctgggcggtggcgacaccgcgatggactgcaaccgcacgtcgatccgccagggcgccaagtcggtgacctgtgcgtaccgtcgtgacgaagccaacatgcccggctcgcgcaaagaggtgaagaacgccaaggaagaaggcgtgaaattcctctacaaccgccagccgatcgctatcgtcggtgaagaccgtgttgaaggcgtgaaagtggtcgagacccgtctcggcgagccggacgcccgtggccgtcgtagccccgagccgatcccgggctccgaagagatcatcccggccgacgccgtggtcatcgccttcggtttccgcccaagcccggcgccgtggttcgagcagttcgaaatccagaccgacagccagggccgcgtcgtcgccccggaacaaggccagtacaagcaccagaccagcaacccgaaaatcttcgccggtggcgatatggtgcgtggttctgacctggtggtgacggcgatcttcgaaggccgcaatgctgctgaagggatcctggattacctcggcgtttaagcctcggtacgcttcacacaagcgggcttgttccttacggacaagcccgcttttgcgttttattgcttacgttttttaacgcgcctcatcaccaccacaaaaaacaccggtacaaacaccacggccagtgttgcgctgatcatcccgccgatcacgcccgtaccaatggcttgctggcttgccgagccggcgccggtggcaatggccagcggcaccacgcctagaataaacgccatcgaagtcatcacaattggacgcaaccgcagccgggcggcttgcagcgtggcgtcgatcaggtcgtggccctcatcgtaaagtgtcttggcgaactcgatgatcaggattgcgttcttcgccgacaggccaatgatcgtgatcaaaccgaccttgaagaatacgtcgttgggcatcccgcgcagcgtgactgccagaacagcgccaagcacaccaagcggcacgataagcaacacggatgtgggaatcgaccagctctcgtatagcgccgccaggcacaggaacaccaccagcagcgacaggccgatcaggatcggcgcctggttgccggacaagcgctcctgcaatgacagccccgtccattcctgcccaatgcccgcgcgcgcctgggccaccaggcgttcgatttcggccatggcttcgccggtactgtaaccgggcgcgggttcgccggagatgctcaccgaggggtagccgttgtaacggttcaattgcgcaggcccttgagcccatgtggcttgaacgaacgtcgaaaggggcaccatttgtcctgcgttgttgcgtacgtgcatcttcagcaagtcattaacctgttgacgttggtcgccttcggcctgcaccaccacccgttgcatacggccctggttgggaaagtcattgatgtaggccgaaccgatgccggtggacatcaggttgccaatgtcggcgaaggagacaccgagcgcgttagcatgtcggcggtcaatatcgagtttgacctggggggcctctgccagcgcgctttcgcgcacatctgtcaggatcgggctggcttgcgccgcttccagtaaatcgttgcgagcctgcatcaaggctgcgtagccaaggctgccacgatcctgcaaacgcaactcgaaaccgctggaactgccgagaccgcgaatcggtgccggcgacaccaccagcacctcggcttgcttgatttgactcaaggccgcgttggctcggtcgatgattgcggctgcagagtcattactgccccgccaggaccaacccttgagcaccgcgaaacccaacgccgcgttctgcccattgccggaaaagttgtagccgagaacgaatgtgctgttgtccatggcaggttccgtggcgaaatgtgcttcgacctgtttgacgacctctaccgtgcgactttggctcgctccggggggaagttgaatgtcgatgatcacaaagcccttgtcttctttcggaagaaacgaggcgggcagttggctgaagctcactaccagcaagagcagaagggctgcatagatgaacaaatagcgcccgctgcgtttcaaggcatgagtcacccagccttggtaatgctcggtcagttgttcgaaccggcggttgaacccggcgaagaaccgtgcagaggtgtgatcacccgcggccacaggcttgagcagcgttgcgcaaagcgcgggtgtgagcgtcagcgcaaggagcgccgagaacagaatggatgtggccatggtcagcgaaaactgctggtaaatgaccccgacggacccctgcataaatgccatcgggataaataccgccaccagcaccaaagtaatgccgacgatagctccgctgatttgtttcatcgccttgcgcgtggcttccctgggcgagagccgctcctgcagcatgatgcgttcaacgttctccaccaccacaatggcgtcgtccaccaggatgccgatcgacagcaccatgccaaacatggtcagcacgttgatggaaaatcccatcagtaacatgagcgccaaggtgcccatcaatgcgaccggtacaaccagggtcggaatcaatgtgtaacgaatattttgcaggaacaggtacatcaccgcgaacaccagcaccatggcttcgagcagtgtgtacaccactttagtaattgaggctttgacgaacggcgagctgtcgtaaacgatctggtacttcatgctggcaggaaagtagcgtgacaactcgtccatcttctcgcgcacgcgtgttgccgtactcaactcattgccgtcaggcgtcaattgcacgcccaactcgctggacggtcggccattgagtcgggtgccgaactggtattcctggctgcctatttcaacccgggcaacatcgccaaggcgcacgacagccccgttgggctcggctctcagcacaatgtcggcgaacgcttgcgggctcgacagttggccctcagccaggacggtcgcggtgatttcctgggtattggcagcgggtaactcgcccaggctgccggcggctatcaaagtgttttgagccgcaattgctgcgttgacttctgcgggtgtcaggttgaaagcgatcaacttttgcgggtcgacccagatacgcatggctcgctcagcgccgaacaactggactttcccaacgccctccacgcgcttgatttcgttgatgacgttacgtgccaggtaatcgctgaggtcaatgctggtgacattctcgtcggtgccgataagcgaaacgaacagcaggaagccggtggatgctttctccacgcgcaagccctgttggatcactgcttgtggaaggcgcgattcgacggctttcaggcggttgagcacatcgacctgcgcaagatccgcaggggtgcctggcttgaatgtcgcagtgatcgtggcggtgccttggctgctgcttgattcgaaatacagcaggtgatcagccccgctgagctcttcttcgatcaggctgacgacactttggtccatggcctgcgccgaagcaccggggtagttggcgacgacttcgatgcgcggcggcgcaatgttggggtactgcgccacggggagctgtggaatcgccagaacacccgccagcaggataaacagggcaatcacccaggcgaataccgggcggtcaataaagaattgcggcatgcgctagcgtccttttgactgaccaatagcctggtcgagtggaagagcgccgttgtcgatcaccacgtgttcgcctgggcgggcatgttgcaagccttcgacgacgattcggtcgccggatgtgaggccgtcggtgacaatccaccggttctggtgcacagcgcccagttgcacggttcgcaggctcacacgcagttcctcatccaccagcagcacttgagccagcccggcgctgttacgcaggatggcgcgctgcggcacgctgataccttgttggtcgatggcgtgctccagccgcacacgcacgaagctgccgggcagcaaatcgaggtcggggttgggaaactcgctgcgcaggatgatctggccggtgccggggtctactgaaatgtcgctgaacagcagcttgccgggcaacgggtacgcgctgccgtcgtcctgcagcaaggtggccttggcctggcccgggcccggttgttgcaactggccggagcggaatgcgcggcgcagttcgttgagttcacgggtcgattgcgtcaggtcgacatggaccgggtccaactgctggatcagcgccagcggggttgattcgttctgtccaaccaaggcaccttcggtcaccagggcacgcccgatgcgcccggagatgggcgcggtcacggtggcataactcaaattcaggcgcgcgcgttgcaccttggcctcgttggctgcgacgtcagcttcagcctgccgtgcggccgcgcgcgcgttgtcatactcctgagcactgatcgccttggctgagatcaactggcggtaacgctgttcttgctgacgtgcgcgtaaagtatcggcttgcgaccgtttaagcccggccagggcggtgtccagatccgcctgcagcggcgccgggtcgatgtagaacaggacgtcaccctgtttcacgtcaccgccttgcgcgaacacacttttgagcaccaccccagccacccgagcgtttacctgtgccgttcttggtgcggcaatgcgcccactgagctcgctgctgatggaaatgggtttggcttgcagggtttctgtgctcacctttacgggggcggatgcctgcggctcgggtgcctgggtgcaaccgctcgcagcaatggccaacaccactgaagcggatgcgaaacgcaactttctatacatcgacatgcctccataaagaggcatggatgctaggaacgagcagttaattcgcggttaaaccgaggttggaagagtgcgagcaaatgtgacccttagtttcaaatctttgcagagaagaagctcaggtgtgacgttccatcaccgcgacaaattgacccgatagacaaaaggcacggctcactccgtgccttttgcgtcgcgctctgagaaaatgcccgcactttttttgcggatgccgacatgactgccctcaagaacgaccgtttccttcgtgccctgctcaagcaacccgtagacgtcacgcctgtatggatgatgcgtcaagccggtcgctacctgccggaataccgcgccagccgcgccaatgccggtgatttcatgagcctgtgcatgaacccggagttcgcctgcgaagtcacgatgcagccgctggaccgctacccacaactggacgcggccatcctcttctccgatatcctcaccattcccgacgccatgggccagggcctgtattttgaaaccggcgaaggcccgcgtttcaaaaaggttgtcagcaccctggccgacatcgaagcgctgccgatccctgatccgcacaaagacctcggttacgtgatggacgccgtcagcaccatccgccgcgagctcaacggccgcgtgccgctgatcggcttctccggcagcccttggaccctggccacctacatggtcgaaggcggttcgtcgaaagacttccgcaagaccaaggctatgctctacgacaacccgcaagccatgcacctgctgctggataaactggcgcagtcggtcaccagctacctcaacggccagatcatggccggcgcgcaagcggtgcagatcttcgatacctggggcggcaacctgtcgtcggcggcgtatcaggaattctccctggcctacatgcgcaagatcgtcagcggcctgatccgcgaacacgaaggccgcaaagtgccggtcatcctgttcaccaaaggcggcggcctgtggctggaaagcatcgccgatgctggcgctgacgcgctgggcctggactggacctgcgacattggcgaagcgcgccgtcgcgttggcggccaggtcgcgctgcaaggcaacatggacccgaccgtgctgtacgccaatccggaagcaatccgcaccgaagtcggccgcatcctggccagctacggcaagggcagcgggcacgtgttcaacctcggccatggcattacgccggaagtgaacccggagcacgccggcgcgttcctgcgcgcggtgcatgaactctcggcgcagtaccacgagtaacaaaaagcccggcagatgccgggctttttcatggataaacacaaaacaactgtgggagctggcttgcctgcgatggcggtggtgaactcaccaccgccatcgcaggcgagccagctcccacataaaagcaggaacgcctcaggcctgcacattccccagcggcggcaacttcgccagcttcaacgccaccagcagcgcgccaatcaacagcgccacgataaacccgccaatcccgttccacccggcaaagtgccagaagaacccgcccgctgtaccggcaatactcgaccccacgtagtagcaaaacaaatacagcgacgacgcctgccccttggccttgaccgcgcggcggccgatccagctgctggccaccgagtgcgcgccgaagaagccgaaggtgaagatcagcatgcccggcaccaccagccacaacggggtgaacagggtcaggctcatgccgccgagcatcaacacaatcgtgccccacaacacgcggcggcggccgaggcggtcggccagcgaaccgatttttgccgagctgtagatgcccgtcaggtacaccagcgagagcaggccgaccaccgcctggctcagcccgtacggctctgccaacaggcgataaccgatgtagttgaacatcgtgacaaaagcgcccatcagcaggaaaccttcaagaaacaaccacggcaggcccgcgtccttgaagtgcatgacaaacccattcagcaggttgcgcggcttgaggctgctggtgcggaagttgcgcgattcgggcaggaccttccagaacaccgtggccgcgatcagcgccagcgcgccgatgatcagcattgcggtgtgccagctgacgaagtcgatgagtacgccgatgatcaaccgcccgctcatgccgccaatggcgttgccgccgatatacaggcccatcgccaggccgatgtgttgcgggtggatctcttcgcttaggtaggtcatcgccacagcggccaggccgctcaaggacaagcccaccagcgcgcgcatcagcagaatcccctcccaggtcggcatcaggccgctggcgatggtcgccagcgcggcgcagaacagcgcgcagaccatcaccggcttacgccccagccggtcggaaatcggcccggtgaccagcaagcccaacgccagcatcgccgtggccaccgacaggatcaggctgctttgcgcggcattgatggaaaactcgtgggacaacgccggcatcatcggctgcacgcaatacagcagcgcaaaggtggcgaaccccccggaaaacagcgccagcaccgtgcgcatgaacatcggcgtgcctttttcgatgtactgctcgttgagctgggccaccacctcatccagggcggtaggcgggacttcttgagcaaatggagcgacagcagatttcacggggacctcggcgagggaaagcctgccagaactggcaatgcgaaaaagaatatagctgcctaatgattctttccaatatattgttcgacctgtttgatagcttttacgacctaatgaggtttgcatggaattgcgtcacctgcggtacttcatcgccgtcgccgaagagctgcattttggccgcgccgcgcaggtgctgggcatctcgcagccgccgctgagccagcaaattcaggcgctggagcacgaggtgggcgcgcgcttgtttgagcgcaccaatcgtcgggtcgagctgagtgaggcggggcggttgttcctgcacgaggcgcgattggtactggcgcaggtcgacaaggcgtcggacgtggcgcggcgtgcgcagttgggcgagctgggggagctgaagatcggcttcacttcgtcggcgccgttcaacgccagcattccgcaggcgatcttcgcgtttcggcaggcgtttccggcggtgcatttgaatctgcaggagatgagcagcaccgaagtggccgagtcgctggtggatgagtcgatccaagtggggctgatgcgcccgctgccgttgccggattcgctgaatgtcatcgagctgatgcgtgaaccgctggtcgccgtgctgaatgccggtcacccgctggtggacggcagcgagcgcggcttgcatctggcgcaactggcgcaggaaccgtttgtattcttcccgcgcacctatggcagcggcctgtacgcccaactgctcaacctggcgcgggacgccggtttcagcccgcacttcgcccaggaagccggggaggcaatgaccatcatcgggttggtggcggcgggcttgggggtgtcggtgctgccggcgtcttaccagcggattcgaattgatggcgtggtgtatcgcaccttgctcgatcaggaagcggtgacggccgtgtggctggtgcaacgcaaaggcgcgcaaaccccgatggccaaggcgtttgtggaactcttgacgcgcaaagcggtggtgtaggcactgtcacatatcaggtaacgcaaccggcttagtcattcgcaagaatgttgcgcagaatcgctttttttcaagcgagtgatatggatggcacttctttatcagcccaaggagggcagcgtgttgatttgtgattttcgaggctatgaggtcccggaaatcatcaagattcgacccgtcattgtgatacgcaagcaccgaaccaataagctgctggtgaccgtagtgcccttgagcacaaccgctccgcaaacgcttctggagcatcatttgcagctcgacagtcatcttcagggcgcgaaccccatctgctgggcaaagtgcgacattgtcgcgaccgtaagcctggggcgactggatcgaatcaaaagcaaagaccgtcatggcaaacgaacttacaaaatcgcagagctcaccagcgagcagtttttagcgataaaggcggcggtgcgcagtgcgctggggttgcgatgaagtggatcagagatgagcggcgctttgccaccgattgcaggcgagctgttttcaggcatactggccgagttcccgaaaggggcttgtgagactctgaggatcctgggtaaccagccatcgcagagccaggcaggacgcggcgatgacaagccaacctgtttgtgaagagggcgccgaaaggcgccctttgtcgtttccgacgggctgaaatgctcagttctgcttcgacgtccccgtctgctcaaacaactgcgccgccgacccggcctcattcacgccattgctgcgcaaacccgccatgatgtcgctgtccaagttattcacccagcggttgtagttgcgatggatcttgccgtccttgtagcccaggtcgctgctgtcgcggtaggtgatggcgtagctgttgcgggtgtagcggatgtcgattgccgcgtagtactggttacgcacggtgatctcggcctgcaccagttgcgggccgaaacgttgcacggtccactcgcgtttttgcagggccgtgacaatcacctgtttcattttttcttcgctgacttgagcgtcggccggcagcgcatgctgggtgttgagcaccggtttagtggtgcacccggcggtggtcagcagggccagggtgatcagggtggcacgtagcaaggaagacattccgttttctccaatcgattaaaaattcaggaccagcggcgaaaaatcagcgaagtgttgacgccgccgaacgcaaaattgttgttcatcacgtagtcgttgtgcatctcgcgaaacccaccttgcaggtaatccagctcgccgcattgcgggtcgaccgaatcgaggttgaaggtgtgcacatactggtcgcggttcatcatttcgatgctgaaccacgattccagcgcgccgcacgcgcccaaggtgtggccgaggaaactcttctgcgagctgatcggcatgcggctgccgaacaggctgctggtggccagtgtttcggcgatatcgccttgatcggtggcggtgccatggccattcacgtagccgatggccgaaggctcaagccccgcatcttcgagggccagctccatcgcgcggcgcatggttttctgctccgggcgcgtggtgtgctggccgtcggcgttgctgccgaaaccgaccagctcagcgtggatgtgcgcaccgcgtgccagcgcgtgttcgagttcttccaacaccagcatgccgccgccttctccgatcaccaggccatcacggccgctgtcataggggcgcgggctggtctgtggcgcgtcgtttttcaggctggtggcgtagagcgcgtcgaacaccatcgcttcagtggggcacagttcttcggcgccaccggcgagcatcaacggcaggcggccgaacttgatcgcctcgtaggcatagccgatgccctggctgccgctggtgcaggcgctggacgtggggatcaaccggccggtgaggccaaagaaaatgctgatattcgccgccgtggtgtgcggcatcatgcgcacatacgagttggcattcagcccctcggccaccgagttcagcagcatattgccgaacgccttgatctcatcggtgctgccggtggatgagccacaggccacgcccatgcgcccgtccttgatcgactcgtcgccgagcaagccggcgtcctgcaacgcctgctccgctgcccagacagccaggcgcgagacgcggcccatgctgcgcagttgcttgcgcgtccagtgcgcaggcacgacgaagtcatcgatcggccccgccaggcgcgtgttcagttcagtaaaacggtcccactcgtccatgcgccgaatgccgctgcggttggcgcgaaagttggcggcgatggtgtcccagtcgcagcccagggaggttatgccggccatgccggtgacgacgacgcgtttcatcagcacaggcccccgttcacggccaagacttggcgcgtgatgtaagcggcctcggccgacatgaggaaattcactgcaccggcgacttcttccggggtgcccatgcgctgcgccgggatcattttcatcagctcttccaccggcacgttttcatcgagcatggcggtgtcgatcaagccaggcgccacgcagttgacggtgatcttgcgcttgcccaactcgatggccagcgccttggccgcgccgatcaggccagccttggaggcgctgtaattcacttggccacggttgccgatcaaccccgacacagacgtgatgcagacaatacggcccgccgcgcgacgacgaatcatcggcatcatcaccgggtgcagcacgttgtaaaaaccatccagattggtgcgcataaccacgtcccaatcgtcttcggacaaggccgggaacgcgccgtcacgggtcaggccagcgttgagtaccacgccgtaataggcgccatgctgctccacatcggcctcaaggatttgcttgcacgtggcgcgatccgccacatcgaattgcagcacccgcgccttgcggcccagggcttcgatctcgacctgcaccgcgtccgcttcaacgcggccactgcggcaatgcagcacgatgtcgtgcccggcctgcgccaggcgcagggcaatggcgcggccgatgccacggctggagccggtgaccagtacggattcagtcatggcgtttcgtccttcgattcatctaaatagttggccgcctggggcggtcgaaatacgttcaagcgcgcgctggcctggatcccgtcgccggtcaggtggcattcgaaaacacccatgccgttgtcgtcttccagcgagcgcaggccgtggatgcgcagctcggcaccggccgggaaatgttccacgttgcactcaaacttacgtgtgcccaacaggaaacccagttccaccgcttcgcctttttggcgcgcgcggcaaccggcataggcggcgacgctttgcgccatcagttcaataccgacccacgcaggcaggctgccgtccggccgattgaacaggccaccgggcttgacggtggcgcgggtgtgcacctgctcttcatcgaacgacagaacctggtcgatcaggatcatgtcgcccgcgtggggcagcagttcggcgagtggccaatcgatcatggggcctctgcgattatcaggctgacgttgttaccgccgaaggcaaacgagttgctcatcaggcagcgctttttcaaggtgtcgccggcctgcgcccactgcaaggcaggcagggccgggtcggcgtggccatcccacacatgtggcgggaccaagccgtgggtcaggctcagccaacagaacgccgcttccaatgcaccggccgcgccgagggtgtggccggtcatgggtttggtcgaagagcaggccacgccgtcgggaaacaggctggcgacggccaggctttccatggcgtcgttgtgttgggtggcggtgccgtgcaggttcaggtagccgatctgttcgggcgcaagttttgcgctggtcaaggccttgcgcatcgcctgcaacgcgcctttgccggtgggctcgggcgccgagatatggtgtgcgtcgcagctggcaccgctgcccaacagtgcaatcggcgccggtgtttgagtcatcaagaacagcaccgccgcttcgccgatattgatgccgttgcggttcaccgaaaacggattgcagcgctcgctggagacggcctccagcgaagtgaacccgttcagcgtcagcttgcacaggctgtcgacgccgccgcaaatcaccgcatcgcacacgcccagggccagcaggcgctgagcgctcatcagcgcgcgggcgctggaggtgcaagcggtagaaatcacataggccgggccgctcagttgcagccagtcggcgaggaagttggccggagcgctgagttcctgttgctgatagtcgtagtcgccggggaactgctggtcgcgcaggtaatgggcgatgccccggctggcttcgtcgatgcccgaggtgctggtgcccaacacaatgccgacccgcgaggggccgtaggtgtggatcgcctggcggatctggccttcaatctgcaacgcggcgtccagcagcaactggttgttgcggctgctttgctggttcagttgcgctggaatgctcgccagttcaccgtgcacaccgcccaccggcaacacgcgttccggcacccagccactttcggcgcgcatgccggagcagtcgccggcaaacaggttgcggctgacttcgtcctggccacggcccagggcgcagattacgcccagtgcattgagataggcggtcatcgagcgaccccaagcggggtgatgcgatagctcaacggctggcccgtcatgttcacgctgaatacctctgaagactggtagacgatttgccagtggcccggcagcgtgcgcgtaaggtccatggcctgggcactcgggtaaagcgcgcgcacgtcatccgccgaggtcagcgcaaacagcaacgcggcaaacagctcgcgggccgccgggttaggcggcagcaggccgtcagcctgccactggccgttgatcagtttttgccgggcctggggaatgcccagcgggtccatcatcgaccagcgcaacccagcgccttcgcgttgaatcaccagcaaccagtcctggctctggccgcccgccaggcgctgcacgtgcagctgcatcggcaaggccagcgccggggttttctcgggcagcggtggctggctggcgcaggcgctcagcagcaacaggcaaccgatcagcagcctccgcatcatggcgcagcactctctaacggtttacgcaccacgcagttgaccagggtctcttcacgctggcccaccggtggcgggttgcgcaggccccagcgttccagcaggccgaaatcgctggaacggctccaccacaaatacgggtatgagacgttctgcgggccaaattcaaagccctgctcgcgcagcatctgcaaatactcttcggcgcttttctgcacgtgcatcgggtggcggaacagccagcgaatcacccaggtgtcgatgtaggcttcggtggactcggcaaacagcaggtagccgcccggcttgagcacacggtagaactccttcaaggcgcgatgctgttccaccaggtgatggaaggtctggtggcagaacaggatgtcgacgctttcatccggcaccgccagggtcgcgcagtcgctgccgatcagctcgatggccaggccttggcgcgcggcttcggcgtggcacagttccaggctgtgggggtcggcgtccaggccgatcaggcgctgcggcgcaaacacctgctgcaaatactggaacgacttgccctggccgcaaccggcgtcgagcaacaccggcgccaccggcaacggctcggtgaacaagctgcgcaggtcgttgatcgccacgcgcaacacatggtgctgccacgtgtggctgcgcaggaaccagaaaccgaacctggtttcttcgacgtagttgttacttaaatactgactgctcacgcggcatcccctgcacaaatctccgacaacatccgtaaccgccgcttgggctcactgacaaacgggttgcgctcatcccacgcataaccggccaggatcgaactgatcatccggcgtatgtccggcgagctgccagggtggaaaatcacatcctggaatgtccccgcgtaccagccttcgacgtagcagcggaaggtgtcgacaccgcgctttaacggcacggcaaactcgctttgccagtccacggtctcgcctttgagctggcgatgcaacaccccggccgccatgctcgccgaacgcatggcgatagtcaccccggaagaaaacaccgggtcgagaaactccgccgcattgcccaggagcgcaaagccagggccgtgcagggttttgacgttggccgagtagccgccgatggtgcgcgcaggcgtgtcccatacggcgttttgcagcacgccggccaggcttggggtttcgtcgataaagccgcgcaggcaggcgtcgaggtcgctgtcgcggccgtcaaaatgctctttggccgcgaccacgcccaccgagcaacggccgttgctgaacggaatggtccagaaccagatatcacgttgggtggggtgcgtggtcacgaggatcttggtgcggtcgaagccaggatgttcgatgtgatcttcaacgtgggtgaacaccgcctggcgcagcgggaaattcgacggcgcttccaggtccagcaggcgcggcagcacacggccgtaaccgctggcgtcgagcacgaacttggccttgaggtggtactcgctgccgttctcgcgacgcacgtgcaggtagcggctctcaccgccaaagtccacgccgacgatggtttcgccgtagcgaatgtccacgccctgcagcgctgcctggtcggccagtagtttgtcgaattcgccgcgctgcacctggaaggtggtgggcttgccgttgctgaaagtgtcaccaaaatcaaatgcgctgtagcgctcgccccaggcaaacgcggcgccggtttttacctggaaaccggccgcctgcacggcgtcgagcatgccggcttcttcgataaaatcgatgcagtgcgacagcaggctctcaccaatcgaaaaacgcggaaaatgctggcgctcgataatcaatacatcatgcccgttgcgctttaacagcgcggcggcgatggcaccggacgggccggcaccgatcaccaccacctggcgacgttccatttcaactgtgggcacgagggctccttgccgctatggcgataatcacattcataaggcgtgcttctgatgcccggcccacggcgccagcataaagctgaacgccaggcccaggctgaccgacaggccgaaattgctcacggccggtgtactcgacaccgccagcaggccaaacgacaaccaggtcgtcagcgccgccaacagcgttcccaaaaggctcacggcagcgccgccgatttgctcgcgcatcaagatcgcgtagtcgacgctgatggctgtgaccaacagcaggccaaacaggctgaacagggtcagtggctggcccagccaacccaggctggccaggctgcacagcgcggccagcaacggcagggcgacgatgcgcaaggcaccgccaacgccgaatggcaggatcagcaacagcacgatcagcacgcacgacatcaatttcaattccgccgcgctgatctgcgtgtcggcgaacacccggttcaagtcgcccaggcgatcgaccaattgcacgccgggcaagtccagcgcctgcacccgcagcagcgccgggttgttcaagccttgcaggctgaccatcgccgccacgccgccgtccaccgggccgagccacagtgtgcgccacggttcggcgagcgggccaaccagtgcggcgtcgatgtcttcggtgggcagtgcttgcagctgcgcaacttcggcctgcaaggcgctggcgggcacgccaaggtccagcagcggttgccagtgttgcggcagctggttcagcgcatcacgcaactgttgctgctcggcgggcaagttgaccagttgattgagcgccaggtagccctgcaacttgtccatgttcaccagttggtccaggcgttgacccaaggccgcctggcgttccagcaactgctgctggttctccgcgcgcaccaggaaaaactggctggtgggctggaacccggtgatgcgcgccacggcctgcgcctcctggagcaattgtggtggggcacctatccattggcggatatcgtttttgctgttcaagtgccacaggccgcccgcgcagaacagcagcaccagtgccagcagcagcgggctcggtacgcgtttgatcaaggcggcgcgcaacagccacaggccttcggcgatgcgcagcggccattgcgccgggcgcaggtccacgcccttgagcagcgcgggcaacaggcacacggccgacaagtaggcgccgaccagacctgcggcagagaacaccgcgatttgcgtcaacgccgggaacggcgtccaggccaacgccaggtagccgatgcaactggtggccaggctcaggctcaaccccggcagcgtcaggcgcaacgccggccaactgcgccagggctgcaggctccagcttttggacagatagtgcagcgggtaatcgacggccacgccgatcaggctggagcccagcaccagggtcatcacatgcatatggccgaacagcgccacacaggccaccgcaccaaacagcatgcccaccagcaccggcacaaacgccagcagcacacgccagcggcggaaggcgagcaacagcagcaacaggatgcccagggtagcgccgccgccgacccaggtgatttcccgcgtcgcttgttgctgcccattagcggcatagagcaagccgctggcggcgagcagctgcgcgccttgctcactggcctgcgtgcggctggcctggagcaaatccgcgacttgcaccggcagtttcatatcaaaggcgttgccggtggtgcgcgcacgcagcagcacccagcttttgccgtcggcatcggcgatcaacgcgccgctgccgatgtccagctgcactgaaccgtgctgcggctggctgttctgaatgcgcccggtcaggcccagccagtcgtcctggctcggcaccaggctgaacccggtgaaggggtcgaacagtgcctgtacacgttgctggataaacgccgcgggttgctcgatcagttgctcgcggtccttggccgagagcattgccaggcgcccgcgcagcagttgctcgcgcagcgccggcaagtcggcttgcaggttccactgcaccttttcaaacagcccgctggcctgccagcgctcgcccaattgttgcgcgacctccacggctttttgccgatcggcatgccccaccagcaccagcatttcgcggttcagcggttcctgcatgcgctgttcggccttgagctccagcgcgtccggcgtgcttcccggcaccagctccatcaggttggccgacagcggcgcgccatggcgccactgccaaccggccagggccagcacggccaccagcaggatcaggaacaggcgcggcagcaggcgctcactgggcaaagtcatgttgctccgcgtcgctcaacggttggctggccgtgctgtcctgcatgcgcagcacagtgctgtcgccttgggtttccagcagttggatggtttgcaccaactcgccgccgtcgatattgatctgggtgaagacctgtttgagcagcaatgagcgtgggatcagcgtcagcttccactggttggcttcgccttgcagttgcagttcgaagtcgcgctgcaggccgctgctgtcaccctggagcacggcgaggaacagacggttctgctcggcaccggcgctcttgttcggcagcagctgccagccgttggcatcgcgccgggcaatgccctgggcgctgatgcggtagtcctgttgcagcggcgttttcagcagccacagcaggccgtgatccttggcgagcacgaaggtgcctttgctgaccaggggctggggcagggcacgcaggtgtttttcctgggtgaagttgccgtgaattacggacggttttgccagttgatcgctgagctgctgtagatcaaaagcatgggccaggcctggaatgctcaacaacaggattagcaggatccttgtgggagcgggcttgcccgcgatgtacctgagggcgctgcgcagtgtcaggcggttcgcgttatcgttaacgaccatcgcgggcaagcccgctcccacaggagtcagcatttcaaggccctttctacggcgtcggtgaagacttttggggaggccaactgcatctcgcggctggcgatttctaccgccacttgcacagtgctggcgcgggtcaggcgtccgccgctggccaaatcggtgatcaggtaattgaccttcaaacggttttcccactccaccaaactggcgcgcacattgatcgtctggccgaacaccgcgccgcgcacgtagcgcagttgcatgtcgatcaccggccaggcgtagccggattcgagcattgccgtgtagttgtggccgagcttgtccagcagcgcgcaacgcgccacttccaggtacttcacgtaatgcccgtgccagacgacgttcatggtgtcgacgtcgaaaaacggcacgaggatttcagtgtcgcaatgcagcacgccctggctacgcatgcagcctccagtgttgctcggcgatacgtttcaggcacaggcgcagttcgccttccagcgcacggtcttcgatgaccggcgggaagtccttggccagttctgcatgcatggcggccaaggccggcggcagggcgcgtgcatcttcagcctgggcgcgcagccacacgccttggttggccgcgagtaaggtggcggcggcgacttgttcggtcagctccagcacgcggatcgcatcgcgggcggcgatggtgcccatgctcactttgtcctggttgtggcactcggtggagcgcgagaacacgctggccggcatggtgtttttcaacgcttcggcggtccaggcgctggtgccgatctgcacggccttgaaaccgtggttgatcatcgcgcggtcagccggtgcgccagacaagttgctcggcaagccgtggttgtaacgcacgtccaccagcaaggcgagctggcggtcgagcaggtcggcgacgttggccaccaaggtcttgaggctgtccatggcaaaggcgatatgcccgccgtagaagtgcccgccgtgcaacacgcgctcttcttcggcgtcgatgatcgggttgtcgttggcgctgttcagttcgatttcgataaacgagcgcagccagttcaggctgtcggccaacacgccgagcacgtggggcgcgcagcgcagcgaataacgatcctgcaggcggtgcagcggcgcggtcggcgcatcaatcgccaggtctttgcgtagccacgcggcgacttgcatctggcccgggtgcggcttggcggcgaacaggcgttcgtcgaagtgttccgggttgccctgcagcgccactacgttcaacgcagtgatgcgcgtggccagttgcagcaggtaatcggcgcgggcgaaggccaggcaggccaaaccggtcatcacggcggtgccgttcatcaaggccagggcttctttggggcgcaataccagcggctcccagcccagttcgcggtgcacatcggcggcctggcggcgttcaccacggaacatcacttcccgctcgccggacaaggtcgcggccacgtaggacagcggcgtcaaatcgccgctggcgcccaccgagccttcttccgggatcagcggcagcacatcgtgttctagaaacgcgtgcaggcgctccagcaactccacgcgcaccccggaaacgccgtggcacagcgactgcaaacgcgccgccagcaccgcgcgggtggcttgggcgtcgagcaacttgcccagcccgcaaccgtgaaaggtatacaggtgacgtggcaacgcctcgacgtgctgcaatggcacggccaccacgcacgagtcgccgtagccggtggtgacgccgtagatcacgccttccttgtccagcagcgagtcgaggaactgcgcgcctttggcaatgcgctggcggtacgcagcgtcgccctgcaactgcgtgggcgcctgacggttggccaaggccagcacgtcttcaatgcgcaaagcgcgttcgccaaaggttaccggctcaagatgcgtcgtcatcggtcttccagaaagggtaaaagttgaaccattgttggggcgcttgcagacagaactggcccaggcgtgcggcgtagcgcgcggtccacagggcgatgacctgctcgcgggtgctgcgcttccattcgatcaattgcgcgaacggctcgatggtcaggcgatagcggccgtcgtgcttgaggcacatcagcaggttcaccgggcatttgagcagcccggccagcagccacgggccttgcgggaacgccgcgtcatggccgaggaaatccacgcgcaccttgcgcccgccgtgcagtggcacacggtcgccggcaatcgccagccactcaccgtcgtccaggcgctggctgagcagcagcatggtcgccgggtccagttcgctgacctggatcaggcgcaaatgcgtggccccggcttcgcccagcaggcggttgaattgttcggcgtgcttggtgtgcaccagcacgttcatggtgacttgttcgccgatctcggccagcgcacggcacacttcgaggttgcccaagtgcgcgccgaccagcatctgcccgcgctcgccgcgcaattgcccgcgcaactgcgccgggtcgttgatttcgatctgttcgatgcgcagcttgccgttccacacgtcgagcttgtcgagcaacgagtcggcaaaggccatgaactggccgaagacgcttttatgcgtgggccgcagctcatcgcgcccgctccaggcggccaggcgctgctggtattcccaggcgctgtggcgcgcggtgcggccgaacaggaagaagtacagcacgatgccgtacaacagcgggctcagcagtcggcggccgaggactttggcggcgacggcggtgagtttcatcagccagaagctgccgcgctcttcgcgatcggcccagtgtttggtgctgtcgctcatgcctgccaccgtcgccacaggatcatcggcgcgcgcaccaacatgccgaagaacagccgcgtgtgcatggccgaaatgcgcacgttgtcgcggaacaggcggaagtgcgacaggccatcggcggggtaatgcacctgggtcggcagccagcgcatcggctggttacgccaggccaggcgcaccaggatgtcggagtcgaaatccatgcgcgtgccgatgtaggccgtgttcatcaaggctaatgtgggcgccagcgggtacacgcgaaagccgcacatcgaatcacggatttgcagtgacaaggtgttgatccacacccacacgtgcgtcaggtagcgtgcgtagaggcggcctttgggcacgctatcgtcgtattcggggtagccgcagatcaccgcgtccgggtgcgtgcgcgaggcgtcgaggaagctctcgacttcgcgcaggtcgtgctggccgtcggcgtccacttgcagggcatgggtgaagcccaggcgcgcggcttcgcggaaaccggccatcaccgcgccgcctttgccctggttgttgggcaaggtcagcagggtgacgtgttccagtgtcgctaattgcgccaacaccgctgcgcaggccgggctgctgccgtcgtcgacgagcaggcatggcaggccgctgttcaacaggctgtggaccacggcgggcacggcggcttcatggttgtagaccgggatcagggcgcaggggttatgcatggcttacccaactggctatggcgagcaggcttgttgtggcgagcaggcttgccctgcgttgggctgcgaagcggccccaaaccctgccaactgggtatgtctgacacaccgcgtaccgcttactggggctgcttcgcagcccaacgccgggcaagcccgctcgccacaacaagcccgcttgccacaacaagcctgtcagccacaaaagcttatgcatgcgcggccaccagttgaatgcggccgctggagcaggccgccacgccgttgcggtaggcgaaatacagcttgccgcgtgccgggtcgaagcgcaggtgcagttcaacctggtcgccggggcgcaccagttgctggaatttgagcacttccatgccggcaaaggtcgtgggcacatccagcagttgctggccgaggttgaacgcccattccacttgcaccacccccggcaacaccggcgtgaccgggaagtggccgctgaaatacgccaggtccggcgggatgctcagttgcacggtccattcgccgtcagcctcgacttgctccagcacttccggcgcttttggccggggtgccagcagcaacgcctctacctcggcctgcggcagtttgccctggctgttcagcggcaactggcgcagcaaccgccagcgacgcggcagcgccagtgcttcgcaatgttggctcaaatgctggcgcagggtttgggtgacggtgcggcggccctgattgcgcagggcatgcaggccgtcggcgctcagcaccaccagcgcgccgagggaggcgcggttttcctgcaccacgcccaggcgggtgtcggcgacccaggcgtgggccatcagcgcttgttcgagcatgggcagggagatgcgtttttcttccagcttgacgatgcggtccaggcggccgagcagctcaaagcggccatcggaatgaatgcgggcggcgtcggcggtctgttcgatatgcccggccggcaggtaaggcgaggcaatgcgcagcgcgccgtcggcatcctggctcagctcgacctcggcaaatggctgccacggctgtgcgccttggcgccaggcaatgccaccggtttccgagctgccgaggatttccgtcggccattgctgcaagcggtcgtacaagctgccagccgcctcaatcggcaacgcgccaccggacgaaaacacccgcgacacctggctcagcgccggccagtcgaggttgtcgcccatgcgcttgagcagcgcagggctggcgacccaggcaaattgtgagtgctcgcggctggcgcgctgcaggtcttcggggaaggccagttgtttgcgcacaaaggtgcgaccggcacacagcggccacaacacccggaacaacaaaccgtagatatgttgggtggcaacgctgccgatgatgcacgcatcgttaaggtcggcgccccacaaggcttccagcgcctcaacttcgttggccaattggcgcagggttttgtcgatacgcttgggctcgccgctggagccggaggtgcacaggctcaactggcaagtgtccaggtcgagagccgcagcgctcaacggcgcctgatacagcgcgtcgaggtcggcggcttcaaccagccaggcatccacggcggcgttccaacgctgacgggtttgcgcttgcaggtcggcgggcagcaacacgctgaccccggcgcgccaggcgcccagcagggcgattgccagggtgcctgcgtcttccaggtgcacggccaaacgctggatgccgcgcgcctgcaggcccgccgccaggctcagggattgctcccatagctgggcgtgattcatcgcaggttcggtggtgaccaaacggtgttccagcggctcaagcaacaggtgctcaagtttcaaccctttcatacgcggcctcgaaccctttgtcgtaccagccattccacggcaaacaacaaccccatcagcccgtaggcgatcaggccgttgtacaacgtccaccagctcagcggcgcccacagcgtgagggcggcggcgagcaggccattacacagaaaaaacacactccacaccacggtgacctggcgcgtatacaccaccgcgttgggcggcagttgcgggtcactcatgcgcgccaggcgctcgaccatcggcgggccgtatttcaggctcaggccgaacagcgccagcatgaacgcgctgaccaggctcgggtaccagcgcagcagctgcgggttgtcgaaccaggccagcaacaggcaaaacacgattactgccaccgccatccagcggctgccggggcgccgtgcaccggtgagtgcgcgcaacagccacaggctgcccagcagcaggccgaattgccatggcgcaaagtgctcggtgccgtaatacactgcaaaagggtacagcagccccgccagcaacaggccaaggccgatcagccggctcatgcggcaggcgtgaccagacggtacaccgcctcaaccacgtcgtttacggtgcgcacagtcttgaattcttcggcggcgatctttttgccggtctggcgcttgatatggtcgatcaggtcaacggcgtcgatgctgtcgatttccaggtcctggtacaggttggcgtcgagcgtgacgcgttcgggttccagttcaaacagttccaccaaggcgtcgcgcagggtgttgaaaatatcgtcacgagtttgcatggtccggtctcaagctacctgtctggccgtgacgaacgccgcaaggctggccacgttggtgaagtgattgcgcgtgtctttggcgtcggcatcgatcttgatgccgtactttttctggatcgccaggcccaattccagggcgtcgaccgaatccaggcccaggccttcgccgaacagggtttgttcgctgccgatgtcgtcgacgctgatgtcttcaaggcccagggcctcgatgatcagcgtctttatgtcgtgctcaaggcggtgttggtcgctcatcttcggcgagctccttaataaaatagtggtgcaggtaatcgttgagcttgcgtgaagcctggggcgcgggcccgagtgcggcaaaggcgtgtggttctatatcggcacccacgcgcaaactgaaatgaaatcgacatttaggaatgcgataccagggttccgccttggtcagggtggtggggctgaccttgatcaccaccggggtgatgattgtcgcaccgcgcagcgcaatggcggcgccaccgcgatgaaaggcgggtgccgcgccgggcgtggtacgggtgccctcggggaagatgatcaaggtttggccttcgcgcagcgcctgggcggcggcatcgagcatgtcggcgctgccgtcattgctgatatagcccgcatcgcgcaccggcccgcgggtgaacgggttctggaacaggctctgcttgaccacgcaattggtctggcgcatcaggccgatcaaaaacaccacgtcgatcagcgacgggtggttggcgatgatcatctggcctgggcggccgagtttctctgcgccttcgacgctgtaggtcagcacaccggcgcgctgcatcaggcggatgaagaaccagaacagcttgctgatggtgtggcgagcgcggcgctggtgttttgccgcgctgcccggcaggcaactgagcaacgggaacaccagtaaacgcaggcacagcccaccgacgccgaacatgaagaagctggcggcggtggcgaacaggcgccagtagtaggcgtcccgtggtttgtcggtcagggcttgcgttgccagttccatacacggttcttccaggcatgttggcaggcgacctgttcagtgagcagggtgcgcagcaggttcagggcatggggccactgagttgtttgagtgagttggacagcgccgctgtttagttccaattgccactcgtcgcccggtgtcagcagcaggccgacggcgtaggggaagggcacgtcattaatccagctggcgtaggctgcgggcggctgttcttcggtaatcaccagcaacactgccggggcgccttcgttgagcagcgcggcggcctcaagcatgccgtgctccaggccatcgccagcggcggcgagggcggtcatttcgctggtttcattgcgcaggatcgaccacaggccaatcactgcgttatgcaccgacaggctgaactgggtcggcgacagcggctgctcattggccaggtcgctgaggatgtcgagggtgcgcggggtttcgccgtgccgggaaataaacaccagtggcaggtcttcacggccttcggccagcggccaacccacgctgaacgccatgcgcgccaggcggctcaggcgccgacgctgcatggccggcaggaaggacacatcgggggattcttcgctggcgggcagcaacaccggggcctggcaccaggcgtgccagtcgtccgcactttccaggctgggagcccaggcgcgccattgggcgatgttgaaagtgatcactgagaagttatcccgcccctgcgggcttccatgtgcggccattggccccgaataccgggacagggagcaatcgccgaatggcgcgcattatcccggtgctgcggggttctagcaaacattggtaaagaattgttcacggctgattacaatttggcggcaaagatttacagattgtcctttacccggggttgatttgggttgtaggacagttcctattcatgtgccggcgacgtatgacggtcgaagcgaattggcccaccgatgcagccgtgcatggatgaacgaggtagctaacaggcgcttttgccctctacactcggacattcattgatacacggaggtttttccatgcggcgtgtggtgttcaatcagaaaggcggcgttggcaagtccagcattgcctgcaacctggcggcggtcagcgccagtgaaggctatcgaaccctgttggtagacctcgatgcacaggccaactcaacccagtacctcaccgggctgaccggcgacgatatcccgatgggcattgccgagttcttcaagcaaaccctgtcttccgggccgttctccaagaaaaaccgcgtggacatctacgaaacgccgttcgacaacctgcatgtcatcaccgccaccgctgagctggctgacctgcagcccaagcttgaggccaagcacaagatcaacaagctgcgaaagctgctggatgagctgagcgaggattacgaccggatttacctggacaccccgccggcgctgaacttttatgcggtttcggcgttgattgccgctgatcgtgtgctgatccccttcgattgcgacagcttctcgcgccaggcgctgtatggcctgctggcggaaatcgaagaactgaaggaagaccacaacgaaggcttggaagtggaaggcatcgtggtcaaccagtttcaggctcgggcgagcctgccgcagcagatgttggaggagttgattgccgaaggcctgccggtgctgccggtgtacctggccagctccgtgcgcatgcgcgagtcgcaccaggaaagcaaaccgctgatccacctggacccacggcacaagctgacgcagcagtttgtggagttgcataacttgctggaaaacgcctgatctaaatacaacacccatccctctgtgggagctggcttgcctgcgatgcaggcaacccggtctgccatttagacctaggtgatgctatcgcaggcaagccagctcccacattttggttttgcattccgataggggatttggatagttcccacataggctgtaggaagtgtctggcaagcggggttgcgccttgtctcgctgcctacagataagccagaatcgcccggcttgtgcgtctggatgggcgtctctaaggttcttcggtcgctgaatgttcagtgatcgggtttagtagcccgtggtgagacgtacagtaattcgtcaatcaggaccttcctgaatttgatggtggctgtacggagggcgctttcgagcgcgccggttgagtctccccggtctactaacctgcgtacagctgccaccctccgtttagtagcggctggttgcggctcctactcggagacgatccatggttaacctttataccgttgcccccaacctccccaccgaaaccctcgtgcttaacagctacgaaaccttctcttccgtgcgcacgctattactcaagctatccaacgacctcactggcgaacaccgcgacgtcgccctggccatccatcaattaagcgaactcggcgtacaactcgtaggccagatgatggaccgcaaaacccccgtagcccaagcctaaaacacaatcactgtgggagctggcttgcctgcgatgcaggcaactcggtctgccaggtacaccgaggtgatgccatcgcaggcaagccagctcccacagttgatccagttgatgggcggactggtttacaccccctggctacgcaaccaactcatcaactgcggcaacggaaacgccccactctggcgcgccacttcgcggccgttcttgaacagaatcaaactgggaatcgagcgaatccccaactgcgccgacaactgctgattggcctcactgtccagcttggccaaccggcacttgccctccaactgcccagccgcctgctcaaacaccggcgcaaacgacttgcacggcccgcaccagtcagcccacacatccaccagcaacggcaggtcgcccttgatctggctggtgtagtcgctttgtttcaactcaaagggcttgctcagcaacacaggctgcttgcagcgcccgcacttgggcgcatcacccatgcgttcgccggggatgcggttgaggccgttgcaatgcgggcaggggattacaagaggttcggacatggtgggctcctggagagggtcaataggttttatttggagccagcgccgatatttatcaaggcaaatacataactgtgatcgttcccacgctccgcgtggtaatgcatctcgtgacgctccgcgtcacccgtgcgcagatgcagatcattgcaaaaggcgggacgcgtagcgtcccaggtggcattcccacgcagagcgtgggaacgatcatcgatcatgtgtcttcttaagaagaacaactaatctccaaatgcttgccccaatccggcggccgctgggcgtattgctccatccctgcctgctcttcaaacggcttgctcagcacttcatgcagccgccgcacttcgttgtaatcgcctgactcggcagcagcgatggcgttttgtataagatcgttcccacgctccgcgtggtaatgcatcccgtgacgctccgcgtcacccgtgcgcagatgcagatcatcgcaaaaggcgggacgcgtagcgtcctaggtggcattcccacgcagagcgtgggaacgatcatgtgtcttcttaagaagaacaactaatctccaaatgcttgccccaatccggcggccgctgggcgtattgctccatccccgcctgctcttcaaacggcttgctcagtacctcatgcagtcgccgcacttcgctgtaatcgcctgactcggcagcagcgatggcgttttgtgccaggtagttgcgcaggatgtacagtgggtttaccgcgtgcatgcgctcgcggcgttgcgcttcgctgtagtccccgtcccgttcaacgcgggctgtgtactgttcggcccaggcgtcaaaaccggcgaggtcgacgaagtcatcacgcagctgtgccacggcctgcgctgcaggctcatcgcccaggcggcggaagaacagcgtgtagtccacgccactgttctgcatcagcttgagcaggcgctccaccagtttctggtcatcgtcttcagccgtggtcagccccagtcggcggcgcatcaggtccaggtagtgggcctggtacagcggcaggtacaggccaagggtttctttcaaggcgtcgacgctgataaacggcgtgagtgcctgggccagtgcgctgaggttccactgcccaatcggtacttggttgctgaaggagtagcggccttcgtgatcggagtggttgcagatgaagtgcgcgtcaaagtcatcgaggaacgcaaacggcccgaagtcgaaggtgatgcccaggatcgacatgttgtcagtgttcatcacaccgtggcagaaaccgtaggcctgccatttggcgatcatctcggcattgcgctcgacgatttcgcggaacattgccaggtaaggctcgggctgttccatgcactcggggtagtgcaacgaaagcacgtgttcagccaattctttctgctgctcgggcttcttggtgtagtagaaatactcgaaatgcccgaagcgcacatggctgtgcgccaggcgcaagaccatggcgccgcgttcctgtttctcacgccacaccggcgtgtcggagccgatcacgcacaaggcgcggctgctggggatgcccaaggcgtgcagggcttcggaagcgagaaactcacggatcgaagagcgcagcaccgcgcggccatcgcccatgcgcgagtaaggcgtgagcccggcgcctttgaggtgcaggtcccaatgctcgccggcctcgttgtacacctcacccagcagcaacccacggccgtcgcccagttgcggggagtagccaccgaactggtgccccgaataaaccatcgcccgtggttccgcctcggcccacagcttgtgcccgctgaacagctcggcaaacaccggcgtttcggccacggccgggtcgaggtcgagcagggccatggcggcgttgctcgccaccacaaggcgcggttcgtcgagggggtcaggcaatacgtgggttgagaacgcgtcgcccaggcgtgcgaagcggttgtcgaaggtcagttcgtcgagggctttcaccggccatctccagcagaatgtccgagcattctgctggggataggcgcgttagtcgagtttgctcggcggcggttcctgcacgccgccgtcgttggcgggtttggccggagtgtcgacttccaccagtttgtattcctggccatggaggttcttgaggtagacctccatctggcggaacgagatgttgatgtggtggttcttgaactcgcggttgataaagcggttcacctcgtcgattaccgggttgcggtcaccgaggtcgcgcacgtgcatgcgcagttcgtggtcgagggtgctttcgccgaagttgaggaagtacacgtggggttccggctctttgagcacccgtgggttttcgcgcgcggccttgagcagcagttccttcaccaggtcgaggtcggagccgtagtccacacccagtttcagcgtgactcgggtgatggtgtcggtcagcgaccagttgatcagttgcccggtaataaacgtcttgttcgggacaatgatgtccttgcggtcgaagtcggtgatggtcgtcgcgcggatgcggatcttgctcaccgtgcccgacaggttgccgatggtgatggtgtcgccgatacgcaccgggcgctcgaacaggatcatgatgccggagatgaagttggcgaagatctcctgcatcccgaagcccaaccccacggacagcgccgccaccagccattgcaacttgtcccagctcacgccgagggtggacagggtggagacgaagcctacgccggcaatcacatacgacagcaaggtggtggtggcgtaggcgctgccttgggccaaatccagcttggacagcaccagtacttccagcagaccgggcaagttgcgcgccagggcgaaggtgatgccgacgatgatcgacgcaccgagcaagtcgccgatgctgatcggcaccatgctgatattggcaccggtgccgctggtgtattcgtagagcgtcacgttgtccaggtaggagaacacggtgatcaggtctttccacacccagtacagcgcggcgataaagccgccgagcaaggccaggcggatcaggcgcatcgactgttcgttgacctgttcgatgtccagggtcggctcttcgatcaccgcttcgccgtcaccggcttccttggccgcctggcgtttggccagggcgcgcgcgtaggccaggcgccgagcggcaacgcccaggccgcgcacgaaggtggcttcgatcaccagccagaacatcagcaggtacagggtgttgatcaggcggtcgctgagtttgagcgcggtgtagtagtagccaaagcacacggcgataaacagggcgacgggcagggcggtgaacaccaggcccacggctttgcgaaacagcgaggctttttcgtgggtcgggctgtgcagcagcaggcggcccagcagccaggccatcagcgcgtagcaggtcagcaccacgccgatacccagcacgtcgtcggccagcgccgccggttggtgttcggcaatggccaccacggccaccagggccagtaccaccagcccgagcttgcgcacccagccttgcaggaattcgacttggggtttttcccagcggaagtgcagttccgccacgccgcccgacgcgaggatccggtaagcggtgtagaacaccagccacgcctgggcgatctgcagcagggccgagccgaggttggcgttctgcccacgggcgtcgatctgcagtgcgtagccgcacagcgccaggcccagggaaaccggcatcgccagcaggatattgatcaggatggcctgcggcgtgtgccactggctgtcgcgcttgaagtggccgatgtccaggtggactttgttaaggcgctggtaaagcgccttgcgccgccatagcagtgcgccgatcaacagcagcaacggcaggaacagcagcgggcgctgggtcaggccgtcgtacagttcgctgacgctggaggcccacggcagggtggtgatttgcttgctcaggtgtgccggtacggtttccagccactcggtgtccagcggcttgttgctggggatccagaacatttgctcgtccagcgtcgcgcgcagagtggtggcggtgctgagcagttgtttctggttcagttgcagggtgatcgattcgttcagcagcgcgctcagctcacggctcaggcgctccagcaggtcgctgcgggtaattgccagctccagcagggtgcgacgcagttgcggggtgacgtcttccggcggctggttggccagcaagttatccacataggcgctgggcgagctgatcgcctcgcgctgctggttgatctcgaactggtacaggcgaatgttggcgatgtcgtccgccaggtcgcggtccacggtgaggcgcggcagtgcctgtttttgcttatagagaatcttggagagcagcaggctgcccttgagcacgttgatttgctcatcgagtgccgagtcgctttgggtcacggtgtccagctgctgcttggtctgcaggtttttctgggtcaggtcattgaggcggtcggtgcttttgagcaggtagtcggagagcttcaggttggccgcgctttcggtggccaacaggctgctgccgccggttttttgcgcctcgatggactgctgggtcacggtctgctgggactgggcgaggcgtttctggttgatcagggtttgcaggtcctggatttcctgttccaggcggctggtcttctcggtcgccaggtcgcgctggctattgcccaggtcttgcagttggctgttgcccgccagttcctggcggcgcagcggaatcaaagcgttgagggcggcgagttcggcgttcagcaggttgcgctggtcgccggtgaggggcttgccgttatctttgccggctttaagggtggcgttgatctgctggatgcgggtctggctgttgctgatttcggtttgggcgcgctcggggcgggtctgggcggcgatggacatgctgttggcatccgccatgtccttttgcaggtcgccttgctgggtcgtgcgctgcaccagcaattgttcgagctgcggcacgggcagcgtggcatagcgttgcgccaccgggatgactttggtggccttgagccgcaccagttcgcgctggttatcggtggtctggcgcggggcgtcttccagctggcgcttgaggtcggtgaggcgctgctcgtaatcctgcttgttgcccaggtaggtcagggtctgttgcaggatggtctgcagcgccttcatgtcggcgtcgggcagcttgcggtcgggcagcttgtccagggtttgctggatggcctcggcgctgggcgcgtcggcggcgtaaacgctgcccacacaaagggtcaggcccagcagggcagtggctaaaaaagtgcgcagagttgtcatggataccggtcgagcaaggtaaagaaggtgggggcgtggcgcctggccccgcagtttagaggaagagtccagggcctggacgacttccttcggggaatttgacgccgacttttccgattctgttcccgtccatgaccgcgacggtccacagcgtgttgttccactccacttggtcgcccaccaccggcgcaccgccgaccttctgggtgatgaagcggctcagtggcatatccgggtcgataccctcgagcttgaggccgtacagcgccgacaccgcgcccagctgggcgtcgccttcgaggacgaagtcgccgaagaaacgcaggtcgaggccacgttgcggcgcctggctgaacagtttacccagggccggcaggttgtgttcgtggccgatcacgcagagcaaatcgtcgacttccagcaccgtactacccgacggatggagcagttgctggccacggaacaacgccgcgatccgtgtgccctcgggcattttcaattcgcgcagggctgcgccaatgcaccatttttccgcgcccaggcggtagacgaacagctcccactcgctggtgacgtgcacttccagggccgcgcgggaaatcggcgcggggtcgggcggtacggtgactttcagcagtttggccacccacggcaggctggtgccctgtaccagcagcgagaccagcacgataaagaacgccaggttgaagtacagctgcgcgtggggcaggccggccatcagcgggaacaccgccagaatgatcggcacagcaccgcgcaggccgacccaggcgataaaggctttttcgcgcccgtgaaaggccttgaacggcagcaggccgaccatcaccgacagcggccgcgcgaacaggatcatccacagcgccaggcccaacgccggcagggcgatgggcagcaagtcatggggcgtgaccagcaagcccagcaccaggaacatgccgatctgagccagccaggccatgccgtcgagcatatgcaaaatgccatggcggctgcgcaccgggcggttgccgatcaccaggccgcacaggtacacggcgaggaaaccgctgccgtgcaaggcgttggtcagggcgaacaccaccaggccaccggcgatgaccaggatcgggtacaggccggtggccaggttgatgcggttgaccatctgcagcatcagccagccgccgcccaggccgacgatgccgccgatgccgaattcgcggatcaggtgggtcagcaggctccagtgcaggccggtctggcctgtggcgagcatgtcgatcagggtgacggtgaggaacaccgccatcgggtcgttactgccggattcgatttccaggctggcggtaacccgttcgttcaggcctttgccgcccaatagcgagaacaccgcggcggcgtcggttgagccgacgatggcgccgatcagcaagccttgaatgatgttgaggtcgaacagccaggccgcggccatgccggtgaggccggtggtgatcaacacccccaccgtggcaagcgacaacgccggccagagtgccacgcgaaaactggctacccgcgtgcgcaagccgccatcgagcaggatgactgccaaggcgaggttgcccaccaggtaggcggtcgggtagttgtcgaaaatgatgccgccgccgtcgacgccggcgaccatgcccacggccaggatgatcaccagaatcgggatgcccaggcgggacgaaagagaactcaccagaatgctcgcacccaccagcaacgcgccgatcaagaacaggctgttgatggtcgtcgcattcaaaggcagtactccagagctgggaagacggggcgcaaactgaccatgcagtctgcgtgccagcgattctaacctgttgaattgctgcgctgtcaaaagatcgttcccacgctctgcgtgggaatgcttcgctggacgctctgcgtccgattttaaggcgtgacgcggagcgtcacaggctgcattcccacgcggagcgtgggaacgatcaatcaccggtgtcagttacaggcggaagcgccccaccatcccgttcaaatccaccgccaggcgcgacagctcactgctcgccgcactggtctggctggcgcccgtggccgattgcaccgacaaatcacgaatgttcaccaggttgcggtccacttcccgcgccacctgcgcctgctcttccgccgcgctggcgatcaccaggttgcgttcgttgatctccacgatcgcggtgttgatggtgtccagcgacatcccggcgcctttggcgatgttcagcgttgattcggcccgctcggtgctgttacgcatcgaatccaccgcgtgctcggtgccggtctgaatgctgccgatcatgcgctcgatctcgctggtcgactgctgggtgcgatgggccaaggcccgcacttcatccgccaccacggcaaacccacgcccggcttcaccggcacgcgcggcttcaatggcggcgttcagcgccagcaggttggtctggtcggccaggccgcgaatcacgtcgagcaccttgccgatatcccgcgattcattcgccaggtcgccgatcaaggtggccgtggcttgcacatcgccgctcatgcgttcgatggcgctgacggtttcctgcaccaaatcacggccatcgccagcggaagtggtggcggcgcgcgaggcttcggaggtgctgaccgcattgcgcgcgacttcttcgacggcgctggtcatctcgttgacggcggtggcggcttgttcgatttcgttgttctgctgggtcaggccacgggcgctttcgtcggtgacggcattcagctcttcggccgccgaagccagctgggtggcggaaccggcgatgcgttgcagggtgtcgcgcaatttgtcctgcatcttggccatggcggccagcagacggccggcttcgtcgttgccgtcgaccttgatcgggcgcgtcaggttgccttcggcgacttcctcagcggcctcaagtgcctgggaaatcggcacggtgatgctgcgggtcagcagccaggcgaacagcaacgtcagcgccgtggccacgatcagcaggcccaccaccagctcaaacgccatgtcgtattggtctttggcttgctggttggtggcgttggccatcttgttgttgatgtccagcaggcgtgtcaacactgcgttgacctgctcggagttgctgagcaattcggtgttgagcaagttgcgcaggtcgtcgatctggttggcgcgagacaagctcttcatgcgctcttcgatctggtggtactggccgagcaaacgcacgtattcgtcgtaggtcgcgcgttcttcgctactctcgatgagtttttcgtacacgccctgggcggtgcggatctgctggttgcgcagttcaaaggcttccagggtcttttgctgcacatccggctcgcggttggtcagcaagcggtacgacaacacgcgcaggcgcagggtcagctgggtgaattcgtcgagggcgcgaatgcttggcacgctggactgggtgatgtcttcggtggcagcacggatcttgctcatctggttcagggcgaacacaccgagaaacaacatgagtgcaccaataaacgcaaagccaagaaaggcgcgcggcgcgatattcatattacgaagagacatgctggagtcctggggagaagcgcgatccgtgcggccatgagacggggtgtgcatcttctatcggccatgcgactaaagtcttaagggggcgcgcgcttttgtcgcatctgacgaggggtttagcggattcaggaaccagatggggtaaatgcagtcactaaggctcgaaagcgcggcccggcccttaaaaatcgggctgcgcgccggggataaccctggcttccgaggtgatttttctttatcgtcaccgccctttgaaaaagcccgagaaatcaaaatgttagaagcatccctcagccagcttgaacagcttgtcactgacctcgtacaacaaaaccaggacctgctcggcagcaatgaatccctcaaggcggaactggcccgtgccaaggatgaaaacgacagcctgcaactgaacctgatggaacaggaagaaaaacacggcgccactgccgcgcgcatccaggccctggttgagcgtgtgagcgcaggtcctgtcggcgcatgaatgaagggataaaggtcgtttcgattctcggagaggattactcgatcaaggcgccggaaggggaagatcaaaccctgatgcacgccgtgaccatgctcaaggcctccctggccaccaccaagaaaaagtacccgaccctgatcggtgacaaattattggtactggccgcgctgaacctgtgcgccgagcagatcgaaatgcaaaagcatcaccagcaggaactcgaccgttaccaagagcaagtcagcgccacggtcgaagtgatttccaaggcgatcggaacgccttagaaccacgcatcctgcatccccaggcacgtgtcatcgcgtgcctccagaatcgccagttcatgatggcagctcggcacttcccaggtcaggaagtaccgagcggcctggagcttgcctttatagaaggcagcgtccgccgcatcgcccttggccaagccttcctcggcgcgaatcgcctgttccagccagcgccagccaatcaccgtgtgcccgaacaccttcaagtacagcgccgaatttgccaggctgctgttgaccttgccctgggcgagatccgtcagcaggccaatcgtcacgctttgcaggcgattaaccaactgctccagaggttctcgcagggccgtgagtgacgggtactgctgcgcccgtgcgccggtttcggcgatcaaacggatcagttgcttgaggcccgcaccgccattctgcgcgagcttgcgcccgagcaagtccagggactggatgccgtgggtgccttcgtggatggggttcaggcggttatcgcggtagtactgctccaccgggtattcgcgggtgtagccatggccgccgagaatctggatcgccagctcgttggccttgaggcagaactccgatggccaggatttgacgataggcgtgagcaggtccagcagttcgtgggcttgcttgcgttcggcctcggtttccagggtggtggtgtcatcgaacagccgcgcggcatacaggccgaggtcgaaggcgccttccacgtaggctttttgagtcagcagcatgcgcttgatatcggcgtgctgaatgatcgagaccggcgcggtgctggggtctttgctgtccggcaggcgaccttgcgggcgttcgcgggcgtattccagcgagtagaggtagccggcataaccgagcatgactgcgcccatgcccacgccgatgcgcgcctcgttcatcatctggaacatgcagctcaagccctggtgcggtttgcccaccagatagccgacgcaattgccgttatcgccgaagttaagcgccgtggacgtggtgccacgccagcccatcttgtggaacagcccggccaacagcacgtcattgcgcgcgcccaggctgccatcctcgttgaccaggaacttgggcacgataaacagcgaaatgcccttcaccccggccggcgcgtccggcagcttggccagcaccatgtgcacgatgttttccgacagcggatggtcgccaccggagatgaagatcttgttgcccttgaggcgataagtgccgtcagccgcaggctctgcccgtgtacgaatatccgacaaggacgagcccgcatgcggctcggtcaaggccatggtgccgaagaagcggccgtcgatcatcggttgcaggaagcgctgcttctgctcctcggtgccgaaactttcgatcaggttggcagcgcccattgtgaggaacgggtaggaggtcgaagccgcgttggccgactgaaagtgcgcaaagcatgcctgggacagcaacgtcggcagctgcatgccgcctgcttcgaaactgcgcgcggcgttaagaaagcccgcttcgaggaacgcgtccacggccggtttcacttccggaatcaggatcgcctggccgtcttcatagcgcggttcgttttcgtcattcttgcggttatgcggcgcgaagtacttctcggcaatgctgcgcgcggtgctgatggccgcatcgaaagtctcgcggttgtgctcggcaaaccgctcgcgctgggtcaggccctcggcatcgaggacttcgtacagctcgaaagccagattgcgggaactgagcagcgtctcggacatggcggcttacctgtgttgggataggcctgagtctaagtgcgcgaatagaggctggatagcaagattgatctgggtgatggagggacagaacgagggccgaaggtgggatgcggtcaatgtgggagctggcccgttgtggcgagcgggcttgccccgcgttggggcgcgaagcggccccaaatcctgacaccgcgttttatctgttaaaacgcggtgacctttttggggctgcttcgcagcccaacgcggggcaagcccgctcgccacgacaagccgccccacaggtgggtgttagccgatggtcatcaggctggcgttaccgcccgccgcagcggtgttaacactcaacgcccgctcaatcaccagacgctccagcgcaatcgccgtctcaccttgcgacaaaccatgcacgccaacaatcgcgccaccacgctgcgccacttgctggcacaccgcacgcagttggtcggagtcgccgtggtgcaggactgcgtcgaataccacttcgtctttggtccagtcggccacgcgcttgatcttcgcctgaacgtccttcggcaaacgtgggaacaatgccttggtcaggtcagtttccggccataccgccgaaccgccgacggccagcactgccgccagttgcgtcagcaggtcgccttcgacgtccgccagacacagcacgtgctcgcggggcaggatcgcatagctgttgcgctcgcctgtcgggccagccaactgacgggtgataccgctttgcgactgcgcggcgaattggctgcacagcgcgctcagctcgctgaacttattgctgtcggcccaggttttgagggcggtcagcggttggctcatggcatcgcgcaggcgcacgtccggcgcggccagcttgtcgccacgtacgaaggattgctcgatggcatcagtaggacgcgtcgacagcaaacggtacaggtacaacggcccgccagctttcgggccagtgcccgacaggccttcgccgccgaatggctgcacgccaaccactgcgccaacgatgttgcggttcacatacacgttaccggcatgcacgttgtcgatcaccttggcgatggtctcgtcgatgcgggtgtgcacgcccagggtcaggccatagccggaggcattgatctgcgcgatgagctggtcgatctctttgcgcttgtagcgcaccacgtgcagcaccgggccgaagatctcgcgttgcagttcgtcgaagctttccagctcgatcagggttggcatcacgaaggtgccgcgcttgatctcttcgccgtcggcgattgccacttggtacacgttgcggcctttgtcgcgcatggcctggatgtgtttctcgataccggccttggcttcggcgtcgatcaccggcccgatgtctaccgacaggcgctccgggttgcccaggcggcattcagccatcgcgcctttgagcatttcgattacacggtctgccgaatcttcctgcaggcacaagacgcgcagggccgagcagcgttggccggcactgtcgaaagccgacgaaacaacgtcgatcaccacttgctcggtcagcgccgaagagtcgacgatcatcgcgttctggccaccggtttcggcgatcagcggaatcgggcgaccctgggcatccagacgaccggcgacgctgcgttgcagcaggcgcgcgacttcggtggagcctgtgaacatcacgcctttgacgcgatcatcacccaccaggcgcgcaccgacgctttcgccctggcccggcagcagttgcagcacgccttccggaataccggcttcaagcaggatgcgtacggcttgtgccgccaccaacggggtttgctcggcaggcttggccaataccgggttaccggcagccagtgccgcagcgacttggccgctgaagatcgccagtgggaagttccacgggctgatgcagaccaccgggcccaacgggcggtgggcgtcgttggtgaaatcgttgcgcgcctgcacggcgtagtagcgcaggaaatccacggcttcacggacttcggcgatggcgttggcgaacgtcttgccagcttcgcgggccaacaggcccatcaacggctgaatctcgccttccatcaagtcggcggcacgctccaggattgcggcgcgctcggcgggcggggtggcctgccagatcgggccggcgttgatggcgcactggatcgcattgtcgacgtcttcgacggtggcttcctgtacatggccgaccacgtcacgcaggtcggacgggttcagcaccggtgcagcggcttcattgctggaggcgcagcccagcatcggcgcggctttccagtcgttgtgcgcggtggccaacaaggcacaggacagcgacgccaagcggtgttcgttggccaggtcgatgcccgccgagttggcgcggtcgctgccatacaggtcacgcggcagtggaatacgcgggtgcggcaggccgaagccgccttccagcgtcgccatttgctcgatgttggccactgggtcggccaccagctcctggatcgagatggtgtggtcggcaatgcggttgacgaacgaggtgttggcgccgttttccagcaggcgacgcaccaggtaagccagcagtgtttcgtgggtgccgaccggtgcgtacacgcggcacggacggttcagcttgccttcggaaactttgcctacaacctgctcgtacagcggttcacccatgccgtgcaggcattggaactcgtactggccggggtaatagttctgaccggcaatatggtagatcgccgacagcgtgtgggcgttgtgcgtggcgaactgcgggtagatggcttccggcaccgacagcagtttgcgtgcacaggcgatgtaggaaacgtcggtgtacaccttgcgggtgtacaccgggtagccttccaggccttcgacctgggcgcgcttgatttcgctgtcccagtacgcgcctttcaccaggcggatcatcaagcgatggcggctgcggcgcgccaggtcgatgacgtagtcgatcacatacgggcagcgcttctggtacgcctggatcacaaaaccgatgccgttccagccggtcaattgcggctcgaagcacaggcgctcgagcaggtccagcgacagctcaaggcggtcggcttcttcggcgtcgatgttcaggccgatgtcgtactgcttggccagcaaggtcagcgaaagcaagcgtgggtacagctcatccatcacgcgctcgtactgcgcgcggctgtaacgcgggtgcagggcggagagcttgatggaaatgcccgggccttcataaatcccacggccgtgagaggctttgccgatggagtgaatggcttgttcgtacgaggccaggtacttctgggcatcgtgttcggtcagtgcggcttcgccgagcatgtcgtaggaatagcggaagcccttggcttcgaacttgctcgcattggccagggcttcggcgatggtttcgccggtgacgaactgctcgcccatcaggcgcatggccatgtcgacgcccttgcggatcatcggctcgccgctcttgccgatgatacggctcagcgacgaggtcaagcctgcctcgttgtgcgtggccaccagtttgccggtcagcagcaagccccaggtggcggcattgacgaacagcgacgggctgttacccaggtgcggctgccagttgccggtgctgatcttgtcgcggatcagcgcgtcgcgggtgcccttgtccgggatgcgcagcagcgcttcggccaggcacatcaatgccacgccttcctgggacgacagggaaaattcttgcagcaggccctgaacaataccggcacggccgccggcgctcttctgattgcgcagtttttcggcaatcgaggcggccagtttgttagtcgcttcagccatcggctgcggcaggcgtgcctgctcgatcagcatcggcaccacttccggctcggggcggcggtaggcggcggtgatcgaggcgcgcagtacggactgcggcaggatgctttcggcgaactccaggaagcactggtgggcgtggtccggctggacttcgcctgcgtcttcagcgtccttgctgcccgagccattgagctcggtcagggttgcaccaccctcgagtttctccaggtaattgaaaatcgcctgcttgatcagccagtgcggcgtgcgatcaatggaggtcgcggcggccttgaggcgttcgcgggttgggtcgtcgagtttgaccccaagggtggtcgtagccatctttttatcctcatgggtgccactactgcgtggcatctgctggcggcaagattagctttgcgcatgcagaggtgcaaccgggtgcaacccaaattgttcaggatttttttgatcgtgatcgggaaaaaatccggccctcgtcggaatcggctcttccttggtgcgtttacttctgagatcggctgttcttgctccgaaaaggagcaaaaaaccgatgttttgccttaaacatacccaggtgcaacttattctcaagaaactggttgcaccttatttactttgttgaatagcattcgcgcccaaggtgcaaccagctgcaaggtttggttcatcggctggcggctttcctggggaaacgccagtcataaatgcacggcacgcagtttcgtctacccggttatccacgggtggccgtctgactcagaccgtcgctacataaaaacaaagccagggcgtcacttcttatgagcgttagcaaccccaccctgatcacgtttgtgatctacatcgcagcaatggtgctgatcggcttcatggcctatcgctccaccaacaacctctccgattacatcctcggcggtcgcagcctcggcagcgtggtcaccgcgttgtcggccggtgcctccgatatgagcggctggttgctgatgggcctgccgggcgcgatctacatgtccggcctgtcggaaagctggatcgccattggcctgatcgtcggcgcgtacctgaactggttgttcgtggccggccgcttgcgggtgcagaccgaacacaacggcgacgccctgacgctgccggattatttctccagccgtttcgaagataaaagcggcctgctgcggatcatctctgcagtggtgatcctggtgttcttcactatttattgcgcgtccggcatcgtcgccggtgcccgtctgtttgaaagcactttcggcatgtcctacgagacggcgctgtgggccggtgctgcagcgacgattgcctacactttcgtcggtggtttcctggcagtcagctggacagatactgtgcaagccacactgatgatcttcgcgctgatcctcacgccgatcatcgtgctgctggccaccggtggcgtcgacaccaccttcctggcgatcgaagccaagaaccctgacaacttcaacatgctgaaaaacaccaccttcatcggcatcatctcgctgatgggctggggcctgggttacttcggccagccgcatatcctcgcgcgtttcatggcggcggattcggtgaagtcgattgccaacgcacgccgcatctccatgacctggatgatcctgtgcctgggcggcaccgtggcggtgggtttcttcggtatcgcttacttctcggcgcacccggaagtggccggcccggttaatgaaaaccacgaacgtgtgttcatcgagctggccaagctgctgttcaacccatggattgccggcgtgctgctgtcggccatcctggcggcggtgatgagcaccctgagctgccaattgctggtgtgctccagcgcgctgaccgaagacttctacaaaaccttcctgcgcaaaaacgcctcccaggttgaactggtgtgggtcggccgcgccatggtgttgctggtggccctgatcgccatcgccatggccgccaacccgaacaaccgcgtgctgggcctggtgagctacgcctgggccggtttcggcgccgcgtttggccctgtggtgctgatctcggtgatctggaaacacatgacccgcaacggcgcactggccggcatcctggtcggtgcggtcacggtgattgtgtggaagcacttcgagctgctgggcctgtacgaaatcatcccaggcttcatcttcgccagcctggcgatctacgtcgtcagcaagctgggcgcaccgactgccggtatggtcgagcgttttgatgctgcggaaaaagactacaacctcaacaagtaattcttcgggtgcctagcgcccgttgagttggaaaaaaggcccgcatcctacggatggcgggccttttttgagggccgattcagtcagcatccgcttgattaagaaaaatcagcacgcccagaatcgccatgtagaacttgaacgccgcttcctggccgttccactgatgggattgccacatcaagaaccattccccgcccaccaccataaaaccaaaaaaccacaccacaaagccaagggcgaggccgctggttgcgcgggctttggcgcggttgaagtcgctaccgctggcgtgccgcgcgcgccacagcgacagcgcaccccaggccagcaacagcgcgcagagcgcctctcccaggatgatcagcgcataggccgcgtgccacaaccacggcgtggtgattgagcggtacatggccgcgttaccagggaacgtggtgtccatgctcagcacgtgttggacgaaggcgaagttggagccgtagtccgtgatgttgttgaacgcaaccatgctggcgaaggcggcgagggcgagggtcaagatgatttttgcgtagcggatggccatgctttttccagtgatccggcgagaaagggacaattacgctagcacggcggtggtgtgctttcgacgcagggaacatgaagaatcgggcactcatggcgtaggaacatactgatttggccgcgcggcgctcaggagggcaaaaagctggtgcagaatcgaccgcccacccctcgcagagaaacaccggatgttcgctcctgccaacgaaagcgcgtttaccctgaccctcgatgggcagcccagcgatctgaaggtccatgggttcacaggtgatgagtttattagcctgccgtttcgcttcgaccttgaactggtcagcgaacaggcggatctggacctcgagagcctgatgcaccggcaggccttcctgggcttcgacgctgacggtcatggtattcacggcctggtctatcaagtggcccaaggcgatgcgggcaagcgtcttacccgttaccagatcagcctggtaccgcagttggcgtatctgcacaacagtacgcaccagcgaattttccagaataaaaccgtgccccagatcatcgcgttggtgttggaagcccaggctatccaggccgacacgttcacgtttcaactgagtggaaagtatccggagcgtgaatactgtgttcagttcggcgaaaacgatctggagttcattcaacgcttatgtgacgagtcgggcattcactaccacttccagcacagccccgagcgccacctgttggtatttggcgatgaccaaagcgtgtttgtccggcaggatcaagccaccccgtactcgcccggcaccgggatggtggccgatacgcccgcgatcaagcgcttcagcctgcggttggaaacccgtacaacgggtgtgaacctgcgcgactacgacttcaagaaaccgagcctggtactggaaagcgcagcgtccggtgggcaacgcccctccctcgatgagcagcgctaccccggggactttacggatcgtgagcacggcaagtacctggcgcagcgccggttggagcgccatcgcagcgattaccgcctggccagcggcttcagcaaccaaccggcattggtcactgggcagttcctgaaaatggccgggcacccgcgtcaggaatggaatgatttgtggttggtcacccgtgtgcatcatgtggggcatcagcctcaagtgctggaggagtctgccccggaaatatatggcgataaattgtctcagggctacgacaacgatttttttgccacgccttgggacgtgcagtttcgatcacccttgatactgtcgcggccgcagatctccggctaccagaacgcggtagtcaccggccccgccgacagtgagatccactgtgacgaatacggccgggtcaaagtacagctggcctgggaccgcgacggcgagcataacgaccattccagctgctggctgcgcgtcgccagtgcctgggctcatgaccgttatggtgcggtgctgattcccagggtcggcatggaggttctggtcggcttcgccaacggcgacgtggatatgccgctggtgatgggttgcctgcccaacgcggccaaccccgtgcccctcgacctgccggcggacaagacccgcagtatcttgcgcagccacagcagccctggcggtggtggctataacgaactgcgcattgaagaccgcaagggcgccgaggaaatctacctgcgtgcccagcgcgactggacccagcacgtgctgaatgaccagcaggtgcaggtcgataacgggcgccgtgtgaaggtgggcggcgagtcgcatcacgagctgcaaggcgaagagcagcgcattacccatggcaaccgcctcaccgagctcaagcaggatgatcatctggtggtcggtggttcgcagcagatgcgcgcggggcggacgattcagatcggagcagggcaaagcgttgttatcgatgccggtgccagcgttacgatccaggcgggcgggcagtcgatcacgctgtcggcgggcggcattttcagcagcgtgccgattcaactgggtggtgcacccgctgctgcagctgcgccgttactaccgggcatcaaggaagcgctggcggcggttgttcccgcaccgctcagccgcgtgcaagtggccagcctgaaacgcagcgcgccattttgcgaagagtgtgagcgctgcaagaacggccagtgtgatatcgccgaccacacccaggttcgcccttaaaaggaatttacccgtatgcgtcactccttgactccacacacctggctggccgaatttcctttgctgcccgatgagcgaattttcgcggtattgggcagtgccagcgacgctaaaccctatgccgcctggcatgccatggccgtcggactgccgtcccagccaatctgggcaggcagcgcctacgcgcaatggaatgaagtaatgccttacgttgccgttatcgagcccggcagcgcctttctcgactgggtcgcaaccaccgactcaacggattggggctggctggccgtatcatccagcccgctggaaaccgtggtggcgcacctgcaaagcctgaccaaggtgctgctgcctgacggccaggaggtatttttacgtttctgggatggcgctcaatggctgccgattgtgcaaacgctgggcgacgcggcggggaaggtgttgccggtatttcagcgttacttgatcaacggccaaccgctaacggttgcgactggcccggtcactgccgccaacaccagcccatggtggcaagtgcctgcctcgttgctggagcatctggcagagcaatcaccccacgtgctgatcgacaacctgctgcaatggctcgaagaacagcgacccgacctgtttaccgccttcacgcctgcgaccttgcgccacaaggtcgcctactttgcgcgcaggccgggtggcagtcatgaagcactgactgagtacctgaccttagagatgaattgagcccaacgcggggcaagcccgctcgccacgctctgcccctttgctccggtagaaggtaaacttcgcctcctgcgcaggagcaaccatgaattatcgtcacgcctttcacgccggcaaccacgccgatgtcttcaaacacttgaccttgacccgcctcatcgccttgatgtcgcgcaaggagcagccgttcgcctacctcgacacccacgccgggatcgggctgtacgacctgcaaggtgatcaggccaaccgcaccggtgaatacctggaaggcatcgcccgcctgtggggcgagagtgacctgccgccgctgacggccgattacatgcgcgtgctgcacgaaatgaacccggatggccagttgcgctactaccctggttcgccggagctggcgcgccgcctaacacggcctcaggaccgtgtgctgctgaatgaaaaacacccggaagacggcgtgctgctcaaggacaacatgaagggcgatcgccgcgtcaaagtgcatttgggcgaaggctggcatgtgccgcgcgccttgctgccggtgccggaaaaacgcgcgttgatgttgatcgatccgccgtttgaaaagctcgacgaaatgcagcgctgtgcagcgtccctcaaggaagcggtgagccgcatgcgccagaccgttgcggcaatctggtatccagtgaaagaccagcgcatgttgcgtcgtttctaccaggacctggccggaactggcgcaccgaaattgctgcgggtggagttattagtgcatccgctggacacgcccaataccctgacgggttcgggcctggcgattgccaacccgccgtgggggctggaagaggagttgcgtgagctgctgccgtggctgtccaagaaacttggccagacccagggcgggtggcagatggactggcttatcgctgagtaatcagtcgcctgtcagggcgctatcgcgggcaagcccggctcccacagttggaatgcattccagggtgggagtcgggcttgcccgcgatgcttttggcgtcagatcgggcaggtcacgcccgtgccgccaatcccgcaatacccctgcggattcttcgccaggtactgctggtgatacgcctcggcgaagtacaccgtcggcgcttgttcgatttccgtggtgatggtgcccaggccagccttggtcagctcagcctgatacgcctcggcgctggccttggctgcttccaggtgctcaggtttcacggcgtagatcaccgaacggtactggctgccgatgtcgttgccctggcgcatgccctgggttgggttgtgcagttcccagaacattttcagcagctcttcgtaactgatcttgtcttgatcaaacaccaccagtaccacttcgctatggccggtcaggcccgagcagacttcttcgtacgtcgggttcggcgtgtaaccaccggcgtaaccgaccacggtgctgaccacgccgtcgcgctgccagaaccgacgttcggcaccccagaagcagccgagaccgaagatcgcgaactctacgttgtcgacaaacgggccgagcagcgggttgccgttgacgaaatgcgtctctggcagcgccatcggggtttcacggccaggcaaagcttgttcttgagtgggcaacacgtttttgttcaccagaatttccgagcgcaagaccatgatcagtcctctcgtcaggttgagttagcggtaaagattcagacagccagtgtgcccgagtgttacagcgctgtcaggcgattggcccgcgcgggtagcgtttaagcttctcgagcagctctgcaccggggatcggccggtcgaagaggtagccttggcccacatcgcagcgatgccggcgcaggaacgccagttgctcggcggtctcgatgccttcggctaccaccttgagcttgaggttgtgggccatggcgatcaccgccgaggtgatttccatgtcgtcctggttgtccgggatttcgtggataaaactgcgatcgatcttgatgatgtcgatggggaattttttcaggtagctcagcgatgagtaacccgtgccgaagtcgtccatggccagggtcaggccaaaactcttcagttggtcgagttgcaggcgcgtgtcttcggtggcttccagcagcaggccttcggtcagctccagctccagcaggttggcgggcaactgttcttccttgaggatggtggcaatcgaggccaccagatccgggtcggagaactgcttgggcgacaggttgatcgccacctgcaaattgcccatgcctgcggcggtcagctgacggctcatgcggcaggcctggcgggcgatccatttgccgatcgggatgatcagcccggtttcttctgccacgctgatgaattgatcagggcggatcatgcccttttccggatggttccagcgcagcagcgcttccatgcccagcaagcggccgctgcgcaggcacagtttgggctggtagaacacgtccagctcgttctgagtcagggcgcggcgcaggttgttttccacgaacagcttgtaactggcctcggcattcagcgcctcggtaaacacctgtacctggtgtttgccgttggctttggccttgtgcagcgccaacccggcgttacgcatcagggtttgcgggtcgcggccatgcagaggcgcacacgccaggcccaccgagccggtgacactgatcaactggttgtcgacgaacatcggtttgtcgagggtcgccagcaattggctggcgacctgctggccagtctccaggtcggtgtcgtcgagcaacaccgcaaactcgttactggcaaaccgcgccaggctgccactggcactcaggctgttgcgcaggcggcgcgccaggctgatcagcagcttgtcgcccgtttggtggccaaggctgtcgttgatccgcttgaaattgtcgatgtccaccagcaacaggctgatcgggctgtcgctgtcgcgggcaaagcgctcgtcgaggttgcggataaacgctgggcggttgcccaggttggtcaggttgtcggtgtaggccaggcgctcgatgcgctgctgggccagcttggtctgggtgatgtcttcgtagatgccgatgtagtgcgtcagctcacggttgtcgccatacactttggaaatcgacagctggccccagtagggttcgaggttcttgcgtcggctcttgaactcaccctgccaactgttgctcttggccaggctcgacggcgcgtcgaacagcagctcgctgaggttctccagggccggcaactgcgccaggcgatggccgtggacttcttcggcgctgtactgggtgatcgcggtgaagctggggttgacgtactccaccacgccgtcgcaattgaccagcaaaaaggcgttggcgctttgctccacggctcgctggaacaagtgcagcgcgctggtggcggtgcgccggttgtggttgttgatcacttgcgcgaattggtccgccaactcgccggcaaaggcgatctcatcggcctgccaggcacgcgagctgccgctttgttccaggcacaacacgccgatcacctggccatcaacgcggatgctggcgtcgagcatggcgtgcacatccttggcgcgcaggctctcggccatttcccgggtgcgcgggtcgcgcatcgcatgggtggcgtcgatggcgcggctcgaatgcagggcttccaggtagtccgggaagccgctggcgtcgatcgcttctggcaagtggtgctgttggtcgtcgcggtggtacgccgagatcggcaccaggcgctggccttcaaggttccagatgctcgcgcaatcgatctggtagatatcgcaggcgctgcgggtgatcagctcggcggcttcctgcaacgaattgggcgtggtgtagcgctggcgcgccagcagcaggatcagctcctgttgggcgcgcacacgttccaggtgctgcaattgttcctgctgggcgcgctggttgagttccagagcgatctgcaggcggctgttctggttttccaggtcggccgttggggcggcggtggggatttcgctgaacagcccgtcgaccaccatcaggtagccgcgcagcaggtggcggttgtgttgtttgtaggcctcgcccatttccagcaggctcagcgggccgtcgttggtgtgcagggtgtagcgcaccaggtaatgcgggctctgggtcagttgctgctggatcgcatcgtgcagctgatagcgcgcttgaggttccatcaagctggcgtagggtgtgccgaccagtgcacacagttccatcgccggcagaccgaattggcgctcgcaattggggtcgaggtacagcagcgcccagcttgcctcattaagccgctcgaaacgcagcataccgaggcgcgagggcaccggtaactgcgtcactacctcggccgccatacgggcgacatcgggttggcttttcatggggaaactcgcttgggaaaatgcgcacggcgccgggctcacgccctctttactgtcgcctgcggcaaggttgcatcatgcagcacgcactgacaagagaggatgaaggctaagtgctatatggctgttatcggccgccggagcggtttctacaatccaggtgatgggtggcgcattgacgcaggtacgacgccctttgcccctacaaaacaaccggccaaaaaaagccccgccaattggcggggttgaggtacgagcgtggcgctcgaaaatcgttgcagccaggcctctgcggtgaagcagaggcctgttgaggcttacagcaagatggtgcggatgtcgttcagcagttggctcagacgctgcgtgaagcgtgcagcagcggcgccgttgatcacacggtgatcgtaggacaacgacagcggcagcatcagcttcggctggaacgctttaccgtcccacacaggctggatggttgctttggacacacccaggatcgccacttccggcgcgttgacgattggcgtgaagccagtgccgccaatgtgcccgaggctggagatggtgaagcacgcgccctgcatgtcgtccggggtgagcttcttgtcgcgggccttggcagccagtgcagcggcttcggcagcgagttgcagcaggctcttctggtcgacgttcttgatgaccggtaccagcaggccgtccggggtgtctaccgcgaaaccgatgtgcacgtacttcttgcggataatcgccttgccgcttggtgccagcgaggcgttgaagtccggcagctccttgagcaaatgcgcgcaggccttgagcagcagcggcagcacggtcagtttcacgccggccttttcggccacggctttctgcgcaacgcggaaagcttccaggtcggtgatgtcagcctggtcgaactgggtcacgtgcgggatgttcagccagctggcgtgcagaccggccgcgccgatttgcatcaggcgggtcatcggcacttcttcgatttcgccgaagcggctgaagtcgacggtgcggatcggcggaatgcccgaaccaccggtcgcgccgccagcagccggcgcttccttggctttctgcatcatggctttgacgtaaacctgcacgtcttctttcagcacgcgaccgtgtgggccagtggccgacacagcgttcagctcaacgccgaactcacgggccagctgacgcacggcagggccggcgtgaaccttggcaccgcttggcgcaggtgcggcagccgcaggggccggtgcggcctcggcttttgcagcaggcgcaggcgcaggcgcagcagccggagccgcttcagccttggcagccggagcagcggcggcgggtgccggtgctgcggcaggcgcagcgccttgtactttgagcttgaggatgaagtcgccagtgccgacttcgtcttccagcttgaccgcgatgctttccaccacgccggcagccggcgaagggatttccatggaggctttgtcggactccagggtgatcagcgactggtcggcttcgacagtgtcgccgaccttgaccagcagctcgatgatcttggccttgcccgacgagccgatgtccggaacatgaatgtcctggacggaggcggcggcaggtgcagcggccggggctggagcagcctcggcagcagcaggtttttcagcagccggtgcgggtgcagcagcggcagcaggcgctggcgcaggggccgcatcagcggcaccttcgatttccagctccagcagttcgtcgccttctttcaggcggtcgcccagcttcactttcaggctcttgaccacaccggctttgggagcagggatttccatgctcgccttgtccgattccagggtcaggatgctctggtcggcttcgactttgtcgccgaccttcacaaacagctcgattacttcaccttcaccgctgccgatgtcaggtacgcgaatgagttcgctcacaaaaaatctcctcagcagtccagtgggttgcgtttttccgggttgatcccgaacttgacgatagcgtcagccaccaccttaggttcgatttcaccacggtcagccaaggcttccagggctgccaacaccacgaaatgacggtcaacttcgaagaagtgacgcagcttcttgcggctgtcactgcggccgaaaccgtcggtgcccaggactttgaattccttggacgggacccactggcgaatctgttcagcaaacagcttcatgtagtcggtagaggcgatgactggacctttacggccggccaggcattcttcgacgtagctcttcgctggcttctgacctgggtgcaggcggttgttgcgctctacggccaggccgtcgcgacgcagttcgttgaagctggttacgctccacacgtcagcgccgacgttgaactcgtcacgcaggatcttcgccgcttcacgcacttcacgcaggatggtgccggagcccatcagctgcacgtggtgcgccgcttccttggtgtcttcttcgagcaggtacatgcccttgatgatgccttcctcaacaccggccggcatggctggttgctggtaggactcgttcatcacggtgatgtagtagaaaacgtcctgctgctcttcggtcatcttcttcatgccgtcctggatgatcaccgccagctcatagccgtaggttggatcaaaggtgcggcagttcgggatggtggcagccaggatgtggctgtgaccgtcttcgtgttgcaggccttcgccgttcagcgtggtacggccggcggtgccgccgatcaggaagccacgggtacggctgtcgcctgctgcccacgccaggtcgccaatccgctggaagccgaacatcgagtagaagatgtagaacggcagcatcggctggttgtggctggagtacgaagtaccggcagcgatgaaggagctcatggcgcctgcttcgttgatgccttcttcgaggatctggccctttttgtcttccttgtagaacatcacctggtctttatcgactggctcgtagagctggccgacggaggagtagatgcccaactgacggaacatgccttccataccgaaggtacgggcttcgtccgggatgatcgggacgatacgcgaaccgatttccttgtccttgaccagctgcgcgaggatccgcacgaaggccatggtggtggagatttcacggtcgcccgagccgtccaggatagccttgagggtatccagtggcggggtcggaatatcgaaggacttggcgcggcgctgtggcacgaaaccgcccagtgcagcgcggcgctcgctgaggtagcgggcttcggcgctgtttggctccggcttgaagaacggcaggttctccagctcttcgtccttgaccgggatgtcgaaacgatcgcggaacagcttcaggctttcaacatcaaccttcttggtgttgtgcgcagtgtttttcgcttcgccggcaccggtgccataacccttgatggtcttggccaggatgacggtcggttgttctttgtggttgaccgcttcgtggtacgccgcgtagaccttgtacgggtcgtggccgccacggttgagtttccagatctcgtcgtcggacaggtcggcaaccatcgccttgagttcaggcgtgttgaagaagtgttcacgcacgaacgcgccgtctttggctttgtagttctggtactcgccgtcgatgacctcgtccatgcgacgttgcaggataccgtcgacgtctttggccagcagtgggtcccagaaacggccccagatgactttggtcacgttccactgagcaccgcggaacacgccttcgagttcctggatgatcttgccgttgccgcgaaccgggccgtcgaggcgctgcaggttgcagttgatgacgaagatcaggttgtcgagcttctcgcggccagccagggagatggcgcccagggattccggctcgtcacactcgccgtcgcccaggaagcaccagactttctgcttgccttcagggatgaaaccacgcgcttccaggtacttcatgaagcgagcctggtagatcgcctggatcgggccaaggcccatggatacagtcgggaactgccagaaatcaggcatcagccaagggtgcgggtacgacgacaggccgttaccgtccacttcctggcggaagttgttcatgtgttcttcggtgatgcggccttccatgaacgcacgggcgtaaacgcctggagaagtgtggccctggaagtagatcaggtcgccgccgtgttcgtcggtcggggcctggaagaagtagttgaagccgatgtcatacagggttgcgctggaagcgaagctggagatgtgaccgcccaggtcagaatctttcaagttcgtgcgcattaccatcgccatggcgttccaacgtaccagcgagcgaatgcggcgttccatgaacaggtcgccaggcatgcgtgcttcgtgggtaacggggatggtgttgcggtatggcgtggtgatggcgtagggcagttgcgagccgctgcgggtcgcgagttcgcccatacgggtcatcaggtagtgagcacggtcttcgccttctttgtcgagaaccgattccagggcgtccagccattcctgggtttcgacgggatcgaggtcttgcatggcttgctccagggcggaaaggctaccagaatcggttgcctgaagtttgcgactggccttgtgggcagacgacataaattcttggatggccgaaggttgcttcggcgtcctgtagttttactacaaatcgtcggccatttcagcctttcgaatgtatatacgagtagtaaaactacacaagactgagcgtatggctcggtctggctggtgagcataatcgttattgttgatcttttgcgaacaagaaaaggtgaaagtttgatgttgcctgccaagattaatttaatttcagctatttataacctttgttcgacagtccttcaccaagcgtggttcttgcgttcacagcaacacgccatttacgcgccgatcaaggatagaccatgagccttccaacgctggccgaactaccggccattctcttgccttttgcccagcgggccgagcagtcatttcgtgacgcagtggccgcgctggacgccgatcatggcctttctgagtggacgccgcaacggtgggctgaattcgcccgcgtgtgcgccgccagtgatttcgtcattgaacagagcttgcgtgaccctttgatgttgctcgaactggtggcctggggcgagctggaccgcggctttgcgcccggtgagctgtgcggccagatcgccggcgccgtgcaacaggccgaaacagaagatgagctgggccgcgtactgcgccgccaacgcacgcgccagcaagtgcgcatcatctggcgcgacctgacgcgccaggccgacctggtgcaaacctgccgtgacctttccgacatggccgacgccagcatcgaccaggcttatcaatggctgtaccaacgccactgcgtgcagttcggcacgcctaccggccgtcgcagcggcgaagcccagcacatggtcatcctcggcatgggcaagctcggtgcggtggagctgaacctgtcgtccgatatcgacctgatcttcgcctaccccgaaggcggcgagacggtgggcgtgaagcgcgccctggataaccaggagttttttattcgccttggtcaaaaattgatcaaggccctcgacccgatgacggtcgacgggtttgtgttccgcgtcgacatgcgcctgcgcccttacggttcggccggcgccttggtgctcagcttcaacgccctggaacagtattaccaggaccagggccgcgactgggaacgctacgccatgatcaaggcgcgcgtcgtcgccggcgaccaggtggccggtgcgcaactgctggatatgctgcgcccgttcgtctaccgccgttacctggacttttccgccatcgaagcgctgcgcaccatgaagcagctgatccagcaggaagtgcggcgcaagggcatggccgacaacatcaagctgggctcgggcggcatccgcgaagtggaattcatcgcccaggcgttccagctgattcacggtggccgcgacctcagcctgcaacagcggccattgctcaaagtactcggcaccctggaaggccagggctatttgccgccggcggtgatcgccgagctgcgcaatggctacgaattcctgcgttacaccgaacacgcgatccaggcgattgccgaccgccagacgcaaatgctccccgacagccccgaagaccaggcgcgcattgcctttatgctcggcttcgccgattgggccgccttccacgagcgcctgatgtactggcgtggccgggtggactggcacttccgccaagtgatcgccgatcctgatgaagaagagggcgaagaaagcgagttggtcgtaggtggcgaatggctgccgctgtgggaagagtcccaggacgaagacgctgcttgccgccagttggccgaaggtggttttaccgatgcgcccaaagccctcaaagccttgactggcctgcgcggcagcccgcaactgcgtgccatgcagcgcctgggccgcgaacggctcgatgcgtttatcccacgcctgctcgcccaggccgtcgaacacgccaacccggacctggtgctggagcgtgtattgccgctggtcgaagccgtcgcgcgccgttcggcttatctggtgctgctcacggaaaaccccgacgccctgcgtcgcctgctgaccctgtgcgccgccagcccgtggatcgccgagcagatcacgcgcttcccgctgttgctcgacgaactgctcaacgaaggccgcctgttcaagccgccattggccccggaactcgccgccgaactgcgcgagcgccttacgcgcatccccgaggatgaccttgagcagcagatggaggccttgcgccacttcaagctggcccaccgcctgcgtgtggccgcgtcggaaatcgccggtagcctgccgctgatgaaagtcagcgactacctgacctggctggccgaagccatccttgaacaagtgctggccctggcgtggcgccagaccgtggcgcgctacggctcgccgcaacgggtcgacggcacgctgtgcgaccccggttttatcatcgtcggctatggcaaagttggcggcatcgaactgggccatggctccgacctggacctggtatttgtccacgacggcgacccgcaggccgagaccgatggcgccaagccgattgacggtgcgcagttcttcacgcgcctgggccagcggatcatccatttgctgaccacccagaccaactccggccagctgtatgaagtggacatgcgcctgcgaccttcgggcgcgtccggtttgctggtgagttcgctgggggcgttcgagcgctatcaggaaaatgaagcctggacctgggagcatcaggcgctgatccgcgcgcgggtgctggtgggcagccaggatgtgggccatgcattcgagcaggtccgcgctaaagtactggggcgtgagcgcgacctggccaagttgcgccaggaagtcagcgagatgcgcgccaagatgcgcgacaacctgggcaccaagtcgacggcggccggcaccggcgccaatgccttcgagcccacggcggcgttcgacctcaagcaggacgccggaggtatcgtcgatattgaatttatggtgcaatacgcggctttggcgtggtctgcgcagcatccatcgttgctgcgctataccgacaatatccgcattctggagggcctggagcaggtcgggctgatgcccgccgccgatgcccatctgttgcgtgaggtgtataaggcctaccgttccgccgcacaccgccaggctttgcaaaatgaggccggcacagtggctggggatcagttcgccgacgaacggcgtcaggtgatgcgaatctggaatgaactgggtttaagctgattaattaagtggctccaatttaatgtggaaatcggctttatgtgggagccgggcttgcccgcgatgcaggcgcctcggtacttcagccataccgaagcgatgccatcgcaggcaagccagctcccacaaaaagcgcgatctacaatcattgtcgatgcggggaggcataagcctccccgcatcgtttgtggaaactacatgaatattctgatcgttgggcccagttgggtcggtgacatggtgatggcgcagacactgttccagtgcctgaaacagcgtcatcccgactgccaaatcgacgtgctcgcccctgagtggagccggccgatcctcgagcgcatgcccgaggtgcgcaaggccttgagcttcccgctcggccacggcgcccttgagctggcgacgcgtcggcgcattggcaaatccatggtcggcgagtacgaccaggcgatcctgctgcccaattcgctcaaatcggcgctggtgccgtattttgccggcatccccaagcgcaccggctggcgcggcgagtttcgctacgtcttgctcaacgacgtgcgcgccctcgacaaagcccgctacccgctgatgatcgaacgcttcatggccctggcctacgagcccggcgccgagttgcccacgccgtacccgcgcccgagcctgcagatcgacccggtgacccgcgacgcggcgctggccaagttcggcctgcagctcgaccgtccggtgctggcgctgtgcccaggcgcggagtttggcgagtccaaacgctggccgtcggagcattacgccaaagtcgccgagatgaagattcgcgagggctggcaggtgtggttgttcggctcgaaaaacgatcattcggtgggcgaagacatccgccagcgcctgattcccggcctgcgcgaagaagctgtgaacctcagtggcgacacgtccctggccgaagccatcgacctgctgtcctgcgccgattcggtggtgtccaacgactccggcctgatgcacgtggccgccgcgctgaaccgcccactggtggcggtgtacggctcgacctcgccaggtttcacaccgccattggccgacaaggtcgaagtggtgcgcctgggcttggactgcagcccgtgtttcgaccgcacctgtcgtttcggccactacaattgcctgcgccagttgctgccgcaaccggtcagcgatgccttgcagcggttgcagggctctgtggtcgaggttcgttagtttgcgcgttctggtaatcaagacctcatccctgggcgacgtgatccacgccttgccggcacttaccgacgcggcgcgggcgatccctggcattcgctttgattgggtggtggaagaaggctttgccgagatccccacctggcacccggcggtggacaaggtcatcccggtggcgattcgtcgctggcgcaaaaacatctggcaaaccatcaagagcggcgagtggcggcgtttcaagcagcgcgttcagtcgactaaatacgacttggtgattgacgcccaaggcctgctgaaaagtgcctggctgacgcgctatgtgcgtgcgccggtggcaggtttcgacaagaactcggcacgcgaacccatcgctgcgcgtttctactcgcgccgcctggccgtggcgcgtgggcagcacgcggtggagcggttgcgccagctgttcgccgtggcactgggctatgacctgcccaaaggccttggtgactatggcctgagcgtcgataaactgctcggcctgccaccgaaaaaaccgttcgtcttgctgctgcacggcactacctgggacaccaagcattggcccgaagcctattggcgcgagctggccgagcgcatgggtcgcctgggcgtggacgtgaagttgccgtggggcaatgccgccgaaaaagcccgcgccgaacgcctggcccaaggcctggccaacgccgaagtgctgcccaagctgaacctggccggcgtcgcccgtgttctggccggcgcccgcgcctgcgtggcggtcgacaccggcctcggccacttggccgccgcgttggacgtgccgaccatttccctgttcggccccaccaaccctggcctcaccggcgcctacggcaagggccagattcacctggccagcgattttccgtgcgcgccgtgcctgcaaaaacactgtacctatcaacccacggccgacgatgcgcgtcggttcgacatcaagcgcgagtcgcccctgtgcttcacgcgcttgaaccctgagcgtgtggcaagccggctgagcacgttgttactggctgaggagctgcactgatgcaactggcttttgttctgtacaaatatttccccttcggtggcctgcagcgcgacttcatgcgcatcgccctggagtgccagcagcgcggccaccagattcgtgtctacacgctgatctgggaaggcgacatcccgcccggcttcgaagtgctggtggcgccggtcaaggcgttcttcaaccatcggcgcaatgaaaaactcagcgcgtggatggaagccgacctggccaagcgcccggtcgaccgcctgattggcttcaacaaaatgcccggcctggacgtgtactacgccgccgacggctgctttgaagacaaggcgcaaaacctgcgtcattcgctgtacaaacgttttggccgttacaagcactttgccgagtacgagcgcgcggtgtttgccaaggacgccaagaccgaagtgttgatgatttccgaagtacagcaaccgctgtttatcaagcactacgacacgccgctggagcgcttccacctgctgccgccaggcatcgcccaggaccgccgcgcgccgccgaatgccgccgaaatccgcgaaggtttccgcaaggaattcaacctcgccgacgacgacttgctgctggtgcaaatcggttcgggcttcaagaccaagggcgtcgaccgcagcctcaaggccgtggccgcgttgccgtcggaactgaaaaaacgcactcggctgtttgtaattggccaggacgaccccaaagtattccaattgcagagcgccacgttggggctgggcgataacgtgcagttcctcaagggccgcagcgatatcccgcgtttcctgctgggcgccgacctgttgatccacccggcgtacaacgaaaacaccggcaccgtgttgctcgaagccttggtagccggcttgccggtgctggtctcggccgtgtgcggttatgcgcattacatcgctgaagccgacagtggtttggtgctggatgagccgttcgaccaggcgcagctcaacgggtacctgacccaaatgctcactgacactgcacagcgcgcggcctggagccgcaatgggttggccttcgccgagacggccgacctctacagcatgccgcagcacgcggcggatgtgattctggcggagccaaaacgatgaagttgattcttgccgaaccgttcaagactttatgggcggggcgtgacgcctttgccgaagtcgaaaaactgcaaggccaggtatttcgcgaactggctgcgcgtcgcaccttgcgcaccgaggtggagggccgcccgtatttcgtgaaaatccaccgtggcatcggctggggcgaaatcttcaagaacctgatcaccgccaaactgccggtgctcggcgccggccttgagtggtcggcgatccaccgcctgcaagcactcggcgtgccgaccatgaccggcgtggcgttcggcgaaaagggcagcaacccggcggaccagcactcgttcatcatcaccgaagaactggccccgaccatcagcctggaagacctgaccgtcaattgggtggccgagccgccggcgttcgccttgcgcctggcgctcacggccgaactggcccgaatggtcggcgacatgcaccgtggcggcgtcaatcaccgcgactgctacttgtgccacttcctgctcgacaccgcgcaacccatcgacgcccgcaacatcaagctgtcggtgatcgacctgcaccgcgcccagttgcgtgcccacttgccgctgcgctggcgcgacaaagacttgtccgcgctgtactactcggcgctggaaatcggcctgacgcagcgtgacaagctgcgcttcctcaaaggttacttccgccagccactgcgccagatcctggccgagcagtcggcgtccttgagcctgctgcagcgcaaggccgacaagctgtacgcgcgcaagcagcgtttgggggatgcgatctgatggcgggttggaacctggaacctgcttacgccgccctcgcggatgactttggcagccttgaggcggtgtttgccctgcaaggcgaacgcctgacccgcgacccgctgtcggaagtgattcgggtcgagcgcggcggggtcaattactacgtcaagcgctacgtcggcgccggcaaaggcctgcgtcgctacctgggcaagccacgggtgaagtccgagtggcagaacctcaagcgcttcgccaagtggggcattcccacggctgacgtggtggcctggggcctggagcgcaaggggctggcgtatgaccgtggcgcgatgatcactcgcgagctgccgaaaaccgaagacctgtcggcgctggccgaccgtcacgatgcctgtttgaaagacccgaaatgggtcaatgcgatcagccgccagctcgccgaatacacccgtaccatgcacgagcaccgcttcacgcataacgatttgaagtggcgcaacctgttggtcgacgaccagcaaaccctgtacctgatcgattgccccaatggcgatttctggcgcggcttctggctcaagtaccggattaccaaggacctggcctgcctggacaaggtcgccaagtatcacttgtcggccacccagcgcttgcgtttctacatgcaataccgccaacgcagccacctgacggcgtcagacaaacagcgtattcgccatgtggtgaagtttttcgagggacgcgaatgagtgatttcctggcggccgaagaccgcgctctgcttgagcgccacggcctcgcaaccttcgacgccctgtgggccaggcaactggacgcggtggatgagcccaataccagcgagggcggctggagcagcgtgtttcgcctggagcttgacggccagggttactacctcaagcgccagagcaactacctgacgcgcacgctgcactcgccatttggcgaacccacctttgcccgcgaatttcgcaatatcagccgttaccagaagctcggtattccggcgttgcaggcggcgttttttggtgagcgcaaggttaacggcgagcgccgcgcgatgctgctcacgcgtgccctcgacggctggaatgacctggattcgttgctggagcaatggtcgcacctgagcgacgcccagcaccgcgcgatcctgctggcctgtggtcaattggcgcgacacctgcacagcgtcgggcaggtgcatggctgtttttaccccaagcatattttcctgcaggcggctggcgacggttatgccgcgcaactgatcgacctggagaaaacccgcccgttgctgttcggccgacgtgaccgggtcaaggacctggagccgctgttgcgccgcgcgccgcagtggtcggatgcgcaggtgcggcaattgctggcggcctatcttgatcaaccgcaagacagctcgctggtcagcgcctggtttgagcgtctgacggcgcggcgcagccacaaggagaagcgctgatgcgtttgtccgagctgaaaaaagccggccgcacgcccagcctgccgctgaccatcgaactggcagacgccgcaggccccgggcagttgcaactgctcagcctgttgcgcgtgatgccgggcgagcgctatgtgggcgccggcgtctggcgcgggcgcacggtgctggccaaattgctggtgggcagcaaggccgcacgccactttcagcgtgagctcagcggtgtgcgcttgctcgccgagcaaggcctgaccacgcccttgttgcttgccgatggcctgcaggaaggcgagggtggctggctgctgttcgaatttatcgaaggcgccgaaagccttgccgatgcctggcaggccgtcgaaggcctgccgccgctggccgacgaacaaaccgccgtgctcgctgaagcattggcggcgattgcgcagatgcacacccagggcttgtggcaggaagacctgcacctggacaacctgttgcgccaagacggcaagctgtacctgattgacggtgccggaattcgcgtggaagaggcgggcaaaccgctgtcgcgcaaccgcgtgctgggaaacctcggcgtattcttcgcccagttgccaaaaaacctcgcgccgttcaccgaagagttgctggtgtattacctgctgagcaacggcgagcacgccttgccgctggaagccctggaaaagcaggtgcgcaaagtcagcgcctggcgtttgaaggactttttgaacaaagtcggccgtgaatgcacgttgttcagcgtggtgcgtggcccctttgccttgcgtgcgattcgtcgcgaggaagaggccgcgatgctgccggtgttggagcaggctgatgcgttgctcgatcaaggccacctgtacaagaccggtggtgcggccagtgtcggcaaggtcgaggtggccggtcggccgctggtgatcaagcgctacaacatcaagggttttgcccattggctcaagcgcttctggcgcccgagccgtgcctggcattcgtggtgcgaaggcaatcgcctggcgttcctgggcattgctacgcccaaaccgctggcggtgttggaaaaacgctttttctggctgcgcagccgagcctatctggtgactgagttcctgccggggccggacatcatcgagcgttttgcgccgtatgttgaacacggtgatgcgcccgaaaacgaactgctggcgctggaccatttgtttgccgagctgattcgcgagcgcattagccacggcgatttcaaaggccacaacctgttctggcacgaagaccgctgggcgttgatcgacctcgacgccatgtgccaacacagctcagtcgccagcttcgcgccggcgtatgccaaggaccgcgcgcggtttatgcgcaactggccccagagcagcgcgttgtaccaactgatagatcagcgtttgcccaaagaggtgcaatgatcgttcccacgctccgcgtgggaatgcatcccgtgacgctccgcgtcaccttgcacagggcgggacgcagagcgtccggggcggcattcccacgcagagcgtgggaacgatcagtgcctgccgttactcagcacgctctggctggtgaagaagtacccgtaatgatcgttcccacgctccgcgtgggaatgcatcccgtgacgctccgcgtcaccttgcacagggcgggacgcagagcgtccggggcggcattcccacgcagagcgtgggaacgatcagtgcctgccgttactcagcacgctctggctggtgaagaagtacccgtaatgatcgttcccacgctccgcgtgggaatgcatccggtgacgctccgcgtcgccttgcacagggcgggacgcagagcgtccggggcggcattcccacgcagagcgtgggaacgatcagtgcctgccgttactcagcacgctctggctggtgaagaagtacccgtaatgatcgttcccacgctccgcgtgggaatgcatccggtgacgctccgcgtcgccttgcacagggcgggacgcagagcgtccggggcggcattcccacgcagagcgtgggaacgatcagtgcctgccgtt

SEQ ID NO: 34 - DNA, 144455 bp, Pseudomonas poae FL10F
cgactcaactttgtccatgccgccgccttcgcagcctcgctggggctcgacagctcccacatgggatcggcgttgttaattagggcctaactgtctgcatcgaacctcaattaagcgtgggctcccacaaacgatgcaaaaccctgtgggagctgtcgagctttagcgaggctgcgaaagcggtgggtcgggcgactcaatttcgtctgtgccgccgccttcgcagcctcgccggggctcgacagctcccacaagggatcggcgttgttgaatggggcctgactacctgcatcgaacctcagttaagcgtgggctcttataaacaaagcaaaaccctgtgggagctgtcgagctttagcgaggctgcgaaagcggtgggtcaggcaactcaactttgtccatgccgccgccttcgcagcctcgctggggctcgacagctcccacaagggatcggcattgctaactgcctgccaggcagctcggggtggcggcgaccagggcgtcgatggcgcagcgggtcttggctggcatatgtgtggcggtgggccagatcacatggatcggcgcaggctggtcgcggtagctgggcagtaccgcttcgagttggccgcgcagcacatagtgcgcaatcaaccagctcggcaaccaggccaggcccacgcccgcaatggcggcgtcggccacggcctggaggtcgtccagcaccaacggcgatgtcacacccgcgcgatgggaattattgcaacggtaggcaatacctcggtgaccggcgaggtcatcgatatgttcaatccgcccgacacgttgcaaatacgcaggcgaagcggccaggcccacggactgttcacccaggcggcgtgcgctcaggcgatcggtgtccgggagcgcaccgatacgcacggccacatcaaagccttcctgcgctaggtcgatcatccggtcggagaacgaaatctcgacttccaattgcgggtaacggtccatcaagccccacaacgccggggccgcatagtggtgaccgaaggccagcggcaggctcgcccttaaccgcccgcgtggctgttgccggccactctccagcactgattcggcggcttcaagttcggccagcgcacgcaggcaatgctcgtagtacgcctgcccgtcctcggtcaggcgctgacggcgagtggagcgctgcaacaggcacgtgcccaaacgtgcctccagtcgcgccaaacccttgcccacggccgagcgcgtgaggttcaagcgttcggcagcctctgtcaggttgccgctttcgacgatttgcaaaaacagttcgacgccatcaaaacgcggagtggccatggctctattgtcgcccttgattcccttagcagaggaaaagttatcacgaataaagaattatgttcccgtgagaatggtacttccccccatcacaaggaatatcccatgccgcccgccgccgctgtatcggccgtcagcgcaccgcgcaccgccaaagatggcctggccctcaccgccgtctgcctcgtcgccctgatgttcggcctggaaatctccagcgtgccggtgatcctgccgaccctggaacagcaactgggcacaggcttccaggacgcccaatggatcatgaatgcctacaccctggcctgcaccagcgtactcatggcggcgggcacactggccgatcgctttgggcggcgacgcatgttggtgctgtgcttgtggctgtttggcctggcctcgctggcgtgtggcgtggcgaacgacgcttccacgctgatcgccgcacggtttgtccagggcgtgggcgccggggcgatgatgatctgccagttcgcgatcctgtcgcaccagttccgtgagccggccgcacgggcgcgggcttttgcgatatggggcgtgatcgcaggcgtgggcctgggcttcgggccaatggtgggcgcgttgattctggcggtcgcggactggcgctgggtattcctggtgcatgtgccgctgaccctgctgaccttggtgttgctgcgcatcagcgtgcaggaatcccgcgacccggccggccatcggctcgatatcgccggtatgctgaccttgacgctgtcggtgttcgcgctggtgtacttcatcacccagggcagcgagaacggcttcggcacgccggccatgctcggctgggcggggttgtcagcagccgggctgctgctgttcatcgttgttgaacggcgcagcgcgcacccgatgttcgacttttcggtgttccgtatccagcgctttaacggcgcactgatgggctcgatcggcatgaacttcagcttctggccgttcatgatttacctgccgctctacttccaggcgggcctgggttacgacacgctgaccaccggcgcggccctgctcgcctacaccttgcccaccttgctggtgccgccgctggccgagcgcctggccctgcgctacggcgccgagcgcatcattcctttgggcctgggcatgatgggcgcgggctttatcgcgatggcgacggtcaatgctgccgagcatccgagcattgtactgatgcttttcagctgcgcgatggccggtgtggggttggcgctgactaactcaccgaccaccaacaccaccaccggctcggtctcggccgaccgtgcgggcatggcctcgggcatcgacctcagcgcgcggttgatcaccttggcgctgaacatcgccttgatgggcctggtgttgctgctgggcatcagccatcacctttccagtgtgctgcccccaacgtctgcactggattgggccgccatcagccagagcattgcggcgggcaagctggacgcgctggcgctgaccccggcagacgcgcagtcggcactacgccacggcaccggttgggcgatgctttttgcgggccttggcgctggcgggttggcgatgctgagcgggtacttcttccgacacggcagataaacaaaaacgggcctgcagatgcaggcccgtttgattggggttgaaaaaactgtcagctatcagctgttaagcgcagcctgttcgttttccagaaattcctcttcaagctcggcctcgtcggccttggtatcaggcaatgcttgcccggcggcgcgtggtttgccgcgtaactttccgtacagatgctccagcgcgtgttcaagcttggtcgctgcaccatcaatcgcctgttccagggtatcggccttatgcaggaccgacagtggctgatggccctttggccgtgcctccaggcggcaactcagatcatgaggaccgggcttatcgccattctcatctttcaagtagacctcgacgcgggtcaggtcttcttcataacgttcgagcgtgctctcaatggtagtacgtacccactcctccagtcggatgctgctttcaatatggttatcgctattgacttggatttgcatagttcttcccttatttcagctagctcgcgagaggtcacaaactgcaacaccggggtggtgaaaccatgacctcttgattacacaattgagcagtcggaagaacatttcaacccctttgcgaagataaattacacattacaaattaagcctgacgacgggcaaaaacgctgttagggtggggagttagttacatcttcttacgcccagcgaacctcacaattgcccctctcccaacgggtgcaatccgcgaaaaacccccgcttcctccaccagccagtcatgcaccgcacgcacgcccggatggttcagcgcgccgggcgcatacagcagcacatagcgtttgtggttcggcacagccaggccgaacggcacgatcaaggtgccgcgctccagctcatcattgagcaaggtgcgccgtgcaatcgccacgcccatgccggcgatggcggcttcgatggtcaggtgattgcggttgaaggtgtgcccgcgccgtacgtcggcgtcgtggtagccgatggcattcaggtaaaactcccactcggcgtactcataactcccacgccaggcggtaatgtcgtgcaacaacgggaaatgcaccaggtcggccgggccatgcagcggcgggcggccacgcaagaggctgggcgcacacaccgggaaaatctgttcatccagcagggctgtggataacaggccagggtagctgccgtcgttcaagtcgatggccaagtcgaagtcgccctcgtgcagcgcaatgctgctgtcttcggcgaccatgcgcagttggatatccggaaaacgttgctgcaaacgcggcaagcgcggcgtcaaccatttgcccagaaacgacgggattgagcgcaggcgcaaggtgccgctgatcatccctgcatccaggcgctgcaactcggcgtcgatgctgccataggcctcccccaccgtcgccgccagccgctgcccctccgcactcagctccacaccgcgcgcgcgccgatgaaacagacggaagcccaaacgctcctccaattggcggatttgctggctcaccgcccccggtgtgatgtgcagttcttcagcgcagcgggtaaacgacaaatgccgcgccgcgcaggaaaaaacgtgcagccagacatacgtctggccatgaaggggccgggtcatagggtttagtcctgctaaagggtgtcttaggataattcgttggtcagtgccgatccagaggctcagtatcgcgccaattccgcctgctctacaaaacatggcagcgattcctactccattgcttgtaaggctttagcatggctatcagtgttttcgatctattcaaagtgggcatcggcccttccagctcccataccgtcggtccgatgcgtgcagcggcgaccttcgcccaggccctcaccgaccaggatttgctgagcgacacacgccgtgtcgaagtgcgcctgtacggctcgctgtccgccaccggcatcggccatgccaccgaccgcgcctgcgtgatgggcttgatgggcgaatggccggacaaggtcgaccccacgtcgatcaacgcacgtatccaacaattgcgcgaatccggccaactgttgctcgcaggcacgcaggcaattgccttcaactggcacaccgacctcctgctgctggacgaaagcctgccctaccaccccaacgccatgtccctgcacgcttatggcggcaatggcctgctgagcgaacaaacctattactcggtaggcggcggtttcatcatcgaagcggctgaggcggcctccggcattgcgccgaccagcgatgttgaattgccctacgacttttccagcgccgtcgaactgctggccttgtgcaacaagcatggcctgcgggtttccgaactgatgatggccaacgaacgcgcgtggcgcactgacgaggaaatccgcaacggtttgctgcatatctggtcggtgatgcgcgaatgcgtggagcaaggcttgcgcgatgagggcatcttgccaggcggcctggacgtgccgcgccgcgccgcgaaactgcaccgcagcctgttggaaatcggcaagcccaatgtcatcacgtcgaccttgtccgccatggaatgggtcaacctgttcgccctcgccgtcaacgaagaaaacgccgccggcgggcgcatggtcactgctccgaccaatggcgcggcggggatcatcccggcggtgctgcactactacatgaagttcaacgccgacgcgtctgacgatgacgtggtcaatttcttcctggctgccgccgccgtcggtatcctctgcaagaaaaacgcctcgatctccggcgccgaagtcggttgccagggcgaagtcggttcggcctgcgcaatggccgctgccggcctggccgatatcctcggcgccaccccggagcagctcgaaaacgcggccgagatcggcctggaacacaacctcggcctgacctgcgacccggtcggcggcctggtgcaagtgccgtgcattgagcgcaatgccatcgcggcggtcaaggcgatcaacgccacgcaaatggccctgcgcggtgacggcaaacacttcatttccctcgaccgcgtgatccgcaccatgcgcgataccggcgccgacatgcatgacaaatacaaagaaacttcacggggcggcctggcggtcagctgggtggagtgctgatcggagcactgcaacccgccttgaacgtgagcccgcgcaaaaataataacgaggcaatatcgatgaccgatgtacgccttccgccgcgtgcctgctctgcgccagtactcgggccagctgtcgaatgtgtttgtggtggtgatcgggctgattgcgctgtctgcgatcgttttctcggtagtgccctgaaatagctcacaacacaaatccaatgagggagcgggcttgcccgcgatagcgatctgtcagccaggaattattaagctgatacaccgcaatcgcgggcaagcccgctcccacatgagatagatgaaggtaggaagatcgctgtacggcacgccccttgctgtacagctattgaggaaaacggaccttgtgaaaacctcagcgatggagtggccggtggtcaggcaacgcgaactaatcccgacaccggtcgtcaatgactgcatgttcttatcaggcggtaacgcaccatggacaatccttttcagatcatcaccgacaccttcagcccaaaataccgggttaacctgagcatccagcgtctggatggcagcatcatgctcaccctctccaatgaggagggcgtggttgccaaacgtatgatcagcgccgaacagcgcaatgacccgcaacggctcaaacggcttgtgcaaagcattcaattcggcatcgccatcgagcagggccacagcgccatggagatcctggcggtgatgacggacggcgaccataaactcctgcagcggccgcccgcccgcaccctgcccttcagcgtcgggctttaaagctcgcccttctcggtttccaggctcgcctcgcccttgcgacgcgggccttcgactttaaccgacgggaatgccgacgacgcgtagcgcaccaccagaatcgagaacgccaacagcagaatgccgccgcacaggtagatgatgccgatgtccggcgggttgtggtgggacacgttggagatcagcaggcgcgtcagcgcggtgatcgccacgtagatcaggaagcgcaccggcatgtggttggtcttgaagtaaatcccgaccatcgcgcccaattccaggtagatgaacagcagcaagatgtcatcgatcttgatgtgccccgtctccagcatccccagaaactccatcaccgccgcccaggcggtcaccgcaccaatggcgaacaacgccaggtagtggaacgtctcgacaaacagattgcccagcgactcggccagaccatggacgttctggcgcagcttttcggcccagttgattttcacgatgatgcttccttaggtcggctcgaccggataatgcgggttggacgtgacggttgttctgcatgcagaaaaaaggccagacactaggacttgagatggtggcggcgtgacatgaggcacacggtgacgacaccacctgtggcgagcgcgctctttgatcggcagaaatttccgttgtagcaaacctgtatttacgggctacattaaaaaactgctacccaaaccctgcggtttggcttacccttttcgctgtatataaatacagtagtcgcaaaagacaactatcgtgaaggcatgtgaggtggtgaatggccgtcgaagtggtataccgcagcagccgagatctggagcgtttgttcatggataaagccgaagctgaccgtcatgacaagatgcttgaactcgctgagttgctggcagaagtgttgcaaaaagccgtgccgtccctgagcgagcagcaggtggaagaagccgggatctacatggcgaagaaccgcgatgtatttgccaaggcgttcaagagccaaccggacgcactgtccgagttgctgaacccggcagcggaataaagcccgaattgaacaggccctgaatcattgattcagggcctttttaatgcctggtttatgggtagagcaggcgttcggccagctcatccgccacccgtgcgggggagcgtttttcggcttgggcgtgggcgaagatttcggtaaggcgcgtgccgatgttcgacaggtgcgcggtgatgccgggcagctcggcgccggcgtgtttgagcgcgacgtagatcaggccgccggagttgatcacgtagtccggggcgtagaggatgccgcgcccttccaactggtcggcgatttccaggttggtcagttgcgcgctggcggaaccggccacggcggcgcagcgcagttggccgacgctgtggcgattgaacaccgcgccgacgccgcacggcgaaagaatgtcgcaaggcgtgctgagcaatgcatcgttggcaatggggtgcgcgccgagttgttccatggccagttgcaccttgccgttgtcgatgtcgctgaccaacagttcagcgcccgccgcgtgcagttgctcggccagggcgtagccgacattgcccaggccctggactgccacgcgcaagccttcaaggttgtcgctgcccaggcgtgccatggcggcggcgcggatgccggtgaatacgcccatggccgcatgcggcgccgggtcgccggcggcggtggtgctggtgacgaagcgggtgtgctgggcgatgcaatccatgtcggccaccgaggtgccgctgtcgatggaggtgataaagcggccgtcgagtttttcgacgcaacgcccaaacgcctcgaacagcgccgcgcggctttccacatgcaccggccggatgatcactgccgtgccgccgcccaccggcaagccggccagggcggctttgtagctcatgccctgggccaggcgcgcggcatcggccacggcactttcatcgtcggggtaggcgagataacggcagccgcccaacgcggggcccaggcggctgttatgaatggctatgattgccttcagcccggttaccgggtcgacgctcaggtgcagcgattcaaggcgggtgctgtgcatgagagcgaacatcgtcgggctcccgaatcacttctggttgaggcccaagtataggcttacggcaggaaactgccgaagtacgctggaataagccgcccgatttcgctgaccccgcgacataagcaggtcggatatttcttaagtcactggacgaaaattcacagcaaggctaaaacggggggcatacgccggagaacgcaatgaatccccgcacagcctttttcgcctgtctggaccgttcaccccctgcgctgtttgaagccgcgctgtggattgctgccgagcacgacccggccgtgcagccgttgctgatcctgcaagatctggcgttattgcaacagcaggtcagcgtcggcatgcccatgttgccggccgatgaactcggccagccactgctgcggcgcatgaatgacctggggttcgcccaggacgacttcaccccactgcgccccgccgccgccttgctggacaaggtgctgcagcgcaaacgcgggcaacctttggccatggggctgatcgcgctggagatggcgcggcgcctggatatcccgatggtcggcgtcaacttcccagggcatttcctgctgcgcgtacccggcgccgatcacctgctggacccctgcggcgggcggcgtttgtaccccaatgattgccgcgagttgctgcaccgtcagtacggaccgaatctcaagctgaaggccgaccacctgctcaccgccgaaccccgcgcaatcctgcaacggctgtcacgcaacctgcgccagctgcacctcgccaacgacgacccattggccgccttgattgacgccgaacgcgtgctggaactgggcaatgccagcgcggccgactatctggcgcgggccagcctttaccagcgcctggattgcccgagcgccgagcgttttgacctggagcacgccttgctgctcagcgaagacccgatccagcgcctgcgcctgaccgagcggctggggcacctgccgcctaattcagtggtgcactgaattgggcggcatgggctgttgtggcgagcgggcttgccccgcgttggagtgcgcagcgctcccaatccagccaccgcaatccaatgggtagaccgagtcgtcagggttcagggctgcttcgcagcccaacgcggggcaagcccgctcgccacgacaagcccgctcgccacgacagccagctcaccacataagccgcatcaggcgttgagtcagtgtttggccggtgctttgagaatgtcactgtggagtgggctcttcggcacagcagagcccggcgaacgcacttgaatgatcaacaacgccgcaatcaccgccggaatcgcgcagaagaagaaaatctgctccacagggatatgcatcgccaacagcagactgccaaacaacggtcctaaaattgaaccgaatcgccccacgccgagcgcccagcccgtgcccgtggcgcgcacatgggccgggtagaaattactggcgaaagcattaagcgtgagctggccgccaatgatgcagaacccggccgcgaatacgcaggccaccaggtagcgtgggttgtcgtgattcacgccgagcaaaatggtgcacaccgcagccgccgccaatacgccggacaatagccgcactttgcttttcaggcggtccgcgaaccaggccatgccgatagcgcccaaggtgccggcaaacaggaacatcgaggtcaccaggttggcttctttcaactcgaggccgctttccagcaacagcgacggcaaccagctgatcatgaagtacagcaggatcaggctgacgaaaaacgtcgcccagatcagcacggtcgggcgcgcgtagccgttacgaaacagctccaccaccgtaagtttgctgccttgcgcctggcgactttctgcttcattcgacagtggcggttgccaacccggcaacatccgcgccgtgaccttttgcaggcgcgcgtacggcggtgcatcccgcaataaacgtggcaaggattccggcagcagccacacgaggaacgggaacagcagcaacggcgtcacaccgcccgccaggaagaccgcctgccacccgtagccttcgataaaaccagccgccacaaacccacccgccgcgccgccgaacgagaagccacaggcggccaaggtcaccatcaaggtgcgcatacgtggtggcgaatattccgacatcaacgccatggcactcggcatcgcgccgcccatgccgataccgcagataaaccgcgcagccatcagcgtagtcagggaattggcgaacaccatcagcaccgtgaggctggcataaatcagcacgcaaccgagcaggatacgccgcacgccaaagcggtcggccagcggcgtcaccagcagcgaacccaacgtcagcccgagcaggttggcactgaatacggggccgaacgcggctttttccaggctccaatccttggccaaggccggcaccacataaccgagtacttgggcatcgtagccatcggttaccagcagcagcgccagcaacagaaggatcaaccactgatagcgcgacaccggacgggcgtcgagtgccgcgcgaaagctggcaatctgattgtgcatcgcaaggtacctattatttttataagcatcacgccgatcaaaatgtgggagctggcttgcctgcgatgacggagtaccagtcagtgaatcatcaactgacagaccgctatcgcaggcaagccagctcccacattgatttagggtgtgtctggggtatccggttggttggctggatgcgcctgcacaaacgccggatgctgcgccgccaacgctgccacacggtcaatgcgcgggtacgcggccaatggcactttgaagcgctccgccgcgtacagctgcggaatcagaaacgtatccgccaaccccggctgttcgccgaagcaaaaccccttatcgccaatcaactgctccaccgcacccaagccctggctgatccaatggcctatccattcgagcacttgcgcctcgtcatggccccacgtgcgcagcaggttctgggtgctggagttgtgcagcgggtgaatatcgcagccgataatcgacgccactgcacgctcatgggcacgggtcgccaggtcttcggacagcagcggcacctgtggataacgttcttccaggtactcgatgatcgccggcgactgaatcaacagttcaccatcatcggtgcgcaacgccggcacccggccttgggggttgatcgccaggtacgccggttgacgattggcaccgcccggcggcaccagcaggttgaccggcaccgcagtaaaatccaggcccttgagcgccagggcgatacgcacccggtatgacgaagtggagcggtagtaagtgtagagttccatcgccctgccctcttagcgtgccgcgatcacggtgccacggcattcgccgaagccgatggaggcaaacccttcgcggctgcaacgcgcgcgcaggatgatttcgtcgccgtcttcgaggaacttacgcacctcgccggaagccaattcaatcggctttttgccgccttcggtgatctccagcaggctgccgaactgccccggctgcggcccggacaaggtgcccgaaccgaacagatcaccggcctgcaactggcaaccgttgacgctgtggtgcgcaaccatttgcgccacggtccagtacatatgctgggtgttgctcagggtcaggcgatgggccggcaggttttgttcgcgcatcgcggcggtggtcagcagcacttccagttcgatgtcgaaaccgccggcggcctggtcacgcttgtccagcaggtacggcagcggctgcgggtcgccttcggggcgtgccggttgggctttgcggaacggctccagggcttcggccgtcaccacccagggcgagatgctggtgatgaaacttttggataagaacggacccagcggctgatattcccaggcctggatatcgcgtgcagaccagtcgttgagcaggcagaaaccggcgatgtgttcggccgcatcgccaattgcaatcgagtcgcccatggcattgccctggccgatccagatgcccagctccaactcgtaatccaggcgcgcgcaggggccaaaagtcggctcggtctggccggccggcagcgtctggcccttaggccgacgcacctcggtgcccgacgggcgaatggtcgaggcacggccgtgataaccaatcggcacgtacttgtagttcggcaacagcgggttgtcgggacggaatagtttgccgacgttctgcgcgtgttcgatgccgacgtagaagtcggtgtagtcgctgattttggccggcaagtgcatctggcaatcggcggcgcggtgcagcacttgggcctcacgggtttgcagcttgctgccttcggcgagcagttccagcagacgctcgcgcaaggccacgcgcgggccacggccgagttcgaaaaaggcgttcagttggccaccggcagtggcttcaacggcacgccgtgcttcaccttcgaactcatccagcgcagcgtgcaggtcgagaatcgcatcgccaatcgccacgccactgcgcggcgccgagccgttgatgctgaacacacccagcggcaggttttgcaggggaaaatcgcggtgaccgttggcggaggccacccagctgcgggttggcgttggttgagtcatgggttatctccggttcgggttgaaggtggcgggcagcgaggcccagcacgcgtcgtaagcgggttgcagttgcgggcattcgagggcgaactgcgtggggcgcagcacttggctggtctcgaacatgaaggccatggtgttatcgatcttgtgcggcgccagctcgacgttgatggctttggtacaggtctcgccgtccgggccgtgggcgctcatgcagctgtgcagcgacgcgccaccgggcaggaagccttcggccttggcatcgtaggcgccctggatcaggcccatgtattcgttcatcaggttgcggtggaaccacggcggccggaaggtgttctcggccaccatccagcgcggcgggaaaatcacgaagtcgaggttggccaggccgtgcacgctggtgggtgaggtcaatacggtaaagatcgatgggtcggggtgatcgaaactcaccgtgccgatggtgttgaaacgccgcaggtcgtatttgtacggcacgttattgccgtgccaggcgaccacattcagcggcgaatggtcgagctcgcaggcccacagctcgccgaggaatttctgcaccagtgtcgtcggctgcttcaggtcttcgtagtgggccaccggcgttaaaaagtcacgcgggttggccaggccattgctgccgattgggcccaagtccggcaggcgcagcggcgcgccgtggttctccgcgacgtaaccgcgtgcttgcgcatccagcagttcgacacggaatttcaggccacgcggcagcgccacgatttccagcggctcgacgtccagcacgccaagttcggtggcgatgcgcaggcggccctgctcaggcacgatcaacagttcgccgtcggcgttgaaaaacacgcgctccattgagcgattggcgcggtagttataaatgctgatgcctgccggtttgtccgacccggcgttggcgaccatgcctacgagcccgtcgataaagtccgtcggctcgctgggaatatccagtgggttccagcgcaagcgattcggcgtcaccgcgcccaacggcccaccggccaactgccgctccagtttgacgaatgccgggtgattggccgacggctgaatgcggtacagccaggtgcggcgggcttcgctgcgcgccatggtgaaggccgtgccggagaacagttcggtgtacaggccataaggggctttttgcggggagttctggccgacgggcagcgcgccgggcagggcttcgctggcgaattcattgccgaagcccgacaggtattcgaggttcatggatcatcctctgagcggaagttgtttttatcgtaatccagttacgcataacgtaatttgatcactatcgaccgtcaagctataaagacgcccattcatctctcggattctcacccttccatggaaaagccccgcgacaccggtaaacagaaagtccgctcggctgaagtgggcaccgatatcctcaaggcgctcgccgaactgtccccggccacttcgctgtcgcgcttggccgaacatgtgcagatgccggcgagcaaggtccaccgctatttgcaggcgctgatcgcctcgggttttgccgaacagaataccgccaccaaccattacggcctgggccgcgaggcgttgcgtgtgggcttggccgcgctgggcagcatggatgtgttgaaagtcggcgccctgcccttggcggaactgcgtgatgaactgaatgaaacctgttttttggcggtgtggggcaaccagggcgcaaccgtggtgcacatcgagccggcggtgcgcgcaatcacggtggtgacgcaattgggttcggtgttgccgctgctcagttcgtccaccgggctggtgttcagcgcctatctaccgtcgcgggaaaccgtggaattgcgcgagcgcgaggttcaggccggtatcgcccatgccttggccgacgaccaggcctacgccgccacgtgtgagcagatccgcagccgtggcctgcactttgtgcatggcttgctgatgccgggcgtcgatgcgttgtcggcgccggtgttcaacgcggtcggccaggtggcggcagtgatgaccgtggtcggcccgacctcactgtttcacgccgatgaagacggcccggcggcgcagcgcttgctggcggcgacccgggccgtgagttggcggatgggctatcagccctgaattattcgccccagcgtgacaaggccaccgccacgcggttctccacagccttgacctgtgcaccggcaaccacatagttattgctgatcatcgagaacactaaccggcgcccgtgggcgtcggtgatgtagccgctcaacgatgacacgccgcccatggagccggtcttggcatgcaggttgttttccgccggtgtgccgcgcaggcgatagcgcaggctgccgccggtcatgcggtcggtgttgccggcaatcggcagtgcggtgtaccaggcgttgaaccacggctgtttgctcgcggccagcagcaggtcggtgagggtttgcgacgacaccaggttctgccgcgacaggccggaaccgtcaacctgcttgagggttgccgtgtccacgccctgacgcttgagaaacccatcgaccgccgccacacccgccgccgccgtgccgctgtttgcggtcttgcggcccatggccttgagcaaggcttcggacatgttgttgttcgagagcttgagcagcggcgtgatcagttcctgcaacggcgccgattgatgctcggccagcacggtcacgccggccgggcttgcagcccccatcactcgacggcccagcacggtgatgccctgctgcttgagggcttgttcaaacagattggccaccagttgcgtcggctcccagacgctgaccagttgcgggctctgccggcccggcgccaccgcgccgctgagctgcaacaggttggtgccatggcggcggttgatcccgtaggtgttacccggcccactcaccgcgcggttgctcaattgcaggtaatcggtgggcgggaagatctcgacgctcacaggctggccgacacgcaccggcgctttggccgtgacgagtacgctgcccgcatcaaaatcagcattgggtgacacggtcagcgccgaaatctgcgcgccgtaataggtggtttcatcatcgtgggaccaatcgacacccaggcgctcggcgtcaaaccaggtgtcgtcgaacacgatatcgccctgcacttggcgaacaccctggctggccagttgcgccgccagcgcctggtaatcggcgaattgcatcgtcgggtcgccgaggccacgcaggtacaggttgccggtcaggcgatcgccctggcgtatgccgttgctcagcagttgcgtggcgaagcggtattgcggccccaacacgtccatcgcggcggcggtggtcaacagcttgaggttggaggccggcaccagccgtgtgcgtgggttgtgctggtacagcgtggcgccactgcgcgcgtcacgcaccatcagcgacaccgaggcgccgtgcagcgcgggatcggccagcaattgatcaagggagttggaagtcggcgaaacactcgcgcagccgcccagtaaaaagctcaagcagaccagcattgcgctggtgtgtatccatttgcccaactgcatcagtagcgttttcccgcgaagtctttagtggcggcaacgctaccagctcaatgccttcgtggcgagcggggcttatgttggctagtggtcttgttgtggcgagcgggcttgccccgcgttggggcgcgaagcggcccctgataagaccgccgcgtttttccaggcacaccgcagtggttggttttgggggctgcttcgcagcccgacgcggggcaagcccgctcgccacagccaggttaaaactgcagggtactggacaccgacacctgccgcgcatcgcccagcgatacaaacacccggctcgcggccgaggtgtagtaggtgcggtcgaacaggtttttgacgttgagctgaaacttgaccttctgcccttcgatcttggtgtcgtaggtggcaaacgcgtctgcgacggtgtagccgggcaggttgaagtcgttggcggcatcgcctgcgcgctcgccgacataccgggcgcccgcgcccacccgcagttgatcgccgccgaaaatattgccgaaatcgtaaaccgccgacagcgagccggtgtgcttggccacgttttgcaggcggttgccttcaagcgtcgggtctttgtccttggtgtccagcgcatcggtgtaggcgtagctgccgatcaggctccattggtcggtcaactggccggaggcgtccagctccaggccacgggaacgcacctggccggcaatgctgtagaccgtgttcgcaccggaacccaccgagaccagcacgttgcgcttatcgatattgaacaacgccgcgctggcggtgatacgcccaggcatgtcgagcttgacccccagttcccaggacttggattcctcaggcgtcaagtcgccggtcaaggtgctgccatcggccagggcggcgatggtggagttgggtttgaacgactcggtgtagctgccgtagaacgacaattcatcggtgtagcggtacaccaagccggcacgcggcacccacgcctggccattgccattggtgttggcggtaaatggcacgcccttgccggcgtactggtcgtacatctgatagcgcacgccgccgaccagaatccactggtcggtcaggtgaatggcgtcctgaaagaacagcgagtcgctgcgcagcaggtcagtctgggcgctgtctttggcactgacggtggtgccttgtacatccttgccgtagaccggatcgaggtagttgaacgcgctgcgttgcgcctggcgaatcaggtcggcgcggtagatcttgcggtactcgtcatcaaggccgaacaccaggtcatgctgcatgccagcgatgttgaccttgccttccaggctcatggtggcgaagcggtcggtggtcaacgcaccgcgggtgccgtccatgctccgagtcagggtgccattggggttgaccgacaccgtgcgcacttggctggcgtcgtaggtttcgcggttccagctgtagccgacgtgcgccttccagtcgtcgttcaaatcgtggtcgacttccaggcgatacaggtcggagcggccttccatattattgaacggctcatccaggcgacgggtcgcggggatgttcaacgggtggttggtcttggggtcgatggcggtgccacggtcgaacggcgagaggaattcgcggtgttcgtaggcgaataccactttggtggtgtcgccgtaccaagccagggacggcgccaccagcgtctcgcggtgggtgccgaagttgcgccagtaatcttcgtcttcatggtcgacgatcagtcgataggccaggccgctgtcgccaatcgggccggtagtgtcgaggttgccgccgctgccgttcttgccgtcgccgaaggtcgagccgcgtgcggtcagggcagtcgactgcaccagttcgggctttttgctgacgatattgaccacgccgcccgggtcctgaatgccgtacaacaaagaggacgggcctttgagcacttcaacacgctcggcggtggagttgagcgctcggccctgcaccaccggcatgccgtcctgcatgatcgaaccgttacggttatcgccgaaaccccgcagcatcaccgcgtcctgggtgctggccaaggtgttggcctgggtgatgccgctgatattggcgagggcgtcgtccaggttgcgcggggtctggtcgcgcagcacttgggcaggcaccacgttgacggtttgcggggtttccagcagcaggccgtgggaacgcatcaccgagctggtgggcggcggctggtagctggtgctgtcctgggcttggccggcgccgctgatggtggtggcgccgaggttgaccgcgccgtcggtgggcacgggttccagggccaaggtgcgcgcgtcgatctggcggaaggtaaagcctgatttgctcagcaggcgttgcagggcttgggtcgcgctcatctgcccgctgaccgccggggcgctgaggccgtagggcgcttcatcggtgtagatcacgctgatgccggtgacgcggctgaaatcgctcagggcctggggcagcggtttggctgccagggcaaagttgaactgggcgctttgctgctcctgcgcctgcgccacggccagaggcagcaatgccaaccccgacactgtcaataccgaggctcccagccactgttttacccaaccgcccgccgtcgatttcatgctgtgagaacccgtgtagaaaacgctgttaatgcgaattgatcgcagtttcaagcactacacggttgggcggtggatttacctcacctttgtttgcaaatatttttgtttattgcgcctgaatgcgaaaaccaaggcgtgggaagtgcacatgcacgataccgccgcgctcatccgtacgccgtaggatcagggcttcgcgcccggcaaacagcaactcaccggcgaccggatcaaccccgtagtccgttgcgctgatggtcacctgctggccgggcttgaagccgttggggtcttcgaagatttcctccggcaagggcgcgggcgtggcattgcgcgcaatctccagcgcctggtcggcgcgcatttcactggcgttgccatggccaaagctcaatacccgcgccagccatgccgctacggccgggtagtgatccaccaacggcgacgtcaccggcgtgcccttgaggaaccacaagggatgcgccatggcgaagtcggcaatcgacggctcgccaaacaggaagtccccggtgccatgctgcagttgctgctccaggcgcaccatcagcgccggccattgatgccgtgccagctcgagcggcaccttgctcgccgtgccaccgctgaacagcgcgacgcggtcggccatcagcgcctgcatcgcctgcggcggcactttggcaaagcgcacggcggcggattccggttcgaagaccaaggtcacgctatggtgaaacaccacactgtcggcccagtaagcaaaggcctgggtgttgatttcctggcccagcggaaacaacgccggggtggatttttcctgctccaggcgccgggcgatcagggcggtgtcgcagtagatatccgcgcccacctgcaataccggcgtcttgcgatagccccccgtcaatgcggtcaggtcgggcttgggcgacatcggtgggataagcaccgagtgccacgacaaacctttgaaacccagcatcaggcgggctttttcagcaaaaggggactgcgggtagtggtgcaggatcaactcagacatgccaggctccgctggataaatgagcggctagcttaacgcgcaaaatcgcgcgcaggcgaaatgggaacccatcagtcaaatcaatgagccactcgccgccaggcattccttggcgcttttcttgagcttcttgatcagccgttcctggcgcagcgcttcgcccttgctcgcgcactgttcggtgtacaccagcgccacggccgggctggataaaaagaaccgcgcgcccttgccgctttggtgggaggcaaaacggcgcaccgggtcattgctgatgccgcaatacagcgagccattggcagcgcgcaccaggtacacgaaccagggtttgggttcagtcgattcagtcacagggcaattcggcaaaccagagaagcgccaatcttatcaacgaccggcctggaatgccttcaggcctttaagcgcctgggcgcgcacagcgtttttcagcgctggcgaccagcccagcaacaggcccttgaggcccagtgcctggcgcgaccaacgccacaggtcgaagtggtcgtggtgctcgcagatcttgccgtcgcgaaacacaaaccgcgcaccgatatcattgaccaccgtgttgccggtggcgctgaacaggtacgtcgccacccaatgcgcgctgccggtggagccatcgctgcggacatggtcgaaggtcagggaaaaatccttggcgcgggtggtgagcatgcgccacatatcaccggcatcgcgcccacgcagttcgccgaaggccgggtcgctgaacaccacgtcatcggtgtagcaggcggccatggcttcggcgtccaggcgttggaaggcactgtagaactcggtgatcagggcgttgtgggcatcactcatgggcaggtttcgcacggtggtcagaggtactgaacgataagctgcgcaacaagggaatgccatggctattcgctatgggcatgagtaatcaccgtggcagactcaaggataccgtctacggcaccattcccgccgagcgcgcataggcgaacaagtccacatcggttgaaatacacaaccggctcatggccgtgcttttctgtttgctgatggtggaaatgctgcggttgacccgtgccgcaatctggctgacggtcataccgctggccagcatgcgcaccacttcacgttccttgccggacaactgcggcggttgcgattgatcgcccgtgccggcctcgtgcaactgctcgcgtagacattcgctggcgaaggtctggcccttggtgacggccttgattgccaggggcaactccttggccgaggcctttttggcgacgatggcctgtgcgccatgggcgaaggaagcccgcagggtcgcgatgttggcgaacatggtgaccagaatcaccggcatcttcgggtattggcgttgcaacaggctcagcaagcaataaccgtcagcctggcgcccgcccggcatggcgaaatcggttaccaatacgtcacagggcgtggtgcccagcaacaccagcaattcatcggggccactggcttcgccaacgactttgcaggtgccactcgcctcaatcaccaccctttgcccaatgcggacaatggggtgatcgtcggcaattattactcgaagcataaatactcacggatgacggccacttgattccgggcaaaataccttcgaccgggcgcttcaacaaccgcccggcaaaggcacatttcagccaaacccagtgccttgtagtgctatccatcaaacttacaaaataaaaggaaaaggcccacatacaaaaactacaagccaaaagaacaaattcctacaagccaagatgaaagctcataacgtactcacgtacgcgaagtaacgcttgaggtcatgctcaaacatctccagccttcccaggttcgcccacacaccttggagccggacctgttcaatcagcgcaccaccccgcgcctccaagtcgtcgcagcccaaaaaagccaggctgcccagcaagcgatgcaaccgctccaacgcaagccgggcgttcaacgtgacgcgtgcatcgaccagggccgcgcagtccgtgcgggcttcgtgcagcaagctgccgagcatctggttgaccacctgttcgctgccgaaggtctggaccatgcctgcgcgcgtcggccaagccgttgagcccctgggcgttgccgacgatacgtcacacggtgggccgggcagccatcgcccaagcacatcgcacaactgcgcaaacgtcagcggcttgagcagccaggcatccatgccggcatcgcgacagcaatgcgggtcgtcagcctgcaggttggcggtcagggcaatgatcggcacccggcgccgaccgttcgcccgctcgtgcaggcgtatggcgcgggccagggcatagccgtccatgcgtggcatatggcagtcgctgatcaccaggtcgaagcgcctgcgcgtgaaggcggcaaagccttcacagccgtcgcctaccactacatggccaagcccgagtttttccaggaaccagcccaacagcgcgcggtaggccgaatggtcctccgcgaccaatacctccaggtgtcgccagtgatcgggcggggagaaatggaccggaatgcgctgcgcagagacatcgctcgaaggcacgctcgctcacctcgttgaaattgtcggtggtgcagcgcccgtggcccaggaacacgaatgtcgtgtgggcgaggagcgctgacgcgacagtcaacggaatgcactctgcagcaggtttcaaatattcaaatgacggtcatcgccaaggaaaagtatcgtttcgcacgccactctgaccatacaacaactacgaaactgaccatttacctacatttaactgttcattcttctgacacagatcactccactttccgagtctttgtgattgtcgtaaaagttgtatgtctcccgcccaggcccatcgttagattacggcccactctagtcaggaacggtccgccgccccctgagcagtccagataaacattaaaagccgccttgcacccgtcgacacactgcccacagcgagtgtcgctacggcgtgactcaacgtattggaacccaagaaatgaatgctcccttcgccctgttagcctccgcattgctgcttaccggcgcttcgaccgtgtttgccgccagcagcgtagacctgaccgtccagggcttgattacccccagcgcctgcacgcccagcctttcaagcggcggagtgatcgaccacggaaaagtggcggccaaggatttgagcccggtcaactggacggggcttggcgatcacaccctgcagctgaacatcacctgcgaagcgccgaccctgctggcgctgcagggtgttgataaccgtggcggctcccctgacgcgtacaacggctacggcttgggcctggtcgacggtaaaaaactgggcatgtacctgctgtcgctggataacgcgacgtccggcggtgcgccgatctccgtgcttgagtcccgcgacagtggcctcacttggcaggaaagcttctcgggcgacgtcatgccgcgggcccacctcgcatcgttcggcgacagctcaacgggcagctgggcgcccacgccggtgcagaacgtgacgtcagacatgaaggtgacaaccatgctcgcccccacggccggcatgaacctggccaacgagatcccgatcctcggctcggccacggttgaagtgaaatacctgtaagccaccccataacccacaggatgtgacccatggctcgccctctcattaccctcgccgcaaccctgataattatgggtgcaggctccgtatttgccgccagcagcacagacttggccgtcaccgggcttattacgcccagcgcctgcgtcccgacgctgagccagggcggcgttgccgactatggaaagatcgccgccagagatttgcagataagccaacccacgcccttgccggccaccaccctgcaactcaacgtgaactgcagtgcggccacgctgtttgccctcaacggcgtggataaccgccccggttcatccatcgatgtcgacagctcgtcgtacggcctggggttcatcaacggaaccgagaaggtcggcagtttcctggtggttctcaataactacctcgccgacagccagcccgtgaccaagctggtttcgcgcaacaacggcgccagttggatcgagaacagcgaggacgccatctggatccccggctggttcaccgccttcggcagtaactccggtggcgactgggcgcctgtcgcgatcacgacgctgaccagcgacgtgaggatcaacccgatcatcgccgcctccgagacactgaccctgactgaagaacaaccgatcgacggttccgcgaccctggaagtgcgctacctgtaacccacccgttcattgcatcgaccacaaggacctgtgcccatggaaagaaccacgcccgccgctcttgccctgctgctcgcggcctgcgcccccggcgcattcgccgccagcaacaccgacttgagtgtcaccggggtcattaccccgtcctcttgtacgccaaccctgtccgatggcggcatcgtcgaccacggcaaattgaccgccagggacctcgacccggacaagcccaccagcctgcaggccggtgaaatgaacctgctggtgaattgtgaagggccgacgtttttcaccctgaccaccgaagacagccgcagcgaaagcgtggcactcaacccggcgcaccacgggctgggcatgaccaacgatgacgagaaactcggcaacgtggcgttcggcctgttcgatccggtggctgacggtgcgccggcgcagaccatcttgtcgcgtgacggcggcgctacctggtacccctcttcgtacctgggccacgccgctttgacctcgttcgcggcgccgagcagccccaccacgccgatggcgctgcagaccctgagcgcccggctgcgggcgttcaccatgattgcgcccgccagcgacctgaccttggtcgacgaggtgccgatcgacggccttgccgtgatgcaactcaagtacctgtaagccctttcttccgtctccccattcaggaaccccatcatgaacaccgcattcaaaacactctccgccggcctgctgttgctcggcagtgccaacgtactcgccgcatccagcgtcgacctgacggtcaagggcctgattaccccaagcgcctgcaccccgaccttgtccagcggcggcaccgtggactacggcaagatttcagccaaagacctgaaacctgacgcgtcgacctttctgcccatccaggtcgtgcaattcaccgtcacctgtgatgccgccaccctcatggcgatggaggccaaggacaaccgcgaagggtctgacgccaacaacgacacgatggaattcggcctgggcctgatcaacggcacggaaaaactcggcggcatggaattaaggctgctgaacccggttgccgatggcgtctcggtcgcaaccgtcggctcatacgatggcggcgtcacctggggcgcggagcgcaacctgatgcgcaacaatatcctcgcccctgcggtggccggcgtcgatacgccgatcccggtccaactgtggaacgcagacctcagcgtgcagccctttatcgccaaaaccagcgggctgaccctcaccaacgaagtcgccatcgatggctcggtgaccctcaccgtgcgctatctgtaacaaccttcgagtcgaacaacggcaggcctccgcgcctgcccttgtcacctacgcaaattgatgaacccggcaaccggtgaaccttccccatgaagcagatttcttcacgccttcttgccctgttttacctgctcggtgccagcccgctggtcgtggcggcgtccagcaccgagttgaatgttaccggcctgatcacccccaatgcctgtaccccgacgttgtctgccaacggcgtcgtcgaccacggcagagtgccggcgcgcagcctcaaccagtacgagtacagcgcgctgcccacgcaatccctagacctgatagtgagttgcaaccaaccggtgctgttcgtactggtgggcgtggacaaccgcgccgactcatccctcgggccgggtttttactatggcctgggcaacaatatccatgtgcccagcgaacggctgggcacggtttccttggcctatcgcgacgccatgggcgacggcgaacgcgtgctggtattggcctcaagcaacaagggtgagacctggttccccgaaaccaacgccttcccgaacaactacatggggttcgcccgcctgggcacgctggtgccggagccccatcgcgaagtcaccgccagcctgcaaatcaatacgtccatcaatgccgccgcctatttgaccctgaagcaggaagtgccgctggacggttccatcgtgcttgacctgaggtatttgtagccatgactgccctgcccttttttacccgcgccttcatcttcacgcgcctcgccggcctctacctcgctgcgctggcgctggcgatcggcagcccggccctggtgctggccgatggcatggtgcccgacacctcggtggtgatcgtccacgagggcgaaggcgaggcgtcggtcaccgtgaccaacactgacgacaagctggccttgctgcacgtcaccctggaagacattcctgaagacaccgcgacactgctgtttgtgaccccgcccttggccagggtcgaaccgaacaagagccaactgatccgcttcattctgcaatcggccgagccgttgaccacccaacgcttgaaacgggtgatttttgaaggcatgccccaaggccgttcggcggcccaggctgggcatgcacaggtgggcgtgacggtgcgccagaacctgccggtgatcctgcaccccaaaggcctggcccccaaccgcacgccctggaccggactggaatggcgcttgaagcgtgaccaattgagcgtgcacaacccgagcccttacgtggtgcgcctggcccaggaactgcgcctgctgcccggcagcggttcggccttgttgccgcgcacctatgtgctgcccggtgaaaccctgaacgtgtcagtgaccagcaccgacaccggcgccaaccgcgtgaagctgcaaccggccaccgtgtatggctttgccgtggcgccttacgaagcaccgatcaccctataaaaagaacgccctataaaaaagagtggcttgccaaagccacccaacacttgagtacgaccttgtgagcacagcaatgactgaccgcgacggccgcgccgtgcccggcgtttcaccccgccgcgcaggcaaaatactgacgagcctggcgctgactctgggcggcgcactgccgtgcggggcggtgctggcgagtgatatcgtcggcgccttcgacccccagacgctgtcccgacgcggcatcgacccggagctggccaacctgctgctgcaagcgccgcgtttcgcggcgggccggcatgccgtcaacctcagcgtcaacggcctgcgccgtggccgggtggacgtggagttcgaccgccagggcggcctgtgtttcaaccgcgccctgctggatgcgggcaacctgaacgtgcccgatgaagacggcgcccgcacctgccaaccctttatcgagcgctacccgcaaaccgtgatcgagcaagacccggccgccctggccgtggccctggtggtgccgaccgacgccctgcgccccgcccagcaagacatttccggctaccagaccggcggcaaagccttgttgctcaactacgacctgaccggcctctacaacgagttcggcgacaacacgagccgcttcggctcagccaacaccgaagttggcttcaacgccggcgactggatcgtgcgcagccgacaggcaaaaacctggcaggacggcaactcgcgcaccacccacctggacgcctacgcccagcgcacgttcgccgaacaacaggcagtgttgcaggccgggcaaatcagcctctacaacccggtgctggcgggcacgcagattaccggcgcccaggtgctgaccgaaaccgcgctgcaagaccagaaccagggcgcgaccatcaccggtatcgccaacagcccggcccaggtggaaatccgtcagaacggcgcgttgatccactccaccgtggtgccggccgggccgttcgcgctgactgacgtgcgacgtttgaacggccgctccgacgtggaagttacggtcaaggaaaccaccggcgaagaacgccgctttaccgtgcccgccgccatgctcggcctgggcctgcccgcgccgggctattcagtggcggccgggcgtgtgcggcagatcggcaacagcgacggccgtgaaccctgggtgatcagcgcaggctggagcggcccgttgcacccgcaactcagcgtcagcgccggcgggctgatggcggatgcctatcgctcggcaggtgcgagcctgggctggttgccgtggcaagacagccagctgcaattctccgcccaggcggcgcaagccagcccaaagcgcatgggcactgagcggggtgtacaaaccgacctctcctggtcccagcggttgagtgaccgctgggcggtgagcaccgccggttcctggcgctcccagggttaccgtgaccttgaggattcaacttacgtcggcaacagcgacgatcaacaacgtacgcgctaccgcgaccagcaaagcgcgaccgcgtcctgggcgcacccgacgttgggcgcgttcagcgccggggtctcacgcacggcgtcgtataacggtgaaagtagcagccgcgcgctggcgtcctggggcaccagttttggccgggtgtcggtgtcggccagtgcggagtggcaagtgggcggccgccagcaaaatgacgacagcatttacctgaacctcagcgtgccgctgggtgaaacccgtcgcgggcgtgcctgggtgcgtaataccggcggcgagcatcgcctgggggtgggcgtgaacgagcaactcaacgaccaattgagctaccgggtaggcgtggaacgcgacagtcgtgaccgcgaagtggagtcgtcgctcggcgtatcggcactgccgtggtacagccagctggacttcaactacacccgcagcgacgacgaacgttcaagctaccagggcggcgcccgtggcggcgtggtgctgcatgaagacggcctgaccttctcgccgtacccggtgcgcgacacctttgcggtgatgtcggtgggcgagatggccgggatcaaggtcagcaccccaagcggcccggtgtggaccgactggcaaggccaggccgtggtgccgcaactcagcgcctatggccgcagcccggtggaagtgcagacgcgctcactgccgcgcaacgccgatatccacaacggcctggccgtgatcgccgcagggcgcggtgcggtcgacaaggtgcacttcggtgtcgcccttacccgccgcgcgctgttgaacgtgaccaccgacagcggccagccgttgccacgcggcgcaaccgtgaccagcgccgacggcgagttcatcaccctggtgcaggaaggcagccaagtgttcctgcccgacgtgctcgacccgcgcaccttgtgggtcaaggcaccggggcagccacgctgtcgcctggactttgaactgccgaaaaccgcagaccccgaggtgtatttcgaaaccgcagcggcccggtgccgccagccatgaggacattcgccatgggcctgaaacacccgttgtatcccttgggcgttgcgctgctgagcagcggcgcctgggccgccgatgaatgccagctcaaccttagccaggcccagctggatttcggcctgatgaaccgcgccgtagcgctggcgcccgcgcctgaacgattgctcggcgagcggcgtatcagcctgacgctgaactgcccgcagcccaccgacatgagcgtgttttatcgcggcctgggcgccgggccggagcgctttcgttttagcgaacgcggcagctacgggctgcgcgtcagcgaagcggtgctggacggccaggcggtggagctgggtttgattgcaggccaaggccaaccgcccgccactgtcagcgcccaactggcgtggcaaccggaccagggcattgtgccgatgcgtgccggcgtcgcagtgagcgggcgcaacctgtccttgcagatcgacgccagcgcctgggccagcgaagacgccgcacgggtacgcgatgccgtgacctgggacgtcggcgggctgttcgacgccctcgccgccgggcgctcgcgcgagctgcgtctgcaagcgcgctttgcgccggcggcgtgcacgcccacgctgtccaacggcggccatgtggcgctgggcaagctgtcgattggcgacctgaatgtcgacaaggacacggccctggccccacgcgccttatcactcagcgtgacctgcgatgggccgacctacttcgcgttgcgcatgcaagacaatcgccatggttcggccacgggcacagccgatgaaagcacctatgggcttggcctggacgcgcgccaacagaaaatcggccgttaccggctcttgttcgacccggcccgcatcaccgccgacagcttcgcccaggttttttcgaccgactccgccactggcgggccgtcctggagcagcgccagcgcgggcatcgcggccgtcggcgcgaatcgctacctgggcttcggtgctacgtccggcagtaccaacggccccagccccattcaaaacctcaatgccacgctgagcctggaagcggtaattgcgcccttgggctccttggacatgagcagtgaagtacagctggatggctcgggcactctcgaaattcactatttataggagcacagcatgaaaccgtttctgatccccctggcgatctgttcaggcctggtcacaggcatggcccacgccgcttcaaccgccgaactgaccgtcagcgggctgatcacgcccatggcctgcacgccggtattctccgccggcgggctggtggacttcggcaagatctcccagaaggacctcaaccaggccaccggtacgcgactgccgctcaagacactgaccttgaccgtcagttgcaatgcgcccggccgttacgccttgcgcatgcgcgataaccgcgacggcacggcccacgtcaacagcgagatctattacgggctggggctggacaccgccggcaacaaactgggtgtctattcggtaaagttcgatcccaagcaaaccgtcgccgatgccttgccggtgacttacggcaccgaatccaccacgggtggtgtggcgtggcgcacatcgaacaccaaccccatcgacatcggctccaggagtttgctcggctttaccgatgtggtcggcagcaccgccgggccatcggcgatccagaacctgaccagcaccctgaccctggaagccgtgatcaacgccaagcaaaacctggacctgagtgtggatacgctgatggacggctccgccacgctggaagtggtgtacctctaacctcagcgtgtttcgctgctgacctgcacatacagcgcacgcccggcgccgaggccggcgatgatcgcgcccaggccgatcaccgcgaagatccagcccacggcgccccagccgccggtccagtcatgtaccaggccgaccgcgaacgggcccatggacgccagggtgtaaccaatgccctgggccatgctcgacaggttggcggccacgtgggaatcacgcgagcgcaacacgatcaaggtcagcgccaggctgaacgtaccgccctggcccaggccgagcaaaatcgcccaaccccacaggccgtcgagtggcgcgtacaggcagccaaacaggccgccgagggtcagcagcatcaccaccacgatggccaggcgctggtccttgccgcgggtggccagccacggcgcggcgagggaactggccagttgcacgataactgaaccggacagcaccagccccgcctctgtcgcggtgagaccgcgaccgatcaaaatagaaggcaaccaaccgaacacgatgtaggccagcgaggattgcaggcccatgtacaacgtcacctgccaggccagcggatcgcgcagcaaacctttgacccgataggcgacttggtgcgcgccatgctgttgcccgacctgcggcaaccagaacagcgccgccaccagtgccggcacaatccagaagcccaggccgatgttccagctgtcgccgaagtaatgactcaacggcaccgtggaacccgctgccagtgccgcccccaagcacaacgccatggtgtagacgccggtcatggtgcccgcgtgcctggcgaaatcgcgcttgacgatacccggcagcaatacaccgatgatgccgatgctcgcaccggcaatcaggctgccggcgaacaggccgacctcaccgaacgaactgcgcaggatgatcccggccgccaatgtcagcagaatccccagcacgacgcgctcggcgccgaatcgccgtgccagggtcggcgccagcggtgcgaacaggccaaggcagagcaccggcaaagtggtcagcaaaccggccttggcggctgacagccccaagctgctggagacttcggccagcaacggcgacatgctcgacaacgccgggcgcaggttcagcgccaccaggatcaagcccagcagcaacagccacggccgcatgaccaccgggtggctgtgctgcaccacgtcgtcgtcggcttcggcgtcgatcaacagtgcttcgagttcgggcgtgcgtttggcttcaaggttcattgatcaactgccggcagagggatttggcgcgttcggggtcgtggttttccacggcatcgagcagggcgacatgcaggtcgaacacggcctggcgacgcggcgaaatgttcagggtctggcgcaactgtgcagcgacgatggcggaaaaatactggtacagctcgctcaacgccgggttgtgtgcggcgtcgaccaagtgcttgtggaacaccagatcggcgctgatgtaagcctccaggtcaccgtggtacagctcgccgctgatactcaaggcctggcgtaattttttcagatcgtcatcggtgcggcgcagtgccgcgaggccgatggcctccacttccagaatctgccgcgtctcctgcgcctgctccagggtgcaactggacagcgcccgcatggcgcccaacgggtcggtcattgagcgcaagtaactgccgtcgccctggcggatttcaatcaagccggaaaacgccagcacccgcatggcttcgcgcacggtattgcggctgatgcccaactcggcggacagctcgggctcggtgggcaagcgctcaccgatggcccatctgccttcggtgatgcgtcgacgcagttgctccagggcttggtcaaccagggaacgtttgatcagaggggcgatgtctgtcatggattttgcgctttcgtccaatcataggatgaattttcctacagcctattaggagttacctacaaaggcaacgcactagggtttgggggcaacaaaaagaactgaattttcgattggtaaaattaccctctaagggtaattattggacgcaggtgtcttatggaaaagtacacacctcattacgatctggcggtgataaaggctgatgtgaggcggcttggcgccagggcttttacacggggggcaaagagaaccgcagaggctctcgaccttgatctcgcgcagatgcaaatgatcgttttcaaactgcaaaacaggatgttgtacaaatcgatgacgacctatgccgatcaccgcgtctggcatgacgtctaccacatccaatcacatggtctggagatttacatcaaggtcacttactgctccggcagtaacccacccgtgatctccttcaaagggatgaacccatgaaaacccaacattgcttcatctgtggtacccctgacgccatggtgcgttttgaggggcgcagtgaaaccctacgcatcaaaggcatggagcagcgcgttgatgacctctcgggctgggaatgccaactgtgcgaggacggcatgtatgacgctgacagctccgagcgccacgctaaagcaggtgacgagctactccacgccgcccgacggatgatgggcgccgaattgaagcgtatccgccgcaagctgcacctcacgcagaaacaaaccgtagaattactgtccggtggcgggcacaacgcgttctcacgctacgaacgcggcgaaataacaccgcccaaaccgttgatggtgctgatgcgcctgctggatcgttacccccacttgctcaccgacgccaaagagttggccgaaggtgcagacctgcgcaacgccttcactcacaccatcaaccacgaaacacaagaagccctcaaagcttcttagacaggcaaaaataaacccggcaccaggccgggtttatcgtttcaagcgtcgatcaatgcagaatctggctcaagaacaacttggtccgatcattctgcgggttgtcgaagaagtcattcggcgccgcctgttcgacgatctcgcccttgtccatgaagatcacgcggttggccacggtgcgggcgaagcccatttcgtgggtcacgcacaacatggtcatgccgtcttcggccaggccgatcatggtgtcgagtacttccttgaccatttccgggtcgagagccgaggtcggttcgtcgaacagcatgattttcggtttcatgcacagcgcacgggcaatcgccacacgctgttgctggccaccggacagttgccccggaaacttgtgggcctgctccggaatgcgcacacgctccaggtagtgcatggcaatttcttcagccttgcgcttgggcatcttgcgtacccacatcggtgccagcgtgcagttctgcaggatggtcaggtgggggaacaggttgaagtgctggaacaccatgccgacttcgcggcggatcgcttcgatctgcttgaggtcgttggtcagttccacgccatcgaccacgatgcgcccttgctggtgctcttccaggcggttgaggcagcggatggtggtggacttgcccgaacccgacgggccgcacagcacgatacgctcgccctgcttgacgttgaggttgatgtctttcaacacgtggaactggccgtaccacttgttgacgccctgcatctggataatgccttcagggctcacaggctgtttgatcgcttcgctcataacaacaactcctaacgcttgtggcctgtgtcgagcttgcgttccaaatgaatggaatagcgcgacataccaaaacagaaaatccagaacaccagggcggcgaacacatagccttcagtggccatgcccagccatttagggtcggcagcagcttgtttgacgctgttgagcaggtcgaacaggccgatgatgatcaccaggctggtgtccttgaacagcgcaataaacgtgttaacgatgcccggaatcaccagcttcagggcttgcggcagaatcaccaggcccatgctgcgccagtagcccaggcccatcgctgcggccgcttcgtactgacctttgggaatcgcctgcaagccaccgcgcaccacttcagccacgtaggccgactggaacagaatcacgccgatcaacgcccgcagcagtttgtcgatgcccatgccttcgggcaggaacaacggcagcatcaccgacgacatgaacagcacggtgatcaacggcacgccgcgccagaactcgataaaggtcacgcagaccacacgaattgccggcatgttcgaacgccgccccaacgccagcacaatgcccaacggcaaggcgccggcgatgccgaccgtggcgatgaccagggtcagcatcaggccgccccactggctggtggccacgttggtcaggccgaagacgccgccatgcagcaggcagtaggcgatgatcgggtacagcaccaggaagctcaggccgtagaccgccttgcgctggaaacgcgagatgaacaacggcgccacgccaacgatggccagccacacggtcaggtccacacgccagcgcaggtcgccggggtagtagccatacatgaactgcccgaagcgctgttgaataaacacccagcaggcgccttccttggtgcaatcggcgcgcgtggtcccgacccagttggcgtcgaggatggcccagtgcaggatcggcggcacgaccaggtaaatcaggtagaacgccaacagcgtcagcaaggtgttgagccagctggaaaacaggttggcgcgcatccatgccatcggcccgaaaactttgttcggtggcggcatatcaggtttgaaagtatgcgaagtcatgtgcgtttcctcaccgctcgatcagcgcaatgcgcttgttgtaccagttcatcagcagggaaatgctgatgctgatcgccaggtacacgctcatggtgatggcaataacctcgatggcctggccggtctggttgagcaccgtgccggcaaacagcgaaaccatttccgggtaaccgataccggcggccaacgacgagtttttcgccaggttcaggtattggctggtcagcggcggaatgatcacccgcagggcctgcgggatgatgaccttgcgcagcgtcggcccagggcgcaggcccagggagcgcgccgcttctgtctggccgtggctgacggacttgatgcccgaacgcacgatctcggcaataaacgctgccgtgtagacggtaagcgccagggtcaacgcgagcagctcggggatcaatacccagccgccgacgaagttgaaaccttgcagcttaggcatttcccaatgcagcggcgcgccgaagatcaaggcacacaacgccggtatcaggatgaacagcgccaggcccgcccagaacttgtgaaacggcacacccgtggcttcaaagcgtttgttggcccagcgcgccatcagcacgattgccacaatggcgaccacgatgctgaccacgaatggccagaaaccatcggcggcaatcgctgccggcatgttcaggccacggctgctgacaaagaaggtgtcgccgaagttatggctgttgcgcggccccggcatggtcaggaataccgcgaagtaccagaacaggatctgcagcagcggcggaatgttgcggaacacttccacatacaccgtcgccagcttgttgatcatccagttgggcgacaaccgcgccacgccgatgatgaaaccgagcagggtcgccaggaccacaccgatcacggtcaccagcaaagtgttgagcaaaccgatcacaaagacccgggcatagctgtccgattcggtgtagtcgatcaggtgctgcgcgatgccgaagccggcactgcgctcaagaaagtcgaaacccgaggtaatgccccggtgttgcaggttggtctgggtattgttgaagaggtaccagcccagcgagatcaccgccacaatcgtgatgatctggaagagccacgcacgcactttgggatcgctgaagctgagcttctgctttggtgcgccgatttgattttgcatgaagtgccccggaaataatggaacagaacatcacccggtggttggcccaccgggtgatagaaccatcagcgatcagcgcacaggtggtgcgtattgaatgccaccgttggtccacagtgcgttcaagccacggtcgatttccagtggggtgcttttgccgaggtttttctcgaacacttcaccgtagttaccgacctgcttgacgatctgtacgacccagtctttcttcactttcaggtctttgccgtattcgccgtcagcaccgagcagacgcgcaacgtccgggttcttggtggacttggcttcagcttcgacgtttttcgaggtgataccggcttcttcagcgttgagcatggcgtagccaacccagcgcacgatggccagccactcgtcgtcgccattacgcacgaccgggcccagtggttctttggaaatggtttccggcagtaccacgtagtctttcggcgaggccagcttgctgcgctgtgcgtagagttgggacttgtcggaggtcagcacgtcgcaacgaccggattccagcgacttggcgctttcatcggaggtgtcgaaggtgatcggggtgtatttgaggttgttggcgcggaagtagtcggaaacgttcagctcagtggtggtaccggcctggatgcagatggttgcaccgtccagttccttggcacttttcacgcccagcttgttgttaaccaggaagccaacgccatcgtagtaggtgatgaagcccgggaatttcaggcccatgccggcatcgcgagagctggtcatggtggtgttacgcgacagaatgtcgacttcgccggattgaagcgcggtgaaacgctccttggcgttcaactggctgaatttgaccttggttgcgtcaccgaaaacggcagcagctacagcgcggcaaacgtcagcgtcgatcccgaggatcttgccgctggcatccggcaccgagaaacccggcaggccgtcactcacgccacattgtacgaagcctttcttctgcacagcgtccagggtggcgccggcttgggcaaaaccactgacacccagtacagcggccgcgcttacgatggccagggtggatttcaataccttcattcaaacctccagttttgctcttgttgtgtcggagctccaacctcagcgcacccttatgaggcgatatcgacccgtgttggctttttttggggtcaagcggcatgaagttgttgcagtaattccagttgctatcccacaagcggcagtcactgatagtgttaccgtcctaggatagttctgacatcgatctacacatagcaagccccgtaccagagtggtggctgagtcgattcagcccatggtcaacagtaaaactttcaaacttgcgacattctcttaacaaatgaacctgtcgcgcaccgttccgatgcacccaatcggagcgcacgcacatatatggagcagacatgaccgaacccttgattcttcagcccgccaagcccgcagacgcctgcgtaatctggttgcatggcctgggtgccgatcgctacgacttcctgccggtggccgaagcgctgcaggaaaatttgctgaccacgcgctttgtattgccccaggcgccgacccgtccggtgactattaatggcggctacgagatgcccagctggtacgacatcaaggccatgagcccggcccgctcgatcagcctggaagagctggaaacgtcggccaaaatggtcacggatttgatcaaggagcaaaaaagcagcggaatagacgcttcgcggattttcctcgcaggcttttcccaaggcggcgccgtggtgttccacaccgcgttcctgaaatggcagggctcgctgggtggcgtcatcgccctctccacctatgcgccgaccttcggtgacgagctggaaatttccgccagccagcagcggattccggccctgtgcctgcacggccaatacgatgacgtggtacagaacgccatgggtcgcagcgcctacgagcatttgaagagccgtggtgtcaccgtgacatggcaggaatacccaatgggtcacgaagtgttaccccaggagatacacgacataggcgcctggttggcggcccgcctgggctgaaatccatacattatgtagccgtatgacagacgcactacgccgcgcccgattcttgcattacactggccggcgtacattccttaatcaattaatgagatcaccgtgctcaaagcacttaagaagatgttcggcaaaagcgaggctgagccgctcgcgcctgttcccagtgctcctgcccccaagcccggccaccgcaatgacggtaaacagcccgagcggaccgcacctgtcgccgcgccgaagccgcctgcggtgacacagcctgaacaggcgaaaccggccgaggtagcgccaacgccggcgcctgcacccaaagccccccgccgcgagcgcgcacccaaaccgcccgtgacgccatggaaactcgaagacttcgtcgtcgagccccaggaaggcaaaacccgcttccacgatttcaaactggccccggaactgatgcacgccatccaggacctgggtttcccgtactgcacgccgatccaggcgcaagtgctgggcttcaccctggcgggcaaagacgccatcggccgcgcccagaccggcaccggcaagaccgctgcgttcctgatctcgatcatcacccagttgctgcaaacgccgccgcccaaagagcgctacatgggtgagccgcgcgcactgatcatcgcgccgacccgcgagctggtggtacagattgccaaggacgccgccgacctgaccaagtacaccggcctcaacgtcatgacgttcgtgggcggcatggacttcgacaaacaactcaagcacctcgaagcgcgtcactgcgacatcctggtcgctacgccgggccgcctgctcgacttcaaccagcgcggcgacgtgcacctggacatggtcgaagtgatggtgctggacgaagccgaccgcatgctcgacatgggcttcatcccgcaagtgcgtcagatcattcgccagaccccgccgaaaaacgagcgccagaccctgctgttctccgcgaccttcaccgaagacgtgatgaaccttgccaagcagtggaccaccgacccgtccatcgtcgagatcgaagcgctgaacgtcgccagcgaaaacgtcgaacagcacatctacgccgtagccggtgccgacaagtacaagctgctgtacaacctggtcaacgacaatggctgggaacgcgtgatggtctttgccaaccgcaaggacgaagtgcgccgcatcgaagagcgcctggtgcgtgacggcgtcaacgctgcgcaactgtccggcgacgtgccacagcacaagcgcatcaagacgttggaaggtttccgcgaaggcaagattcgcgtgctggtggccaccgacgtggccgggcgcgggattcacattgacggcatcagccacgtgatcaacttcaccctgccggaagtgccggacgactacgtgcaccgtattggccgtaccggccgtgccggggctgcgggtgtgtcgatcagctttgcgggcgaggatgattcgtatcagctgccgtcgattgagaccttgctgggccgcaagatcagctgcgaaacaccgccaacgcacttgttgcgggctgtggagcgcaagcgccctcaagcctgaaacgcggttaaaaatgtgggagcgggctatgttggagctggcttgcctgcgatagcatctcctcggtgcaactgaaaaaccgaggtgcctgtatcgcaggcaagccagctcccacacaagcccggctcccacatttggatctccatacacctttagtcaggtgtttacttccaccgatccgccgcggcgtgatcactgccccgcccttccacccagcgcgggccttccggcgtgttttctttcttccagaacggcgcacgcgtcttcaggtagtccatcacaaacgcacaggcatcaaacgccgcctggcgatgcgcgctggcggcagccacgaaaacaatcggctcgcccggttcaagcgcgccgatccggtgcagcacttccagcttgagcaatggccaacgctgttcggcctcgaccgttatcttggccagggctttttcagtcatgccagggtaatgctcaaggaacatccccgacacatcccgcccgtcattgaagtcgcgcacatagccgacaaaactcaccaccgcgcccacgccgacattcgccgcgtgcattgcattgacttcaaagcctgggtcaaacgcctcggcctgaacacgaatggtcatgtcagcctccggttacgggcgggaaaaacgcaacttcatcaccggcctgcaccggctcatcgaggccacacagctcttcgttgcgcgcgcacatcaggctggtttcattgagcaccgcaaactccgggtcagcggccagcgccaggcgcacggcatcgacggtggcgaaatcgccctccatctccagcgaatcaaagcccaccgcttcggcgtagcgggcaaaaaacaatacgttgatgctcatgcctggtccgccttgaaatgcccacttttgccgccgagtttttccagcagacggatgctttcgatggtcatgccacggtccaccgccttgcacatgtcgtagatggtcaacgccgcgacgctggcggcggtcagtgcttccatctccacgccggtctggccgctgagtttgcagcgcgccaggatacgcacggcgtccacgccctcggcgctcagctcgaccttgacgccggtgagcatcagcgggtggcacagcgggatcaaatcactggtttttttggcggcctggatcccggcaatgcgggccacggcaaacacgtcgcccttggggtgggcgccgtcgacaatcattttcagggtctcgggcagcatgcgcacccgcgcttcggccacagcctcacggaacgtcacggctttgtcggtgacgtcgaccatatgggcacgaccttgggaatcgagatgagtcagcacagggatactcctgatcaggagctccgattgtaaacccaacgcaccctgaatgtgggcactggcttgtgtaggggctggcttgtgtgggagctgggcttgcccgcgatgcaggctccgcggtgtgtcaggcacaccttggtgatgctatcgcaggcaagccagctcccacacaagcccgactcccacacaaaccagctcacaacgagccagcggttatagatgcgactcggcgtactcggccagaatcgaacgaggaacaccctgcagcgcgatgtgcacgccgttcgggaagtctttgaagcgttccgtcaggtaagtcagcccggagctggtcgcggacaggtaaggggtgtcgatctgtgccaggttgcccaggcacaccactttggaaccggcaccggcacgggtgatgatggttttcatctggtgcggcgtcaggttctggcattcatcgatcaaaatcaggctttgctggaagctgcgacctcggatgtagttgagggatttgaactgcaacggcactttgctgaggatgtaatcgacgctgccatgggtgttttcgtcatccatgtgcaaggcttcgaggttgtcggtgatcgcccccagccacggctccattttttccgcttcggtgccgggcaggaagccgatttcctggtccaggccctgcacgctgcgggtggcgataatgcggcgataacgcttggtcaccatggtctgctcgatggcggcggccagggcgaggatggttttccccgagcctgcggcgccggtcaggttgaccaggtggatatccgggtcgagcagcgcatacagcgccaggctctggtagatgtcacgcggtttcaggccccaggcttcctggtgcaacaggggttcctgatgcaggtcgaggatcagcagcttgtcgacctggatctctttgatccagcccacaaaaccctgttcgtcgatgatgaactcattgatgtgcacggccggcaggttgtcgatcaactgcacctgatgccaggtgcggccatggtcctgacgggtttcgaccttgctgaccaggtcccagaaggagccggtcacggtgtgataaccacgcgacagcatcgacacgtcgtcgacaagctggtcggtgctgtagtcctcggcagcgatcccacacgctcgtgccttgaggcgcatattgatgtctttggtcaccagcaccaggcgcaggtccttgtcgcgcgcgtgcaggtcgatcaattggttgatgattttgttgtcgttgaggttttccggcagcaggctgttgggctcgctgcgcttgctcatcagaatcgacagcaagcccttgggcccgcttttgccacgctggatcggcacgccgacctcaacgtcctcgggtgaggcttcgcccagggtcttgtcgatcaggcggatggcctggcggcattcggcggcaacgctgtggtgcccgcttttgagtttgtcgagctcctcaagcacgatcatcgggatggcgacgtggtgttcttcgaaattaagcagtgcgtttggatcgtggatcaatacgttggtatcaagcacataaaggattggctggtcggaagaagggttacgtccatgatcatccatactcggtcacctttgtgggagccagtcgacgcaataccacaacagtgctgcgcctcgattcgaccaccgactgcacctgagtgacgtcaagtgcagtgcccacatgaggagtcttggaagacgccacctgtgttgcaggtttcggcgatctgacttcgtaataccgcaaaaaccatgacaggaaaaagcactttgacgcttttttgaagtttatttttcaggatgacgaatagcactagccgagtgccagccaccccgttaaagtcggaagtccgcctgcatcgaaatgtcgcacaaaatcaccgcaaaaatgcctcatccccaacggggccgggcacttcagcattttcagcgaaacgcctcccggcagtcctgccaacccagcccactttgcgccgttgcctgcagcaacatcggcaatgcgacccgcgccttgtcctgggtgtcgtgaaacacaatcacgcctttgcgccacagcaacatcaatgtcagcacccgttgcgccgactcatcggccttgagtttgcccggctcgtcctgggaatcgatgtcccacaacgccacctgcaaaccttgggactggaagaagccctggctgtcggcacggcgctggccgtacggcgggcgaaacagcggcacgtagttttccggcatcaggttctgcgccagtgatgcactgcgggtgatcgagctttgccagtcgacccaatggctgtgggaacgatactgccagccctgggtgcccacgcactggccttggtacaacgcctgcacatcggcggcggaactgcgctccacgcgggtctgcaggctgctgccgagggcgaagaaggtggcgttcatcttctgcttgcgcaggtaatcggtgagccagtcgctattgccgctgaccggtgccgggccgccgtcgaaggtcagcaggaacaggcggtcgttgaattcatcgccattgcgctcgtgatcgccgaaacgcagcacttcactgccgatctgcgggaacagcgcggctttgcgcagcagttcgtcgaggtagcgttcgtggaaattatggctggggccggcccagcctatatagaaggaattgtcgctgacctggaacttgccggcctgttcgcgcaggtcgtccatgttttccaccaggtagcagaacgaggcgtcttctttacagctttgctgggcgaaggtgtagttttccagcaggcgctgccagagctggcggcgcaggtcatcgatggcggccaggttgataatcttcaggcccaggcgttgcttgagcgcggtttcgtcctggctctcgctggccagcaggctgtgggtgaacatcaggatttcggcgcgcgaggccacgtcgaacagcgccgggctgctgagcttttccggccaggtgccgcggtccaggctggccacctccaccggcgccgcattggcgttcaggcataacaggcaagctgataataaaagcgcaattcgcacctagggtctccctctccagagtcaccgcccatcatagcggatcgtgcctatcgccatcataggtggagtcaaaagccccaaccccctagaatccccccacgtttaaaggagccaagttcatgctgatggtgatttcccccgccaaaaccctcgatttcgagtccaagccggtaaccccgcgcttcacccagccgcaatacctcgaccactcccaggagctgatcgaacaattgcgtgaactgagcccggcgcaaatcagcgaattgatgcacgtctccgacaagatcggcggcctcaacgccgcgcgcttcggcagctggacaccggcgttcacgccggagaacgccaagcaggccctgctggccttcaagggcgacgtctacaccggcctcaacgccgagaccttcagcgacgccgacttcagctatgctcaagaccacctgcgcatgctctcgggcttgtacggcctgctgcgccctctggacttgatgatgccgtaccgcttggaaatgggtaccaaactgcccaacgcccgtggcaaagacctctacgccttctggggcacccgcatcagcgaatggctcaacgaagcactcgccgagcaaggtgatgacgtgctgctcaacctggcctccaacgagtacttctcggcggtcaagcgcacggcgctgaacgcgcgcatcatcaataccgagttcaaggacctgaagaacggccagtacaagatcatcagcttctacgcgaagaaagcgcggggcatgatgagccgcttcgtgatcgaagagcgcatcaacgacccggccaagctcaagcagtttgatgtacagggctatcgcttcaatgcggagcagtccaagccggataacctggtgttcttgcgcgatcacgcaccggaataaggccgtacacacgctcacggcctctatagatcaactgtgggagctggcttgcctgcgatagcggtgtatcagtcgacttatctctgactggaataccgctatcgcaggcaagccagctcccacatttttatctgcgctccacaccaaagatcgtcatttatttggcgtcaaaaaacatcctgacgcattcctaacgaatctttcactcgacatttcagaaattttttcgtagtggcaccactttttttaacaggtagtggcacaaaactatccctgcgcgccaactccctataactactggcccaaatagcaagtgctatcagtatagtaccagtgccatcttttctaatatttcaagaaatttccggaaacaggatgagtggccaggaacttcactccaaagcaccgctcataccaccggtaacgaaattctctgttgctgtaagagatgacttacatgaccgaccaatggaagtagcaaagttgtcacacacactttgactgcgtggtcatattaccaaccgattagttaagagcggcgacaaggatgaattgccacccactataaggccaaggctcagcttcccctaatgggtcagtgagacaacccaaggcattgatatttaaaggcttgccgcctctatcaaagttttgcggcactggcgccaggcccttctcccaggaaggccggctgcatttcagggcaagccccaataacaaggccatgtttcgcacaacttgagtgcaatcgttagtcactcgttatttaacatgcctgcacacggtaagtcggcgtctattcgcctaactttcgtggcaacagtgacgcttgcaaacatgaactccggccatctaattggcatgattaatatcgtcttcaatgacaaagaggtaaatgcgatgcgcatcagcatatttggtttgggttacgttggcgcagtctgtgccggttgcctgtctgcccgtggccacgaagtggtcggcgtagacatctcccaggaaaagattgacctgatcaatgcgggcaaatcgccaatcgttgaaccgggtctgggtgaactgttgagccaagggatcgagaccggtcgactgcgcggtactaccaacttcgccgaagccatccgcgataccgacttgtcgatgatttgcgtcggcacgccaagcaagaaaaacggcgacctggaactcaactacatcgaatcggtatgccgcgagatcggttttgtcctgcgtgacaagaccacccgccacaccatcgtggtgcgcagcaccgtcttgccgggcactgtggccaatgtggtcatcccgatcctcgaagactgctccggcaagaaagccggcgtcgacttcggtgtcgcggtcaacccggaattcctgcgtgagtccaccgccatcgccgactacgacctgccgccgatgaccgtcatcggcgagttcgacaaagcctccggcgatgtcctgcaggcgctgtacgaagaactcgacgcaccgatcatccgcaaggacatcgccgttgccgaaatgatcaagtacacctgcaacgtgtggcacgccaccaaggtgaccttcgccaacgaaatcggcaacatcgccaaggctgtcggcgtcgatggtcgcgaagtgatggaagtggtctgccaggacaagaccctcaacctgtcccagtactacatgcgcccaggcttcgcgttcggcggctcgtgcctgccaaaagacgtgcgtgccctgacctaccgcgccagctccctggacgtggaagcgccgctgctcaactcgctgatgcgcagcaacgagtcgcaggtgcagaacgccttcgacatcgttgaaagccacgacaaacgcaaagtcgcgctgctgggcctgagcttcaaggccggcaccgatgacctgcgcgaaagcccattggtagaactcgcggaaatgctgatcggcaagggctacgacctgagcatctacgacagcaacgtcgaatatgcgcgtgttcacggcgccaacaaggactacatcgagggcaagatcccgcacgtgtcgtccctgctcaactcggacttcgacgatgtgatcaacaactccgacgtgatcatcctcggcaaccgcgacgagaaattccgtgccctggcgcataacgccccgcacggcaagcaagtggtcgacctggtgggcttcatgtccaaggccaccagcgtgaccggccgcaccgaaggcatttgctggtaacagcaacggcaagtttcaggctgcaagcgtaccaatccccagcgcttgcagcctggagccttcttcaccttcggatgacgcttatgtccaagttaaaacacgtactgctccaatctgccggctggctgttcttcttgagcctgctgatgggactcgccctgctgttaccggcgagtacgttcgactccgagtcgaagaattttattttcctgattggcgccgtcggtatctggcgctactcgatgggtgctacgcatttctttcgcggcatgctgttcctgtacgtggtctacccgcacctgcgccgtaaagtgcgcaagctgggcaagtcggcggacccgtcccatgtgttcctgatggtcaccagttttcgtatcgatgcgctgaccaccgcacaggtttacagctcggtcattcgcgaggccatcgaatgcggcttccccaccaccgtggtctgctcgctggtggaaatgtccgatgagctgctggtgaaaagcttgtgggaacgcatgaacccaccggaacacgtgaagctcgatttcgtacgcatcgccggtactggcaagcgcgacggcctggcctttggcttccgcgccatctcccgccacctgccggacgaccgtgccgtggtggcagtgatcgatggcgacaccgtgcttgccgaaggcgtggtacgcaaaaccgtgccgtggttccagctgttcggcaacgtcggcggcctgaccaccaacgagttctgcgaagtgcgcggcggctacatcatgagcgaatggcacaagctgcgcttcgcccagcgccacatcaacatgtgctccatggccctgtccaagcgcgtgctgaccatgaccgggcgcatgtcggtgttccgtgccagcgtggtcaccgacccgggctttatcgccgacgtggaaagcgactcgctgcaacactggcgcctgggccgcttcaagttcctgaccggcgatgacaagtccagctggttcagcctgatgcgcctgggctacgacaccttctacgtgccggacgccgcgatcaacaccgtggaacacccgccggaaaagagctttatcaaggccagccgcaagctgatgttccgctggtacggcaacaacctgcgccagaactcccgcgccctgggcctgggcgtgcgtcggctcggcctgttcaccagcgtggtgctgttcgaccagcgcgtgtcgatgtggacctccctgctcggcctgactgtggcaatcatcgccaccttcaagtacggcggcgcgttcatcctcgcgtacctgctgtggatcggcatcacccgcctgatcctgaccctgctgctgtcgtgctccggccacaagatcggcccggcctacccggtgattctctattacaaccagatcatgggcgcgctggtgaagatctacgtgttcttccgccttgatcaacagtcctggacccgccaggacaccaaactgacccgcgatttggccagctttcaacgttggttcaacacctggtcgtctcggaccatgaccttctccgccggcagcattttcgtcgccgtgttgctgatgatggtctgaccctgccaagcctgaattaacttaaggaattgccctgatgaacagccaagtaaacgccaacgttgtccacgaatccgaagcccagcgccaacatgcccgcgtgaaaatcccggccaagctgcgcttcttcaacaccgaccgtacccagaccgaagcgcgggtgatcgacctgtccgccggtggcctggcgttcaccgccacccagccgttgaccgtcggtgaagtgcacaaaggccgcctgcaattcgtcatcgataacctcggcctggccatggacgtagagctgcagattcgctcctacgaccgccagaccggccgcaccggttgccagttccagaacctggaacaacaagacatctcgaccctgcgccacttgatcacctcgcacttgtccggcgacatcgtgaccatgggcgacgtactcgccaccctgcaacgcgacaacttcaccaaggcgcgcaaggtcaaggacggcggcagcggcatgaccgcgttcggtcgcctgcgcgccgtggtgttcagcgcaggtattttcatcgtcggcctcgccgcattcggctttgtcttcaagtcggtgtatggcatgtacttcgtcagccacgcccaggccggcctggtcagcgtgccgggcatgaacgtgacgatgccgcgcgacggcactgtgcaaagcctgctcaaaggtgatgcggtcgccgccaaaggcgcgccactggcgaccttcagcaccagcatgctcgatgtgctcaagggccatctggacgaagaccaactgcagccggccaaggttgaagagctgttcggcaagcaaatgaccggcaccctgacctcgccgtgcgattgcgtggttgcccagcaactcgtcgccgacggccagtacgccaacaagggcgatgtgatcttccaactggtgccacgcggcagcctggccaacgtcgaagcgcgcttcacctatcgccagttcgccgacgttcgcccaggcacgccggtgagctttcaggtcgccgacgaagaacagatccgcaccggcaccatcgtcagcagcaccagcttgaacagcgccgacctgtcctccgacatccgcgtgcagatcaagccggacgcaccgctggacagcacctacgccggccgcccggttgaagtgaccagcgaccgtggcccatcgctgaactggctgatcgacaaagccacggctcacggtctgtaagcgaggacatgcctgtgaaccctatttcaaaaacagcattgacccatgtgggagccgggcttgcccgcgatgcaggcgactcggtttttcagatgcaccgaggtgacgccatcgcaggcaagccagctcccacacaaagcagatttcactctgcctctgcgctctgcgcgctggcattggcggtgagcctcgccggttgcgccggcctgcccgaccagcgcctggccaacgaagccctgaagcgcggcgacaccgtcaccgcccagcagaattaccagcaactggcagacctgggttacagcgaggcccaagtcggcctggccgatatccaggtgaccacccgcgaccccgagcaaatccgccaggccgaggccacctaccgcgccgcggccgatacctcgccccgcgctcaggcgcgcctgggtcgcctgttggtggccaaacccggcgccaccgaagccgagcagcatgaagccgaaggcctgttgaaaaaagcctttgccaatggcgaaggcaacaccctgatcccgctggcgatgctgtacctgcaatacccgcacagcttccccaacgtgaatgcccagcagcagatcagcaagtggcaagcggcgggttacccggaagccggtctggcccaggtgctgctgtatcgcacccaggacacctacgatcagcatctggatgacgtggagcgcatctgcaaggccgcgctgaacaccaccgacatctgctacgtcgagttggccacggtctaccagaaaaaagccgagccggaaaaacaggccgaactgctcaagcagatggaagccggctacagccgtggcaccgtcaccgcccaacgcgtcgacagcgtcgcacgtgtcttgggtgatgcgaccctgggcaaaaccgacgagaaaaccgcgcaagcgctgctggaaaaaatcgcccctggctaccccgcttcctgggtcagcctggcgcaactgctctacgacttccccgaactgggcgacgtcgaccagatgatgaagtacctggacaacggccgcgccgccgaccagccgcgcgccgagctgttgctgggcaagctctattacgaaggcaagtgggtgccggccgacgccaaggccgccgaagcgcatttcgaaaaagccgtgggcaaggaagtggccgccgattactacctcggccagatctaccgccggggctacctgggcaaggtctattcgcaaaaagctctcgaccacctgctgaccgctgcacgcaacggccagaacagcgccgacttcgccatcgcgcaattgttttcccaaggcaagggcaccaagcccgacccattgaacgcctatgtcttcagccagttggctaaagcccaggacacgccagaggccaatgacttggccacgcagctcgaagccccgctcacgccggagcaacgcgccgaaggccaacgcctggtgcaacaggagctggccgcgcgcggcaccctggcccagagcacgctgcaactgcacgccctgcaagaagaagacggcgaggaatccctatgaagctcaacccattcgtcaaggccggcatcggcctgaccttcgccctgctgtggtcgtgcccgaccctggccgcgctgaccgaagccaagaacttcggcctggaagtcaaagccaccgcgcagtccgaagatgaccgcgacctcggcacgcagaaaggcggcgacgtcaacggcatcggcctcgacctgcgcccgtgggtctacggcgaaagcggcgcgtggagcgcctacgccatgggtcaggccgtgacctccagcgacatcatcgagaccgacaccctgcaacagtcggccgatgacaccacggaacaatcgagcaacgacgaccgcaaggccaagaaaaactacctggccctgcgcgaattctgggtcggctacagcggctttacgccctacccaggcgagatcctcaagttcggtcgccagcgcctgcgcaatgacgacggccaatggcgcgacaccaacatcgaagcgctgaactggaccttcgacaccaccttgctcaaggccaatgtcggcgccgccgaacgcttcagcgaataccgcaccgacctcaaggaactgtcgcccaaggacaaggaccgccagcacttctacgccgacgccgcctaccagtggacgccgggccagtggatcggcctgcgcggtcaccacacccacgacgacggcaagctcgactacgccgaaccgggcgtggccaccgacccattggacaaacgcgagaatggcgacctgacctggctcggtatcgaagccaacagcgacgcctataactggcgcaacaccaacacggtcaactactgggccagcgtcaccggcatgaaaggcgaccgcgacacggtcaacgccctgaacaaagacggcactcgcccaaccgaagccaagcgcagcgatgacgtgagtggctgggccaccgacctcggcattcgcctgcgtctggacccgcagtggcaagtcggcgcggcttactcccgcgcgagcgccaactacgagcagaacggcctgcaaagcaaccgttcgaactggaccggcacccagtcccgcgtgcaccgtttcggcgaggcgtttcgcggcgagatgaacaacatgcagtccatgagcctgttcggttcctggcagctgcgcgaggactacgacgccagcctggtctaccacaagttctggcgtgtcgacggcaacaagccggtgggcagcaacggcatcgatgccgtgcagaacaataccgacgacgtgaccggcgcgatcctgtccagcacttccctgccgctcgaagacggcaagaaggacctgggccaggagatggacctggtggtcaccaagtacttcaagaaaggcctgctgccggccgcgctcagccagtcgatcgacgaaccgtcggcgctggtgcgctttcgtgccggcgtgttcaagccgggtgacgcgtatggcagccaggtcgactcgtacatgcatcgcgcctttgtcgacgtgatctggaagttctgatgggagcctgcgcaatgattcctcaaaaattgctggttgccgcgatgctgatggccagtgccacagcgttcgccgacaccccgcagcagggcaaggcgccgaccatcgccaaagaactgcaacaggccaagacctacaccatttccagcccgccgaccgcgccgctggaaatggccaagcccgccctgccggacctgtcgggctacaccggcgcggcgatggaaaaaaaaatcgtcagaaccaagccgggcaaaatcagcatccgccgcatgatgcaggaagacgcgctcaaggactttatcggcggcgataacaagatggccgaatgggtggtgcgccagcacggcattccccaggcgatctttgtcgacgacggctacatgaacctcaaggacctgctcggaaaagtgcccaagcagtacttcagcgaaacctcgccgggtgtgtttctggccaagctgccgatcgtggtcgggcgcaaaggcatcctcgaaatcgacaagaaaacccaggagctgcgcctgtcgcaacaagccggttcgttcctgatcaacgacggccagctgtttgtgcgtgacacccggatcaccggctggaatgaaaagaccaatggcccggcactgttccagtcgcccaaggaattccgcccgttcctgctggcgtggggcggcaccgagacctacgtcgccaacagcaaaatggccagtttcggctacgccaacagtaagtcgtacggggtgagtatttctcagtacacgccgaacatggccaaggtgctcaagcgccctgagccgaccggctggatcgtcgattccgagttctcggacatgtggtacggcttctactgctacgagaccacaggctttgtgctcaagggcaacacctacaaagacaacatcgtctacggcattgacccgcacgaccgttcccacggcctgatcatcgccgacaacaccgtctacggcaccaagaagaagcacggcatcatcatttcccgtgaggtgaacgacagcttcatcttcaataaccgcagctacgacaacaagctgtcgggcctggtgatcgaccgtaacagcgtcaacaacctgatcgccgacaacgagatctaccgcaaccacaccgacggcatcacgctgtatgaaagcgccgacaacctgctgtggggcaacaaggtgatcgccaaccgtcgccacggcattcgtatccgtaacagcgtgaacatccgcctgtacgagaacacctcgatggccaacggcctgaccggcgtgtacggccacatcaaggatttgaccgacaccgaccgcgacatcgccctcgacccgttcgacgccaaggtctcgctgatcgtggttggcggtgaattggcgggtaacggcagcgggccgctgtcgatcgactcgccactgagtgtcgagctgtaccgcgtgtcgatgctggcgccgaccaaatccagcggcatcagcttcaacggcgtgctgggtgatcggcaggaagaaattctcgacctgttggtgcgccaacagaaagccgtgctgatcgaccctgtcgaacgccagaccgaaatgcaggactgaggatgacccttatgcacccacacatgatcaaactgctgagcctctcgggtctgaccctcggcctgctggcggccagccaaggcgtacgcgccgatgaaatcaaggcgccgacctttaccgccgaaccgtgctgcagcctgtgcccggccgcccatgacgcgaagaactacaccacgcgttaccagcagaacttcaccaccctggtgcaagcccagggcgactggctgttccgtacccaggaagatttgcgcaccgaattcgacaccagccccgccggctacaaacgcatgcaacagctgcacgatgcgttcaaggccaagggcgtggaactggtggtggtctaccagccaacccgtggtttggtgaaccgcaacaagctcaaccccgaagaaaaagccaagttcgatttcgacaaggcactgggcaactacaagaccatgcttggccgtttcgccaagatgggttacgtggtgccggacctctcgccgctgactaacgagcaactgccggatgaactgccggcccacgatttctacttccgtggcgaccaacactggaccccttacggcgcccagcgcacggcgaaaatcgtcggtgccaaagtccgtgcgatgcctgagttcgcggatattcccaagcgtgagttcgaaaccaagcgctccgggcgcatgggcaagaccggcaccttgcacaacatggccgggcaactgtgcggcaccagctacgcgatccagtacatggaccagttcaccaccgaacccaagggcgaagccggtgacggcgacctgttcggcgattcgggcaacccgcagatcaccctggtcggcaccagccacagcggcaagaactacaactttgccggcttcctggaacaggaaatcggtgccgacatcctcaacgtcgccttccctggcggtggtcttgaaggctcgatgatccagtacctgggcagcgacgaattccagaaaaccccgccgaaaattctgatctgggagttctcgccgctgtaccgcctcgaccaggagaccatctaccgccagatgatgtcgctgctcgacaacggctgcgaaggcaagaccgcgcagatgagcgccagcaccacgctcaaacccggcaagaacgaattgctggtcaacagttcgaacaaagacctgcgtaacagcagtcaccaggtcgacatccgcttcgccgacccgtcggtgaaaaccttgcaagccaccctctggtacatgaacgggcgccacgaggacatcaagatcgagaaacccgaaacatccgatacagacgggcgtttcgcctttgaactgcgcaccgatgaagactgggcctcgcagaacttgctggccgtggaagtgcagggccccgaagcgggtgctgccgcgcagaaagtcgaagcgaaaatttgcacacgcaacgtattccctgccggcggtcaacagactgcttcagtgccgtgaattaagtatgcaatgaggttacttatgcagaagttattgatcccatcgttactgggcctggcgatcttcgccggcgcagccaacgccgccgcgccactgcgcccgccccagggctatttcgccccggtggaagcgttcaagaccggcgacttcaagaatgactgcgacgccatgccggcgccgtacaccggctcgctgcaatttcgcagcaagtacgaaggttcggacaaagcccgttccaccctgaatgtgcagtccgaaaaagcctttcgcgacagcaccgccgacatcaccaaactggaaaaagacaccagcaagcgcgtgatgcagttcatgcgcgacggtcgtccgcagcagctggaatgcaccctgaactggcttaccagctgggccaaggcgaatgcgttgatgtccaaggacttcaaccacaccggcaagtccatgcgcaaatgggcgttgggcagcatggcctcggcctatgtacgcctgaagttttccgactcgcacccgctggccaaccaccagcaggaatcgcagttgatcgaagcctggttcaacaagctggccgatcaggtggtgagcgattgggacaacctgccgctggaaaaaaccaacaaccactcctactgggctgcctggtcggtgatggcgacgtccgtcgccgtcaaccgtcgcgacctgtttgactgggccgtgaaggaatacaaggtcggcgccaaccaggtcgatgaccagggctttttgcccaacgaattgaagcgtcagcaacgggccttgtcgtaccacaactacgcgctgccaccgctgtcgatgatcgccagttttgccctggttaatggtgttgatctgcgccaggaaaacaacggcgcgttgaaacgcctgggcgacaaagtgctggccggggtcaaagacccggaaatcttcgagaagaagaacggcaaggaacaggacatgaaggatctcaaggaggacatgaaattcgcctggctcgaacccttctgcaccctctacacctgcgccccggatgtgctcgaacgcaagcatggcatgcagccgttcaagaccttccgactgggcggtgacctgaccaaggtctacgacccgacgcatgagaaaggcaacaaaggcaactagcggctgatgatcgttcccacgctccgcgtgggaatgcagccagggacgctctgcgtcccaaaagcggacgcagagcgtccagtgaggcattcccacgcagagcgggggaacgatcacagcctcccccgaaatcgtggggggggtttgggggggctctggcccttgactgtctgttaaacatggagagatcgggatggttttctcgtccaatgtgttcctgtttctgttcttgccgatctttctcggcttgtactacttgagcgggcaacgctatcgcaacctgctgctgctgattgccagctatgtgttctacgcctggtggcgagtggacttcctggcgctgttcgccgccgtgacgctgtggaattactggatcggcctcaaggtcggtgccgccggcgtgcgcaccaaaccggcccagcgctggctgttgctcggcgtggctgtcgacctgtgcatcctcggctacttcaagtacgccaacttcggtgtcgacagcatcaacgtgatgatgaagtcggcgggcctggagccgttcattcttacccacgtgctgttgccgatcgggatctcgttctacatcttcgagtccatcagctacatcatcgacgtgtaccgcggtgacaccccggccacgcgcaacctcatcgactttgcggcgttcgtggcgatcttcccgcacctgattgccggcccggtgttgcgctttcgcgacctggccgaacagttcaacaaccgcacgcacaccctcgacaagttctccgagggctgcacgcggttcatgcagggtttcatcaagaaagtctttatcgccgataccctggcggtggtggccgaccattgcttcgccctgcaaaacccgacgaccggcgatgcctggctcggcgcgctggcgtacaccgcgcagctgtacttcgacttctccggctacagcgacatggccatcggtttgggcttgatgatgggttttcgcttcatggaaaacttcaagcagccgtacatcagtcagtcgatcactgagttctggcgccgctggcacatcagcctgtcgacctggctgcgtgactacctgtacatcaccctgggcggcaaccgtaaaggcacgctgaccacttaccgcaacctgttcctgaccatgctgctcggtggcctgtggcatggcgcgaacatcacgtacatcgtgtggggcgcctggcacggcatgtggctggcgattgaaaaagccatcggcctcaacactgcgccgcgcagcttcaacgtggtgcgttgggccttcaccttcctgctggtggtgatgggctgggtgatcttccgcgccgagaacctgcacgttgccggccgtatgtacggcgcgatgttcagctttggcgagtggtcactgtcggaactcaaccgcgccagcctcaccggcctgcaagtggcaaccctggtggtggcatacgcaacgcttgcgttcttcggcctgcgcgatttctacaccaatcgccctgccgagaaagccaagccggctgacccgagcctgatcaaagcggtgcctggcgacaacccgggcagcatccaccagccaggtttcaccgtcggccaggacgccgccgtgcaaccggcctactggactgctgactggccacgctacgccatgcgcgctgcggtgctgctgctgttcgtggcgtcgattctcaaactgtcggcgcagagtttctcgccgttcctttacttccaattctgagggagccgaccatgacacgatcattgcgcgtcctctatatcggcctgttcctggtggtgctgctggcgctcggcgcctggtcgctgcgcagtttctttggcttcagcaccaatgccgacgccaccgtgctcaacggccgctggaccaaagccgtcgagacccactacgacgaccagttcccgatcaagcgcatcggcaccaacctctgggcagcgctggactacaagctgttcaacgaaggtcgccctggcgtggtgctgggtcgcgatcactggttgtacagcgacgaggagttcaaccccatcgtcaacgaagaccagaaccttgagggcaactacgcgctggtcgaaggcgtgcgccagaagctcaaggcccaaggcattcaattggtgatggccatcgtgccggccaaggtgcgcctgtacccggaacacctgggtgaggtgaaaccggcgagcatccacgccaacctgtacgaagacttccacgcccgtgtcgcggcggacaagatcatcgccccggacctgctcggcccgttgcaacaggccaagctggggggcacgcaagtgttcctgcgcaccgacacccactggacgccggacggcgccgaaatcgccgccaagcagttggccaagagcattgctgaaaaaacgcctttgagcggcgagccgcagcgctttgtcaccgaagcgcaaaagaccgaaccgcacaaaggcgacctgcgtctgttcctgccgctggacccgctgtttgaaaacctgatgccgcctaaagagccgctgcaaaaacgcgtcacgcacctggctgaaaacaaaggcgacgacgccctgtttgcagacagtgaaaccccggtggcattggtcggcaccagctacagcgccaaccccaactggaacttcgtcggtgcgctcaagcaagccttgcacagcgacgtcatcaactactcggaagacggccacggcccgattctgccgatgctcagctacctgaaaagcgacgacttcaagaacagcccgccacaggtgctgatctgggagttcccggaacgttatctgcccgtcaacaacgaaatcggtgacgccgacccgcagtgggttgcgcagcttaaacaagccggttcgcgccaacaaaacatggcaatcaacacctcagttaaaaatcaaaaatccgagacgcccgaccgggcgcaaaactgaaagagaggtaactcacatgactttcactacaactcctcgtcgtctcgccaagactctggccctggctgccggtatgagcattgtgtcgatgtccgccttcgccggtggtgacgccgcgctctacggcccaaccgcgccaaaaggttcgagcttcgtacgtgtgtacaacgcttccaaccaggaagtcagcgccaccgtcggcgccaccaacctcagcgacgttgcgccactggccagcagcgacttcagctttatgccgggcggtgactacagcgccaaggtcggcagccagaccgtgccggtcaagctcgccgccgatcactactacaccctggtcaacagcggcagcggccagccacagctgatcgaagaaccgccgttcaagaacaagcagaaatccctggtacgcgtgcagaacctcagcgacaaggccctgaccttgaagacggccgacggcaagaccgacgtggtcaagtcggtggctgccaaaggccgcggcgagcgcgaaatcaacccggtgaaggtgagcctggcgttgtatgacggtgacaagaaagtcggcgatgtgaagccggtggcgttggaacgtggtgaggcggcggtgctgtatgtgaccggttccggttcgagcatttcgccagtctgggtgaaacgcccagtgtcgacccgctgattagcttttcaatttgacgctccccctgtgggagcgggcttgctcgcgaatgcggtggttcagcaacagatgtgctgactgaaacaccgctttcgggagcaagccccctcccacaggctctgacccaaatcgattcaaggagaaacccccatgattccagttatcctttccggtggtagcggctcacgtctttggccgctttcccgtaaacagttcccgaaacaattcctggccctgaccggcgaacacacactgttccagcaaaccctggagcgcctggtgttcgaaggcatggactcaccgattgtggtctgcaacaaagaccaccgctttatcgtcaacgagcaactgagtgcgcgtaacctcgagtgccagcgcatcctgatggagccgttcgggcgcaacaccgcgccggccgtggccttgaccgcgatgatgctggtcaacgaaggccgcgacgaactgatgctggtgctgccggccgaccacgtgctcgacgaccagaaagccctgcaacgcgccctggccctggccaccgtggccgccgagcgcggcgagatggtgctgttcggcgtaccggccactcgcccggaaaccggttatggctacatcaagtccaccaacgattcgctgctgccagaaggcgtgagccgtgtgcagcagttcgtggaaaaaccggatgaaaaacgcgccgtcgagtttgtcaaaagcggcggttatttctggaacagcggcatgttcctgttccgcgccagccgtttcctcgaagagctgaaaaagcacgacccggacatctacgacacctgcgtgctgaccctggaacgcagcgagcagaccgccgacaccgtgaccttcgacgaagccacgttcgcctgctgcccggacaactccatcgactacgccgtgatggaaaaaacccagcgcgcctgcgtggtgccgttgagtgccggttggagcgacgtgggttgctgggcctcgctgtgggcggtcaacgacaaagacgccaacggtaacgtcagcaaaggcgacgtggtgatccaggacagccgcaactgcatgatccacggcaacggcaagctggtgtcggtgatcggcctggacaacatcgtggtggtggaaaccaaagacgcgatgatgattgtccacaaagacaaggttcagggcgtcaagcagatggtcaacaccctcaacgaccaaggccgcagcgaaacccagaaccactgtgaagtctatcgcccgtggggttcctacgactcggtggacatgggcgggcgtttccaggtcaagcacatctcggtcaagccgggcgcgtgcctgtcgctgcaaatgcaccaccaccgcgccgaacactggatcgtggtcagcggcacggcggaagtcacctgtgacgacaacgtgttcctgctctgcgagaaccagtccacctacatcccgatcgcctcggtgcaccgcctgcgcaacccgggcaagatcccgttggaaatcatcgaagtgcaatcgggcagctacctgggcgaagacgatatcgagcggttcgaagatatctacggacgctccaccccggttgaacgtggcgtgtcagtgaaaactatcgcgcaataaaacagtcgtaaaaagaagccctcacccagcccattgcgtcccctatccgcagtgggttgggtgggggctgatcgttcccacgctccgcgtgggaatgccgcctgggacgctccgcgcactggtgacgcagagcgtcactggatgcatgcccacgcagagcgtgggaacgatcagctgtaaaggcctcatcgcaggcaagccagctcccacaggggaatgcattccaactgtgggagctggcttgcctgcgatggcgtccgaaagcaccccgccagcattgacccctgcccccatcctgcctatcctcgcgcctgtcacgactcattcgtgatgaggtttgacggcctcggaaactcataggatcccattttcattaggagatccatcatgtccaaacaaaccacccgccccaccactttcggccccagtgaccgcagtgacgaacctctattctgcgtacaacccggcattcccatcgaacatgcactggaacatgccagttatgttctgggcaccgcgcgcgtgctcaccctggcggctcaagacttgtgcactgaacaccagagctacctgaactgggccagcctgcaattggctgaaaccggtttggccttggttgaggcttctatcgaaggcttgcaggcggattcttctgctcagtaactaagtctcgcaggcaagccagctcccacaggggaatgcattccaactgtgggagctggcttgcctgcgatggcgtccgcccaaccaacagctatctcaagctagccaatcccacctacgcttaagttaggatgctcgttctctattcgaggtggtctccatgttcatcggcgttttactgatcatcacctggctgatcctgctgctgcgctaccctgccaaggccttgccggtgtcccttgccgccgccgtcggcctgggctttgtggcgatttgggtggtgtggctggacaaccgcgaagcctcacaactgtcgcgcctggaactgcgcatcagctacgcgccgcaggaatgcccggccgatcgcccgttgaaactgatcctgaacaacggcaacgacgtgccactcactgaattgcgctggcgcgtcgccgcctatgcaccgggtgacacggtgaacctggccgacaacgtctatgctgccccacgctatcgtggccccggcgagttgcaagccggcgccacctgggatgattgcctgcccacaccgccgttgcgccctggctaccgcccgcaaaccctggaatttcgcgccgagcacctgcaaggcagtttctcggactgacaaaggattgatccatgcccaacgtattcatcaccggctgctccagcggcattggccgcgcgctggctgacgcgttcaaatccgccggcttcgaggtgtgggccagcgcccgccgcgaagacgacgtcgccgccctcgccgccgccggtttcaatgcggtgcaactggacgtcaacgacagcgccgccttgcagcacttggccgagcagtggggcgagctggatgtgctgatcaacaacgccggctacggcgccatgggcccgctgctcgacggcggcaccgaggcgatgcagcgccagttcgaaaccaatgtgttttccatcgtcggcgtcacccaggcgctgttccccgcgttgcgtcgcgctaacggcctggtggtgaatatcggcagtgtgtcaggcgtgctggtgacgccgtttgccggcgcttattgcgcctcaaaagccgcggtgcacgccttgagcgatgcgttgcgcatggagttggcaccgttcggcatgcgggtgatggaagtgcagccgggcgctatcgacacgcggtttgcgaaaaatgccggggcccaggctgagctgctgatcaacgagaagtcgccgtggtggccgttgcgcgaaggcattcgtgcacgctcccaggcctcacaaaacaacccgacctcggccgagcaatttgcggctcaagtgctcaaggccgtgcaacagtcaaagccgccacggctgttgcgtgcgggcaacggttgccgggcgctgccgttgatggcggcgttgttgcccaaggcattgctggagagagtgttgaagaagcgctttggtttgaacggtgtgttgtaagcaaccgtgaagcccacctgccaaaaaccgggatgagtgccataatcgccgcttgcctattgaaactgactggccccacaagggtactgcgatggaaatcagaaaaattcgactgaacaacgtcggtcgttttaccgacttggaagtcgcctttgcgcctaccgaaaagcatgcgtcgaaggtaacggtgtttgtggggaataatggggcggggaagacgacgattttgaagtcgatagctacgtcgttaagttggctggttgggcgcattcggaccgacaatggcggtggcagtcccatccaagaagatgtcgtcactaatggtgagcgattcgcctcaatcgatgctgaagtcagtggtatatctcacccgtcagcatcagcttccgcgacctactcatggacacttgctcgcaccttgcgaggccacaaagcaaaagtaaatagctctcttactaaattaaccgagctggctgatctctatcgctttcatatagggttggttgacgaaaacggctctcttccacttgtggccttctaccctgtcgaaagatccgtccttgacgttccactaacaatccgaaaatccgaaaaaccattcgatcagtttgatggatacgaaaacgctctaaatggtggcgttgatttcggacgcttttttgaatggttccgtgacagagaagatactgagaacgagcagggcatatcctcagccgtaatggaacagttgaaaaaaatctctagttcggatgaaaaactggtatctgaactgagaagtatgcacctagcatcacgcgatcctcagttgaatgctgtgcggtccgccgtcaacaagtttatgcctgactttagcaaccttagagtccagagaaagcctagattgcatatggccatcgacaagctaggcagtacactaagtgtttctcagctttctcagggggagaaatcactgatggcacttgtcggcgacattgctcgccgcttggcactcatgaatccatcattgaagaacccacttgaaggcgcgggtgtcgtcctaatcgacgaagtagacctccatcttcaccctcaatggcagcgccgtctgatccagcaactcaccgaaaccttccccaactgccaattcatcctgacaacgcattctcctttggtgatcagcgatacaaaagatgttttgtgctacgtcctcgacgacggtgaactagaagagcacaccggtctctacggtctagacgcaaatcaggtcctgcgcagcgtcatgggcaccgatgcacgcaacagtgaggtgcaggaccgcctagatcgtctactggatctgctgcaagacaaaaaattgaaagaggctaaggctattttcgaagagctttcagcagacctccccccaggtcatattgagctgactaaagcatcacttctgattcgcaagctggagctgcgcagtgcgtaagatcaccaaaggaaatgaacccgtagcactgacgcaatggaaacgcttacacccgaaggggcgctaccccgagttatcgcacgttgaaagaaacgccattcgccaagcttgtatagaagagcaatacggcctatgtgcccattgctgcaacgcaattgcactgaatagcgctcacaacgagcatctagaggcgcaaagagatgcccaaaaccgcacggtggacttctccaacatcgtagcgagctgtaatcgacctcaacaatgcgggaaggcgcacgaacatcaggcattgccactcaccgcactgatggatgaatgtgaaacagagctgaaattttatctttcagggcgagtggaaggtttgagcccaagagctatcacgtctattcaggttctgaatttaggtgacagccgcgagaaaaaccgggcgctgttcaatgatcggcgagacatcatcagtgcgcttcttttcaacagcagcatggatggttctgatctcactatagaaaacatcgacctgctgaaaattcttgaagaagaactgcaacaacccgatgagaaccagcaactcaagccattctctccagtcttgataaacgttattcgccaaatcagcgcctgaaccctaccccttcataaaatcaataaacgcccgcaccttcagcggcaaatgtcgcgtgtccgggtacatcgcataaatcccctgcggggcgaaacgatggtccggcaacaagcgcaccaaccgccccgcatccagatcatcctgcaccagccattgcggcaacaccgccacgccgtggccgcgcacggcgaacgcctgaagcaccgccgcactgtcggccaccagcgcagtcgggccggggcggtattgatgctcgccacctgccgggtcggccaggctcaattcggtcaaacgaccgtggcccaacttgggcacctgctctaactcatccagcgtttgaaccccggcgaactcgggtgctgctacggcaaacacctcgaacgtcgacaactgcacggcgcggtggttggagtccaataggcgccccaatcgaatcgcgacgtcaaagcgttccgagatcaaatcggcgtgggtcgaggatgtggataaatgaatgttgaggtccgggtgcaagcgccgaaacgcctcaactgcgggggcaaccaccgccagcgcgtattccaccgtggtggtgatgcgcaacgtgcctttgagctgggcatgttcggaacgcgcctcttccaccgccagccgggcttcttcgagcatgcgtgtgcagcgcaggtagaagcgctcgccggcgtcggtcagtgccagttggcgggtgttgcgggtcagcagggtcacgccgagttccgcctcaaggcgcttgaggttgaagctcaccaccgcgcgagtctggcccagcaggtcggccgcagcggtgagcgagccggcctcgaccacggccttgaaggtgtcgaatcggtccaggctgaccatcggccgcgccctcctttgtcaaaatatttttgacaaactaacaggcaatccgacgtatcccaaacgttgcgtgcggcctaccctgcccgcctcactcgcaggatcgcgttcatgacctaccgctcgaaagttgcctggatcttcctactcggcttcgccctggacctggtgaacatgtttgtcgccacggttgcctacccggatatcgcccgcgagctgcacgcttcggtcacgcaattggcctggatcagcaatgcctacatgctcgggctcaccgtgatcattcccctgagcgtgtggctggcggcgatcatgggcgagcgaacactgatcgcagcgagcctgctgttatttgcgggggcttcgctgatggtgggccaggcgggctccatcgaaaccctgattggctggcgcgcgctgcaagggctgggcggtggcttactgattcccgtggggcaagcgatggcgtaccggcactttccaccggcagaacgcagccaactcactgctcgtgtgatgtcggtggcgctgctggtgccggcactgtcgccggcattgggcgggatgattgtagacagcgtgtcgtggcgctggatcttctacgccaacctgccgctggcgttattaacgctgctgttggcgctgctgtggataaaacctgacgcccctgcaacggtgcgcccggcgttggatctgggcagtattttcaaacaggtacgcagcccgatgctgcgcgtggcgatgctcatctacctgttcatccccggcgtatttatcggcaccagcctgatcgccattctctacctgcgcagcctcggctatgacgctacaaagacgggcgcactgatgctgccgtgggcactggcgtcggcgctggcgatttacctgagcaaaaaactgtttaaccgttgcgggccaaaacccttgctgctggcgggcatggccctgcaatgcatcggcatcctgctgttgaaccagccgaccttggtgattcttgcctacgccttgatgggcctgggcggcagcctgtgcagcagcaccgcgcagaccctggcgtttctggacattcccgccgagcgcatgggcgacgccagcgcgttgtggaatatcaatcgacaagtgagtttttgcctcggcgcggcggcactcagtgcgctgttgtcggccttggattcattcgccataaccttcacgatagcggcagccctgacactgctgcccctttttgccgtgctgcgcctggatgcgtccagagtccgcacactgcttcaccctgccagcgagccccagccatgattgattacagcgatttttttgaagaagtgatccagacccacgtcgagattgaacagtggtttgccggcgttgcgcctgaaggcaccctggaaaccttgcttgcacgcttctcacccgagttcagcatggtcgcgcccgccaccggcacgcgggtgaatacggccggggtgaaggcactgttcacgcgccttggcggtatgcgcccagggttgaaaatcaccctgagtgaaatggccgggatcgaccgccatgcacgcggcgccacggtgacgtatcgcgagcatcaggttgacgacagcggcacgcagaccgatcgccgcgccacggtcgtgtttgaaaaacaagccagcggcgcgctgctgtggcgccatttgcacgaaaccttcatcaaggcctaactcggtcaaaactgtgggagctggcttgcctgcgatagcggtgggtcagcactacatgcttcaactgaccgtccgccatcgcaggcaagccagctcccacacaagccagctcttacagccagctcttacagccagttctcacagccagttcccaccgttagttttgtggtgggttgacgataacggtgcaggtgatccccgccgccagcagcacgccttccggcacttcatcaatgtgaatgcgcaccggcacgcgctgggccagacgcacccagttgaaggtcgggttcacatccgcaatcagctcacggctctccgggttgtcacggtcgtagataccgcgcgagatgctttccacatggcccttgagtgtctcgccgctcatcagttgcatgtcagccttgtcgccgacgttgacgtggggcagcttgatttcttcgaagaagccgtagacccagaacgagttcatatccactacggccatcttcgcctcgccgatacgcgcgtagtcgccacggtgcacattgaggttggtgacataaccgtccactgccgccacgacttgggtgcgtttcaaattcaactcagccgcttcaagctgcgccagcgcatgttggtaatcggccagcgccgagtcggcgatgttgctggcgtcgtcgcggttttccttggagatcaccaacgcatcaaggtcggcgcggcggtgggcgttgaccttgcgcatttcccacgtggctttgcgcgaggccaccagcgattgcgcctgcttgaccgcgatgcggtagtgctcggggtcgatctgcatcagcaagtcgcccttcttcaccaactggttgtcacgcaccggcacgtcgaccacttcgccggtgacgtcggccgccacgttgatgatgtcggcgcgcacgcggccatcgcgggtccatggcgtctccatgtagtgcacccacaatgtgcggccaatccagatcgccaaagccagtaccagcaaggttgcgagcaggctgaaaaactttttcatcggggcattctcaacggtagacggtcagcgccagggcgccgaacaagcaaacgaacaggctcaggcgcagcaacgccgggtgccagaaaaaacggtacaggtcgaaccccgccagaaagcggtccagggcccaggccagccctgccgcgatcaagaacatcaaggtcatggtcggcatgtacacgccgtggaaggcgatttcacgaggcatgcggggctcctttgagggccgcgagtggcgattgcgggtcgagcagcgaggtgcggataaagtgcaggtagcttttcacccggcgcagggccgaagtgtcgaaatgcggggcgaagggttcgtcggtggcctgcacgcggctgatcgcatggtcgacggcaatcaggccgcgctccaggttgctcgcgctcggctgcagaaacagccgcaccagcgaccggcccatcacgcggatcgcctgtcgccacggctgggattcggcatacgccgggtgcaccggcaaaatcgcctgttccttgcgcaactcgatgatcgcgtggccgacttccagcaccacgaacatccagcgcagcaggtcgcgctgcacctgcggctggccgacggcgaggccgtaggcctggtgcaacaggtcgcgggtgcggctttcaaaactcgaggccaggcccttgagtttgccgctgatggcgtacaccacctgctcacgcaggtcctgctccaagcggcgccacagccagcggctgttgggcggcaggataatcgcgcccgccgccgcgcacaccaacatgccgatgaccatggcgatgtagtcgttaataaaggtgtaagggttgtaaacggtcaggttatccggcaccgagccggtgctgaagaagatcagcaggccgacgccgacaccggcgtattgcgggcgtgaagcgaggaaggagccgaagatgatcaccggcgccagcatcacgcacagcaacgggaagccgtcgatccacgggaacacgaagaacatttcgacgaagcccaccaacgcgccgatcaaagtgccgcaggccatctggaacgccatgcgtttggggttgggcgtggcggccgacaagcccacggtggcggcggcgatcaatgtcatggtcgcgccgctcggccaggcggtggccacccaataactgcccagcacgatcaagataaatgacgcacgaataccggacgcggcgcaggccagccagttggttttggggataaaggtttcgtcccactgctcgcgcgcatggctgtggtcggcgagggacgcgtgggttaacgcgtagttgtgcaggtcgtcgacaaagcggtaaagcagctcgtaggcggtatggaaatccagttgctcggcttcgctcgggtcgctctcctggaagcgcgcacgcaggctgcgcactttggcgggcaagccgtctttatagacgctgagttggttgaccaaccgcgccgcgtcggggctggtgagggcgcgagcgtaaaaaccatcgagtagttcggcaaggtcttgcagacccggcttgatggccgcgaccacgtgatcggccgcatccgtgcgcagccgctcaagcaactggtgcaaggcgttaaagcgcgtggtgatgctcatgaattcgctgttgaggcgactgagccggccattgcgccgccgcatatgcgggtcttcaaacacggtgatgctgcgcagcccttccaggcccacggcttcggcgataaagcgcacattgctggcctcgaacccttcacgctggctgcgcccacgcagaccgtcggtgacaaacagcgcgaacacgccgaagcgctgatacaaggcgttgcgcatcgcggcgctgctggtttgcggcaggatcgcggcgctgaccaacgtggagcagagaatccccagggagatttccagcacccgccacaccgccgccataaaggcgccgtccgggtgcgccagggcaggcaaaccgaccatcgccgcggtgtagccggccaacacaaacccataggcgcgaaagttgcgattacgcgtcgcaccggccgtgcaaatgcccacccagatcgccagcgcgccaaggaataattcggtgttctgcgcaaacaaggcgatcagaaagaccatcaccgccgacccggccaaggtgcccaggaagcggtaaaaactcttggcgaacacctggccgctctgcggttgcatcacgataaatacggtgatcatcgccgtgcgcggttgcggcagttccaggcgcatcgccagccacagcgtgaggaacgcggcgatcagcactttgaagatatacacccaggtcacgccatcgctgcgtgcccagtcgaaaaaaccacggcgccactccagggagtgcaaccagcgcagcggtgcaggcaagggcgtcatcaaatcctactcagtgatcaaatacggccagcgccgccggggttttgctcgggagggttttggcaggctgcggcacatcgttgccggcgccgagcccaccgcccagggcggtgaccagctcggcatgcgcgctcaggcgcgcggcctgcacctgttgctcgatttgctgctggcggaacagcagggtctgggcgttcagcacgttgaggtaatcggtgaggccgcgctggtaggcgatcatcgcgatgtcgtaggttttttgcgccgaggccaccgactgcgcggcgaacgccgactgcttgtccatggattcgcggcggatcaactggtcgctgatgcccttgagcgcattgaccagggtttggttgtacttggctacggcgatgtcataaccggcgctggcttcgcccaactgcgcgcgcaaacggccgccgtcgaagatcggcaaggtgatcgccgggccgacgttgtagttgagtttctcaccactcaaaaagcccagcatggcgccgccggtggccatgtagccgaggctgccgacgaggtcgacgttggggtagaaaccggcgtgggccacatcaatgccacgcgcttgcgcggcgacttgccagcgactggcaaccacgtccgggcgttggccaagcaactgcgccggcaggctggaaggtaatttcagcggcgcggcgaggctcaggctcgggcgttgcagttgcgcgccctcacccgggcctttaccagccaacgccgccagttggttacggctcaaggcaatttcttcgtccacggcgtccagttgacgatgggtctccggcaacggcgtttcggcctggctgacgtcgaaatgcgtgccgatcccggcattcaagcgtttattggccaggtcgagaatctgctgttgctgggccagcgtggcggcgacgatatcgcggttggcgtaatgcaacgacagctggatataggcgcgcaccacgttgttttgcaattcgagctgggcctggcgcgcttcggcggcgctcatgtgcgccaggtcgacggcgcgttcgctggcgttgctttcgcggccccataagtcgagggcgtagctcaggcccagggaggaattgttgtcccaggtgttggcgccgctcagctcgcccggcccgtagaactggtccttcggccagttgtggcgcttgagcgtggtgtcactgttgatctgcaacgcctcggccgactcggcaaccccggccatggcccgcgcttcacgcacgcgcgcggcggccatggccaggctcgggctgttttgcgtggccagtgcgacccagcggttcagttgcgggtcgccgtaggcttgccaccattgcgcggtgggccagtgggcgtcctgggtggcgtgttgaatcgcttcgtcggtggccagggtattggcgttgagggcctggccttggggggcgattcctccggttccgatgcagccgctgattgctaacgataaggccaaaacactgagagccttcagctctctgctgatgcgacgcggcacggcgagcgtattcctgaggtggtgtggcgggaaggtggcgcaattctagggggcggcttggggaacgataagctggcattcctgtgaatctttgttaccgttcaagcgataatccgttggtagggatcactggacggcgtaactttctgtcacaatttgttatctcccctgagaacactccatggacactttgcaaaacatgcgcgcgttcagttgcgtggccgaagctggcagcttcaccgccgccgccgtgcaactggacaccaccactgcgaacgtctcgcgcgcggtctccaacctggaagcccatctgcaaacccgcttgctcaaccgcaccacccgccgcattgcgctgaccgaggccggtaaacgctatttgctgcgctgcgaacaaattctcgcctacgtcgaagaagccgaggccgaagccagcgacgcgcatgcgcgccccgccgggcagttgaaagtgcacaccatgaccggcatcggccagcatttcgtcatcgatgcgatagcccgttaccgccgcacccaccccgacgtgaccttcgacctgaccctggccaaccgcgtgccggacctgctcgacgagggctacgacgtgtccatcgtgctggccagcgaactgccagactcgggcttcgtctcccagcgcctgggcattacttacagcatcgcctgcgcctcgccggattacgtcaaggccaaaggctgcgcgcaacggccccaggacttgctcaaccacgcctgcctgcgcctggtgagcccggtgatccagctggataaatggaccttcaacggccccgaaggccaggaaagcgtagcgatcaatacgtcgccgttcctggtcaactcggcggatgcgatgaaaaccgcgatcaccagtggcatgggcgtcggcctgttgccggtgtatgcggcgatcgaaggcctgcgcaacggcacgctggtacgggtgatgccgacttatcgctcacaagaactgaacctgtacgccatctacccgtcgcgccaatacctggatgcgaagatcaagacgtgggtggaatacctgcgcgggtcgctgccggaaatactggcggcgcaccaggcggaactggtggcgtatgaattgagcggcagcctgagcggcgcgcggttggcgaactgattgctatcaggctacaggaatcaaaggtgggagctggcttgcctgcgatagcggtgtgtcagccaatactgtgcttactgttccaccgccatcgcaggcaagccagctcccacattgatattgctgtgccctgacaaccaccgtcaggaatgttagcttgcttggcattctcccgtagtcgatgagcccgcctgcaatgaaaaagaccgtcctcgccttcagccgcgtcaccccggaaatgatcgaacgcctgcaacaggacttcgaggtgatagcgcccaaccccaagctgggtgacatcaacgcgcaattcaatgaggccctgccccacgcccacggcttgatcggcgtgggccgcaagctcggccgggcgcagcttgaaggcgcgagcaagctggaagtggtctccagcgtgtcggtgggctacgacaactacgacgtggcgtatttcaacgagcgcggaatcatgctcaccaacacccccgacgtgctcaccgaaagcaccgctgacctggccttcgccttgctgatgagcagcgcccgccgggtggccgagttggacgcgtggaccaaggccgggcagtggaaagccagcgttggtgcgccgttattcggttgcgatgtgcacggcaaaaccctcggtatcgtcggcatgggcaacatcggcgcggccatcgcccgtcgcgggcgcctgggtttcaatatgccgatcctgtacagcggcaacagccgcaagacgcaacttgagcaagagctgggcgcgcaattccgcagcctggagcagttgctggccgagtcggatttcgtctgcctggtggtgcctttgagcgacaagactcgccacctgatcagcacccgcgagctggggctgatgaagcccagcgcgatcctgatcaacatctcccgtggcccggtggtggacgagccggcgctgatcgaagccctgcaaacccagaagattcgtggcgccgggctggatgtgtatgagcaagagccgctggccgaatcgccgctgttccagctaagcaatgcggtgactttgccgcacatcggctcggctacgggtgaaacccgtgaagccatggccaaccgcgccctggacaatctgcgcagcgccttgctgggccagcgcccgcaagacttggtgaacccacaggtatggaaggcctgacactgatcgttcccacgctccgcgtgggaatgcatcctgtgacgctccgcgtcaccactgcgcaggacctgactcttgcaccacgggacgcggagcgtccggggcggcgttcccacgcagagcgtgggaacgatcatcgggttaaagcctcggccgccgaggtcgataaccctctatagatcgtcatccctgatccacagaaggtttttatgtccaccaccaaagcccgcgcagattcactctcgcttctgctctttaccctgcgcagcggcaagctgatggccatcaacctgttgaaagtcagtgaaatcatcccctgcccgccgctgaccaagctgccggagtcgcacccacacgtcaaaggcatcgccacgctgcgcggtacgtcgctgtcggtgatcgacctgagccgtgcgctgggcgaaatgcccctgcaagacccgaacggcggctgcctgatcgtcaccgacgtcagccgctccaaacagggcctgcatgtgcaggcggtgagcaagatcgtgcactgcctgaccaccgatattcgcccgccgccctatggctccggcggcaatcgctcgtttatcactggggttacccaggtggaaggcgggctggtgcaggtgctggacatcgaaaaagttatccacggtatcgccccggcaccgattgaagcggcacccaccgacctgaccatggaagaggccgaagtcctcggcaatgcacggattctggtggtggacgacagccaggtggccctgcagcagtcggtgcatacactgcgcaacctgggcctgacgtgccacaccgcacgcagcgccaaggaagccatcgacgtgctgctggagctgcaaggcacggtcgagcagatcaacgtggtggtctccgacatcgaaatgtccgaaatggacggttacgccctcacccgcacactgcgcgaaaccccggacttccaggagctttatgtgctgctgcacacctccctggacagcgcgatgaacagcgaaaaggcacgcctggccggtgccgacgcggtgctcaccaagttctcttcgcccgaactgaccaagtgcctggtggtggctgcaaaatctgtggcgcaaaagggcctgtagccggtggcggagtatttccagctgctgcgccgcgacctcaccgccagcctgcccgcgccgcagtggccggccgatattcgattggatcattaccgcgaagaactggctccggcgattcacgcggtgttgcgcatgacccaggaccaaggtggcggccgcgtcgccagcctggcgcaatggcaacaccggttcgtcacggatgccgagttcgaccccacgctgtgcctggtcgccagcaacagcgacggcatactcggtgtggcccaatgctggaccagtgcattcatcaagaacctcagcgtgcaccctggcgcccaaggccaggggctgggccgcgccctgttgctgcacacctttgaggtgttcaagcagcgcggtgaaccctacgtcgacctcaaggtgcgcgagagcaacctgcgcgcccggcaactgtatgaaagcgccggcatggtgtttgtgctgcgcgacgtggtgcccgaggactgacaggcgctggcgcataacttgctttgcaaggacttgaacagtgcagagaggcaaaaacccgtcactgttcaagagtgccctctgaccttgcctggtgacagatcctccatgaacactcacttttcctgcgtgggttgcggcaaatgctgcaccgaccatcatgtgcccctgaccctcgaagaggcccgcagttgggcggctgacggcggtaacgtcatcgtgctggtggaagggtttctcggcaacggcctgggcttgcccgtgcaacaacgcgaacacgccgagcgccgttcagtggtggtgccgagcggcagtaccgaagcgtttgtggcaatcacctttgccgcttacaacgccgggcgctgccggaatcttgacgacgacaaccgttgccgcatttatgagcgtcgcccgctggtgtgtcgcatctatccgatggaaatcaacccgcatatcccgctgaacccagcggccaaagactgcccgccggaatcctgggaacaaggcccggcgttgatcgtcggtggcgaattgatggaccgggaactcgcagaattgatccgccgctcgcgccaggccgaccgcgatgacgtgcagaccaaggaggcggtgtgcgccttgctggggatttgcaccaccgcgctcaagggcgatgggttcactgcgtacttgccggacatgaacgcctttgctcaggcaatcgaatgggcaactgatcagccagccgcagccaatgagtgggtgtttcatgtgtccggcatggacatcgccgaacagctgttggatgccggcgcccagatcgcaacccaggtgccggccaactacgcgtttatttcgttgcgggcctcttaggcccgaaggcttacaggatggccaggcactcgatttcgatccgagcatcggctaacagcttgccggcggcgaaggtcgtgcgcgtgggaaggcggtccgccgggatgtaactggcatagactttgttcatggcgtcaaagtcgcggatattggccagaatgaccgtgcacttggccaaccggtccatccccacgccgtgttcgcgcagcgtgtcgcgcagggtttcaagtgcctgcgcggtctctgcccgaatgccgccgcgtaccaccttgccgttttcatccagcccgagcagccccgacacatagagggtttgccccacttgcacggttttcgagaagggcaaaccaccgtctgccggggtgaatatcatttttgccggctcaggcttgctggacaccggggccagataaggcttggtaatggccgcgtacttgccattgtccttcaggcgctgcagcgctttgttcagcgcggcagtcagttcagggtcggtcttgcgtgtagcaatggcaggcccgctgcccaacagttcatccttgatagccggcccggcaaacgcatacgccctgccctgaggcgtgttcagcaacgcctcgcggatttcgatggtgtcttgcaaggtcgcgtccaactcaccggcgagcaaacttgtgatcaattcggcattgaggttgaaactgcgtacctgcaccccttgcggtgcccatcgcgccattgcataggcggcgcggctggtgccggtcaaaacgcccacgcgtttgcctttaagcgcgttgggttctggcagcaggttggaacccacgggggcgaccaagcggctttcaagggcgtatagggggttggtgaagtctacgatttcacgccgtggcggcgtcgcagtcatcggcatgatcgcgtcgaaacgtttggcctggagcgccgcgatattggtcgcatatggctgatcaacccaaacgcagcgcgcgttgagttcagcacacagcgcgttacccaactcaatatccaaccccgcgagctcgccttgcgcattgcggtactcaaagggcgggacatccgcctcgaccccaaaacgtatttcgctccagggattggcgggagggggggaaacagcacacccgctcccggcgaacaccatcaaagcgagtgccagcattcttattgccgtagtcataaacctgtcctgtgcaaaagtgatgtgaagcattcgggctcaatcacttatggcccaaacaccctcagcgttctaacaagcactgactggtctttaactgcgacacgcctgtttattgagtaggaaaattcccaaaagtgatagtagaccgtttttcgacttagcgccggtggccccagaattcttgcgccaacaggcgcaaatcctccgccagcgcggccacattggccgagctgagctggatttgctgccccgcgctgacggtggcttcaccggcatcgcgaatgccgacgacattgcgattaatgtcctcgctcaccgcgctttgttcctccaccgccgcggcaatctgctgactcatcgatgtaatctggctgacgcgccggctgatgccgtccagcgcgagcgcggcctgctgtgcctgtgcgacgctcgcatcgacatgctcgctgctgtgcgccatggcttgcaccgcatcgcgggcgccgccttgcagggtgctgatcatgcgctggatctcattggtcgattgctgcgtgcgctgggccaggccgcgcacctcatcggcaaccaccgcaaagccacggccctgctcgccggcgcgagcggcctcgatggcggcattgagggccagcaggttggtttgctcggcaatcgtgcggatcacttccagcacgccactgatttcgccgctgtggctttccaactgctgaatcactgcggtggcgcgcgccaactcctgggccaggcgcaacaccgcatcgcggctttcatcgacgcgctgatggccttcacgggtttcgctgccggcctggtccgccgccgtggacgcctcaagtgcatggctggccacttgcgccacgctggcggccatctggtggatcgccgtcgccacctgatccgtctgggtctgctggccgaggctgctggcgtggctgttgtccaagtgctcgaccagctgcgcggcgtgccccgccaaacgttgggacgcatcgccgatgcgccccaccacggcgcccacttgggcttcgagcatttgcagggcgaactcgatctgcccgcactcatcgctgcgaccggtatagatcgcctggctcaaagggttgtcggcaatcaagcgcgcgcgctggttgagttgccccagcggtcgcacgatcgctttaaccccgagcgccgccagtgcacacccaagcattaacgccaacagttgccagatcggcgaatgagccgccaggcccagccccaaggcccacgccaacgcacagctggcggtggcccacagcgacagtttcatgcgcatgccgggcatcggcggcctttgacgtttacctgcgcgcaactgcgcgtaagcacgttccgccgcctgcaccttgcgcgcatcgggtttggtgcgcaccgactgatactccaccgccgccccgtcccgcgtgaccggcgtggcgtaggcgctgacccaatagtggtcaccgttcttgcagcgatttttcaccatgcccatccacgagcggccgcttttcagggtttgccacatctgtgcaaacgcggcgggcggcatatcggggtggcgcagcaggttgtgcggtgagccaagcaattcatcgcggctatagccgcaaacgtcgatgaagtccttgttggcataggtaatcgcgctggtcaggtcggtggtcgagaggatgttggcatcgggagcaaagtccacatttcgaccggtgaccggcagattgatcttcatggagaagcgcgctcgtaattattggaggagtcggcagggcgtcgactctaagcgcacccatggggcaaatactgatccagctcatgttccgagcaattaattggccatcatggactgacgagcggttcatcgaggttgtaaggctgcacgatgcgcaggtattcaccgctctgtttcagtcgttccaacgcgtggttgagatcattgcgcaaagcgatatcgggcttacgcaccgcaatggccacgccgtcgcccagcagctcggccgaaacggcggggcccaggaagtcgaaatcctggccggcaggggtgtcgagcagtgcctggcgaatttccaccgtgccttgcagcgtcgcatcgatatgcccggccaccaggctgcgaaccagttcgtcattgagccagaagctcttgatgaccacgcctgcaggcgcccactttgatcgcgcaaaggcttcccggttactgcccagcagcacaccgacacgcttgccccgcagcgacgctacggtcggcaccaggtcggaggccttgcgcgccacgagccgcgtgataaacggatacagattgtcggtaaaactcacccattggcgccgtcttgaggtgggggctatgcccatgatcgcatcgaatcgacgggcctcaagggcttgaaaactttcgaccaggacctgatcgacccaggtacaacgcgtattgagctgctggcaaatggcattgcccagttcaatgttcaaccccaccaactgaccgtgctggtcgcgactttgaaagggtgggaattgggcgacgacggcgaaacgaatatcacgccggggttcatcagccatcgtaacggagcagaaaacagcggccaaaggtaataaggcaggcacaacaaaaacccggatgaaatccacaggggacgtccttttctggaaagaccagcctcattacaccctgccccggtgagaacaatcggggctgagcagaggctgcacaagctttcaagaaacggtcacgggccttcaatcagaaaggtcagcagaccctgtaggcaaacaccgccacagtctgcgcgtcattactctcagcgtttacccatggagcggcgagtgcccggtggcgccatgcctggcgacttggtgtgaccgtttttggcgccgtttttgtaccaaggctgggcggcattcttggccccagccaactcacccggtttgaacggaaacttgaacgctgggatctcggctttttcaacgctgtcagcgccggccggatcgacgaggtcggccacttcaacagggggttgtgtcggggaagtcatggaagctccggggcgtgcaaataatgaggcggggccggctggcgggccccactggcgcgcagtatacctgcgcgcttcggatctttaaccaccgccagtacgaatggtcggactttactgacagcgccgtcagttagcagtcaccgtgctgaccggattggcgggctataaagaccttgatcctcccaaccctttgccccggcgcctcaccccatgcacattcaacgaaaaaccgccctgatcgtgggtgtcctcgtggtagtggcgattgcagcctgggcactgacccggcccgccaagaccaaactggcggcgccgaccgcgattccggtccgggtcgtcagcgtcgcgcaacaggacatcccccggtatgtcagcgggatcggctcggtgctgtcgttgcacagtgtagtgatccgcccgcaaatcgacggcattctcaccaaattgctggtcaaggaaggccaactggtcaagaccggcgacctgctggccaccatcgatgaccgctcgatccgcgccagcctcgaccaggccagggcacaactgggcgaaagccaggcgcaactgcaagtggcgctggtgaacctcaagcgctacaaggaactgagcatcgacgacggcgtgtcgaagcagacttacgatcagcaacaagccctggtcaaccagctcaaggccacggcgcaaggtaatcaagccgccatcgactcggcccaggtacaactttcctacacccagattcgttctcccgtcacaggccgcgtcggtattcgcacggtggatgaaggcaacttcctgcgcatgagtgatacccaaggcttgttctcggtcactcagatcgatccgattgccgtcgagttctccttgccgcaacaaatgctgccgaccctgcaaggcctgatcgccgcgccgacccaggccagcgtcgatgcctacatgggcgccgacaccgacggccagaccggcgatttgctcggtgaaggccacctgagcctgatcgacaaccagatcagctccaccaccggcaccttgcgcgccaaggccgagttcaagaatgcctcgcagcgcctgtggccggggcaactggtgactatcaagatccagaccgccctcgacaaaaacgccctggtggtgccaccgaccgtggtgcaacgtggcctcgacgcgcattttgtgtacagggtcaaaggtgacaaggtcgagatcgtgccggtgcaagtggtctatcaggacagcgacgtgaacatcatcaagggcgtgcaagccggtgatgtgctggtcagcgatggccagtcgcggctcaaggccggtgcccaggtagacgtgctcaaggaaccgccacacgtcatccagacggtcgacgcaaaggtgcaaccatgagcggcagccgttcgccgtccgcctggtgcgtcgaccacccggtcgccaccctgctgctgacgttcgccttggtgctgctgggggttattgccttcccgcgcctggccgttgcgccactgccggaagcagaatttccgacgatccaggtcaccgcgcaattacccggcgccagcccggacaccatggcgtcgtcggtggcaacgccgctggaggtgcaattcagcgccatccccggcatgacccagatgacgtccagcagcgccttgggctcaagcctgctgaccctgcaattcaccctgaacaaaagcatcgacaccgccgcgcaggaagtgcaggcggcgatcaacaccgcgtccggcaagctgcccagcgatatgcccagcctgccgacctggaagaaggtcaacccggcggacagcccggtgctgatcctcagcgtcagctccgacagcatgcccagcaccgagctgagcgactacgtggaaaccctgctggcccgccagatcagccagatcgacggcgtcggccagatcaacatcaccggccaacagcgcccggcgattcgcgtgcaagcctcacctgacaaactcgcggccatcggcctgaccctcgccgacgtgcgcgtggccatccagcagtccagcttgaacctggccaagggcgcgatttacggcgagaacagcgtgtcgaccctgtcgaccaatgaccagctgtttcacccggatgaatacggccaattgatcgtttcctacaagaacggcgcgccggttcagctgcgcgacatcgccaaagtcatcaacggttcggaaaacgcctacgtgcaagcctggtccggcgatacgcctggggtgaacctggtgatctcgcgccagcccggcgccaacatcgtcgagacggtggatcgcattcaagccgaactgccacgcctggaaggcatgctgccagcctcggtgcaggtcagcgtattgaccgaccgcaccaagacgattcgcgcgtccttgcatgaagtggaagttacgctgctgatcgcgatcctgctggtggtggcggtgatggcactgttcctgcgccaactgtcggcgacgatgatcgtgtccagcgtgctcggcgtgtcgctggtggccagctttgccttgatgtacctgatgggcttcagcctgaacaacctgacgctcgtggcaatcgtaattgccgtgggctttgtggtggacgatgcaattgtggtggtggagaacatccaccgccacctggaagcaggccttgataaacgcgaagcggcgatcaagggttctggcgagatcggcttcaccgtggtatccatcagcttctcgttggtggcggcgtttattccgctgctgttcatgggcggcgtggtcgggcggctgttcaaggagttcgcgctgacggcgacctcgaccattctgatttcggtggtggtttcgctgacattggcgccgaccctggccgcgctgttcatgcgcgcgccgacccaccacgcccacgacaaacccggtttcagcgaacgcctgctcgccgcctacgcgcgcaacctgcgccgcgcgctggcgcatcaacgcacgatggcggcgatcttcatggtgaccctggccctggccgtggtcggctacatctttattcccaagggtttcttcccggtgcaagacaccggcttcgtgctcggcaccagcgaagcggctgccgacgtgtcgtacccggacatggtcgccaagcacaaggccctggccgaaatcgtcaaggccgacccggcagtggaagcgttttcccactccgttggcgtgaccggcagcaaccagaccatcgccaacgggcgcttctggatcgccttgaaagaccgcggtgaccgcgacgtgtccgccagccagttcattgatcgcatccgcccgaaactggccaaggtgccgggcatcgtgctgtacctgcgcgccggccaggacatcaacctcagctccggcccgagccgcgcccagtatcaatatgtgctcaagagcaacgacggcccgacgctgaatacctggacccaacgcctcaccgaaaaactgcgcgccaacccggcgttccgtgacctgtccaacgacctgcaactgggcggcagcatcacccacatcagcatcgaccgtcaggccgccgcgcgcttcggcctgaccgccaccgatgtcgaccaggcgctgtacgacgccttcggccagcgccagatcaacgaattccagaccgagatcaaccagtaccaagtggtgctggaactcgacagccagcagcgcggcaaggccgaaagcctcaactatttctacctgcgctcgccgctgaccaatgagatggtgccgctgtcggcgctggccaaggtcgacccgccgaccgtagggccgttgtcgatcagccatgacggcatgttcccggccgccaacctgtccttcaacctggcgcccggcgttgcgctgggcgatgccgtgatcatgctcaaccaggccaagaacgaaatcggcatgccggcgaccatgatcggcacgttccagggcgcggcccaggcgttccagagttcgctggccagccagccatggctgatcctcgcggcgctggtggcggtctacattatcctgggtgtgctgtatgagagctttgtgcacccgctgacgatcatctcgaccttgccctcggcgggtttgggcgcgctgatcatgctgtggctgctgggccaggacttttcgatcatggccttgatcgggctggtgctgctgattggtatcgtcaagaaaaacggcatcctgatgatcgacttcgccctggacgcccaacgcgtgcgtgggctgccgcccgaggaggcgatttatgaagcctgtgtcacgcggttccggccgatcatcatgaccaccctcgccgccttgctcggcgcggtgccgctgatgctgggctccggccccggtgcggaactgcgccagccgctgggtatcgcagtggtgggcggcttgctggtgagccaggcgctgacgctgttcaccacaccggtcatatacttgtaccttgagaagtttttccacaggcccaaaccagcgctggcgctggcgaccacacactgaaggcggggtcatgcgcgtcctgattattgaagatgaagaaaaaaccgcggactacttgcaccgtggcctgacggaacagggctacaccgtcgatgtggcgcgtgaaggcgtcgaaggtttgcacctggcgctggagaacgattacgcagtgatcgtgctcgacgtgatgctgcccggcctcgacggcttcggcgtattgcgcgcgttgcgtgcgcgcaagcagacgccggtgatcatgctcacggcgcgtgagcgcgtggaggaccgcattcgtggcctgcgcgaaggcgccgacgattacctgggcaaaccgttttcgttcctggaactggtggcgcgcctgcaagcgctgacccgccgcagtggcgggcatgagccggtgcaagtcaccgtcgccgacctgtggatcgacttgattagccgcaaggccagccgcaatggcttgcgcctggacctgaccgccaaggagttctcgctgctcagcgtattggcgcggcgccagggtgaaatcctctccaagacggcgattgccgagatggtctgggacatcaatttcgacagcgacgccaacgtcgtcgaagttgcgatcaaacgcctgcgcgccaagctcgatgggccgttcgacaccaagctgctgcacaccattcgcggcatgggttatgtgctggagaaccgcagtgtcggctaactccatcgccctgcgcctgagcggcatgttcacgctggtggcgctgctgatcttcgtgttgatcggcggcgcgttgtaccagcaagtggaccggggtttgggcttgctaccaggcgccgagctggatgcgcgctacagcgtgctggagtcgtcggtgaaccgcttcggcacgccggaccactgggcgaaaatcaccgccaaactgaaactgctcggtgaagaagacaaacgcatccgcttctgggtggtcagcagcgatccgaactacgaatacggcaacccggacgcgcaaatccgcgccttcgccgaggggccgacgggcaagcgcgacttgcgcctgccagggcgtgaatacccgttcaaggtgttggtcagccagttcgcggcgaaagaacagcgcccgccgctgcgctttatgatcgccatcgacaccgaaaacttccgcgcaacccagcaccaactgctggtggccttgatcggcctggcgtttgtcggcgtggtgctggcggcgctgttggggttctgggtctcgcgcattggcctcaagccgttgggcaaactctcggatgaggcgcagaaactagcaccgcccaagctctcggggcggttgcaactgtcgccattgccgccggagttgagccagttcgtcaactcgttcaactccaccctggatcgggtggaacaggcttattcgcgcctggagtcattcaatgccgacgtggcgcatgaactgcgctcgccgttgaccaacctgatcggccaaacccaggtagcgctgacgcgcgggcgttcggccgagcattatttcgaagtgctgcaatccaaccttgaggagttggagcgcctgcgttcgatcatcaatgacatgttgttcctggccagtgctgatcagggcagcaaggccaccaagctgatcgaaagttcgctggcggacgaagtggccacgaccctcgattacctggacttcatcctcgaagacgcccaagtccaagtgcgggtacgcggtgacgccttggtgcaaatcgagaaagcgcacctgcgccgtgcgttgatcaacctgctgagcaatgcggtgcagcacaccgcaccggggcaggttatcgaggtgaacattgaggtgcaggaccatcacgtggcgattggggtgaccaacccgggggatgagattgccagtgagcatttgccccgactgttcgagcggttttatcgggtggatgcgtcgcgcagcaacagcggggcgaatcatgggctggggttggcgatcgtcaaggcgattgcgcttatgcatggcggggatgtgtttgtgcgcagcgatgggggcgggaatacgtttgggattacgttgccggtgtaggtggtggtttgctgtgggtatatccgttatttgggtgatggccgcttttggttccgcccttacggcgggtcactttggaaaagccccaaagtaaccaaagggctcttgccccaccactcggcacctcgctcaggctcggtgtgccctcactccggtactacggagcgggccgccgcgacggggcgtccctgccccgtcgcggctaaaccggcgtcctgccggtttacccgctccgtactacctgcgctcggccagcgtggtttaacggggcgcctaagatcaaagtcaaaagcagatcaagatcaacagcagagcacgacggcctagtagccgatctgattctggaacctaaactcaatcaaatgtgggagctggcttgcctgcgatggcatcaactgtgtgtcactgaaatatcgaggtgcctgcatcgcaggcaagccagctcccacacttggatttcggtacatcagatagaagttgtgctgctgtgcttttgatccgcttttgcttctaccactcaggtcggctaccaggccgccgtgctctgcttttgatcttgcttttgatctgacaggccccgtcaaccacgctggccgaacgcaggcttgaatccgtgggtaacccggcaggacgccgggttagccgcgctgggccaaggatggcccatcgcggcggcccacggattcaagcctgcgtgcgggcatgccgagcctaggcgaggcaccgagtggtggggcaaagcgttttttggttacttttttaggcgtttgtaaaaaagtgacccgccgtaagggcggaaccctgagtggccgttaccgcagaaatggatatgtactcggtcgtcctgaaccaaaccgtcaactgacccaccgccatcgcaggcaagccagctcccacaaaggagctctgccgggtcgactattgcgatttgggcaacagtcattatcttgttacactctgtatcgcaccgctcacctgcgttaatttgacgcaccgatgagcgcgacggcaaacacagcttcccgctcaccccaatttccctcgacttatttccagggctctacactgggaatctgtttaaagccgctgacttcagcggcttttttttgccgtaaaaaaaggccaggcacacccccacgacattggccgtttacgattgatcaaaggagctccaccggtgaagaactcgctgacgttcaccccgctattcctagcgattgcagcaacgatcgcccccctcgcccacgcggcagacaccacccccgccgacggtttcgtcgaaggcgcaagcctcaagatcaacacccgcaactactacatgaaccgcgaccgtcgcgacattcacaccgatgacagcaaggaatggggccaaggtttcatcggcaccttcgaatccggctacacccaaggcaccgtcggcttcggcctggacctcaacgccatggtcggcctcaaactcgacggcggtggcggcactgacggttccagcatcctcccgtacggcagcggcaacggcaaagcccccggttcgttctctaccgctggcggcaccttgaagatgcgcgccttcgacaccgagctgaaagccggcgacctgttcctcaacaacccggtgatcgccggcggcatgacccgcatgctgccgcaggactttcgtggtgtaagcctgaccaaccacagcttcgacggctggatgctcgaaggtggccaggccagcttcaccaagctctacaaccagagcggccaccggcgcatcggcaccagctacggcgcgctgccggaccacgccgacagcaagcacctgaactgggccggtgtgtcgttcagcggcattccaggcgtgaccagcaacctgtacgcctccgaactcaaggacgtatggcaccagtactactacgacctggactacacctacgcgctcaatgacctggtcagcctcaacccgggcctgcactactaccacacccaggacaccggccagtcactgctgggcaatatcgacaacaacacctacagcctgcatttcaccgtgggcgtgggcaaccacagcgtcaccgccgcctaccagcgcgtcaacggcaacacgccgttcgactacatcagccagggcgacagcgtttacctggacaactcccagcaatactcggacttcaacggccccaacgagcgctcgtggaaactcaagtacgcctatgacttcgccggcctcggcatgcctgggctgacgtccgccgtgtcctacatcagcggaaagaccgacctgaccaaggtcgaccccaacagccgtggctacagcgcctggtacagcgccgatggcaaggacgcgaaacactgggagcgggacatcgatttgaagtacgtggtgcaaggcggcaaggccaaggatctggcggtacgcctgcaatgggcaaccaaccgtggcggcaatggctacgcggcggtggatcgcgatgtggatgaataccgggtaatcgtggactacccgatcaacgtgttctaacccgctgatttttcttttttagcccatgctctaattttcatcgcgtagaactaaactgccagtatcttccctgttgaagcctgcgcgatgagtcaactccgccctccttctttgcctgcacgctcggagcttttgctgattctgggcagtggcctcaccgttatcctgattgtgattatcgttgcagcgttgctgaaccgcgaacacgccagcaccttgcaggcggccaaacgcgcaaccaccaatatcacccaactgatcaatgccgatgtgttgcgtaacgccgagctgtatgacttggcgctgctgggcttgatcagcgccgccaagcgcaaggacctggcgcaggcgtcgccggaaatccgccacgtggtgcagtttgatcaatccaacgcggcgcccttcaaaggcgaagtgctgttgctggatgccgatggcgcggtgattgccgactcctcgacgctgcggcccacaccgcgcaatttcgccaaccgcgattatttccaggtgcataaacagaatgcccaggcgggtctgtttatcagccggccgttcaagatccgctgcgattgcgaccaagtctggcgcatggcattcagtcgccgaataagcggacccgacggcgagtttgccggtgtcgcggtggcgacgatgcgtttggcgtacttcgatcagttgttcaaccgcctcaccatcggcaatggcagctccgtcaatctgctgaacaatcgcggcattctcctggcccagcagccgctgctggaacgcgacatgatcgataaagacctcagcgatcggcccaacttcaaacgcatactgcgcgaaggccaaggcagctttcgggctatctcagccatcagtggcacagagcgtttatacaccttcaccaatgtcggtgaactgccgctgattgtggtggtggcgctggccagtgaagacgtgttcgctccctggaagcgcgccgcgctgctgaccagtggcgccaccggcgtgctctgcattggtttgttatggctgacctggatgttgcgccgtgaactgcgtcgccgttatcgcgccgaacaggtgctgtcggagctggccgccaccgatgccctgactggcctggccaaccgccgtatcctggatcaacgcctgggcctggaatgggaacgcgcacagcgttccaccgagccgctgacgctgttgatgatcgacgtggaccacttcaaggccttcaacgaccgtcatggccatcatggcggtgatgcggcactgcgcacggtcgcccaggtgatcggcggcaacatccgccgcccagccgacctggctgcacggtatggcggggaagagtttgcggtggtgttgccgaataccgacgccaagggcgcctgggtgatcgccgagcatatccgcagcggtgtcgagcacctgccacgggtcgccggtgccgagcggccgatcaccgtaagtatcggcatgagtacctgggacaaacgcagccgcctgtcacttgaggcgttgctgctgcacgccgatcaggcgctgtatgaggccaagcacagcgggcgcaaccggattgtggaggcggccacacgctgaccggctgcaacgccccgcacgtactacgctattggcatcctcgaagcagaagtaagcccgatgagcccgagcctttcccgccctacacgtcgcccggagcgcttgctgatcctgggcagcgtgctcacggcactgctgatcgtggcgatcgtggcggtgctgctgattcgtgaacacgccagcaccctgcagaccgccaaacgcaccgcgaacaacatcacccaactgatcgacgcggatgtactgcgcaatgccgagctgtacgacatggccctcaaaggcctgatcgccgccacggagcgcaatgacctgcacagcgtttccgccgaaattcgtcacctggtgctgttcgaccgctccgccgccgcaccgtacaagggcgacatcctgctgctcgacgccaacggcgagatgatcgccgactcgtctttgctcacgcccaagaccggcaattttgccgaccgtgactattttcaggcgcagcgcaaaaagcctgatatcgggctgtatatcagccggccgttcacggcgcgctgcgtgtgtgacgaccaatggcgcattgcattcagccggcgtatttccgggcccgacgggcgctttctaggcgtcgcggttgcgtccatgcgcctgtcgtattttcaccaactgttcagcagcctgaacatcggcaacaacagcaccattaacctgatcaaccagcagggcatcctgcttgcgcaataccccatgctggaactcgacatgatcgacaaggacttgagccagcgccccaacgtcgcgcgcatgctcaaggaacgcgacggcagctttcgtggggtttccagcgtcgaccaccaggaacggctctataccttttccagtgtgggcgacttaccgctgatcgtggcggtggccctgtccaccgatgacatcttcgcccaatggaagcgcgcggccttgctgatcagcctggcaaccggcgtgctgtgcattggcttgctatggctgagctggatgctgagcaaagaattgcgccgccgccaccgcgccgagcaggtgctgtcagaactggcagccaccgacgccctcaccgggctggccaaccgccgcaccctggaccagcgcctgcgccaggaatgggaccgcgcgcaacgctcaacagagccgctgaccttgctaatgatcgacgtagaccacttcaaggctttcaacgaccgtcatggccaccacggcggggacgcggcattgcgcacggtggcgcaggtgatcgaagacaacatccgccgccccgctgacctggcggcgcgctacggcggggaggagtttgcggtggtgctgccgcataccgacgctaaaggcgcatgggtgatcgccgagcatatccgcagcagtgtcgagcacctgccacgggtcgccggcgccgagcggccgattacggtgagtatcggcatgagtacgtgggacaagcgcagccgcatgtcgttggaggcgttattgttgagtgcggatcaggcgttgtatgaggccaagcacagcgggcgcaatcggattgtggatactgcaacgctctaggctgggtgagtgcagcgtgcattaataggggagcttgcgatgcaggtgccttggtatttatggcacaccgaagtgatgctatcgcaggcaagccagctcccacaggagggctgcggtgctttcacatcaggtataaaaaaaggccacctgaaggtggcctttcaaaactaaagaaagagagttgttacttacaccgccgcaacgggacgcatgtaagagatcggtgcggtgctggcatcttcgaaggtcacgacttcccaagcgtctgtctgctcaatcaacttgcgcagcagctggttgttaagggcgtggcccgacttgaagcctttgaactcgcctatcaggctattgcccagcaggtagaggtcaccgattgcatcgaggatcttgtgcttcacgaattcgtcttcgtagcgaaggccgtcttcgttcagtacaccatccgcgtcgaccacaatggcgttttcaacgctgccgccgagtgcgaggttgtgcttgcgcaggtactcgatgtcactcatgaaaccaaaggtacgggcgcggctgacttcttttacgaacgaagtgctggaaaaatccacgcttgcactttgggtgcggtcacggaataccgggtgatcgaaatcgatctcaaagctcactttaaagccttcgaacgggacgaaggtggcgcgcttgtcgccgtcttctactgtcacttcccgcagaatgcgaatgaacttcttggctgcgtcctgttcttccaggccggcagattgaatcaagaatacgaagggtccagcgctgccatccatgatcgggacttcggacgcggagagctcgacgtaggcgttatcgatgcccaggccagccatggccgagagcaagtgctccaccgtgtccactttgacgtcaccgttgaccaatgtggtcgacatcgtggtttcgccaacgttttccgcgcgagcaggaatctgcaccacagggtccaggtcggcacgaacaaacacgatgccggtgtcgacaggtgcgggcttgagggtcaggtataccttctccccggagtgcagacctacacctgtggcacggataatattcttcagggtgcgttgtttaatcatggcttggaccgcttcagcgcaaattgcgaactggtatcaacaaaggctggcgataataacagaccagacctttgctgaacaccaatcaccttcatagccctgatacattccattaatcggcctgacgacgcaggaatgccgggatgtccaggtagtccagatcatcttgcggattcgggctacgggacgccgcagcaccggcctgagcctggttgcgcatcacggtcggacggtccagatcacgatagttcacagacggcagttcctggcgcgcaggcgctggagcggcagcttgctggctggcgtggctgttgtggccggtgtgaacggtattgtcgatgaccttcacaggcttctcgattttagcgcccaggccggtagccaccacggtcacgtgcagttcatcacgcatgtccgggtcgataacggtgccgactttgaccatcgcgtgctcggaagcgaaggcttcgatgatgctacccacgtcggagtactcacccagggacaggtcaggaccggcggtgatgttcaccaggatgccgcgtgcaccttgcaggttcacgtcttccagcaacgggttgcggatcgccgcttcagtggcttcgcgtgcacggttcggaccgctggcgcagccagtgcccatcatcgccatgcccatttcgctcatgacagtacgtacgtcggcaaagtcgacgttgatcatgcccgggcgcttgatgatgtcggagataccgcgaacggcaccggccagtacatcgtcagccttggcgaacgcggacagcaggcttgcgtccttgcccaggatggtcagcagcttctcgttgggaatggtgatcaacgagtcgacgctttcagacagcagacggatgccttcgtcggcgatctgcatgcgcttgcggccttcgaacgggaacggacgggtgacgacagcaaccgtcagaatccccatttccttggccacttcggcaatgatcggggccgcaccggtaccggtaccgccgcccatgccagtggtgatgaacaccatgttggtgccttgcagcacttcagcaatacgctcgcggtcttccagtgcggcttgacggccgacttccggattggcgccagcgccgaggcccttggtcacggctgtgcccaattgcaggatggtccgcgcgccgatgcttttcagcgcctgggcatcagtgttggcgcagatgaattcaacgccttcaatgttgctcttgaccatgtggttgacagcgttgccgccgccaccgccgacaccgattactttgataaccgggcttgcggggatgttgtctacgagttcgaacatgttccctctcctttcattttctctagttttttcgcctactgcttactgcggtgctgcggtgtcgcggtaaatcgttagaaattgccttttacccaagcctgcagccgctcgaacaacggcgctttcgcctcgtcgtcgctgcggtagctgtcacggatacttgggcccgacagggaaatgccgtcggtctgcttttgcagcccgtacaacagcaagcccacaccggtggaataaatcgggttgcgcaccacgtcgcccaggcctttgacgccatggggcacgcccaggcgaaccggcatgtggaagatttcctcggccagttcgaccgcgccttccatcttcgaggtgccaccggtcagcacgatgccggccgggatcaaatcttcataaccgctgcggcgcagttcagcctggatcagggtgaacagctcgtcgtagcgaggctcgaccacttcggccaaggcctggcgcgacagctcacgcggtgggcgatcgccgacgcttggcaccttgatggtttcaccggcaccagccagtttggccagggcgcaggcgtaacggatcttgatttcttcggcgtactgggtcggcgtacgcagcgccatggcgatgtcgttggtgacctggtcgccggcaatcgggatcacggcggtgtgacggatcgcaccctcggtgaaaatcgcgatgtcggtggtaccgccgccgatgtcgaccaggcacacgcccagctctttttcgtcgtcggtcagtaccgagtaggccgacgccagctgctcaagaatgatgtcgtcgatttccaggccgcagcggcgcacgcatttttcaatgttctgtgcggcgttgacggcgcaggtcaccacgtgaaccttggcctccagacgtacgcccgacatgcccagcggctcacgaacgccttcctggttatcgatcacgtagtcctgcggcaaggtgtgcagcacgcgctggtcagccgggatcgccacggcctgggcggcgtcgagtacgcgctcaaggtcggcggagctgacttcgcggtcgcggatcgccacgatgccgtgggaattcaggctgcggatatggttgccggccacgccgacgaacgccgagtgaatccggcaaccggccatcagctgcgcttcttcgatggcgcgctggatcgattgcacggtggactcgatgttcaccaccacgcccttcttcaggccccgggacggatgcgtgccgataccgacgatttcgatagcaccgtcttcaccgacctcgccgaccagcgccaccactttggaggtgccgatatcgagaccgacgatcatttttccgctttgcacgtttgccatgggtcctgcctcttcttaattcttcgcgacagcgggtttggctgtcgtcggcgcagctggttcacgccagccgacggccaggccgttggcgtaacgcaggtcgacgctcgcaatgttcgtaatctgttctttcaaggtcttgtcatagatggcaataaagcggcgcatcttttccaccaggttgccgcgtcccagcagcaactcgatgcccgggccggaactgcctgccccggtggtcaaaaaccagctgccccgttcacgcagttccaggcgtgcaatggagaaacccagcgggcgcagcatctggctcaaggcctggtactgctgcattacttgctgttgcgcccgctgcggcccgatcaactgcggcaggtgttcgtaattcgccaactcgcgcggggtaaatgcctggccctggttgttcagcagcgcgccatcgccccaacgggccacgggcagctgttcttccaggcggatcgttacctggtccggccagacgcggcggacttcagcgtgggcgatccacggcatttgctccagctccgagcgcataccggccaggtcgatggtaaagaagctcgccgccaggtacgggccgatgcgctgctgtaccgcttgctggctgatgtagctcaagtcgccctgcacactgatcttggtgatcggtcgatcggcatacggcaacaggcgctgcgcaccttcgtaagtaccaaagcccaacgctaccaacagcaccggccagaacagcgctttgagaaaaccaaagttggctttcggcaggcgcgccgacatcggctctttagccaccattcggctggcaccccgaggcaccggcttgcggctgggcactggaggttgctgatgacgaagcgatgcgccgttcatgtgtttagcctcttggctcaatgcttgcggccaggatcgccagcaccaactgctggaaatccaaaccggctgcacgggctgccataggtaccaggctgtgatcggtcataccgggagcggtgttgacttccaggaaccagaaattcccttggtcatcctgcatcacgtctgcccgcgcccaaccggcgatacccagcgcctcacaggctttcgccgtgaggtccatcaattcctgttccttggttgcgtcgaggccgcacgggatccggtactgagtatcggaagccacgtacttggcgtcgtagtcataaaaggtgtggggcgtgcccaatgcgataggtggcaatacctggccacgcagggtggcgatggtgtactcagggccttgaatccactgttccaccaacacttgcgaatcgtaggtacttgccgctttccatgcgtcgatcaattcggcggccgagttcactttggccatgccgatactggagccttcatgggctggtttgacgatcaaaggcaggcccagttccttggctgcagaaatacaatcgtcttcgctgcacagcacgctgtgacgcggggttggaatacccaggctgtgccacacctgcttggtgcgcaacttgtccatcgccagtgccgacgcgaggatgccgctgccggtgtaagggatgccggcgcactcgagcaagccttgcatgctgccgtcttcgccgccacggccgtgcaggatgatgaaggcacggtcgattttttcggcctgcaggcgagcgaggaaatcatcgcccacgtcgataccgaacgcgttcacgccggcactttgcagagcctcaagcacggcattgccggacttgagcgacacttcacgctcggcgctcttgccgccaaacagcacggccacgcggccgaagtcggcaggcgtgatcgtggaaaacagggcgtcgtaattggtggtcatttcgacttcccctgcacggcggcaaacagcgggctcgccagcaacttgggcgctaggccaccgatatcaccggcgccctggcacaacaggatgtcaccggcacgcagcagcggcttgacgatcggcgccaggtcaacaccgcgctcgatgtagatcgggtccaactggccacgctgacggatgctgttgcacagcttgcggctgtcggcgcccgggatcggctcttcaccggccgggtagacttccatcaacagcagcacgttggcatcggccaatacattgacgaaatcgtcgtacagatcacgggtgcggctgtagcggtgcggctggtaaaccatcaccaggcgacgctccggccagccaccgcgcacggctttgatgactgcggcgacttcggtcgggtggtgaccgtaatcgtccaccagcatcacgtcgccgccgtccaccggcaattggccgtagacctggaagcgacggccaacccccgcaaagcgcgacaggccttcaacgatggcttcatcgctgacgccctcgtcggaggcgatgcagatggtcgccagggagttgagcacgttgtggttgcccggcatgttcaccgagacgtccagcggctcgcggtcggggcgcagcacggtgaagaaggtttgcatgccttcctggcgcacattgatcgcgcgcacatcggcgtcttcgctgaagccgtaggtcacggtcggacgcttgaccagcggcaggatttcacgcacgacaggatcgtccaggcacaccacggccaaaccgtagaacggcaggttgtgcaggaattcgacgaaggttttcttcaacttgttgaagtcaccgtcgtaggtcgccatgtggtcttcgtcgatgttggtgaccaccgcaaccagcggttgcaggtgcaggaagctcgcgtcactttcatcggcttcggcgatcaggtagcggctggtgccgagctgggcattggtgcccgctgcattcagacggccaccgatcacgaaggtcgggtccaggccaccggcggcgaacaccgaggcgatcaggctggtggtggtggttttgccgtgcgtaccggcaacggcgatgccgtggcgataacgcatcagctcggcgagcatctcggcacgcggcaccacgggaatacggcgttcaagggcggtggccacttccgggttggaggtgttcacggcactggaaaccaccagcacatcagcctcggcggcgttctcggcgcggtggccgataaagatttgcgcgccaaaggacttcaggcggtcggtgaccggcgactctttcaagtcggagccggacacttggtagcccaggttcagcagtacttcggcaataccgcacatgcccacaccgccgataccgacgaagtggatgcgacggatgcggcgcatttccggttgcggcatggctttctgattctcaaccatgagccacctccaggcagatatcgaccacggtgcgggttgcatcaggtttggccaggcggcttgcggtgctcgccatgctgttgagtcgttccggttgcatcaaaacctcggtcaggcgtgcggccaaatcggcggcgccagtcgttctttgcggcagcaggaaggcagcgccctccccagccaaatattcggcgttgcgggtctggtgatcgtcaatcgcgtggggcaaaggcaccagcaaggacggcagaccggcggcggccagttcactgacggtcagcgcaccagcgcgacagaccaccaggtcggcccagccataggcgtgggccatgtctttaatgaagggctgtacattcgcctcgaccccggcctcgcgatagcgagtggcggtcacttcatcgtggttcttgccggcctggtggaagatctccgggcgcaattccacaggcagttgcgcaagcgcttggggcagcaatttattcagcggctcggcgcccaggcttccgcccagaatcagcagatgcgccttgcgcccggccaatgcctcacgggcaatggccataaacagttcggtgcgcaccgggttgccggtggtgcgcagcttgtccgaggcggcaaaggttttcgggaacgcttcacacacccgtgcggccaacggcaccagcaggcggttggcagtgccggcgacggcgttctgctcgtgcacgatcaccggcacaccagcgagcttggctgccacgccgccagggccggtcacgtaaccgccaaaaccgagcacgcacaccggcttcaattcgcggatgacgttgcgtgcctgccacaccgccttgagcaacacgaacggcgccttgagcagggacagcttgcccttgccacgcaggccggtgacgttgatcaaatgcagctgcaagccggcattcggcaccaattcattttcgatgccgcgcggtgtaccgagccaatgcacggtgtagccgcggttctggaattcccgcgcgcacgccagggccgggaacacgtgccccccggtgccgcccgccatgatcagcacgttagcgcccatggttcggctcctcggcaaaatcgctttcgctgaattccatctcttcgctgcccaggtgggttcgactctcccactcgatgcgcagcaatagccccaggcacgcgcagcaaatcaccaacgaactgccgccataactgaggaacggcaaggtcaggcccttggtcggcagcaggccgacgttcacgccgatgttgatcagaaactggccgatccacaggaacgacaagccgtacgccacatacgcggcgaaatactgtttggctttctcggcccacaagccgatgtacatgccgcgcacacacacgaacacgaacagtgcgacggtgcacagcgaaccgaccacgcccagttcttcggcgagtaccgagaacacgaagtcggtgtgcgcttccggcaggtagaactgcttctgcacgctgttgcccaggcccacgcccagccattcgccgcgaccgaaggcaatcagcgcctgggtcaactggtagccggaaccgaactggtcggaccatgggtcggtaaaggtaatcagacgcgccatccggtagggttgcgcctgcaccagcaccgtcacggcagccacggccagcaccaccatcaaggtgaaacggaacaggccgacgccaccgaggaatagcatggcggcggcggcgcccatcatcaccacggtggcaccgaagtcgggctccatcagcaacaggccagccatcggcagcagcacgatgaagggcttgaagaagcccatccagctttcgcgcacttctttctgacgccgcaccaggtagccggcgaggtagatcaccacgaacaccttggcgatttcagacggctgcacgttgaacgcaccgaagccgatccagcgcatcgaaccgttcacctcgcggccgatgccgggcaggatcaccatgatcagcaagccaaacgcgccgatcagcatcatccagcccaggcgctgccaggtggcaatcgggatcatcatggtgacgatgcaggcgccgagaccaatgaccaaatacaccaggtgacggatcatcatgtacagggtgttgcccgactgcacggcggccacttcggaggatgccgaggtgatcatcaccaggcccaggcccagcagcgcgaggcaaccggcgagcatcgggaagtcgaggtcgatgccacggccagtgatgatcggcgacgggtacggcttgatgatatttctgaaattcatgccaaggcctccacgccgcgggcgaacagctggccgcgctcttcgtagttcttgaacatgtcgaaactggcgcatgccggcgacagcagcaccgcatcacccggctgggccagggcttggcagtgagcgatggcgtcgtccagggacgtggcgcgcacttgcggcaccgcgtcaccgagggcggcggcgatcaaatcggaatcacggcccagcagcaccacggcgcggcaatgggcggccaccggacctttgaggtccttgaagtcggcacctttgccatcgccaccggcgatcagcaccagcttgccttcgatgtcggcacccaggccttcgatggcagccagggcagcaccgacgttggtggccttggaatcgttgtaatagctgacgccgttgagatcgcgcacccactggcagcggtgctcaagaccggcgaaggtgcgcaggctggcgagcatggcatcgaacggcaggccgaccgcatgaccgagcgccaaggctgcgagcgcattggactggttatgcgcgccacggattttcagctcacgcaccggcatcaggttctggaattcgaaggccaggtatttctcgccgttctcttcgcgaatgccgaaggctttgaaatcaggtttgccgaggccaaaggtccagcacggcaggccctcgcccatcagcggacggctcagggcgtcttgacggttgaccacgacttgcctggcaccacggaaaatccggtgcttggccaggtgatacgccggcaggccgctgtagcggtccatgtggtcttcgctgacgttcaacacggtggccacttcggcgccgaggtcgtgggtggtttcaagctggaagctcgacagttccatcacatacagctcgacgtcgtcgctgagcaaatccagcgccggtgtgccgaggttaccgcccacggccacgcgcttgccggccgcaatggccatctcgcccaccagcgtggtcacggtgcttttcgcgttggagccgctgatggccacaatcggcgctttcgcgttgcgcgcgaacaggtcgatatcgccggagagcttcacgccacgtgcggcagcagcttgcaaagccggtgtcgccagggccaggcctgggctcacgtagagctcatcggcacggcacagaaactcgacatccagctcgccacaacgcacttccacgtgcgggtagtcacggcgcagcgtgaccagctccggtggattttcccgcgtatcggccacagcaaacgacgtgccccggttcgccaggaagcgaaccagggacatgccgctcttgccgaggccgacaacgatgcggaagtggtctgaagcgatcagggacactcgtttctacctcagtttcagggtggcaaggccgaccagtaccagaatcacggtgatgatccagaaacggacgatcacgcgtggctcgggccagcccttgagttcaaagtggtggtgaatcggcgccatgcggaatacgcggcgcccggtcaatttgaaggaagccacctggatgaccaccgacagggtttccatcacgaacacaccgcccatgatgaacaaaacgatttcctggcgaacgatcaccgcgatggtgcccagggctgcgcccagcgccagtgcgccgacgtcgcccatgaagacttgtgccgggtaagtgttgaaccacaggaaccccaggccggcaccgatcagcgcgccgcagaacacaatcagttcacctgcgcccggcacatacgggatcagcaggtattcagcgaatttcacgttacccgacaggtagcagaagatgccgagcgcgccgccgaccatcaccgtcggcatgatcgccaggccgtcgaggccgtcggtcaggttcaccgcgttgctggagccgacgatcacgaagtaggtcagcaccacgaagccgatgcccagtggaatgctggcgtccttgagcatcggaatgatcaaggtagtttcaaccgcgcttggcgcagtggtgtacaggaaaatcgcggcggcaaggccgaagaccgactgccagaaatacttccagcggctcggcagccccttggagtttttctcgatcactttgcggtagtcatcgacccagccgatggcgccgaacaacagggtcaccagcagcaccacccacacgtagcggttatgcaggtcggcccacaacaaggtgctgacgccaatcgacgacaggatcagcgcgccgcccatggtcggggtgccggatttggacaggtgcgactgcgggccgtcattacgaaccgattgaccaatttgcaggttctgcagggtgcggatcatccacggccccaggaacagcgacagagacagcgcggtcagcacacccagaatcccgcgcagggtcaggtactgaaagaccgcgaagcctttgtggaactgttgcagatactcagccagcagcagcagcattaatgtttctccgtacttgagccacacaaggccgcgacgacgttttccatcaccgcgctgcgcgatcccttgatcaaaatggttgtgtgtttgtcgtgttctgccgccaccagggcctggataagctcggcctgggtagcgaaatgccgcgcgccgaggccgaaggcgtcgacggcgtgagccatgttcgggccgacggcgtagaacgcgtcgactttgccggtggcatacgcgccgacttcgcgatgggactgttcggcccagtcgcccagctcggcgatatcgcccagtaccagcaccttgcggccgtcgaagcttttcagcaggtcgatggcggcgcagatcgaggactggttggcgttgtaggtgtcatcaatcacgcgcatgccattggttgccagttgcgcaaccgtgcggcccttgaccggctgcaccgcgcccaacccggtggcgataccaaacagcgacacgcccagggcatacgcggcagccgcagcggccaaggcgttggcgacgttgtggttgcccagcagattcagttgtacgtgctcactgccttgcggggtgtgcaaggtgaaggacgggcagccacgcgcgtcgacgcggatatcggaagcatggaaatcggcggctgcattcaacacggcaaacgtcagcactttgcgaccggcggcgcgtacacgccaggtctcgaaggccttgtcgtcgaggttcaatactgcagtgcccgtggcgtcgagaccttcaaggatttcacccttggcttcgacgattttctcggggccgccgaactcgccaacgtgggcggtgccggcattgttgatgattgccacgtggggcttggtcagcgccacggtgtaggcgatttcgccgacgcgcgaagcacccagttcgatcaccgccgccgtgtgttccggggccagttcgagcagggtcagcggtgcaccgaaatcattgttcaggttgccacgggtggcgagcaccggcccgcgcgtgcgcaggacaccggcgagcaattccttgaccgtggttttgccgctggagccggtgatggctgcaaccggcttgtcaaacgcggcgcggttcagcgcacccaactggccgagagccagacgggtgtcggcaaccaacagttgcggcaaggcggaatccgccacttcgcgctgcaccaaggcacccacggcacctttggcggcgacgtcattcaggtagtcgtggccatcgaagcgcgggccggccagtgcaataaacaattgcccaggctggatgttgcggctgtcgatactgacgccgtcgaagctgcaatcactcgacactacgcgtgccgacaaggcctgggtcagttcgctgaatttcatcgctttaagcatgcgcgacctcccaggcggtcagggcgtgatcggcctcgaccagatcggagaaggcatggcgttcgccgttgatttcctggtagtcctcgtgacctttgccggccagcaccaccacgtcgtcagcactggcactggcgatcagttgggcaatggcggcgccacgaccggcgacgaaggtcgccttggacgcgtctttgaaaccgacacggatgtcatcgaaaatctggctcgggtcttcgctgcgcgggttgtcgtcggtgacgagtacgccatcggccaggcgctcgacgatctcggccatcaacgggcgcttgccgcgatcacgatcgccgccgcagccgaacaggcagagcaatttgcccttggcgtgtgggcgcaaggcttcgaggactttttccagggcgtccggggtgtgggcgtaatcgaccaccaccagcggctgcgagccgccgcccaaacgctgcatgcgaccggccgggccttcgagtttgggcagtacacgcaggatttcatccagggcgtaatccaggccgagtaatgcaccgatggctgccagcacgttgctcaggttgaaacgccccagcaaggtgctgcgcaagtggtgctcgccctgcggcgtgaccagcgtggcgagcacgccttcgtcattaaagtgggcgtcgcggcaatacaggtacgcgctggagtcttccaggctgtagctgatcaggcgcgcttcgctgtcttcggcagccaactggcgaccgaacgcgtcatcgaggtttaccacccggcacttcaagtcattccaggcgaacagcttggccttggcggcagcgtatgcctccatggtgccgtggtaatcgaggtgatcgcgcgacaggttggtcatcaccgccacgtcaaaggccagcgccgtcacgcggccttggtccaggccgtgggaggacacttccatggcaaccgccttggcaccggcctttttcaggtcggccagggtcgcttgcacggcaatcgggtttggtgtggtgtgcaggccgctttgcagcgcgccataaaaaccggtgcccagggtgccgacaatgccgcagtgttggccgagcaggtcaagcgcctgcgccacaagctgggttacgctggtcttgccgttggtgccggttacgccgaccaggttgagctgacggctcgggtcaccataaaaacgcccggcgatatccgacagttgcgcagccaggcctttgaccggaatcaacggcacgtcggtgatcggcagcacggtggcgccttcgacttcatacgccacggccgcagcaccgcgctgcagggcatcggcgatatgcgcgcgaccatcgaacttgccgccaggcacggccaggaacaggtcaccggcgcgtacatttcggctgtccaggctcaactcgcgaatcagcagatcgcgtccggcgtgggcaaaaatcttgttcaagctaagagacatcagccgcgccctccattggctttggcagcagcggccggcgggccggcgttcgcttgttgggtgggcggcaggttgtccggcgtgatgttcatcaggcgcagggtgccggacatcactttgctgaacaccggcgccgacacgaggccaccgaaatagccggccttgctcggctcatcaatcaccacaacgatggcgtagcgtgggtcgctcatcgggccgaagccggcgaacagcgagcgatacgagttctcggcgtaacccttggtgcccaccgacgttttacgtgcagtacccgacttgccggccacgtgatacgccggcacctgggcgcggaatacaccgcgtggcgcttcgatcacttgttgcagcatgccttgcatggtcttggcgacgttttccggaatgacctgggtggctttcggcgcttcgtcgacgtggatcaggctcagtggaaccatccggccattattggccaatacagagaaagcatgggccaactggatcgcggtcaccgacaggccgtagccgtaggaaagcgtggcagtctcggcttttttccagtcgcggtagttcggcaggttacccacgcgctcgcccgggaaatccagaccggtgggttggcccaagccgattttttgcgccaggtggtagatggtttcgccgccgatatcgaaggcgactttactcatgcccacgttactggagttgatcaggatgcctgtcaaatccagcactgggccttcggtgcgggacacgtctcgaatggtgtatttgcccaactgcagggtgcctgggtaaacctcgactttgtcgctgggtttccagcgcccggtttccagggcggcactcatggagatggctttcatggtcgaacccggctcgaacacgtcgatcatcgcgcggttacgcatcatcgccggttgcaggttgcgacggttgttcgggttgtaggtcggctggttgaccatggcgaggatctcgccggtcttcacgtccatgatcaccaggctgccggccttggcgccgttctcgatgattgcgttacgcagctcgcggttggccaggtattgcagacgcaggtcaatcgacaacgccaagggcttaccggccttggcgtttttggtgacctggacgtctttgatcagtctgccgcgccgatccttgatgacctgccgtttgccggggaccccggccagccattcatcgtaggcgagttccacgccttcgcggccgtggtcatcgatgtcggtaaagcccaccatgtgcgcggtggtttcaccggccgggtagaaacgacgaaattcctcgatgccgtagacaccggggactttaaggtcgagcacttgctggccctgctcaggggtaagcccgcgaaccaggtagataaattctttgttggcctgggcttccaggcgctcggacaaggctttcgggtcttggcccagggccgcggccaattctggccacttgtccttggcaacctgcaattccttggcgttggcccacaaggtggtcaccggtgtactgacggccaggggctcgccgttacggtcggtaatcaggccgcggtgcgcaggaatcggaatgtgacgcaggctacgggcatcgccctggccgatcaggaagtcacggtcgaccacttgcaggtcgatgatgcgccaggcaatcgcgcccaccatcaatgccagcaagccgagcatcagacggaagcgccatgggtagagtgcgccttcgagtttcatcatggcgccaccatgcgaacttcggccgcgcccggaatgtgcattttcagttgctcggtcgccagcacttcgatgcggctatgggcggtccaggtgctttgctcgaggatcaaccggccccactccgcctgcgctttatcacgcacactcaattccccgtatagggtattgagcagttggcggttgtagtgggcgctgtaggacaccgcaatcgcggaaatcaacacgccgacaaacagcagcaacataaagaagctgccgcccgggaggggcttggcgaaaagcttgctcaccgcagcttctccgcaacgcgcatgacggcgctacgggaacgtgggttggctttgagttcggcttcggaagcgaactgcgctttgccatggattttgattttcggcacaaaggcttcgaaacgtaccggcaggttgcgcggcaggttatcggactcgccctttaccagacgacgcatgaacagtttgacgatgcggtcttccagggagtggaagctgatcaccaccaggcgaccacccacttccaaggcttccagcgcggcttcgaggccggcttccagatcgcccaattcgttgttgacgtgaatacgcaggccctggaacgcgcgggtcgccgggttcttgcccttttcccaggcagggttggcgactttcagcacttcggccaggtcggcagtgcgctcgaacggctggatttcgcgacgctcgaccacggcgcgggccatgcgaccggcgaagcgttcttcaccgtattccttgaacacgcgggcgatttcttcaaccggcgcggtggcaatgaactgggccgcactgacgccacgggtcgggtccatgcgcatgtcgagcgggccgtcgttcatgaagctgaagccgcgctccgggtcgtcaagctgcggcgaagacacgcccagatcgagcaaaaccccggccaccttgcctgccatgccacgctcggcgacttcggcaccgagctcggcaaagctgcgctgcacaacgacaaagcggccgtcttcggccgctagcgcttgcccggtggcaatcgcttgagggtctttgtcgaacccgaggagtttgccgtcggacccgagctggctgagtatcagccgactgtgcccgcccctgccgaaggtgccatccaaatagcagccatccgcgcgtacggcgagagcctcaacggcttcgtcaagcagtacggtgatgtggttaaagccgctatcaatagtcacaggatcaaatcacgcagttcatcaggcatggcgcccggttgttgaatagcagccaggtctgctgcagaaacagcatcccaagcatcttcgtcccacaattggaacttgttcagttggccgaccagcattgcgcgcttgtccagcttggcgtactcgcgcaaacgtggaggcaccaggaaacgaccgctgccatcgagttcgaggtcgacggcgttaccaatcagcaaacgctgcaggcggcggttttcttcacgcaatgaaggcagagcgcgcaacttggtttcaatcaactcccactcgtcgagcgggtaaacacataaacaagggtcaacggcgtcaatcgtgatgattaactgcccggagcttcgcgaaatgagctcgtcacgataccggctcggcatggcgagacggccttttgcatcgagactgatagcgttagctccgcgaaacacagatgcgtttctccaaattttagcgttttacgttcaaaaaacccactttgtgccactttccgccacttgcgcacactataggaatgcgcccaccacaccgtcaaggcgcggattcaaggaaaagccttacagaacggagatttaggagcgcaaaaggaggagaaaggcgagttcgacgaggtttttgactcaacaatcgcaaatagctcatagagctatagctcaaagttaaagtaatttattaagagtaagatttttttggtattacgaagacgcatctgccaatgattcggcagggagggattcttgcgttactaccggttttctgcccgagattcaggcagaaggaaaaaaggtggagagtcgatctgtaagccgggttctgtcttgaacagtcattcgtctacgatggccatcactggacatctttagcaacctacccggtcccagcgcgggccacgccttgggaccctatttggtcttgctccaagtggggtttacctagccacgaactgttgccagtcgtgcggtgcgctcttaccgcaccttttcacccttaccggcaccgaagtgcttaggcggttattttctgtggcactttccgtaggctcacgcctcccaggcattacctggcacttcgccctatggagcccggactttcctcccccccctaattttcatagagggcagcgactgtccaatcgactctccgccgcgcaggttaacggcacggcggcctcaggacaagtattaaaagtacagcaatgccatcacgttcagacggaatacaggtttaaccccggaactattcggctttctgtttatccagcgcaacttgatacagaacattcttacgcacgccggtaatttcagccgccagtgccgcggcgcgcttgaggggcatttccttgagcagcaaatccagaatgcgcatggcctcgctgcccaccgcattttcttcctccggcgccgtccaacccgccaccagcaccacgcactcaccgcgctgttggttgctatcgccttctacaaacgcgcgcagctcctccaacggcaagcccttgagggtttcgaacgtcttggtcaactcgcgcgccagcaacgcgaggcgttcgccgccgaacaccagctccatatcctgcaggcattccagaatgcggtgcggggcttcatagaagatcaacgtgcgcggttcttcctttagtgcctgcagacgcgcacggcgcccaaccgtcttggccggcaggaagccctcgaagataaaacgatccgacggcaacccggcggcagataatgctgcaatcagcgcgcacgcccccggaacaggcactacattgataccagcggcacgcgcctgacgaaccaggtggtagccaggatcggaaatcagcggcgtaccggcatcggagatcagcgccacatcgtcaccggccagcaggcgcgtgataaaacggctgccttcttcgcgctcgttatgctcgtggcacgcggcgagtggcgtgctgataccaaaatgctgcatcaaccgctgggagtgtcgcgtgtcttccgccgcgatcagttttacctcgcgcaacactttcagggctcgcgcactgatgtcgtccaggttgccaatgggcgtcgccacgacaaaaagcgagcctgcagtggaattcaaaggacctggagcagtcaaaacgcacacctcgatggtagggaaaagtcgcattgtagcgcgtaggcgcctcgataatatgcccgcaagttcggccgtcgatgctcgtttgcaacaattgcacgacctaaatcaacggtttcacgccagtaacatcgcgcctgggccagtgcttgggtacaattccacgctaatttgatcggtatcaggaacacttacatgatcgcttgcctgcggctgctctccgccctctgcctcgctgccttgctggccgcttgtgccagctcgccctcgtccagccttggcgacctcccccggaccccggatgccagtatcgagcaactgctcgaacaggcgacttccgccagtacgccagaaaaggccgcgatgctgcgcctgagtgcggctgacctggcctatcgccagaacaaccctggtcgttcggcgcagattcttgcgcaggtgcccctggatgtcctgaagccggctgcgcaagtatttgccagcaccctgtcggccgagctggccatggcacgcaatcagccaaaagctgcgttggcggccctgaaccacccgagcctgcaaagcctgaaggacctgccgaccgaacagcaggtgcgcaccggcaccgtgcatgcccgcgcttatgaagctgatggccagaccctggccgccgcgcgcgagcgagtcgccatggccccgctgctgacgggcgatgctgccgccagcaaccacgaagccatctgggcgcttattgccgcactgccggccgaacagctgcaagccagcggcaacccgacactcgacggctggatcagcctggccaaggcggtcaaaggcgccggcaccctggagcaacaacaagccgccatcgatacctggcgcgcacagaatccaggccacccagcggcagtcaacctgccaaccccgctgaccaaactcaaggaactggccagccagcccctgaacaagatcgccctgctgttgccgcaggaaggtccgttggcgggagtcggcaaggcactgcgcgaaggcttcatggccgctcactaccaggctgaacaagccgggcagaagccgccggtcatcgagttttatgacagctcgcgcctgtcctccctcgacgacttctacgccaaggcccaggccgccggcgtacaactggtggtcggcccgctggaaaaaccgctggtcaaacaactcgcgtctcgcgcgcaactgccgatcaccacgctggcgctgaactacagcgaactgaatgaaaacccgccgcagttgttccagtttggcctggccgctgaagacgaagcccgcgaagtctcgcgccgcgcccgtgccgacggcctgcaccgcgccgccgcgatggtgccgcgcggcgaatggggcgagcgtgtctacaaagccttccgtcaggattgggaagccaacggcggcaccgtcgtcggcgtcgagtacgttgaccagccggtcgccctcgcccagcaaattgccgacctgttccaactgcgcaagagcgaaggccgtgccaagagcctgcaaaacacagtgggcaccgacgtcgcggcacaaccgtcgcgccgccaggacatcgagttcatcttcctggctgtgacgccgcaattggcccagcagatcaagccgacgctgaacttccagtacgccggcgatgtgcctgtgtatgcaacgtcccacgtgttcagcgccagcggcgacaagaaccagtacctggacatgaccaacgtcatgttctgtgaaacgccttggctgctcaacaccaccgacccgctgcgcaaccaggttgccgcgcaatggccacaggccaatggcagcctcggccgcctgtacgcgatgggcgccgacgcctaccgcctggcaccgcgcctgggtcaactgaaggcgctgccggacacacgcgtagacggtctctccggcagcctgggcatcgggggcttccaacgtgttgaccgccagatgccatgggcgaagttcgtcggcggcgacatccagcgcctgccggacaccccgcgctgatgcccgagcggtccagcgcacaaagcggcaaggatgccgaacttcaagcgctcaactatctgcaacaacagggtctgcgccttctggcgcagaactggttgtgtaaacgcggtgagcttgatctggtcatgcttgacggcgatacagtagtattcgtcgaagtccgctacagaaaacacgcacaatggggtggcgcgctcgccagtatcgacgggcgcaagcgtcagaagctgatactcgccgcgcagtttttcctgcaaaaagagcatcgctgggctgattccccctgccgtttcgatgtggttgccatagaaagcacaccgtctggcctcgctgatctgaactggctgaaagatgccttcgacagctgattcaacggacaccttcaccacacacttttgctctttgctttgcgggctgcacattcctgtgccaaacagccgcgctacttaaggtcacacagatggacatgcaatcccgaattcgccagcttttccaggccagtatcgacaccaagcaacaggcgatggacgtacttgcaccgcacatcgagcaagccagtcaggtcatggtcaatgccttgctcaacgagggcaaaatgctttcgtgcggcaacggcggttcggccggtgatgcccagcacttctcctccgagctgctcaaccgctttgagcgcgagcgcccgagcctgccggccatcgccctgaccaccgacacgtcgacgatcacctcgatcgccaatgactacagctacaacgagatcttctccaagcagatccgcgccctgggccaaccgggggatgtgttgctggcgatttcgaccagcggcaactcggcgaatattattcaagcgatccaggccgcacatgatcgcgaaatgattgtcgtagcattgaccggacgcgatggcggcggcatggcctcgctgctgttgccggaggacgtcgagattcgcgtcccggccaatgtcaccgcacgcattcaagaagtccacctgctggcgatccactgcctgtgcgatctgatcgacagccaactgttcgggagtgaagaatgaccgttaaccgcctcagccttttggccattacgctgtgcctcgccatcagcggctgcagcacggcaatcactgcgacacgtgacacaccgattcaggatgaccggggaacacgtacctttggcagcaccattgatgactcgctgatcgaaaccaaggtcaaggtcaacgttgccaaggccgcaacagacctgggtaacggcgcgtcgcgcattgtggtgaccagcttcaacggtgtagtactgcttgcagggcaaacaccgcgtgcagacctcaaggcccaggccgaacaagccgcctcgagcgtgcaacgggtgaagaaggttcacaacgaactgcaagtcatggacccgatcacgctgctggctatcagcaacgatgccttgctgaccaccaagatcaaggcgcagatgctcacagatagcgccgttccaggctcgcggatcaaggtcgtcaccgacaacggcatcgtttatctgatgggcctgctgacccaggcggaagccacccgtgcgtccaacctggtacaaggcgtgtccggcgtgcagaagatcgtaaaagtcttcgaatacatcgactgatgtaaacgcgggccacaaaaaagggcgccgtgcattgactgcacggcgccctttttattggccagggtttattggtactgctggtacgggttgccctggaactggttgttctgctgcggcgcttgttgttgctgctggcctggctgaccgtattgctggccagggatcgggccgaggttgacctctacgcgacggttctgggcgcgaccattcacgtcggcgttgctggcaatcgggttatccgggccggcaccgcgtgcgctcaggttggtcgggctgacaccctgggacgtcaggtagttggccacgctttgcgcacggcgctgggacaggtccatgttcaactggcggctgccggtgctgtcggtgtagccaacgatctgaatggtgttctggttgaactgcttcagcgagcccgccaggttgttcagcggtgtgtagaagctgctggagatcgcgtccgagttggtggcgaaggtgatgttacccggcatgatcagcttgatctgatcgccctggcgctgcacttcaacacccgtgttggccatgctggcccgcagtttcttttcctgctggtcggcatagtaaccataacccgcaccaccaagacctgcgacggcggcaccaatcagggcgcctttaccacggttattatggtcgattgcggcaccggccaaaccaccggccagtgcagccaggccaccgtacttggcggtcttgctgataccaccttgcgaaccatcatttgcctgcccctggctgccgtcataaggattaggtgaggcgcaaccggacaacaaggctacggcggtggcaacaacaagaagacgacgcggagtaaacatgaagggagctcctacttttgcattctgtggtgcaaaggacattggcaatggacctgtgccgggttttgaacgcgacaaacggtaaaaattccgtggccggccagcccgcgctctacaaaggttgagcacactaaaaccctagcagagacttcctgaacggaaattgtcattttctccataagcctcgtcggacggttgccatttggtatctaggccctgacaaacggattctcacgcatctcgtcccccaaccgcgtatccggcccgtgcccagtcaccaccgtcgcgccttcatccagcgtatacaaacgttgcttgatcgaacgcacaatggtcgcctgatcgccgccccacaggtcggtgcgccccacgccgcgcttgaacaaggtgtcaccggcaatcaacagcttggcgtcggcaaaccagaagctcatcgagcccggcgtatgccctggcgtgtgcaaggccaccccgcagccacacgccagctcttcgtcatcttccaaccaccgatccggcgacggcactggcgtataaggcacacggaacatctggcattgcatctccaggttgtcccacagaaattggtcttccttgtgcaagtgcaaggtggcgcccgtcttctccttcaactggccggacgccaggaaatgatccaggtgggcgtgggtatgaatgatgctcaccaccttcaaacccagcgcatcgaggcgcgccaggatcagctcgtgattgccgcccgggtcgaccacaatggcttttttggtgatcgggtcgccaatgatcgtgcagttgcactgcaacgggccgacggggaaggtttcgcggatcagcgcggttttttggttattcatgggtgttcctgcaagctctatggcacattccacgcgcagtatggttgaccttgcccctgatccggaagggagcagcccgcaacacatctactgctaagctgtccaagcgccattgaatcagcagcactgtccaagaccgcagcgcgtcgcgttgggagcaacacttatggcgaatcaacgggtcatctgcgaacactgcgactgcgtgtatgaaaaagtcacgctcgccaaacatcaaaaagccctgtgcatacgctgcgcaggcgtcttgcagcgttacaacggcctgtcggtgcaacaacgcctcgcgttgagcgttaccgccgccgtcctgtggacgtttgccaacttctacccggtgatgagcatcagcctgcagggtttgaacaacagcgcgaccctgtgggattcggtggttgcgctgagcctggggccgatcaccttcattgcgttggtggccgcgatttccatcatcatcgcgccggtattccaactggtgctgctgatctgggtcttgagtttcgccctgtccggccggcgctcacccgcgttcaagctgtgcatgcgctggctggaagccctcaggccgtggagcatgttggaggtctgcctgctcggcgcgatggtggcggtgttcaagctggccggcatgctcgacgtggtgcccggcaccggcctgtttgcgctggcggcgctgagcctgttgctgatccgcatcgccgggcgtgatgtgcgcgatttgtgggacgttctatgaattcgccaccgaccgcccgtgaactcaacctgtgcctgtgccacacctgcggccagccctgcgacatgcgcaacgcgcccaccgagtgcgaccgttgcggcgcagccctgcaccggcgcaaggtgcactcgctgacccgcacctgggcctacatgctcacagcgctggcgttttattttccggcgaacctgttgccggtgatgaatacgacgatgctcggctcgggcgccgacagcacgatcatgagtggcgtgctggagttctggcagcacggcgcctgggacatcgccttgatcattttcatcgccagcattgcggtgcccggcatcaaattcgtgtcgctgacactgctgctggtcaccgtgcagcgcaacagccgctgggcgcgcaaggagcgctcgaagctgtttcggtttgtcgagctgatcggctactggtcaatgctcgatgtgatcgtggtggcgctggtggccgcgctggtgcagttccaggcgttgggcacgatcgagccgcgcctgggtattttattttttggcttggtggtggtgtttacgatgcttgcggccatgagtttcgacccgcgcctgatctgggaaaccccacacaacgaggagcgcttggatgacgccacacaacgctgacaaccctgcaggcacatcggcaggcacacccgcgatcaagacgcggcgcttcagcgtttcgctggtgtggatcgtgccgattgtcgcggtgctggtgggcatttcgctggtggttcacaacgtcctgcaacagggcccgaccatcatccttaatttcaagaccggcagcggcctggtcgccaacaaaaccgaagtcaaataccgcaacgtggtgatcggccaagtctccgacgtggccttgagtgatgaccagaaaagcgtcaacgccaccatcaagctggccaaacaggcggagagcttcacccgcgaagactctaaattctgggtggtgcgcccacgcatcggcgccggtggcgtgtccggcatcgacaccttgctgtccggcgactacatcggtgccgacatcggccagtccgacacccgtgccaaacagttcaaaggcctggaaaacccaccgccgatcacctacggcgagccgggcaagcacttcaccctgcatacccaaggcctggggtcgctggatatcggctcgccggtgtattaccgcaagatcccggtgggccaggtggtggcctatgagctggatgccgaaggcaaaggggtgaacatcgaggtgttcgtgcatgcgcccaatgatgtgtatgtcaccgaaaacacgcggttctggaatgccagtggcattgacctgagcgtcggcgccaatggtttcgcgctgaaaaccgaatccttgtcgtcaatgctggccggcggcatcgcgttccaggcgccgccctacagccccaacgacaaactggctgacgaagaccatgcctatgagctgttcgacgaccagcaaagcgccctcgccccgcccaccggcaaagggcaatacatggccttgcgctttgatcaggcactgcgtggcctcaaagtcggcgcgccggttgagtttctcggcgttgaattcggcaaagtggtgtcgatcaacctggattacgacgccaagaaacgcagctttccgatcaacgtcggcatcgtgatctatccacaattgctcggggaagccaataccaagctgctcaaggccaccaaccacgaccccaacgatgaggccggcggcgtacgcttgatcggcacgttcatcgaaaacggcctgcgcgcccaggctcgcagcggcagcctgctcaccggccagttgtacattgctctggatttcttcccgaaagccgagaaagtcgcgtttgacccgaacctgcgcccgatcaacatcccgaccattcccggcaacctggaacaactgcaggtaaaactcgaaggcatcgtcaacaagatcaaccagctaccgatcgagcgcattgccggcaacctcgacggcagcctggtcgaactgcgcaaggggctcaaccagttcaacgccaaaaccctgcccggcgtgcagaacacactcggcgacgtgagcaagaccctgcaatcggccaattcaaccctggccgaagattcgccgcaacgcgagcaactgacccagaccctggacgaattggggcggatgtcgcgctccttgcgcgagctgtcggattacctcggccggcacccggaatcgttgattcgcggccgccccgacaacgccgcgccgacagacctgcaagggccaccccgcaaatgagcattggagcagccatgacgtttccgttgaagatcaccctggtcggcgcgctgctgttacttgcagcctgccgcagcgagccgattgcattccacaccctgaccccggtgaactggaataacagcactcaaactcaggccagcgatatccgcattgaaagtatcagcgtgccgccccaggtcgaccgcgcacagatcgtgattcgccaaggtgagagtggcgtggcgattcttgaaacccagtggtgggccgcaaccttggccgacgagctcaaaagtgcgctggtggatcaactggccaacagtcattcccggcagcccgtatcgttgcgcgttgaagtgcagcgattcgactcggtgccgggccaatacgcactgctcgacgtgcgctggcgcctgcggccaacccgtggcggtgatgctcaacccctgacctgccgcaccaccttgcagtcaccggcgggcccgagcattgacgacctggtggtggcgcatcagaacaacctcaagcgcttcgccgccctggtcagcaaaaccgccgacacctcgctgaaaacgtgcccgactgcgccgcagtaaacctgtgggagctggcttgctcgcgaaggcggcgtgccagccagctcatgtgtcactgaccctccgcattcgcgagcaagcccgctcccacaattttaccgagttcggcgttcagacttctgtgctctgcttttctgtgggagcggcccattgtcaggccagcaggcccatcgacttggcgcgcgccaccgcctgggtgcgccgctccacgcccagcttgctgttgatgtggctggcgtgggttttcaccgtgtgcagcgaaatgaacagctggttgctgatctcctggtttgagcaaccctgggcgatcagttgcagcaccgccagctcgcgggtgctgagggtttcgtgggtgggcgaggtctcaatggcggccaccaccggcagcagcgccagcaggctctggttgagcaagccgtgcgggtctttgccgagttgctcacgcatccagtccgggtggctttccagcaagcgctggaacggttgcagcgcgccacccgctccggcctcaagtgcctgggccagaatcggccgcgccttggcttcctggccacaggccaacaataaatgcgcctgctgagtcagggccatcaaggcaatcatctggcgaccgctgttatgcgcctgctgcgccagctcatcaaggcgttgcaacgcggcggcgggctgatggcggatggcgtcaagggcggcctgttgcagcccgatgtgttgcgccaggtgcggatgaaactccggcgcagcggcagcgtgctcgccgttgtaggtttgccccaaccgagccagccacgcgtcggcgaggtcggtacggccttgggccagccacaattcgcatttgatcagggtgatcattgccaggtagtagatcggcggcacatcccagatgtgcatcaagcgctcggcctcggcgagttcagcgaaggctttggcaaaatcgccgcgtcgcccttcgaaattggcgatcacgcaatgcccgatcagcacgctgatatcccggcaggcacgcgcttcgctcaagccggcacgcaggcgcgccagtccggcctcgggctgataacgcaccagcagcaaataaccttcgtacagcgacaagcgcgcgcgcacagcatacagccgctggggcgccaggccgtgcagacgttgcaggccttggcgcacttcgtcgagggagcgcaaaatttcgccacgcgcctgtaagacacgtgctcggtcgtagtgggccagcgcttcaaacagcgggttgccgacacgctgcgccaactccagggattcgcgattcaggcctcgggcacgccacaggtcggcgtccacaatggccaggttggacagggtcgacaggcacatcaaccgctggccgtagcgtttgtgcggcaggctttccagggcttcgctgcaataacgctgggtcaactcgcggtcgccgcgcccacgggcgatgatcccgctcagcgccagccactgcgccaacatcgatttttgcgcagtggccgacggcgccggcaggaagcggctgaggtagctggacaactcttcggctgcatccagctggcacgccaagcccaaggcccagctgtacagcacgatcaaacgcggcgtgctgatcagcaggctgtcgggcaaatccatcttccagcgcaacagcatgccgatgttctgctcggccagcagttgttcctccgacaggttctgcaccaggttcgccgccacatcgaggtgaccggcgcgcaacgcctgctccaccgcttcgtcgatcaagccctgggcgttgaaccagcgacaggcccgcaggtgcaggctggctatcggcaacgttgcgttactggcgcggcgggtgcgcagcaggtcggaaaacagatggtgataacgataccaatggccctgttcgtccagcggcaccagaaacacttgatgggcctgcaaatagcgcaggatctcggcgctgtcatgggcttctcgcacggcgtcgcacagttcgctgcaaaagcgatcctggggcgcggtgtcgtacaggaacgcttgcacttcagccggcaggcagtcgatgacttcttcgagcaaataatcgcgaatcagcccttcaccgccgtgcaagctctgcggcagcgcgctttcattgccggcttcggacaaggccagcagccagaaacgcaggcccgccacccagccctcgctgcgtcgaatcaggttgtccagcgcctcaccgcgcaacgaactgctgtgccgatcgagcacggccagcgattcgtcgtgggtcaggcgcaggtcttgttcgtgcagttcgagcaggtgccgtgaaagccgcaaccgcgccaggtgccagtcggggcgctggcggctggtgaccatcaccaccagcccgtccggcaaatgattgaggaaaaattgcaggcagcgatccagcaccgggccctgggccagatggtagtcatccagcaccagcaataacggcgcgcggttggacaggtgcagcgacagctcatcgagcaggccgtcgagccattcttcaaaggcaaagggttggtgacgctggcgcattttcagcaggcccagggattgggcgccgatctgcgggaagtattgttgcaaaccgtcgagcaggcgttcgaggaatcggccggggtcattgtcccgtgggctcagccccagccacaggctttgccaatgggccggcaaactctggcaaaactccaccgccaacgaactcttgccgaacccggcaggcgcgctgaccagcaacagtcgcccggcaagaccggcactcagccgttcgcacaggcgcgggcgcagcacatagccgtcaggcaaaggcggcctgtaaaagcgtgcttccagggttggaatcaccgcgcttgcaggcccttggattcgggacagatcagtcatcgccgggctcttgtagaaggctgttgtcggcattgcagatgtccgcagactagcggtaaaagcggcaggtttgtagatctttgcaacatttgcctgaaaaagaactgcgacaaaaaatctcatcacaaacaaaaaaatgggagccgccctgtgtgggagctggcttgccggcgatgcaggcgccaaggtgtgtcagttacaccgaggtgatgctatcgctggcaagccagctcccacaggggccgctcccatttttggtgacggttgctacggcttagcgaaccccatcctggcgcaacgccgccggggtgaagtcgctggtggtggcggtgaagccgaagtcatacgcctgcttctcttcgttcttcatgcccagagccagataacggccggactgcaggtcgtagagggtttcgagggcgtaccacggcacttgcttgtcgtagtagttctcggcatgggcttcggcaacgcgccacagttggccacggccgtcgtagtggtcgatgactgcggcttgccaggtgtcttcgtcgatgaagaagtcacgtttggcgtagatgtggcgctggccttccttgagggtggcgaccacgtgccagacgcggcgcagctcgtagcgggcgaggtcctggttgatgtggccggccttgatgatgtcggtgtacttgagcttcggatcgtcgaccttgtagctgttggaggcgatgtagatttcttttttgccttccagcttccagtcgtagcggtccggcgcaccgttgtacatgtcgaggttgtcggaggtgcgcaggccgtcggccgctgtacccggcccgtcataggacacttgcggcgcccggcgcacgcggcgctgaccggcgttgtagacccacgccgaacgcggctctttcacctggtcgagggtttcgtgcaccagcagcacaccaccggccagacgcgccggcgcggtcacttgctgcttgaagtagaacagcacgttgcctgggtttttcgggtcgtagtccttcattttgtcgcggaacacgaactggtcgcggaagtacaccaggctgaacgagccgttggtttgcggggtcgcctgggtcaccagacgcgtcacgctgccgccgcgatagcgggtgatgtggttccagatgacttccacgccgcttttcgggatagggaacggaatcgcggtttcgaagttttccaggccgttgccgccggacaccaggttggtgttggtggcgttcttcttgatggcggcgaacacatcagccggcaccgtggcgccgcgatgggtcgggtagaccggcatcttgaaggtgtccgggtagcgcttgaacatcgcgtactgcccaggcgccagtttgtctttgtactgctcgacgttctgcgcggtgatggtgaactgcggttgttcgctggcgtacgggttggccaggaaacctcgggcgtccacggcgccggcattggtcggcaacggcgaccatttggggatggtgccagcggcgttaccggccatttcagcgcccatcggggtcagggtcgtccccagcttggcggcttcatccgccgagaccgccgccatgacgttgctcgccaggatcgacagcccaagcacacccacgtgcaacagacttttagttattttcatgctctggttcttcctgaaaacaaactgcttaaagagagtgtgcttagaagttcacgccggcgctcagcgcgatgaagtcgcggtcatccaccgtggtgaacttgccaccaaagaagttggtgtagttcaggctgacggtgtaggtgttctggtactcggcatcgacacccagactgacggccttgcgaccctcttcaaagttgccgccagggcctggcgaataacctttgacgtcatgtgaccaggccacgttgggcttgaggttcacaccggcaaacacgtccgggtactcccagatagcccgggcgcggtagccccaggacgtggcggtggtgtagccgtcgttgttgcagttggtgttcaggccggacgcattgggcaggccggcaccttgagcggtcgaattgttcagcgcgttacagaagccgccaggcagactgccagggccgaagaccggatcacgcccataacgtgcctcgtttttgctctccaggccgcccacatgggttacgccgatttcgcccacggtggtcaggcgggtggcgcccatcacttggtcgaagaagtgcgtgaaggtggtctggaactgggtcacctccttgcggctgtagccatgcaggtcctggcccggcgtgcccttgagcaccgacgcattgccaaagcccggaattggcgtaacgcccgcatacagaatatcggtggtgctcagttgtaccggcgcgtttggccggtagctcaattcaccactccaggcggtgccggtaggcagcgtggtggagaagctcaagccgtagaggcggatatcttccgggtactcgacaaagtactgggaactgccagccacgatcagcggacgcaatgccgccagcggccccagcggacgggtgtaggccgagttaggcgcacctgtcgcgctgaagatcggcgcacggctgtggtagttcatgaagtacgcgccgaattcggtgtccagcggttcgaagttgtagtgcatggccacgccgaactggccgctgtcccgtgcatcacggtcaccgccacgttttaccagcacgccctcattgttcacgtccacgcccagcgcattcaatgtcggcaaggccgcgccagggatggtggagcgcttgttcaagacgcgcaggttattgctgcaaccgtcggcaatcacgtcgggctgagagaagaacgtgccgcagttatccacaaccgtctggtcccactccagctggtagaacgcctctgcggagaggttgtcggtcagggtctgggacacatagaacatgttgaccggaatcaagccttccttgatctcggcgcccggtcgacgaaatgcagacacgtcgatcgggttgatggagttgataccgccgccgatgaaggtactttcaccccagctcaccacctgcttgccaaggcgcacgttacccggctgatcggcaatggtgtagttgtggtagacgaatgcatcaaggatctgcccgccagaggacttggcgccttctttgcggttgtcgttgctgacgttcttgaagtccaggtcttcgttttgcagggcaaagtcgtaccagtacttgccccgcacaaagatacccgtgtcgccgtatttcaattcaaggtcatggatacccttgaagatcttcgagaaggaatcgcccttgtcgaagttcaggtggccgtcatcagaggtctgcgacagccccttgccaccgttgttggcaccgatcaggtctttatttcgacccgcagtcgaccagctcgcccccaccgacagggatgagtcaaagctaccttcgatttcaccgatattgaaactgacgccgaatgcgggcccggcgagcgtagaagcgagactgacggccaggggcagtcttgcccggcgccagaactggtttactgaggtcatcgacgctactccatgtgcattattgttatggcagtgagttctgtcttctggatgcatgtaacggccggaatacaacgattccaatgccgaacggcaaccgagcccccatggcccgaagcacaacatccttgaaaaactctgagagggactatagccagcgggggggtatcgcttgatccctctaaagtgtgatttgcatcaccgacccgtctgccacaaccctttcgccacgccaacgaaggtcggcgtggcaaggatggctgaaaattggcaaatcacaagtgaaggcgcgagatagagcattgccgcgcccgaacgggcgcggcgaaaggcgtcagagggtggagaggaaggtgctgttgttggcctgccattcaatgatgtcgatacggatacgttttttgtcgagttttcctacgctggtcttgggaatttccgtaacaacggcgatctgacttggaatcgcccacttgctcaaatggcccagttcgacgaaaggcttgaggtgttccttgagttcccgagcacctatcacatggccatcacgcaccaccagcaacgcaaacgggcgttcgccccattgcgggtcggcgatgcccaccaccgctacttcgcgtaccgccgggtggcggctgaccaggtcttcgagggccagcgaggagatccactcgccaccggtcttgatcacatccttgatgcggtcgcgaatatcgatcacgccaaatgcatcgagggtggccacgtcaccggtgtgcatccagccgccttcccacagctcggcgcctttttgcggctcgttgtaataaccctcggtcagccacggtgcgcgcagcaccaactcaccttgcgactcgccgtcggcgggcaggaaattaccctcactgtcgacaatcgccgcctccaccaacggcccaggcacgccggccttaatgcggtaagtggtgcgctcgtcctcggtgccggccatcagttcttcgttgaggtgggcgcaggacaccagcggcccggtctcggacatgccatacgcggcggtcagttgaatgccacgcgccttggacgcttcatacagcgtgcggttgagcgcactgccgccgatgacgattttccagccgccaaaatccacgccttgggcggccttggcgttgagcaccatttgcaggatggtcggcacgcagtgggaaaaggtgacctgttccttgcgccacaactccaccaggtattccgggtcgtagcggccggggtagacctgtttcaagccgagcatggtcgccacatacggcaggccccaggcgtgtacgtggaacatcggcgtgatcggcatgtacacgtcgttggtgcccagcaggcgcacactgtcgacgctgcccatgatggtcgccacgcccatggtgtgcagcaccagttggcggtgggtgaagtacacgcccttggggttaccggtggtgccggtggtgtagaaggtggtggcgacggaattttcgtcgaaatcctggaagtcatacttggggctggcggccgccagcagggtttcgtactcgccgaccaggttgggcagctcggcggtcctggcgtcgccgtcggtgagcagcaaggtcttgtcgaccgtggtcaggtgcccggcgatggcctggtaaagccccacgaactcactgttgaccagcacaaagcggtcctcggcgtggttcatggtgtagagaatctgttccggcgacaggcgcacgttgatggtatggatcaccgcgccgatcatcgggatggcgaacatgcattccaggtaacggtggctgtcccaatccatcacggcgacggtgtcaccggccttgaccccggcttcggtgagcacattggccaggcgcgccacgcgctcgatcagggttgggtaggtgtagcgcagtttgtcgcggtagatgatttcccgggtcttctcgtaacgcgccccggacatcaacaggcgtttgatcaacagtgggtattggtaagcgccttcggcgggcgggataacacgggtctgcaacatacgaatcccttatctgactgcacggtcttggcttgaagacctgcactttagagagcttatgtgtcagccaaatcagccaaaggaatgatttgtagaggccaatgaatgctagctttgcgccagcatccatagcagattcaggtcaaccctgtgggagccgggcttgcccgctatacgggcaccgcggtgtatcagttacaccgcggtgatgcgatcgcaggcaagccagctcccacattggccgtggccactcaggtgtaatacggtgttacttcatgctggtaaacgccaacttcaccccaatcgcaatcagcaccgcgcccatggtccggtcaaaccaatgccccatccgcgcaaacccggcacgcacgcgctgctggctgaacagcatcgccaccaggcagaaccacagcgccgtcgccaccgccaaatacacgccataaccggcctggatcgccagcggcgtgtgcgggttgatcaccacggtgaacagcgacaggaaaaacagcgtggccttggggttcaagccattggtcacaaaacctgcggtaaaggccccgcgcggggtgcgctggcccccttcacggtgcaactcgccctcggcgaccggcttggccggctgcgcgcgcaaggccttgaagccgatgtacagcaaatacgcggcggcggcccatttcaacgcgttgaacagcacgatggactgcgacacgatcaagccaatcccgagcaacgagtaacccacgtgcaggaaaatcgccgaccccacgcccagcgcagtccaggtgccggcgcggcggccatgggtgacactttcacgcaccaccacggcgaaatccgggccggggctggccaccgccaacaagtgaatcaaggctacggtcaaaaactcggcggcgtacatgctcactccattaagtaactgattatttcatctgataggctcggcagattacgccttcgaaccctgtcgcaaaaggtacagttgatgacgaacaatcgccgcgccgtcttccttgatcacccgtccctggacctgggggacctcgacctcagcgaattgcgcaacagcttcagcgacctgcagctgtacgcgcataccacgccgcagaatgtgatcgaacgcctgcaaggcgctcaggtggccatcagtaacaagatcgcgctcaacaccgaaaccctggaagcctgccccgagctcaagctgatccttgtttcagccaccggcaccaacaacgtcgacctcgacgcggcccgcgcccatggcatcaccgtgagcaactgccagggctacggcacgccgtcggtggcgcagcatacgatcatgctgctgctcaacctggcgacgcgtttgaaggactatcaacgcgatgtggctgccggcaagtggcaagcggccaagcagttctgcctgctggactacccgattgtcgagctggaaggcaaaacccttggcctgctcggccatggcgaactgggcagtgccgtagcacgcctggccgaagccttcggcatgcgcgtggtgctcggcgcgattccggggcgccctgcccgtgccgaccgcgtgccgctggatgaactgcttgcgcaggtcgacgcgttgaccctgcactgcccgctgaatgaacacacccgtgacttcatcggcgctcgcgagctggccttgctcaagcccggcgcgtttatcgtcaacaccgcgcgcggtggcttgatcaacgaacaggcactggcagacgccctgcgcaacggccacttgggcggcgccgccaccgatgtgctgagtgttgagccaccggtaaatggcaacccactgctggccggtgacatcccccgcctgatcgtcacgccgcataacgcctggggcagccgcgaagcacgacagcgtatcgtcggccaattggcggaaaacgcccgaggctttttcagcggcgccccgctgcgcgtcgtcagttgataaactgcgccccttttcaaggagcagaccatggatccgcgcagtgaagtactgcttcgtcaggccgaactttttcaaggcaacctgttgctggtagggttgcccgccgacgatttgctcggccgcctgcccaatgcccacggctggagctggcacgccggcgaccaggcggcgctcgacgcacgcttcccggagcgcagccagtttggcgtcaacgtgccggaacgcgggtttgatgcggcggtgattttcctgcccaagtccaaggacctcaccgactacctgctcaacgccgtggccgcacgcctgcccggcgccgagctgtttctggtcggcgagaaaaaaggcggcatcgaaagcgccgccaagcagatgatcccgttcggcaagccgcgcaagctcgacaacgcgcggcactgccaactgtggcaagtcaccgtggccaatgcgccgcaagccgtcgagctggaaagcctggcgcaagtgttcgacgtgccgttggccgaagggccgctcaaggtggtgagcctgccgggcgtgttcagccacggtcgtctggatcgcggcaccgagctgttgcttgcgcatctggacaagctgcccagcgggcatttgctggactttggttgcggcgccggtgtgctcggggcggcggtcaaacgtcgctacccgcataacaccgtgacgatgctcgacgtggatgcatttgccgccgccagcagccgcctgacattggcagccaatggtctggaagccgaagtattgaccggtgacggcatcgacgccgcgccgatgggtttgaacgcgattttgagcaacccgccgttccatgtcggggtacacacggattatttcgccacggaaaacctgctgcgaaaagccgcgaaacacctggcaaaaggcggcgaacttcgcttggttgccaacagcttcctcaagtatcaaccgctgatcgaagagcatttgggcgtgtgtgcaatcaaggccgaaggcaatggttttcgcatttatcgtgccaaacgcggctgatggctttttgaaaaagaaggcttgccgaatgggttttgcctaggcagaatccgctccgtcctaggggagtagtctcccacgagcgccatgctcgtccggcatacgtcaacatacttggtcaacagaccatggcgtatgcgacccaagagtccgcacagacggaccggggtttgacaagacctatgacacgcacaccttacccggggcgggaaggctgtacgtgtcatagccgtgtcgacccgcccctggaaacctacctgatgctggattcattactcgttcctaccgcaatcgttgccttggccgaaatcggcgacaagacgcagctgctcgcgctcatcctggccgcacgctttcgcaaaccctggccgatcatcgccggcatcgtcgccgcgaccctggccaaccatgcggccgccggtgccgtgggggcctggttcggcagtttcttctcggatgcggtgttgcactggatcctcgcggcgagcttctgtgccacggcgctgtggaccttggtgccagacaaactcgacgatgacgaagccagtaccacgcgcaagttcggcccgttcctgaccacgctgattgcgttcttcctcgccgaaatcggcgacaagacgcagatcgccacggtgatgctggcggcgcaataccctgagctgtggctggtgattatcggcaccacgctgggcatgctgattgccaacgtgccggtggttctggcggggaattttgcggcggagaaactgccgttgaccttgattcgcaggctggcagctacggcgttcttcgttctggcggtggtggcggtgtacaaggccatgcaaagcagcggctggatctagcccgacctgatcgttcccacgctccgcgtgggaatgcattctgtgacgctctgcgtcgcgcctttaagagcggacgcagagcgtccagagcggcattcccacgcagagcgtgggaacgatcacgcgttaactcaggacttcttggcctgctgatacaacggcatcaccttcggaatcgccgcctgcaacgaggcgattcggctgtcggacgccgggtgcgtgctcatgaactccggcggcgcaccttctgaagccttggccatcttgttccacaacgtgatggctgcgttcgggttgtagccggcacgggccgagagttccaggccgatcaggtccgcttcgttttcattcgcacgactgttaggcaaggtcatgccgtagttggccacggtatcggccaacgccaggctgtcctggcccagaccgaacagcgcaccagcgccctgcttggccatctggatgccgtaagccttggacatggcctcacgcccgtgttcacgcaaggcgtgggcgatttcatggcccattaccgccgccagctcgtcatcggtgagcttgaggttgtcgatcaacgcgctgtacacaaagatcttgccgccaggcccgcagttggcgttcatctcatcgcttttgatcaggttcacttcccacttccactgcgccgcatccgggcggaaggtaggcgcctgggcgatcagacgattggcgatagcctgcacgcgcttggcgttggcgctggtcttgtcgagcatgcctttgccgctcgcctcacccagcgtctgctggtaggactgggcatacatctggtcgacttcctggctcgacagcatgctgaacatgtactgcttgcgctctaccccaacggccccgccgctggtggtgttaaccgactggcaaccggccagcaacatcgccgcaaccaacccacttaccgccaatgacttcttcatgaacacgctccctgaacacatggcgcgtatcgtaggcgctcatgtgtatctgcgccagatacacaagacgtgtaatcgctaactttcagatacatcccacacacccacaacggcggcgaacagcccatttgcgacatccggcactatttcaccggcccggccttaagcctcccgcgccagtggccgatacaaaaaggcagcccatctgcccttgcgcccggagccttcatgaaattcaagtcgattcagttttctgtcgccgcgctgaccggcgccatcgtgctgagtgtggtcgcggtactggtgctctacgccgtgtttgccggcgcgcgcacccaggaactggtgcagcaacgcacccaggcgcaattcgagcagatcatcgagcagcgcctcaccgcattggcgcaaacccaggccacgctgatccagcgtgaattggaagcaccgctggtgaccgccaaaggcctggccaccgccaacgccctgctcggcatgaaaggcgccaacggtgaaccggccttgcaagtgggccgcgagcaactgatcaacctgctgcacgaaaccgtggtgcgcaacccgaaaatcctcggtgcttacatcggctgggaacccaatgcgatcgaccacaatgacgccgcctacgtgaacacgccgattgtcggcatggccgccgacggccgtttcctgccgtggtggtatcgcaatgccgatggcagcctgggcctggataaactcgccgacgtcaacgaccagaacatcctgtccaccggcgtgcgcgccagtgagtactacctgtgttccaaagagagcaaaaagccctgcgccatcgaccccgcgccttacaaggtcggcaacgcgatggtgatgctcgcctcgtttatcgaaccgatcatgatcgacggcagctttcagggcattgtcggcgccgacctgtcggtgaacttcatccaggacatgctcacccgcgccgaccagaacctctataacggcgccggtgaaatggcgctgatttccagcaatgggcgcctggtggcctacaccaaagacgccagcaagctcggcgaaaaagccactgacttgctcgacagcaacgaactggccaacctcggccagctgaaagtcggcgaagtgcgctacgacatcgacaaggaacacgggcatatcgagctgttcctgccgttcaacatcggccaggccgaagcgcgctggaccctgatgctgcaactgccgctgagcgcggtgatggccgacttgcagcaactgcaaagcgacctgcaagcccagcgcaagaccgacacgttcggcatggccatggtcggcctgctgatcgccggcatcggcttgctggtgatctggctggtgggccacggcatcgcccgcccgctcaagcaaatggtggccatgctcaacgacatcgcccaaggcgaaggcgacctgacgcgccgcctgaccagtgaccgcgccgatgaactgggcgccatcgccacgggcttcaataccttcctgatcaagctgcagggcatgatcacgcaagtggtgagttctgtgcagaaggtcagcgattcgtcggagcacaccgccgatatcgcgattcgcaccaaccagggcgtgcataaacagatggtcgagatcgaccaagtggccaccgccgtgcacgagatgaccgccaccgcccaggacgtggcgcgcaacgccacccaggccgcgcaagccgccagccatgccgatcaggccgcgagccagggcatgcgcatcgtgcgcgacacctccacgtccatcggcgcgctggccgaagaaattggccgcgcggtgagcgtggtgcaaaccctggccaaggacagtgagaacatcaacgcgatcctcacggcgattcgcgggattgccgagcagaccaacctgttggcgctcaacgctgccatcgaggcggcacgcgccggcgaacaaggccgtggctttgcggtggtggccgatgaggtgcgcaacctggcgcagaaaacccagaaagccaccgaagaaatccaggccatgatccagcagctgcaacaaggcacgcgggacgtggtgaaggtgatggaagacagccagaaccgcaccgatgaaagcgtgcagcatgcagccaaagcggccgaggcgctggagacgattacgcaggcggtttcggtgatcaacgacatgaacacccagattgccagcgcggccgaggagcagagcgcggtggctgaggacatcaatcgcaatgtgatcaatatcggccaggtggcgaatgaagtggcgggcggcgcggatgagtcgagtgcggcgagtgcggatttgaccaagctggcggagcagcagcggcggttgatcaatcagttcaaggtttagggattggcggtggtcttgaggccgctatcgcaggcaagccagctcccacatttgactgtattcacaaatccaagtgtgggagctggcttgcctgcgatagggccaatgaatccaactcagcctggggtcaggcactccggcccattcagcttcggatcattgaccatattggccaacacccgctcacgcaacgcagccggctcacccgccaacaaaccctgcaacacatgcaaaggcgtctcgggattcagccacgcctcttgccccgccgcgtccagaatcaacggccgccgctgactctgcgccgcctgggtcaccactgcggtactcagccacacttgctcctgcaccggatacgcttcccagatcgcggcaaaaaacaacgtggagccctcccccggcgtcagccaatacgggcgcttgcgctgggtgccacgccattcgtaaaaaccattggccggcaacaggcagcggcgctggcgaaaggcttcgcgaaacatcggttgttcggccagggtttcggcgcgggcatgggctggcgtgcgggaaaggtcggtcagccagggcggcgtcaggccccagcgcgcgcgggccagggtgcgctgaccttcttccaggcgttggatcagcaccgaatcattcggggaaatgttccactgggcctgctgatcggcagggaagccgggcaaggctgcgaaggcggggttccagcgaaacagggcataacgtccacacatggggtaacacgactcttgggtaaaccgaccgacagcctaacagaccaatacgtcggggaagctgtcgggttcatcaccgggcagtggttgcgcgccgttgtaggcggtaatcagctcgcgggcgtaggcggcctggtcgttgtccacttccaggcccagcaggccgaaaatcggcaactcgccggtgccaccgagcaaatggcgccccaccaggtgcgcctcaatgccttcgctggcgagcatctgttgcagcagctcgccttccatcaggttttccggttcgtagattcgctgcatgggcgtacctgttattcattctcgctgcgtacgttcagcatccattcgtcaccgtgcacctgtagctcgaatgtaatcggccggcagcacacggggcaatcctctatatattcctgatcgccgccggaaaggtccaacaccgcctcggccggctcaccacaataaggacaatcgtacgactcggtttccagcatcgcggtctcccaggtgacttgtgcgtataatcgccggtctatttacagggctattcacggcagagccaatattgcggccgcaccctgatatttcctttacctaacactagccgtttctaacaagagagcatgatgggcgaattcgataccatccgaccttacaacgacagcgaagtcccggcagtgctggcacgtctgttcagtgacaaggcctttctggacatcctgacccactttcgtttcccgcgctttgccggcgccctgggctggctgctcaagccaatgatcgcccgcaagctgcgccgcgagttcgccggtgtcaccaccgtggccacgctgcaggacaaagtcgaatattacgtcgaccacaccattgaccgcgcaaccgacggcgttacttataccggcgtcgagcagctcaagtccggcactgcctacctgtttctggccaaccaccgcgacatcgtgatggacccggccttcgtcaactacgccgtgtatcacgccgggctgccgacgccgcgcatcgcgattggcgacaacctgctgcaaaagccgttcgtcagcgacctgatgcgcctgaacaagagcttcatcgtgcaccgctcgatcactgggcgaaaggagaagatggcggcgtataacctgctgtcggcctacatcaaccattcgatccgcaacgattgccagtcgatctggatcgcccaggccgaaggtcgtgccaaggatggcgatgatcgcaccgagtcggcgatcctcaagatgttccacgtcagccgcaaggatgagccgtttgccgaggtgatccagtcgttgaacctcacgccggtgtcgatcagctacgaatacgacccgtgcgacaccgccaaggcccgcgagctgtatatccgtgccaccaccggcacctacaccaaagcaccgggcgaagatgacgtgagcattgccctcggcatcaccggctacaaaggccgggtgcacatcaactttgcaccgccgatcaccgagcgttttgaagacaccaagctgctggccgtggaaatggaccggcagattctcggcggttatcgcttgttcccggtgcattacctggcgtatgcacagtggagcgacgccgacccgcaactgcaggtgccgacggcggccgaggtgttcccggcggatgaactggccaaggccaaggcggaatgggagcggcgcttgaacgaatgcccggccgaacaccgcccgtacctggtggtgcagtacgcaacgccggtgcgtaatcagtatcgggttaaagcgggaatcccgctgtaatacgcggtaaaaaaatgtgggagcaactgtcttgatggcttttttccaagctgctgttccagagatgacagtgcccccacagcagtacac

SEQ ID NO: 35 - DNA, 132941 bp, Pseudomonas poae FL10F
agatggcttatttgatgtctacttctgtcatcaatttctacggaccttcgacgtaaataaccctgactacggggcataatgtgtccactatgtcctcgcacaggtgtcaaccatgtgtccagtccatacaggcttttccaaagtgagccgccgtaagggcggaacccatatccgccatcacccaaataacggatatgtacacaaccaaccccgtctaatctcaaaaaaacattaccaacacgaataaaaatatcaataaataatgaaagtagagaatattagcttatgcccaaatagcattatatttttaaaatccattccgttatgtttgatcgcaacagcctacccctgacctcggatggtacccagcgtgattcagattctgcgcgccataaccgggtaaagaccccgcggcagaatcgttggaacggagttcaacgtatgttgcccattcaaacccctcgctcgccccacacctagtttccaatcgccgaaacaccccaaaaaaaaccgagcaccgcgcacgaccgcgcgactgcccgacttcgcgatttggaaagtttggagcgaccatgaagcaagttctcccccccaccgccgcactggcgctggccctgctgacaagtacggcccaggcccaggacgacagcaccttgtccaccgtggtggtcaccggcaaccgtggcgccgagcagcgcaccgtcaccagcagcccggtgccgattgatgtggtcagcgccaagcaactgcaaagcaccggcaagcccggtctgatggaagccctgagcgccgtcatcccctctctgaccctgccggaaaaaaccggttgggacgccagcggcattgcccgcgccccgaacttgcgtggcctgagcgccgccgaagtgctggtgctggtcaacggcaagcgccgccacaccagcgccaccctgaacatcaacggcatcaacactggcgcggcaccggcggatttggatttgatccccatcagcgccatcgaccacgtcgaagtgctgcgcgacggcgccgctgcccaatacggttccgatgccatcgccggggtgatcaacgtgatcctcaaggccgacaccagcggcacctcggtgaccaacgtcggccagggttacgacggcaagaagcagaccgtgcaacaaagcctcaacaagggcttcgagatcggtaacggcggtatcgtgcaattggccctggacgcgcgcagccagaatgacgacaacaaagccagcgccaacggctacagctatgcacaagcctatgagcaggcgggtcgtgcaacctatggcggctacggcacgcccaagaccaacctgctgaccctgggctacaacgccgagctgccgatcgacgacagcctgagcctgtattcctttaccacctattcgcggcgcaaggccgagcagggccagaatttccgcctgccgaccatcaccaacaccatcaccaccgggccgaatggctacccggccgggtatacgccgacctggtacatcgacgaagacgatttccaggccgcgttcggcggcaaaggcaccgtcggcgcgtgggactgggacctgtccaccacctacgggcgcaacgaagcggagcagggcaccacccataaccagaacccgtcgctgggcgagtacacgcccaacagcttcacctccggcacctggatttccaccgagctgaccaccaacctcgacttcaagcgcggcttcgacatcggcctgcaaaagccgctggacctgtcctatggcttcgagcatcggcgcgacacttatgaggtgcagtccggtgactatgcgtcctatgccaatggcggctactgcgtggcgccgggcaattgcgcatcatccggggcgcaggtcaccaacggcatttcaccggcggaagagagcagcgcctcgcgcaacagcctcgccagctatgtcgatgtgggcttcaacccgctgccggactggtacgtgggcaccgcgtttcgctatgagcattacaacgaaggcgtcggcgcaacccgcagcggcaagctgaccacgcgctacgatttcaacccgcaatttgccgtgcgcgccacggtcagcaatggcttccgcgcgccgtccctggccaacagcctgttcagtgcgcgttcgaccacctatggcgtggtcgacggcgtgtaccagtcgatcaactacggcgtgctgccggtgggctcggcggcggccaaggctctcggcgcccaggatttgaaacccgaacgctcgaccaacttcagcctcggtttcaccctgacgcccaccgaccgcttgaatttcaccgccgacgcctacgtgatcaacctgcgcgaccgcatcaccctgaccggcaccttgctcggcccggaagtcacccaggtcttgcagaacaatggcatcaattccacctccggcggccagtacttcatcaacggtgccgacacccgcaccaaaggcgtggacctggtcagcaactacaaccaggacattggcccatacggctcgctgaagtggacggcggcgttcaactggaaccagaccaagatcctcaactacaaggcctccaccgacatcctcggcacctcctacgacctgatggaccgccaggcccgtggcctgatcaccgatgtgcagcccaagaccaagctgatcctgggcggtgactggagcatcgaccgcttcaacctcaacctggccttgacccgttatggctcgtacaaagaggtcaacgtctctgccgaccgcagcctcgaccgggtctacagcgccaaatggatcaccgacctcgaccttggctacaacctcaccaaagacctcaacatcgccgtcggcgccaagaacctgtttgaccaataccccaagaaacaaggcgtgccgagcagcaccatgctcgccagctacggcacgtattcgccctacggttttaccggcgggtactactacacccggctgacttacgccttctaaggccgcaacccgcgaggaatagaccatgcccattgtcgccaaaacctatgacctgatcgatgaggtcaccgactacccggtgcgccaggcgcgcgtcgccacgccgatcaaagccttgcacgtggtgccggcccggcacccctggcgctgggccgggtcgattttcgccgcgctggtgctgctcgctatcgtgcattcgctggccaccaacccgcgctgggagtggggcgtgttcggccagtggttcttctcgccgtcggtgctgcgtggccttggccagacgctgctgctgacattgctgagtaccgtgttcagcatcatcctcggcactgcgctggccctggcgcggttgtcgggctcgccgctgctggcggcgttggcctggggctatatctggtttttccgctcgatgccggcgctgctggtgctgatcatcctctacaactttgcctacctctacgaccacatcgtcgtcggcgtgccattcacgggtgtggtgttcgccgagtggtcgacggtggatgtactcagccaattcaccgtggcagtgttgggcctgagcctgatgcaggcggcctacgcggcggagattattcgcggcggcctgatcggcgtggatgccggccagcatgaagcggcagcggccttgggtttgccggcttcgcgccgcatcttccgcatcatcctgccccaggcgctacgctcgattctgccctcggggttcaacgaaatcattggcctggtcaagggcacctccatcgtctacgtgctggccttgccggagctgttctacaccgtgcaggtcatctacaaccgcacccaggcggtgattccactgctgatcgtggccaccgtctggtacttgatcatcaccaccgtgctgaccagcgcgcagtactacgtcgagcgccacttcgcgcgtggcaccgcgcgcgtgctgccaccgacgcccctgcaacgcatccgccgctggctcaaggagaaaacccatgagtgaagcacgcgccgggcgcatccagatccagggcgtgggcaagcgctttggcaaccagcaggtgttgaaagacatcgacctgaccatcgaccccggcaaggtcacggtgattctcgggccgtccggctcgggcaagtccaccttgctgcgcaccatcaaccacctggagaaaatcgacagcgggcacatcaccatcgacggtgaatacgtcggctaccgccgcaagggtgacctgctctacgaattgaaagagcgcgagattctcaagcgccgcatcgacgtgggcttcgtgttccagaacttcaacctgttcccgcacctcaccgcctgggaaaacatcgccgaggcgccgctggcccacaaacgctggagcaaggccgaagcccacttcaaggccgccgagttgctggccaaggttggcctggcggacaaggtcgatgcttacccgcgccagctctccggtggccagcaacagcgcgtcgccatcgcccgtgccctggcgctggaccccaaggtgctgctgtttgacgaacccacttcagccctcgacccggaactggtgggcgaggtgctcgacgtgatcaagggcctgacccagctgggcgtgaccctggtgatcgtcacccatgagatcggttttgcccgcgaggtggccgaccatgtggtgtttctctgcgatggccaactgatcgaagaaggcccgcctgaacagattttccgccaaccccgacatccccgcaccgtggcctttctcggcaaagtgctttagttcaaggagtgactgccatgttcatcaataccgcccgcgtggccttgttggcgcttgccgtcagcaccgcgcaaagcgccttcgccgtgcaacaggtcgacctcagccccgaccgcgtgcgcatccatgtgccgcgcaatgaggcggccatcgcgcagatcccgccaggcttcaagttcgcccagccgggcaagttcaccgtggccgtgtccggcgtggccgggccacccctggcgctgctggccaatgacgacaagaccaccatcggcagcgaggccgacaccgcgcagttggtggctgacagtttgggcttgcaactcaacgtggtgcagaccagctgggaagattggccgctgggcgtcagctcgggcaaatacgacgcggtgatcagcaatgtcaccgtcaccgaggcgcgcaagaaacgcttcgactttgctacctatcgccaggatgtgctcgggttttatgtgaagagcaccagcaagatcaccgagatcaaacaggcctcggacatcgccgggctgaagatcatcgtcggctccggcaccaaccaggaaaaagtcctgctggcctggaacgaggcgaatgaaaaggccggtatcaagccggcgctgttgcagtatttcgacgaccaggccgccgcgcaactggcggtgcagtccgggcgcagcgatgcgctgttcgggcctaactcggtgtacgcctattcggcggccatcaccggcggcatcaagctcgtcggcacggtgaatggcggctggccgttgaaagcggatatcgccgtgaccacgcgcaaggacaacggcctggtcaagccgatccacactgcgctggaaggcgcgattgccggtggccaatacgaacaggtgctgcaacgttggggcctggacattgagcgcgtcgacaaatcgctgatcaacccaccgggcctgccggactaggagtcgcgaacatgggactgacacgacgtgaagcgctgtcgagcatcgccgcagtcggcggtgagccggccgtcaaggatgcactcgcggcattgggcctggggccgtcatcgcaccggcggccgcaaccgctgaaactcaagcccggcctgggccagggtacccgcgtgctggtgctgggtgcgggggttgccgggctggtcactgcgctggaactgacccgcgctggcttcgaagtgcaagtgctggaagcccgagaccgggtcggcgggcgcacctggaccctgcgcaatggcgaccgcgttgactacaaggacggccgcacgcaaaccgtggcgtttgatcagggcctgtatttcaacgccggcccggccaggattcccagccagcaccgtacgattctcgactattgcagcgagctgggtgtgccgctcgaagtactggtcaacagcagccatggcgcccaggtgcgcccggacctgcaacaaccggcgttcaccgtcggccaggcgatcaacgatgcacgcgggcacttgtccggcctgctggccacagcggtgcagcgtgatgcgctcgacgatgtgttgagcagtgaagagcgcacgcgcttgctggcattcctgcaggtatacggcgacctgtcgcaagagctggcctatgaaggcagcctgcgcgccggccacctggagtcgcccgcgcaccccggcgcattacccgccagccgcagcccgctggcgctggaccggttgctgcaccccgaactctggggcgcgttattgcacacggagttcccggagttctcggcgaccatgttccaacccgtcggcggtatggaccgcatcaccgacgccttctaccagcgcgtgcgcgagcacgtgcaactcggcgcccaggtgcgccagatccaccagttcgaagacggcgtggcggtgacctaccacgataaacacagtggccgcgaacaggtggtgcgcgccgattacctggtgtcgaccttgccgctgccgctgctggccaagctcgacaccgatttcagcgacccgatcaaggccgcgttgctcagcacccgcagcgaccaggcgaccaaagtggcgtggcaatcgccgcgtttctgggaaaccgattaccgcacctacggcggcctgtcctggatcgagcatccggcgcggttgctctggtatccgagcaacgacctcaacacccgcgaaggtttgctggtggccggttacgtaaccggggagggcgccgacgtgtttggcgcgcaaccgttcgagcagcagtacgccacttcgaaggaagccgtcgagctgttgcatccgggttacgccaaacacctgcgcaacccgctggcggtgtcctgggaacagattccctacagcgaaggcccgtggctgcaacgcgaacatttccccgccgacgccagtgccttgctcgaacaggcccatggccgcgtgtacttcgccggtgacggcctggtgcaaagcggcgtgggcatctggcaggaatcggcggccaactcggcgcggcatgtggttgcgcaactggctgaccgtgtggcccaacaaacctaccttgcggcagtggccgcctcttaaggagcaccctcatgagcgacagcattcaacgtaccagcgtcggcgattttccgatttcgcaaaccgtgactgtgccggcctccgccagcctgattttcgtcagcggcaccttgccggatcttgccgacgcccaggcacccgctggcacgccagccgcctacggcagcaccgaagtgcagacggtgtcggtgttcaacaaactgcgcaagatccttcaacagcaagacctggacctgggcgatatcgtgcagctgcgggtgttcctggtcggcgccgaagagaccggcggcaagctcgactttgccgggttgcagcgtggttacacgcagttcttcggcacgcccgaacagccgaacaaaccggcgcgcaccgcgttgcaagtggtggcgttgccgctgccgggggcactggtggaagtcgaagccatcgccgcccgtaccctttgatttgaagtgagttggcttgttgtggcgcgcggggctgttgtggcgagcgggcttgccccgcgttgggctgcgcagcagccccaaaacctgacaacgcggtctatctgctataccgagtcggctgggttgggagcgcttcgcactccaacgcggggcaagcccgctcgccacaacaagccctgctcgccacaacaagccctgctcaccacatcaaaccctgcatgccacaacagcccagcttgcttagggcaagcgcctaggcacccttgccgggcaatggccagatctgctcgcgcaccgattcgccgagccaaaccatgccgtgcatgaaggtatcgcgttcctgtggcgtggtgagggggaagctggcgtagtgcgtgtgcgccatcacccgcagttcttcggcccacgcctgcttttcctgctcactgtcgaggttgcagccctcaaggacgtcagccgcaaggaaggtgctcaacgctatgggcagcgcatcgtgggtgaccaggcgcgcgttgagcgtggcgctgcagatctctacggtcagcccgctgatacccttggcgaggagctttttcagcggttttattttgttgttggcggcgaagttggtggacttgagcagggtgttgtaatgcggtttgaagtggttgatcagggcggcctcagccagtgtgatgacctcatcacggttcaggcgcacattgcgcagccgctcaaaatgctccgcctcatcctgctcgctggccaccggttcagcattgaagtctccgccgttgctgatcatcgtccggccgtgctcgaaccggtagagcaggatcgacacttccagctcggggttgttggttgaggtttctgcaaggatgcgttgcaaggtggtgtggttcaacagccggtccaccgccgtacgcgcgtgaaccttgccgaggccctggccgacatacagcacgttcatgtcccgatgttccgcttgcagggtgctggtcgcgtttgccacgacgatgtgcgcggcggtggtcatatgccgtgaggtcgagaggatagtcaggtgtgtgccgttgggcgcgaccagcacctgttcgatgtcatcctgatcgtccggcccgatcctcggaatgtcataacggaaagggatggactgcacgccctgttcgctcatcacgataaaactgccgtgcgccgatcgaccgagcaggtacaggtcatgcgggttgatcagcaccctacgcctcgcggtgatcaggtagatattgctgccggcaatcgcctctcggaaatgcccatcgcccttggcgcggtagaggtcggcgggcgtcattaccgtgggtgggctggaatagaggtgagttgcgccttcggcagaaaactgtcgaatgatcgagtccatgctggtcatcgttccgtcctggcggggctgcgcgcaacggcagcgtcgcgccgcagtgtggcaaaaaaacgcggccatgggcactggctgaacggataggtattcagttttacccatgggacgtacacctgactgtggccggggcttaccaccacttccagcgaccctgttttttcagggtcgcgatgacggcttcgcgtttatggcggatttctaccatcttgtgacgcagttcgcggcagcggtggctgttgaggatcaagaggccggtaagcgggctaatcagggatatggcgtagagaaaaggcggcggacggtacgctatcgtgggcagagatatcagtaagcaaattacgtaaatgccgacactgacccataccaagcggattcgaccataggtgacttgagccttggaaaaaaagaggacaaggcctgttgcaacactgccgaaaaagaagattttgattgcaaggccttccggaagtcccgagagaagggtcaccaacaataggacggcagtcatcgcaatcgtgaaacagccggcaagtagatcggctccaatcactagcgcatagcgtctcctgaactttcgtgggttttcaaagtagaagtatgcgtaagcgcgttcgtcggaaggcaaagatttccaatctttacatttttcatccattgcggattcgccaaggtcttttaatgtttcgcgcttgctcattggctggcttcctcgtagataccaatcgccagcgtcctgatgtttcctggtagtgagctgctagcgaaacccaaggttgcagcgaaggcatctctaatatggttgacggtagaaagttgcatttctgttgcgctgattcgttttggtaataccccattggcttgtttcaccttgagcagtttgggcgttaatcgagggtcacgaagcctgagcagctcatcattcagtttcgctcgttcttgtcggttcaggcctttgagtacctgtctgagcggcttgccggtgactctcgttgctgtgtttactgttttgatcgtggtcagggcggaagtggcaacaccaagtaatgcaatggcattcagcgttgcatcaacggcctgataccaggcgtcgctatccaattgatcaaggtattgcggagcaatcgcctctgcgccggttcgaccgagcccgatgatgcattgggtaatactggcagccagagcggccttaccgataaacgtaatcaccgcactcgtgcccgccgtaaagggcatcaacatcacgccactcgtcaccactatccaactcaatatcgcccccgcacacgtcaccgcggtgcctagcgcctccgccaccagttccgactcccgcggctcatgctccaacatccgcttgaactccgcaggcccgacatagcgaggcgcctcgcgcagcaccaccttcttcggcaccacgctgcataccgcctgaaactcacgcagtgtcacgacattgaattcatcatcgatatacaccacccccgcgccaatcagtgccggatcagcatcgatggcgaagaacagcttgcgtagatcaatactgctttcaatccgctgacgcgcagtgcggtgagccgaggggaatccatctttcaacagcgacgcagtcatccttaactcctggtttttgcgggagtcgagagcgtaaagacgagcaggcagctatgaatgtcggaaggttcgccaattcaagtggggtgcgtctctaacccgctttggcgtcttgcatgcagcgtggtggctaaggaaaagtgcgccccacgtcactaccgacgcacaccaagacagggagcaagcatggccgtcgatatgtttttgaaactgggcgacatcaagggtgagtcaagggatcaagcccatcgcgatgagattgatatcacccactgggcgtggggaatgtcgcagtcggggtcgatgcacagcggcacgggtggtggtgcgggcaaggtcaatattgccaatttgaacctgacaaagccgctggataaatccagccccaacctgatgatggcctgcgccagcggcaagcattatccggaagcgaaactggtggtgcgcaaggcgggaggcgcgagcccggtggagtatttggtgatcaccctgaaggaggtcatggtggtgtcctacagcaccagtgctgaaaacggcgccgatgtgctgcacgacagtttcgccttgaatttcgccaccgtcgacgtcagctaccagccgcagaaagccgacggcggcaaggacggtgggccggtgaagtttggctggaacatccggcagaacgtgaaggcctgagccccagccagtcctttattgctgcaactgcaatgcctgctgcttaagttggcgtttacgctcaaacggcaacttctcatcatccccatacggcgcgctgtaccagttgccataactcgggttaggcagcaaaaaccagcgttgtcccagccaattcaggtagggcgctacggccttgcgctggtccgcgagggtgttgtgttcggcctgcacgaaatcccccagggaatcgcccgccatcaacaacacgcgggcgtggctggcgacccattggcggcggcaatttttgccataaccggcgctttcgcaatggccggtcggcgtgctggcggccagcacctgctcgtcgctgtccaccggaaagccgcgcaggcgcaagttggcgaccgtggccgcgacctggctgtgttcacggttggtaaggtagtaaaccttgatgcctttttgttgtgctgcttgcaggaacgccaccgcgccgggcagggcctgggccttggcctggtcgacccaggtgttccagcggtcgtaggagtagacctggttattgatgatgtcgcgggcattgagcggcacgttgtcgagcagggtttcgtcgatatccacgaccaccgcgggtggcaggccagccaggttgcgcggcgggaagggcagggcatcccaggttgggtcggccagtgccacgtcgagctggcgggtggcgttggcgaacagctggcggtagatcaactcatgttcgatggaggtttgggtccagagcacggcgtcgagttggtcgttggccggtggggtttgctggcagccggcgagtgcggtggtcagcaggcaggcaccggcgaaaatcaggttacgcatgggcaagtctcgaagaggagggcgcgtcggcagcaccttagcctaaacaccgacccatgtgggagcgggcttgcccgcgaaggcggagtgtcagtcactagatacgtcaactgacactccgctttcgcgggcaagcccgctcccacatttggatcttcgtgaatcagacagagaggatgtggagtgcccccttcaaggcccacacaccaacgcctggcgctcatagttcagtgctttattctgcggcgccagcgcatagctcgcgctgcactgctgatcgccccacttgatgatcaacgtgccctggtcctgttccaccaacgccagtgcattgccgttcgggtccgcaatcgccagttgcttgccggccgagtcttccagcgaagcgccaaacgccagcggcttgtgttgcgcatcaaacaactcgaacaacacccgccgcccagtggtgccgctgtagtgcgcgaccacgattgcgccacggcgcggcaccacttgctgggtggcgttggtgatttccacatcgccgccgaggtcgcgggtgtccaggctcacccagttcacgcggtaaggctgggcattcgggatcacggcgtagccgttgtagccggtctcgacgccgctgtagctgctgattttcgcgccggagatgcccggcacttcggctaaggcgaaggtctcgctgacggtctggccaaggttgatgccgccggcgtgcgccaccacggaaccggccaggttgaggttctgcgagttgtaaccctggccctggctgtagccgaggctgacgtccgccaccgacgtgcggctgttgaggttcaccgagccggagtcgccgctggtgtcgctgtggccagcctgtaccgaatagaacgtgtcgctggtgtcggcgacgtagccgttgatgcccgcctgcgtggtggtgtcgccgcgctgccggctggtggtgacaaatgcgcgtggcgcgcgcgcctggctgcccagcgggaatgagacggacagggtcaactgggtgtcgctgctcggctggccccaggcgacgatttgcttggtgcgcgtcacgccgaggttgtagctcaggtcgccccagttgctggtgtagccggccgaaaagctctgcgagccgccacggttccagtagcgctggtcgctggcgttcacgtacacgctgccgaactcgctgttgcggccgatgctctggttgatggtcaggtcggtacgggttttcgaatggccggtgcgcacacgcacatcctgactgttgtcttcgacgtggtcggtgagggtgcggtagccctcggtggaatagcggtaggcggccagggtgaagttggtgtcggtgccggtaaaggtttttgcatacagcgcgcgcacgctgctgccctgggtggttttcccctgggccttgctggacgagtgggtggtgtccagcgagaaggcgccgtacgcggtgttcttgcccgcgccgaccgacagcgcgttgtagtcctcgctggcctgcaacccgacaatcccgctgaggttgctggtcaagccatacgccagggtgccgctgagaaaacgcgggctcgccaggccctctgcattgctcttgaacgtacccgccgagaggctgtacttgacctggccttcacgcaccatgatcggcaggctggaaaacgcctgcgtcgtcacccggcgcgtgccatcggcctcgatcacggtgatttgcaggtcgccgttggagccgctggggtaaatatcattgatctcgaacggccccggcgcgacgttggcggtgtagaggatgtagtcgttctggcggatttccacggtcgcgttggtctgtgccacgccacgaatcaccggcgcataaccgcgctcgctgtcggcgcgcatgccgtcatcggaggccagtttcaggccacgataacgcacgctgtcgaacaggtcggtgtcggagaaaatctcaccggcgctgaactggcccttgagcgcggtcacgtcgtgctgcacgtaggtgcggttgctggtgtaggtgttcgggcggccggtgccgccactcaggttcgactcgttgcgcaggcgccaggcgccgaggttgatgccgttgcgcaggccgaggttattcgagatgcgcgctttggcatcgcccgccgtgcggctgctgttgagttggtagttgatgaacgcagcgggcacgccgtcatcccataactgtgggtcgacatacccgcgcaggccacgctgcatggccacttgcggaatgctcgccatcaggcgcaggcggctgctgtcgtagcgcacgctggcgtccttgatcatgtcggcgagggcgtagcattcctggggttgctgcgggtcgactttgccgtcggcctgcagacgtttcatgtcgatgcccaactgcgtgagcaagtcgagggtcaggcaggcttcgacccggccgttttgcgggttgcgcttgaagtcgatgtcgcgccggcccaccagcacttcgttgctgtacaggtcgacgcggtagttgcccggcagcacgctgttggccgagagcaactgctgcaggtcgaccggtgactgtgagccttgcaggaaggtggtgttgaaggtttccgctgcctcatcggccatggcccaggccggcaggctggcggcaatcgcaagcgacagcgtcctcaacttcagtgcgctacgcgcgggcctgttgctggaaagaaaagacatgcgaagacctgtgacatccctgattggcgaacaggcgggcacgcaaacacgcacgcaacgtgagcctgtgggttagagaaagtacttagggggtgaggcgtgattcagtcgcgtgcgctacggcgctcgacagggctgcgctgtagtggttctgcgcgccgtaatcattgatgctggaaaacgtcagttgcaccgggccgggcgctggcgctgccttgagcgggaactgtttttcctcgccgggcgcaaccatggtcgagtcactggccagttgcgcctgcactttcacgtcagccatggacacgtggtacagcgtcgggtttttcacccgcagcagcgtttgcgcgccgtgtttgaccaggctccactcgagctgcgcgggggcctgcaacgcactgcccgtcaggccggcagggcggtaaaaaatcttgatacgttggcggatagccaactgcaaggtgttctcggtctcactggccttggggatttcctgcacattcagccacaccaccgactcacggtccgtgggcatgcccgtgccctcatacaagatacgcagcagttgctgttccttggcgaagacgcgcgccaacggcggggtgacggcaaacggagcacggctgccgcgggtgtcgttcatgtcgacccaggactgaatcagcacgtcctggttaccgttgcgcacggtgatattggcttctttgtggtcgccatcgaacacgatacgggtggcgttcaatgaaatgctggcggcggcctgggtagccataagcatgcccagcagccccaggcacgcggcgatagaacgaggcagcatgagggttatccggtgtaatcaaaaagagaatggcgaggccgtttggcctcgcgcgttcggtgcacggggcgccgggtttactcgtattgcaggatgaacggcagggtggcatcaccacgacccgcagtggacgcaccggcggcaccggtggtgacgtaggccgccgcgaagctcagggtggcgtcgccgccggcagcgccgttgccgtgcatggtgctttcgatgcgcgcagtggccgccgagctgaggtcgatcagggtgccgttgctgtcgagcagggcgataccgacgtttttagccgaagcggaaccagcgttcaaagccagcacgttcttgccggtcaccaggcccgaaccgccgttgttggcgtcaaagatcatcgcgactttggtgccctggttgcagttgacgttcaagttgaagtctttggcggtcacacggcctgcggttgggttttctgcggtgcccatgtctttgatcgacacgttgcccatgtccaccgaaatagtacggtcggagttggcgccgtcgaccgagcaggcgtcgttgttgatcacgccggtgaaggtaattttaccgctgccgcccaaggtaggcgtcggtgccgggtctgcggcaaatgcactgccggaggcagcgataacggccgaggcgataacagccagggaaaacttcttcatgatgatgtccgtaagtgttagttggaaaatgcggttgttgaactgcgaggaaagagtaagcggcaagacgcggcgagcgaataagacgattcttataagccgcgcaatagacgggttagttgcaccgggagattgggggagggccagtaaataagggaccaagccattgtccaggaatggcttgcaggtggcgcttagttgaacaggttacgcgccaggcaataggtgagaaggtcctggtcgctgctcacttcaagtttgcgcatcgccgatattttttgcgcactgatggtcttcgaactgcggttctggctgcgcgcaatatcacttacgctcatgccggaaataaacaaacgcaagatctcgaactctttgggcgacaaactggtgaagcgctcgtcgatggcggtcaacgtctcgatcaccgaggttttcggcggctccaggctgcggtaggcgctctgttgcgcaatagccttcagcgccaactggatctcggtgtgcaactggcttttctggatgatgccgaccacgcccagttcctgcaggcgggtgaggatcaggtgattggaaatcatcgtcaggatcagaatctgcacctgcggaaaatgccgtttcaggtattccaccagcttcaggccatcgccgtagggcgagtcgccgggcatgttgtaatcggtgatcacaatgtcggcgccctggcgctgcaacagctcgatcaggcccgccgaacacacggcttcgcccacgacctgaaagcgcgtgtcgcgctccaccagctcgcgaaccccaagcagcacgatcgggtgatcgtccgcgataaccacgttgaattttttcataaagggccgtccgtagtgccagttcaagtgagggaagtgtgcccgggctggagcgtgtccaggacggctgacagtcgctgcatcacagccttcaccctaagctcaagcgaggtgtcgaggctgccgcgattcagtgcgctttccagttcgatgcaggcctgggccaggtcgagcgcctgcactgcgccgagggcaccggcggccgagtgcagcagttggccgagggtgcgcgcatcgcgctgtgccagggccgcgccgatacgctgcaagtcttgctgcacgctgctgatgaacagcgggcgcatcttgtccgacagctgcacgctgtcattgaacgtctgcggcggcggttctaccggtggcttgcttttgcagtgcttggccaactgcgcgcgcaaggtttgcaggctcaggggtttgacgatccaggcattcatgcccaccgccaggcagcgcacgccttcttcgcgcatggcgttggcggtcacgccgataatcggcaactgccgatcatgcgccctgagggtcttggtcagttcatagccattcatcaagggcatgttcacgtcagtcagcaccaggtcgaacgcctgcggttgccacagctgcagcgcctgctcgccgttggccgccagggtcaccgagcagccgagcgcttccagttgttccttgatgatcgcctggttgaccgggttgtcctccgccaccaggatgcgcagctccagccgcccagcgctttgcggcagggcagccggcggatgctcgtgcttgccgtgctgcgccaacgacacggtggctgcaatcgcgcgcatggcgtgcatgtccaccacccagccctgttccgtgtgcagcggcggggagtgcgcgcccggcaggcacagcacacgttggccgggccaggggcgcagcggctcattgggcagcacatcgatcagcaccgcgcggcggctatcctgctcgggcgtggacgccgccagggccgctgtaatgcccagacggttgagccagtcacacagcgactgcgccaattcccgcaccggtgcttgcacatacacaggcgttgggctgggttcgatcagcggcatgttggtcagggcaccgctgcacaacggcaggcgcattttcagggtaaagctgctgcccaggcccggttcgctgaccaccttgatttcaccgcccatcatctgcgccagccagcggcaaatcggcagtcccagcccggcgccgccttcgccggcggtgtccggtgcctggtaaaacacgtcgaacagcttggcctgttgcgtctcgggaatgcccacgccggagtcggtgacctgccattcgaggtcgacattgtttgcgtcgagtgtggtgactcgggcgcgaatgaccacgcgcccgatatcggtgaacttgatggcgttgctcaccaggttattgaggatctggcggatacgcatcgggtcgcccatcacacagtcgggcagctgcggatcgatgcagctgtagagttgcaaacctttgcgctgggcgaaggcggcataggtatgcaaggtgtcttcgagcatgtccagcgggcagaattccacggcttcaatcgccatttgcccggactcgattttcgacacgtccagcacatcactgatcaactggaacagcgtggcggaggaacgctggatcgtatgcaggtaagtttgctgatgggggtccaggtcggtcaggccgagcaattccagggtgccaagcacgccatacaacggcgtgcgaatttcatggctcatggtcgccaggaacagcgtttttgccttgttggcggcatcggcggtgcggcgggcgtcatccaaggcctgggcgtcgtcgatatgccgggtgatgtcgttgaacgcatacaggcgcacgtcttcggcctgatagcgggtggagacaaagccgacttgcaagtgccggccttcgatctccaggtgcgtttcgccgctctcggcgcgctcggcgctgtcgtgcacaccggccatggcggccaccaggcgtgcagtgccgggccattgctgggcgcgctggttctcgatcaacaccttggcgtcgctgcgccgtaccacacacaaaccggtgggcgcggtgtcgatgatcacgcggctgaacgccacgctttcggcaatgcgttcgtgggccaggcgcgcgggcgtaatcacctggcgtcgataccaacggctgccggcccagcccaggctgatcaaactggcgaggaacaatgccaggctgctcaacggccataaggccgagtggaagaagtgcgagtagttcaggccatacaccgcgctccacggctggtcaccggcctgggtgatcttgaactcaaagccgtcggcgttaacgtgtatgccgtcgctgagcgtcgcgtcggtctcgggcccgatcaaccggttgccatcgggcgcaattagggtaaagcgatcaaaggccgaatgctcgagggtacgctgcacgtcgtcgacctgggccacgtcgagcacggtgccgaccaccgcctggccctggccgtcgagaggcaaaccgatataagccagcagatgatcgggcgcagggccggcttgccagtacacgcggttctgttccagcggctgcggcgtctgctcgagggtttgctgcaccgcattgaccagcgccaccaggttgccggtttcctcggtgctttctcggcgctgatagcccaccgacgggatggtgatgatgtacggggtctggcgattgagcagaaaggtctgcggcgcctcgtacggtgatgaggaccagaacgcactgaaatagctggtcaggtgcgcgcccaaggcaaagatctgcggccgggcggcggggctgacctgctgctcatcgaacttgacgctgaacggcaccgaaaacgaatacttctggccttcgtacagcgtgcggtggttgtcgaccatgcggcttttgaggctgacctgcacgttggtggcgcgcagcagttcggcctgaatgcccggatgcgacaggctctttaggtacgacgcctgttccgccaggttctccatcaaccgcgcaaaatgaaagcgggtggcgccgtagcgggtttcgaccccgcgttgcagtgaccagtagttggtcaggaccagcagcaacgcgatcccgatcaacaccatcaggcctttgttcaggcgcacggagctgcgggtaaaggcttcgaggaccgcgttgttgtgcttcatcaggggtttccgcaagcgcaggataaatcggcactggatggagcttactccttactatctaacagataatccacggccaccagctagtgagatgtcgcggggccatcattgttcagaagttgttgaaattgttctgaagaaaccgcgtgtgaaatcagaaaaccttgcacctgattgcagtcgaccttgcgcagcagggccagctgctgcggtgtttccacgccttcggcgaccaccgtcaggccgagtttgcgccccagcgcaatgatgctcgccaacgcctgggccatgccctcgttgtcgtggcagccctgcaccagcgcctggtcgatcttcaattcggtaaacggcgtggagaccaggttcaagtacgagctgtagcctttgccgaaatcgtcctgggacaagccgaagcccttgatgcgcaggcggcaggcaccggcgtagaagttgctgatgtcctggggcaccgagcactccatcaactcgaagcagatcattcccggaatgccgtcgtggtgcagcacgaattccagcaaacggtcggccaggtcgtggctgttgagcaggtgcgtgggcaggttgatcgacaccgggatttcatacccacgctggcgccagcgttcctgggcgtggatcgcctgtttgagcaccacccacaacaggcgttcttccagctcgaatgccttgattgccggcaggaatgcggcgggcagcatcacgccttgctcggggtgcatccagcgcaccagcgcttcggcggcgacaatgcgcccgttggcgagggattttttcggttggaaccaggcctgcaactggccgctgctcatggcctgcaccagggtgtggcggtcgatgtccaggtgttcgggcaaatcgggggagggcttgcgcacgctggtcctgagctggtccaccaggctgcgcagggcgtcggcagcgaccggtttggagatcagcccgatgacttcaacgtcgaggtttttcgccaccaggcttgcagccatcaacatgcgccgcgatgccgcgctcatgattgccagcgccggcttgcaccgcaggctggccaggcactgaatgaactgcacgccgtccatgccgggcatcaacaggtcggtcagtaccaggtcgaaatcgcgctggcgcaggcgctccagcgcttctttaccgtcctcggcggtttcgagcatgaaatcccccaactcactgagcaagtgctgcaggtagatgtgctgcaggggatggtcctcaacaatcaaaatactaaggggcttcatgggtgatccgtgcataaggcgccagggagttgaatagagcccgcaacgcaaagggtttgaccaggcagtggttcatgccggcggccaggcacaggtcggcctcgccgcgcatggcgttggcggtggccccgataatcggcaacgggcagccctggcgccgcagttcacgcgccagttcatagccgttgatgtggggcatgttcacgtccgtcagcaccacgtcgaagttgccggcggtgtacagctgcaacgcttcctgaccatcggccgccagctccacggtgcagccgagttcttcgagttggtcacgcaaaatcagctggttgatgatgttgtcctccgccaccagcaagtgcaggttgagtttgttcaagtcacgctggtgcgtgtgctcatcggcgcgggccacccacagcccctgcgcctggctcacggcttggtgaatggcgccgaggtggttgaggttgacgtgccaggcgccggcgtcggcttccagcggcgtgcaggcattgctgctgacgtgaatcaccgggccgggccattccggcaccagcaacgggtcgacgctgccggggtgtacttgcagcagcaggtggctttcgggcagcgtcggcagcccggcctgggcgcgtgcgccccagcggcgcaaccagccgctgatggcatgcgcgagttccgggatgggcgagaccacgtaaatggtctcggccaacagcggcgtcatcggtggggtcggcgcttcttccagcggcaggatcaggctgaaactgctgcccagccccagttcgctgaccatgcggatattgccgttcatcaattcggtcaggcgctggcagatcggcaggcccaggccggtgccggcgaccacgttggtattgccttcgctctggtagaacggctcgaaaatcatcgcctggtcttcctgggcgatgcctttgccggtgtccgagacttgccacagcaggctggagcgctcgccgtcgcggccgagcactttgacccgcagcaccacgcgcccgtagtcggtgaacttcaccgcgttgttgagcaggttattcaggatctggcggatgcgcgtcacgtcgccgatcaagcgctccggcaacttcgggtcgaagcacgcatacagttgcaggcctttgccctgggcggccgcggcgtagccctggatgatttcgtggaccaggtccagcggcgagaactcactcaactccagcgccagttgcccagcctcgatcttcgacacatcgagcacgtcgcaaatcagctgcagcaaggtcgaagacgagccttcgatggcgtgcaggtagtctttttgctgggtatccagttgcgtgcgcgccagcaattccagggtgccaagcacgccgtacagcggtgtgcggatttcatgactcatggtcgccaggaacagcgtcttggcggcgttggccgcgtccgccgactgccgcgcttcctccagtgccgcttcgacttgcttgcgcgcactgatatcgctgaacgcgcaaaacagcacgtcctcgcctttgtagcgggtcggcgcactgctcaagtacaggtggcggccgtcgatggtttcaaaatagtcgctgcgttcggacggttcgccggcgaacgcctgttcgatccagccggcacgcagggtttcgcgctccgggccgttgcccagccattgctgggccagggtgttttccagcaccacctggccgtcggtgcggcgcagtacgcacagggccacgggcgcggtctggatcacatcacggccgaacgcctcgctttcgatcaacgcctggatgcgatggatcgaaggaatgatgaaacgctggtcgacgcggcgcatcaccagccagatcagcgccaggctcagcaggcaaaacagcagcgaaccgagcagctgtttccacaggccggtgaccacggcgcgcaggtcgatggaatacatcagctgccagtcggaggatttcaggtgcttgcgaatcaccaggtggtcgggcagccaaccgccgccgacaaagccgaagaagttgtcttccttgggcttgaggcgttgctggcgcatctgcgtgtcatcgctgttggtgaacaccagcatgccctgggagttgagcatcctgaattcaccggcactctggtcgccgagggcctgggacacttcgcggctttccatctccaggcccagccagccggagttggggtcttggcggtccaggcggatgaaaatgtacaggtgcgagtgctgctcggtgcggtcactcagccacagctcgttgagcgtggccgggtcgctgtgttgcaaggtcttgaggcgtttgagcatgcacttggagatcggcagcacttgcgcggttgcgtcgtacagccgcatcacttgcgggttggggccggcgttcacatacagcaggttgagctgcttggccttgaggtagtcgcgcaggcgcgcggtcagccagatgctccattggttgccgggcgtgtcgcccaggtacacatgttcttcttccggggacgaggggtaaattttcgactgcttgcgcaccgccgacaggctcaggctttcgagcagggcctggcggttggtgaaaaaggtatgcgcttcggcgatggcgctgctcatgtagccgcggcgctcggagatatcgttattgaaggtggacagcagaaaggtatagaccccgctcaagatgccgatgagcagcacggtcgcaaaaatacgaagcagccttctggctgcttcgggtcgggagaggacggggttgatctggagcagataacttttcaatcgcatcggcggactttaagcgcgggcgtgcgccgatggcataagacgatccttaaagcatgcccgattaattaagggcttacttgtaatacatatctaccaccaccgccgcgtcgaacgcgcccggaatcggcagggtgcgccatttcaggtcggcgcgaaattcatcgtggctctggcccaggcccatcagctcctgcagggtgaaccagttattgaatgccagcggctgctggctctcggcgcgcgacaatgagatgcccactgacttgttgttgtccggcaccagcaagccgttgaccacactgccgccgcccggcgtggtggcgaagcgtgcgctgacggtgtagggcgtgtcgcagcccttgcgcaggttcaggctgaagttcgcgctgctggcgacttcaccgattgcaaacttgcgtgagggcatcgggaagctgaccacgttgggagtgatggtcagctcgggggtacacggcacgaagcggatgccgttcatgccggtgaccacgtagttgaagttgctgttgggccgagagttgagcccgagcacgccgtccagttggaacacacggtacgaggtcaaggtactggcctggccgctgggaggcgtggggtcgtatttttcgatgaacacgctgaaattgagggtgaagcgcgccttgtcccaaccgacgcagttggaggtgcagccgcggtcggaaaagaacccggtgccgaccttgccggtgctttgggtaatcggctggttgttgtagcgaatgcccacgcggatacccgtgccaatgctgaccttggccgggttgacgtagaaatacacttcctcgcggccatgtttgtagtcgtctttgcagatcacattgatggagcgtgggccggactcccagatgatgctgccgttgggcgcatcggccgccaccgccagcgcggtgcccagcgcttcctgggtaatgatcgagtcggtgccgtcctcgcggcaggccagtgcgtggctggtggcgggcaagagtgcgcaggcccacagcagtatcggtaaacagcgtttggtcagtgacatgggggcaaatacctcgcgaaccatcagttcagcgccgcgctgtggcgggcctgcaaaccgatgtcggtgatttcggtgaagtgaagcgtggtgcctttgggcaaggggcttggcgccgtcagggttttgcgctcgtacggcttgagcagcaggtaatcactgagcgccaggttgtcggtctgcaggttcaccagtgacaggtggaacgcgctggggttgtggaccgtgacggtgcgcccgtcgtcgctgtgccattgcagttgctgcacggcttcggccgaaccgcccttgagcgcgggcggccgatagaacagcttgagccgctggcgtatcgcaaactgcacgctgttggggtcttcgggcttgagcgggatttccatgatgttgagccagaacaacgattcgcggtcgctgggcaagccttcaccggcatacaggatgcgcaacgggtgatgctcgccggcacccagctgcaccagcggttcagtggcggcaaatggcacgctgcggcccgccgaatcgtcctcgccggtgatccaggtttgcaccacgacctcacgtgacgcctggttgaccacgttaatggtggcgcccttgtcctggccgaaatagatcaggcgggtgccttcgattttcagcgccgcgctggcgggcggcggcgcgagggcgaataaaccgccggctaaaatcaccattctgagtagaaacatgagcacaggtgcaatccatgggagcgtgtgggaacgcagcgcatggtagaggcgggacagtgcgaaggctttcaggcgattcttaaaaggtgcggcgtgcccccggttaccgtttcagaatcgccttaaagtctgtctcggccctgacgggtaacgtgatcagcgttgaatgatcgacgcggatgcccacctgccaggtttaccctatgtccaataaagcgttacgccttctgattgccgatgcagaccttctgcaacggatcaagatcgagaaaatgctcaaccagttgggctatcaccgcatcgcccccttgagctcgttcgacgagctgcaggccttgacgcgtacggacggcgtggcgttcgacctgttgatcatcaacaccgcgctggtgcattcgcggcaggtcaacctgttgaagtactgccatgacaacccgctgattcgccacacgctgatctacgacgggcaatgtgcacagagctcggtggtgtcggtctcggtgagccagacgttgcacctgtcgctgtcgcaatcgccggacttcaactcgctgcgccgctgcatggaaatggtcgaccccgaccatagcctgccgacggtcgagcgcccgacactgcgcgccgtcgaaagccgggtcagccaactctccagcgtgccgcgcgccaattaccagggcgatccggcagtggtggcgtgcgcggtcgggttgtcgcccaagcgttgatcagccggctcggctcaggcgtatcggcaccgatttggctgccggcaccttgctgcgttcggcatggtgccagagcggcaccagcgggttgcattcagggtaatacgcggccgcgcagccttcggggatgtcatacgcgacgatttccagcggcccgacctgacgttttacctcgggctcgatcgccgttgtcagcagcacgccctggccgttttcgaagcccagccgcgcgatgtcgttgcggtgcatgaagatcacttcacgggtgccgctgatgccgcgaaagcgatcttcgtagccataaatggtggtattgaactggtcgttgctgcgcagcgtcatcagttgcagcacatcgcgtggcaacggctcggcgttgacgtcatcgtcttcgttcagcgtggccggccgcacgaattgtgccttgccgctgtcggtcagccattcgcgttgcgccacggcgatagggcggtggaagccaccgggttcagccatgcgggtttccatatcgtggaagatttgcgggtagaccgtggcaatcgcgctgcgcacccgtgagtaatccgcgctccagccctgccagtcaaccgcaccgcctgcgggcagtgtggccaaggccaagccggcgacaatgctggcctcggcccgaacgtgagggctgaccggctccgcactaccacgccagccgtggatacagccggtgctgtcctcggtggcccaggtttgcgcgacgccgttttgccggtcgatctcgatacgtcccaggcacggcagcagccattggttctgcgcgggcagcaagtgcgtgcggttgagtttggtcgcgatctgcacgttgagctgcaaggtttgccaggccggttccatgcgcgaggtgtcgggaatcgcgcgcaggaaattgccgcccagcccgataaagccgcgcacgcgcccggccagaatgccttcgcaggcgtccaccgtgcacaggcccatctgctccggcaccttgaaaccaaactgttgttcgatcaattccaccgggacttttttcgggtcttcggtaatcccgacagtgcgctggccttgcacattcgagtggccacgcaccgggcaaatccccgcgcccggtttgccgaagttgccgcgcatcaacaacaggttcaccagcatctgcacgttctgcacgccatggcgatgctgagtcaggcccatgccgtagatcatcatcactcgctggctgcgcgcatacacctgcgcggcggcctcaagggcgctgcggctcaggccgcagcgacgctcgatagactgccactggctggcgcgaaccatcgccgcatagtcttcgaagccttgggtgtgttcagcgataaattcatggtcgagtaccggtgccagcccgtcacgctgggcctggtcgtccatctccagcagcactttggccaggccgagcagggcggccgtgtcgccgccaatcgccacttgatggtactgggtgctgatcacggtggattcgggggtgagcatttccaccggcgattgcggattgacgaagcgctccagcccacgctcgcgcagcgggttgaaggtgatgatcggcacctcgcgtttgcgcgcatcctgcagctggtgaagcatgcgcggggcgttgctgccgacattctggccgaagaaaaacaggcaatcggtgtgctcgaaatcctccagcgtcacgctgccgacgggtatgccgatgctttcctgcaagcctactgaggtgctttcgtggcacatgttcgagctgtcgggcaggttgttggtgccatacgcgcgggcgaacagctggtacatgaacgaggtttccagggacgcgcgccccgaggcgtaaaacaccacgctgtcgggttgcagtgtttgcaattgcgcaccgatctcacggtaagcctcttcccacgaggtttcacggtagcggtcggatgctgcgtcgtaacgcagcggatgggtcagccgcccgtgttgctcaagtgcatagtccgaccactcgcgcagctcgctcagggtgtgttcggcgaagaaggccggtgacgttttcaaagacgtcagttcccaggccgtggccttggcgccgttctcgcaaaactccagcgcatgcggcttgccgggcttggcccaggcgcaactgacgcaggcgaagccgtccggcttgttctgcttcatcaatgcttgggttgccttggcgaaggcctgttcgcgccagaggattttcatcaccgattgcgccgagccccaaccgccggccgcgtgggtgtaaggcttaaagtgggtctttggatagatgagcatggctgcacctgaaggcgttatcggtggaggataacgttacgacgagcaggcttggcaaaaggttcgagccgagttccaggcggcaggttgaccactggtccgacactctacggatttgttgaacatccctttcgccgccccggccatatcaatcacgacggctggattaattcagccgtacttgcctattagaaaaagcctgccgtgattattttgccgagcggagagacgcctgatgaacgacctacctgcagtcagcccagtggttcagcctttgccgtttgaaccgtcattcgaacagattcctgatgatgaagcgcaaaccagccaggcgctggccgaagccctgcacggcatcatggaaaccacctttcgcgacagtggccatgccacccgcagcgtccacgccaaagcccatggtctgttgcgcgggcacatcaccgtactggacaacctgcccgctacactggcccagggcgctttcgccaagccagtgaggctgccagtgttcatgcgcttttcgaccaacccgggcgatattcttgatgacaaggtgtccacgccccgtgggctggcgctgaagatcgtcggtgtggaaggcccacggctgccgggcagcgatggcgaggtcacccaggactttgtgatgcaaaacgccaaggcctttaccgccgccacacccaaagcgtttttgaagacgctgaagttgttggccaagaccaccgacaaggcgcccggcatgaagaaagccttttcggcgttgttgcgtggtgttgaggccaccctggaatcactcggtggcgaaagcggcaccctgaaaagcctgggcggccatccgcaaacccatatcctcggcgagagtttttccagcgtggtgccgatgctctacggcccttactacgccaaagtcgccgtggtgccggtgtcctctaacttgaccgcgctgaccggtttgcatgtggacttcggcgacaaccccgacggcctgcgtgcagcggtggaagcttatttcgcgcagagcggcgggacgtgggaggtgcgcgtgcaactggccaccgacctggaaaaaatgcccatcgaggacgcctcggtgcaatggcctgaagacctcagcccgtatgtcactgtggcgcgcatcgaccttgagccgcaggcggcctggagcccggaaaacgtggcgaagatcgacgacggcatggcgttcagcccgtggcacgggctgacggcgcatcgcccattgggcggggtgatgcgggtgcgtaaacccgcttatgaaatgtcgtccgggttcagggccgagcacaatggctgcccgatccacgaaccacggccatcaaccacgccatgacggcaggttgttgtcgcccagcgtccagtgcggctggcggggtgtgagacagaccccgccgacccagcgtacgtggctggcgtggtcgagccaattggcctcgccattgagcacggcgcgcgccagtggcgttaatgccagcgcgcggcgcggccacggttgatcggtgtcggtctcgatcagcaatggctgctcagcgtcgatcaatgggcgcaacagcgcatggaacatcatgtcgcccaggaacggcagcggctcgcgctggcccatcaattctgcgaacactctgccgaaaggcaccggcccggcttcggcgatgtacgtcagggacaaacgttcggtgagtgagaggccatctcgggggctcggcaactcctgcaactgacgctgtaaagcgggggctagaaagggcagggcgggatgggcactctgagccagttgtgccaacttgaccggagaggtgtcgcagtaagccgaccacgcctgcttggccaattgcacggcttcatcgtcgatcaagcggcgctgtggccataaccacgccaggacgtctggggcgagttggccaatgccgataaaccgctcgacgccgggaatgcggtccacctcgatcaactccagctggcgcggtgcgcgctcaaggccagccagtgcacggatcagaaacagttggtcgtaggcatccgcctcgcaccacaacacgctgtgctcggcgctcgccaaggcgtgcagctggttatattcggcgtcgacgcggtgcactacttcagtggggttcagggcaaacgcctggctgatgaaagcgctgcgcatcgcgcggaatgcggcgtcgggcagatctcgaaccgggcccatgcacagcgggtcagtgagcatctggaactggcctttgaaccccgccacttgcaggctgtgggcgatgtcattgccgcagcgccagtgcgtggtgcgggcttcgtcgctggcgtcgaaaactgggtggcgcgcggcgaagtcgagggcgtcgacatgcgccttgagtttgggccaactgctgaagcccagctgtttggcgacttgccattgggcttgggacaaggtggcggtggggtcttggcttttcaggcgcggcaacagttccttggcgcgtttgcgctgttgttcaaggttgaggcggccatcggtgttggcgggtaacgggcgttgcgacatacgatctccttgcacaaaccttttccgctttaaggttgggagtcgtagaaatgaggtgcagcgtgagtgtcttgggcgcagccctttccgcggaaggtggcgtagagagcgccaggcgggaaatataggcagcattgtcgttcggcgcaaccccgtagatgtgggagctggcttgcctgcgatggcatcacctcggtttggttagattgagtacatatccgttcctgcggtaacggccacttagggtttcgctcttacagcgagtcactttttttcaaacgccaaaaaaagtaaccaaaaaacgctttgccccaccactcggtgcctcgcctaggctcggcatgcccgcacacaggcttgaatccgtgggccgccgcgatgggccatccttggcccagcgcggctaacccggcgtcctgccgggttacccacggattcaaacctgcgtgcggccagcgtggttaacggggcctgtaagatcaagatcaaaatctacagcacggcggcctggtagccgacctgagtggtagaagcaaaagcggggcaaaggcacatctatctgatgtactaagctccaaatgtgggagctggcttgcctgcgattgcagagtgtcggtcaccagattcactagctgatacaccgctatcgcgggcaagtcgaatcgtcgcaccgccgctcccacatttacttgtctgttctggcatccatggtcttttgatgctcggccaggaacggctgctccgccgggtcgaagcgatcaattccggcggtaaagcgatgccagtacgggtacaacggctggcgccgcgttacggcctcgatgcgtgaagactgctcttcggtgagtttcagttcggtcgctgcgaggttgtcgcgcaggtgcgcttcggtgcgcgcgccgacgatcagcgaggtgatccccggccgatccttgagccatgccaggcaggtccgcgccaccgacacgccatgttcatcaccgacggcagcgagggtctcgatgatgtccagcgcacgttcctggtcatgcacgtagggttccggccagccgctgccctggcgggtagtggttggcggtttttgcccacggcgggtcgaaccggtcaagaggccttcgcccatcgggccccacaccagcgtgccgatggattggtccagcgccagcggcagcagttcgtactcggcttcgcgcgattccggggtgtagtaaatctgctgggtgatcggtttgagcatgccgtgcagctcggccttgcccagggttttcatcatctgccaggcggtgaagttgctggtgccgaagtagcgaatcttgcccgaacccaccaacagccgcagcgcttcgagggtttcctcgatgggcgtcatgccgtcccagttatgcagttggtagaggtcgatgtggtcagtgcccaggcgtttcaaactggcttcgcaggcgcgaatcaggtggtagcgcgaggagccggagttgttcgggttgttgtccacggggctgcggcccttggtggcgagcaggatgtcgtggcgcttgtcgcccagggctttgcccaccacttcttcggcgaggccgtgggagtagaggtcggcggtgtcgaccatattcaccccggcgtcgaacgcgatgtcgaacatgcgcttggccaagggcacgtccaccgcgccacatttttcgaactcggcgcgaccgccgaagggcacggtgcccaggatgatttcggataccagcaggcctgagtggcccagttgtcggtattgcatgtcgcctcctgtttacgttgcacgtgaaggtgtgaacgacatgaatggcgatagtttgaattttttcatgaaatcttcctgcgcctgccgcaccattgcgccaacaggctttgagaggaacaccgcgtccatgagcgcactgatagaaacccgcgacctcacgcgcagggacgagcgccgtcagctggcattgctccagcccacggatttcaccttgaaccacggcgaccgcgtgtcgatcaccggttcctccggctccggcaagagcgtgttcctgcgcgcgctggcgttgctggatgcgcccacctccgggcagattttgtggaatggccaggctatcgccaacgccgagattccccactaccgcagccatatcagctacctgtcgcaacgcccggcgttgctggaaggcacggtggaagacaacctgcgttttcccttcagcctcaatacgctgcgcacgcgcagtttcgatctgcaggctgtgacgacgctgcttgggcatgccggtaaaaccccggacttcttgcagaaaaacgccggtgacctgtcgggcggtgagtcccaagtggtgtcgttgattcgcaccttgcagctgaacccggaagtgctgttgctcgacgaacccacggcggccctcgatcccacgtcatcgcgtgatgtggaagcactgatcgacgcctggtttgccggcgacggctcgcgcgcttacatctgggtgtcccacgacctcgatcaggcccagcgcatgagcgccatctacttgcagatgaacgccggagtgttgaacggagcgacccagccatgaattatcaaaacctcagcgcactggacatgggcatcgccgcctcgctgatcctgatcaacggcgcgctgtccttgctgctgcgcctgggccttggccgccaattgctgtgggcggcggtgcgcaccgtggtgcagctgctggccatcggttacctgctgggctgggtgttcgagttcgcgtattggtacgtggtgttgccgctgatgtgtgcgatgaccttgatcgccggcctgtcggcggcagggcgcgggcgccgcacttaccgtgggcaacgggtcgacagcatcctgtcggtgtggggcagttcgtggctggttacggcggtggggttgtttgcggtgatccgcatccacccgtggtacgagccgcaatacgcgattccgattctggggatgatcctcggcaataccctgaccggcgtgtctctgggtatcgaacgcatgacccaggaattgacctcgggccgcaacaccatcgaaatgatcctggccctcggcggctcacgctgggaagccgcgcaggaagccatccgccaggccgtgcgcgccgggatgatcccgacgctgaaccagatgaccgtggtcggcatcgtcagcctgcccggcatgatgaccggccaggtgctggcgggtgagagcccggtggacgcggtgcgctatcagatcgtgatcatgtttttgatcgccgcctcgtcagcgttgggcacggtaggcgcggtactgctcacctaccggcggttgttttccaccagccaccggtttttgcgggatcggctcgaagagcgcgcctgagcctcaggtgttgttgcaacccttggcaagcgagtcttcattggaggtgtagggccgtgacggctccaggttcctctccggcttgttgcgggcgatattgaagtggcacaccagtcggcttcagcaacgcagatcaaatgtgggagctggcttgcctgcgatagcggtggggcagccaaatcatggtcgactgatgtgccgccatcgcaggcaagccagctcccacagaaaggcagattggcttttgatctggctgtagatctggcttttgattttgatctcaggcgcccccgttaaaccacgctggccgaacgcaggcttgaatccgtgggtaacccggcaggacgccgggttagccgcgctgggccaaggatggcccatcgcggcggcccacggattcaagccttcgttcgggcacaccgagcctgggcgaggtgccgagtggtggggcgaggactttttgcttactttttggtccctcaaaaagtgagccgctgtaagagcggaaccataggtggccgttacctaaggaatggatatgtacaccggcggaccgccatcgcaggcaagccagctcccacagggggatcaattttgctggggggattgcatgccaggccaggcgtcagcccaggtccggcacaccaaaatccagcaccactttcatcgcctgggtcttgtccgccgccaactcaaatgcctgcaccgcctcgccaaacggcacggtgtgggagatcaccgggcggacgtcgatgatctggcgattgagcaaatccaccgcctgggcgaactcgctgtggaagcggaaagtgccgcgcaaatcgatctcgcggctgaccagcagattcaacggcaacgacacatcgccgcccaaccccaccgtcaccagcacaccacgcggggcgatgcattccaggccgttgcgcagggcctgggcgctgccggagacttcgaacatcacgtcgaagtagcccttttcggcggtgtagcgcttcagtgcatcggcaccttcggcgatgttatgggtgcgcgtggcgcccattttttcggcgcaggcgagggcgctggcggacaggtccacggccacgatttcaccggcacctgcagcgcgcaggctaccgatcagcaggttgccgatcgggccgcagccggtcaccagtacgcgtttgccgaacaccgcaccggcgcgttggatcgcgtgcaaacccacggacagcggctcggccaacgcgccctcggcgaggctgacgtggtcggccaggcgatgggcctgatgggtttcgatcaccaggctttggcgaaacgcgccctggatatgcggaaagggcatggcgctgccgtagaagcgcatgttcaggcaatggttcggcaaaccttgatggcaatagcggcaggcgccgcacgggcgcgagggcgacactgcaatgcgctggccgaccttgaacaacccggcgtcgctgcccaccgcgtcgatcaccgccgacacttcatggccaagcaccatcggctcgcgcaggcgcacggtgccgaagccgccgtgctggtaatagtgcaaatccgaaccgcagatgccgccacgggcgatgcgcacgcgcagttggtcgggggcgagggtttgcggttcgtcctgagggtcgacccgcaggtcttttgaagcgtgacagacgatagcgtgcataacgttctccaggattacagcgacgcggtgatgccaccgtcgacgtagaggatatggccattgacgaagctggcggcgtcgctggcgaggaacacggcggctccggccagttcggccacatcgccccaacggcggctcggcgtgcgttgcaccagccagtcgctgaactcggggttggccaccaggttggcgttcagttcggtcttgaagtagccagggccgataccgttgaccgtcaacccgtgcgggccccagtcgatggccatgcctttggtgagcattttcaacgcgcccttgctggccgcatacggcgcaatcccagggcggcccagttcactttgtaccgaacagatgttgatgatgcgcccacgcttgcgcgggatcatcgcccgcgccaccgcctggccaaccaggaacgcgctgtcgaggttggtgctgatcagctcgcgccagtgctgctcgctgtagtcctccagcgggccacggcgctgcatgccggcgttgttgacgaggatttccagcgccccaaggcgttcttcgatatcggccacggcagcctggatcgccgcgctgtcggtcacgtcaaacgcctgggtgtgcacctccagcccttcggcggcgagcagtgccgccgcatcgcgcaaggtgctgcggttgcggccgttaagcaccacccgcgcaccggcctgggccaggccacgggcaatcgccaggccgataccggcgctggaaccggtgaccagcgcgagccggccatcgaggcggaagttgtctaaaacgctttgcatgggctacctctcctaacgcttcacaccaccaacgacagcagcatgatgaaccccagcgcactgaaggaaagcacggtttccatcagcgtccaggtcttgaaagtttcgacgacggtcatgttgaagtactgcttcaccagccagaaaccggcgtcattgacatgcgacaacaccagggaaccggcgccggtggcgagcactagcagctcgcggttcacacccggcatcaagccgatcaccggcgcgacaatccccgcgccggtgatggtcgctacggtggccgaaccggtggccacgcgaatcaccgccgccaccagccacgcgagcaggatcggcgagatttcggcgcgcaccgccatatgcccgatcacatccccaacgccgctggccaccagcatctgcttgaagccgccgccggcgccgacgatcagcacaatggcggcggttggggccaggctcgaatccaacagcttgctcagctgtgcacgcgagaaaccacgggccgccccaaaggtatagaacgccagcagcagcgccgcgagcagcgcggtgatcgggtggccgataaagtccatccacacgcggaacacgctgtcggcagggaaggcgacgtcggcgaaggtcttgagcagcatcagcaccaccggcagcaggatggtggtgacggtgatgccaaaacccggcaggttgtcgcccgaggactctttggccaactgctccatcagttccggcgaggcctggccgggtacgtagcgtgaaatcaggttgccgaacagcggcccggcgatcactgccgtgggcaggccgacaatcaacccgtagaaaatcgtcttgccgatgtccgcgccaaaaatcccgatggccaacagcggccccggatgcggcggcaccagcccatgcaccaccgacaacccggcgagcagcggcatgccaaccttgatcagcgacaacccggtgcgccgcgccacgataaataccagcggaatcagcagcacaaaaccgatttcgaaaaacagcggaatgcccaccagaaacgccgagaacatcatcgcccattgcacgcgttgcttgccgaacgcgcgaatcaaggtgcgcgcgatctggtcggcgccgccggagtcggccatcaacttgccgagcatggtgcccaggccaaggatgatgccgacaaaccccaatacgccgccgaaaccgtcctggaacgacttcatcaccttgtccaccggcatgccggacgtcaggccgagaaagcctgcggccacggtcagcgcaacaaaagggtgaacctttaaatgggttatcaacaatatcaatccgacaatcgtgaccagtgcatcgagtagcagataagtgtcgttagccatgccgagcatggtgcctcctttttgtcattgttataggccaagccctgtcatatcgtgtatgaaggtggcttacttcaccgtagcggcgctcaagcgtccaattttcatttgtgatcgggtgatcatttttagtgattaccgagggaattcgatggagttaaagcacttgcgcgcctttgtggtgctcgcggaaaccctgcacttcggccgggcggcggcgcagctgtcgatcgtgcaaccggcgctgagcatgcagatcaagctgctcgaaagtggcctgggcgtgcgcctgctggatcgcaatcgtcattcggtgacgttgaccgacgcggggcgtgccttcttacccgaggcccaagccactttgcaccaggctgcaaaggcggcggatgcggcgcgggcgtccagccgtggcgaaatcggccgggtgcgcctggggtttgtgtcttcggtgctgccgcaactgttgccgcagttgatccgcgcggtgcaccagcggtatccgcgtatcgaactggaactcaaggacatgcccggccccgaccaggccgctgcgttgaaaaacggcctgctggatttcggcctgatgcgcctgcccgctgcccatcccggcgtgcagacccgcgccgtgctgcgtgaaagtttttgcgtggcgctgccgatcgagcatcccctggccgcccaggaaaccatccaacccacggatctgctcaacgtgccggtgtacatcctcgcgcgacgttacgcgccggggttctacgacgaattcatccacgcgctgggcatcaccctggacatcgcttcggagctgggtgagttcaccaccatgctcgcactggtttctgccgggttgggcgttggtgtgttgccgcagcaagccgcgcgggcgctgccggccaactgcgtgtcgcggcacctggagttgggcgcatttgaggccagtaccgggctggcctggaccgagctggacagcgcggtaaagaccaccttgttcaacctgattgtggaattgtttggcgagtgattgtttcattggctgaaatgctcgattgtaaatcctggtgattccatcgatcagtgcagcggtagaacatggctggcgtcgataacccaccgtttggagccttgcatgtcccagcccttgattaaactctatggtttccctctgtccggccactctcaccgggttcagctgatgctgtcgctgctgggcctgcccagtgaatttatcctggtcgacctcaagcaaggcgcgcagaaagcgcctgagtttgtcgccaccctgaacagcttcggccaggtgccggtgattgacgacaatggcaccgtgttggccgattccaatgcgatcctggtgtacctcgcgaacacttatggcgaccgccaatggctaccgagtgaccctgtcggccaggcgcgcgtgcaacgctggctgtcggctgcggccgggcaactccattccgggccggctgccgcgcgattggccgtggtgtttggcgccgaggtcgataccgtcaccgccatcaaccgctcgcatgcgctgttgaaggtggtggaacgacagttgagccacagccgcttcctggccagcgaacagccgagcatcgccgacatcgcgttctacacctacgtggcccatgcgccggaaggcaatgtgtcgctggccgactaccctcaggtacgcgcctggctcgccagcatcgaagccttgccgggcttcgtcggcatgccgcgcacggcggtggggctgcaagcaaagtaacgtgaacacagaaaggtgcgacgcctattgtggcgagggagcttgttgtggcgagggagcttgctcccgttgggtcgcgtagcggccccagtaagaacaccccgcaccttcaagcactgcgcgatggcgtgtttgggtctgctgcgcagcccagcgggagcaagctccctcgccacaggtgagtgatttgtagccagtaaagtgagcgccgatggaccgatttcatgaaatgcaggtgtttctcgcggtggccgaggagcaaggcttcgctgccgcggcgcggcgcctgaaaacctcgccgcccagcgtgacgcgggccatcgccgcgatggagcagcgcatcggcacccagttgctggcgcgcaccacccgcagcctgcacctgaccgaagccggccagcgttatctggacgattgccggcgcatcctcgccgaactggatgaggccgaagaagcggcggcgggcagctattcgattccgtgtggtcacctgacgctgaccgcgccggtgctgtttggcgaattgtatgtggcgccggtgctgggcgattacctggaccgtttcccccaagtgagcatcaacgccttgctggtcgaccgcgtggtgaacatggtcgatgaaggcgtggacgtggccgtgcgcatcggccacttgcaggcgccggggcagcaggcgatcaaggtcggcgaagtgcgccgagtggtgtgcgcggcgcccggttatctcgaccaacacggacggccgtcgcggcccgagcaattgcggcaagcgaaaatcgtcacctcgtcttccagccagttagtcagtgagtggcggtttgtcgacggcagccagccgctgaccgtgcccatcgagccgcgtttagtggtgaccgccaacaatgcggcgatcaacctcgcgcgtctgggctggggcgtgacgcgggtgttgtcttatcaggtcgccgcgtcggtggcggcgggcgagttggagattgtgcttgaggcgttcgagccggcaccgctgccgatccaggtggtgttccagaaaagtggccgcgtaccggccaaggtccacaccttcgtcgacttcctcacccatcgcctggggcaggacgcggccctgaacccgtcgatgaaacggcgcagctgatggtgcgttatcgcgacatgcagctgtttgcggcattggccgggcaaccgagcctggcttcggcggcgcgtgacgcgcgcgtctccggcccaaccctggtgcgcgcgattgcgcgcctggaggcacgcctgcgcgtagcgctgctgcaacgcactacgcggggtgtgagcctgaccgacgccggcagcgcctacctgagcgactgcgtgcgcctgctggcggccgtggacgctgccgaagcctcggccaacggcttgcatgtgcagccccagggcaacctgcgggtgtttctgccgtggctgttcagccgctatgtgatggcgccggtgttggccggttacatggaccgttaccccgacgtgcgcctcgtcgcgcactatcacgactattaccccaacctgcacgaagaggggctggacgtggccgttctcgttggtgaactgcccagctcgtcactgattgcgcgaccggtcgggcaggtgcggcataggctctgcgcgagccccggctaccttgcggcccacggcgaaccccggcacccggacgacctcatacagcaccacttgatcgccagctccgatcaggtgcactgggattttcagcacggccacctgaaggcgcgcgcacgcctcagttgcaccacggtgcaaggcgcgatcaatgccgcggtacagggcgcagggatcattcggtgccagagctacccggttcaccaacacctgttgagcggccagttatgccgggtgttgcccgcgtttgagccgccgccattgccggtgcatgtggtctaccgagaaggccgccatgcgccgatgcgcgtgcgcagttttgtcgaccactgtgtggcggcgctgcgtgaacatccggcatttcagctggcgtaacagtggattgccaaacctgggcattctctcgatgcggggcagggcatagcctctacacatccaacttgaggtgatcgccatgaacctgatcgaacaatccccgtggcatgccggtgaacggcagatgcaggaaagtgccggtgtcgccgagcgcatggaggtggtcggggccaaagtgattcgtgatcatttgcccgaacagcaccgggatttctacccgttgctgccgtacctgctgctcggtgtggtggatgcgcagggcattccctgggcgaccttgctggaaggtgcgccggggttcgcccattcgccggacccgcagacgttgcagatcgacagcctgccgtccaaagccgatccggcgctggcggccttgcacagcggcgcgtccgtgggcctgctcggcatcgacctcaacacccgccgccgcaaccgcatgaacggccgcatcggcagcctggatcacgaggggttttcggtcgacgtggtggacaccttcggcaattgccccaagtacattcagctgcggcccgtcgatgcaatcgcgcgcaaacctggcacccaggccgagcacttgaacggcctggacgccgctgcgcaaaccatgattcgcaacgccgacacctttttcgtcgccagcttcgtggatgtggcgggcgaacgctcggtggacgtttctcaccgtggcggcaacagtgggtttgtacgtgtcgagggtaacgtgctgaccatcccggactttgccggcaacctgttcttcaacaccttgggcaacctgtcggccaacccggtggcggggttgttgtttatcgatttcgagtcgggtgacgtgctgcagattgccgggcacacgtcactgatccttagcggccctgaagtggccaggtttgagggtgcgcagcggttgtggacggtgaccgtcgagcacggggtacgccgcccggcggcgttggcgttgagatggcagtttgcggaattttcgccgttcagcctggcgatgggcggctggcaatgatttagggagctgccggattctttgtggcgagcagtccaaccgtggcgagcaggcttgccctgcgttgggctgcgaagcagccccaaaaccatgcagcgcgcagtacctgacgcaccgcgttcatcttgattgggggcgcttcgcaccccaacgcaggacaagcctgctcgccacaacaagcctgctgcctaaacccctgttgccccagttaatagtcaattgcgccaccgccggtgtttacccgcacgccatccttaaaagctaccgctgactcagtgtgaaaaccggctttctgtgggagctggcttgcctgcgatgcagacacctcggtatgtcagtgacaccttgttgatgctatcgcaggcaagccagcccccacagttgggtttgattacattcaggtcagcgccttgccagcaccggcgcattctcccaagccccgcccagcgccgtatacagattcacctccgccaccaactgcgccagccgatcgacaatcagtgcctgctgcgagctgaacagcgagcgctgcgcatcgaggaacgtcaggttgctgtcgacgccgctgcgatagcggtgttgggccaaatcgtaataggcctggttggccgcgacgaaatcccgctgcgcctcaagctggtcgttgaaggtctggcgggcggcgaggccgtcggcgacttcctggaaggcggtctggatcgacttttcatactgcgccacgctgatgtctttttgcagtttggcgtagtccaggctcgcacgcaggctgccggcgttgaagatcggcaggttgatctgcggctggaaggtccaggtacccgagccgcccttgaacaatcctgacagctccttgctggtgctgccggcgttggccgtgagggtgaccgacggaaagaacgccgcacgggccgcgccgatattcgcgttggcggcctgcaattggtattcggcctggaggatatccgggcggcgttgcagcaggtccgacggcaggcctgcgggcacgcgcgccaccaggtcatcggcgagcgggcgtgccggcaggttttcatccactgggccgcccaccagcagggcgaggttgttgaggtcctgggcgacttggcgttcatagcgggccacgctggcgcgcgtgctttccaccgccgtgcgcgcttgcaccacctccagcgccgaggctttgcccgcgcttttgctgcggctggtcaattgccagctgtggtcgttggccaccagggtttgctgtgccagggccagcagttcctggtcggcgcgccaggtcaggtaggcattggcgacgttggccaccaggctcaattgcgtactgcgccgggcctcttcggtgctgaaatacgtcagcagcgcctgttcgctgaggctgcgcacacggccgaacaagtccagctcatacgcgctgagccccaaggtcgcagagtagttggaggtaatcgcagacttgccggtgccggtcacatcccccggcaccttctgacgtttgccggcaccggtggcggacaccgccgggaacaggtccgcgcgctggatgcggtattgcgcctggaaggcctcgacgttcaaggcggctacccgcaggtcgcggttattcaccagcgcatggccaatcaactgctgcaatgccgggtcgtgaaacagctgctgccagtcgggcgtcgccgccaccgcaccggcctgcgccaggcggtagacgccgtcttgagggaactgggccggtacaggcgcggcgggccgttggtactcggggatcagtgaacaaccgctgagtatccacgccatgctgacgccagtgagcatgcatttgttcatcaggcgccaaccatccatttggccaagccatggcggccactcacgcccaacttggcggcggcgcgcttgaggtaggtttcaatcgagctgtttttcacgctgagtttttccgccatttgcggcacggtgccgccggtcaacaggcccaggcagacttcctgctcccgcgccgacaaggtgacgtcgctcagggacagccgcttgtagaactcgcgctgcaactgcgattgctccagttggctgtgcaccggctcggcctccgtgtgcggcgcctggcgcagtaactgcgcgtgccgctccatcagcggtaacagagtgtccgacaggcacttgagaaacgacaactcggccagggaaaatccctgttgcgtcggtgggcggtaaaacgaaatcacgcagcggcgattgccctggcgcgacaccaggttgcactggtgtgaactgcccagcgggtgtgcgctgtcggccttggccttcatctggatcagcagcgggtcctgcatgcgcagcatctgccgcagcagcgggtggtctttcagcgggtgcagggtttgcggcgcagacagatcctttttcaccccggcgctgcccagcagcttgatctcgcgcacgctgtcgcgcggttcatcgagggtccattcactgaggtccacgaggtggataggcacccacttgtccaccaggtgcaacatgctcgcggcgaaattctggtggccgctgtttgaaatcaactcgcccatttcggcgtagaaatgcgggcttttggcagtgccaatactacgggtcagactcatagccatctcatccttgatgtcgaaaaccgtcaacgggcgccctgggtctgcgtggggcggtccgtgttccttgaacgtaactcggcgttcgaaaggtcatttagccatagcgatttatcctacgtatgtagcggaaacgagggacacaacctgccataaaaaccacgtcattaattcgacgtttctgacgcctaattccgcatacgaaacgcggttatgggtttttagaatttattaaatatttgataaacaagagaaaaatacattttttaaaaacttctaagcgttatgacggcggtcatctatagccaatttcctacagccctttaatcgtttcagcaatgaaccatcagccaagcccgtttgcgtcccgtcaggtgtccgggtttcgggtgacagacacgcccggacccccatgctcaaatccggcaatttcggcgtattgggccagcgtgagcggccagtgcctgacacccatgagaaggatcttatgaagtattcctcaagcttgccggccagcttccccctcaccgccgcccaacaagacatctggctcgaccagctgcgcgtgggcgattcgccgctgtacaacattggcggttatgtcgatttcgccggcgccgtggaccccgacttgatccagcgcgccgtggagcggttggtggccaagcacgatgcgttgcgtacccaactgcacaccgatgccgagggcatggcgcggcaaaccttcgataccgaatgggtggtggaggtggtgcagcacgacttttccaggttgcccgacccgcaggccgcgacccaggcgttgatgcaggcgcaaatggcgcagccttacgccatgaccggcgagccgctgttcaggtttttcctggtcaagctcgacgacgatcatttccgcctcggcacccaggcccaccacctgatcctcgacggctggggcttcggccagatgctgcagtccttggcgcgcctctacaccgacctgcaacacggccgagaatcggagccgcacgcgccttcctatatcgactttatcgacaccgaccagcgctaccagcattcggcacgttacgcccgcgaccgcgcctactggctggataaataccagcagttgcccgagccattgctgacgccgcgccacaacgcgcaggcgccgagcaacacgcttgtggaagcgttcccggtggcgctgctcaaccgcatggagcaagttgccaaccgatatcaggcctcggccttccatgtattgctggccgcgatgtatgtgtatttcacccgcaccagccagcgtgacgagtgggtggtggggctgccgattcttaaccgctccaacgcgcgttttcgctctaccgtaggcttgttcacccaggtcagcgcggtgcgttttcagttcagcgagcagctgtcgttcagcgcgttggtgcgtggcgtacgtgaccagctcaagcaggatttccgccaccagcgtttccccctgagcgagatgaaccgcgaattgggcctgcgccgtaccggccgcgcgcagttgttcgacctgtcggtgtcctatgagcaggatgaccacgacctgcgttacggccaggtccaggcgcgggcgatcaaggtgtccaaccaccatgagccgctgccgattgccatccacctgcgcagcaaccgttaccaggacaccgcgtgcctgcattgcgtctacaacgaagcgtactttcagcacgatgaagtgcaggtgttggcgcagcgctttacctggctgctggaacagggcctggaaaataccgcactggcagtcggtgaattctcgctggtcacacctgccgaacaggcccaactgcagcagtggaatgccaccgcgcagccgactgccactctgcaaaccctgcatgggcgcatcgaggcacaggccgcgcgcacaccggatgccgtggcggcggtgcaccagggccggcaactgacctacgcccagcttgatcaacaggccaatgccttggccctgcagctgttggaacacggcgtgcagcccgatgaccgggtggcgattgtggcccggcgcggcctggagaccttggtggggctgttggcgattctcaagtccggcggctgctatgtgccggtagacccggcccatcctgccgaacgcctgcattacctgttgcacgacagtgcgccggtggcggtgttgacccagcaggatttactccaccgtttgcctgcgctggacgtgccgctgattcggctcgaccagccgaccattcaccacgctggcagcccgcgcgtggcggtcatgccgtcgaacctggcttatgtgatctacacctccggctccacagggttgcccaagggcgtgatggtcgaacaccacagcgtgtcgaacctggtggactggcactgccaggccttcaacctgcacgcgggcagccacaccgccagcgtggcggggttcggttttgatgcgatggcctgggaagtctggcctgcgctgtgtgtgggcgcgacactgcacttgccaccggcccacgatggcccggaagacatcgacgcgctgctgggctggtggcgcgcgcagccgttggacgtgtgcttcctgccgaccccggtggccgagtacgccttcagccagcgcctggaacacccgacattgcgcaccttgctgatcggcggcgaccgcctgcgcgccttcagccgcgcgcaaacatttgacgtcatcaacaactacggccccaccgaagccaccgtggtcgcgacttccgggcgggtcaaggtcggcgcgccgctgcacatcggcgcgccgatcgccaatgccacggtctacttgctggatcaacaacaacgcccggtgcccatcggtgtggcgggggagttgtacgtcggtggcaagggcgtggcgcggggttacctgaatcgccctgacctgagcgccgaacgctttcttgatgaccctttcagccaggggcgcatgtaccgcaccggcgacctggcgcgcctgttgcccaacggcaatcttgaatacctgggccgcaacgacgaccaggtgaaaatccgtggcgtacgtatcgaactgggcgagatcgaatccgcgctggccacccatccggcgatcaaggaagcggtggtgcagtttcgcgaagggcagttactcgcctggtttatccagcagcacagtgtcgatatcgaaaccctgcgcgcccacctgcaagcctcgttgccggagtacatgctgccggtggcctatgtgaagctggacgtgatgcccctcaccgccaacggcaaactcgaccgcaaggccctgcctgaacccacgcatcaggcctttgtcacgcgcctgttcgaggcgccacgtgagggcgtggaaaccaccctggcgcagatctggaccgagctgctgcaggtgcagccaatcggccggcacgatcattttttcgaactgggcgggcattcgctgctggccgtgcaactggtgcaacgcatgcgccaggccgggttgcgtgccgacgtgcaggtgttgttcagtcagccgaccctggcggcgttggcggcagccagtgtcggcagcgacgtgcaggtgccggccaatcgcatcccgaccgattgcacgcagatcaccccggacatgctcgtgctggccgagctcgatcaacccagccttgagcgcatcgtcgcgggcattcccggcggggcggccaatgtgcaggaaatctacccgctggcgccgttgcaggaaggcttgttgtaccaccacatcaccgatgaacgtgatccgtaccagcaatttgcgatgttcagttttgccagccgcgagcaggtggacgcgtttgcccaggcgctgcaacaggtgatcaaccgccacgatatcctgcgcaccagcctggtgtgggatgcccttgagcaaccgatgcaagtggtgtggcgccaagcgcagttgcggcttgagccactgcgcgaaccggctgcagcgctggacttgcgccaggcgccgttgatggcgctggactacgccgaagagccgcacaaccggcgctgggtcgctcgcttgcgctttcatcacttggtcaacgacgccacctcgaccacggtgctggtggacgagatccgcgcccatctgctcggccaacaggcgcaactgccggtgccggtgccgtatcgcaacgtggtcgcacagagccgttcgccgcaacgtctggcggcccatgaagcctttttccgtgagcgtctggcggatgtcgacgagccaaccctggcgttcggtttacaggagcgccaggcggatcgggctgaaatcgaagccttcgaccagccgctcagcgacgcgctcaaccaacgcctgcgggcgcaggcgcgtgcccttggggtcagcgcggcgagcctgtttcacctggcctgggcgcaggtgctcagccgcgtcgcgggccgcgatgacgtggtattcggcaccgtgctgctcggccgtttgcaggctggcgagggcgccgatcgcgcgttgggcatgttcatcaacaccttgccgctgcgcctgcgcctggccgggcaaaccgtgctcgctgcactcaacgacacccacgcccagctcagcgccttgctcgcccatgaacaggcctcgctcgcgttggcgcagcgttgcagcggtgcgtcgccgctgttcaacagcctgctcaactaccgtcacaccagcgccgacaccgacgttaacctggtgccgggcatcgccttgctcagcagtgaagacattctcagctacccgctgatgctcacggtggacgacgtggccagcggttttcggctcaaggccaaggcgccacgcaaggttggcgcgcagcgcttgttgagctacctcgacacagccttgcatggcctggcgcatgcacttgagcacgtaccgggcacgccattgcgcgacgtgcaggtgctgcctgccagcgaattgcaacgcttgttggtggacttcaacgccaccgccaccgactaccccgacacccttaccgtacaggccttgttcgaagcccatgcgcggcatattccgcatgccatcgcagtgcaagcgggcgagcggcaactgacgtatcgcgaactcaacgagcgtgccaaccagctggccttccacctgcgcgaacgcggtgtgcagccggattcgcgggtggcgctgtgcgtcgaacgtgggctggacctggtggtgggtttgctggcgattctcaaggcgggcggcgcctatgtgccgctcgacccgggctacccgcgcgagcgcctggcctacatgctcaacgacagccagccggtggcgctgctggtgcacgccgccacgcgcgacctgccgggcgaggtgtcgatgccggtgatcgattttgaccacaatgcctggagccaggcgcctgtcggcaatccttcggtgcccggtttgagcatggccaacctggcctacgtgatgtacacctccgggtccaccggcacgcccaaaggcgtgatgattgaacatcgcggcctgggcaatctcatgcactggggttcacagctgtgcccgaatgccgaaggcggcgcgttgttgcaacgcgcgccgttcagcttcgatggttcggtgtgggagctgttctggccgctggccaacggcatgcgcctggtgctcgcacggcctgacgggcaccgtgaaccggcgtatctggcgcaggtgattcgcgagcagcagatcaccgtgatcaagttcgtgccggcgatgttgcagcagttcctcgaactggaagcgtcagccttgtgcaccagcctcaccgacgtgctctgcggcggcggcgaactcaccgaagccctggcccgtggcgtgcaggcgcgtttgcccaaggtgcgcttgcataacgtctacggccccaccgaagccacggtggacagcagcgcctggaccctggaacccggtgaaccggtgccgaccctgcaactgccgattggtcgggcgatcaacaacacgcgactgtatgtgttggatgaacacgacgcgccggtgccgttcggtgtcagcgggcagttgcatattggcggtgtgggcgtggcccgtgggtatttgggcctggagcagatgaccgccgaacggtttatcgacagcccgtttgtggccggtgaccggctgtatcgcaccggcgacctggtgcgctacctgcccgatggcaacctggagttcctggggcgcaatgacttccaggtcaagctgcgtggcgtgcgcctggagctgggcgaaattgaatcacgcctggcggcgcacccggccttgcgtgaagtggcggtgctgattcgtgatgagcgtttggtcgcgtacttcaccttgcgcgggccagcgccgggcctggacgccttgcgcgcccacgtgctggagcaattgccggagtacatggtgccggcggcctttgtgcagcttgacgtcttgccgctcaaccctgccggcaagctggaccgcaaggcactgcctgcgcctgggttggagtcggtggtcagccgtgcttatgaagcgccggtgggggaggtggaaaccttgatgtcggggatttgggccgaggtgttgaagctggagcgggtagggcgccacgaccatttcttcgagctgggcgggcattctttgctggcggtgaatgtggtggcgcgcatgcgcaaggcgggattggaggtggatgcgcgaaccttgttcagccagccgaccctggcgcaacttgcggcgtgtaccgcgacacaggtgcagcgtgtggaagtgccccagaccgccattccccaacttaaccgccggcggcgaatttgaagaatgaagatggccaatgtgggggctggcttgcctgcgatggccataggtatctacacaacgttgagtgcggcgctagtaccaggagagggaacttgctgtctggcaacttacagctatctaactgatgcaccgcgttccaaatgtgggagggggcttgcccccgatggcggcctgacagccgaccagggtgctggatcagaccgagtacatatccattcctgcggtaacggctacttagtgttccgctcttacagcggctcactttttgaaggaccggaatgccggcccagcaaaaagtaagcaaaaagtcctcgtcccaccactcggcacctcgcttaggctcggtgtgcccgtaatccgacattgatttggggggccgccgccacgcgccatccatggcgcggggcggctaaaccggcatccctgccggtttaccccccaaatccatgtcgaattccggccagcgtggcttaacgggacgcctaagatcaaaagccagatcaagagcaagagcggctcgctgcgcatcgtggttacggttggcagatacacagttgtgtagatacctatgctgcgatggcggcacctcggtgtatcagtgacagggtgtcgatgccatcgcaggcaagccagctcccacattttattgggtgcagtttcaatcaacaggtcggctgtcaggcagccgccttcgcaggtttcaagcattcgatggaacgatccaccgtggccttggcaatctccagcaaatgccacaccgtcagaattttctcccgctgcgggctcaccagcagctcaccacaatcgagcgccgtggccgaagcactgtgcagcaagctggcggtatagagcagcgcgtcttcgaagctcaggtcttctttaacgctgtgaacaccttcagagggcaggtagtggtcgatggcgcggttgaacgcggcgcggtcttttgcgggattgagcgggggattgggcgtaacttttttcattgagtagctcctgattaagtcagaagccggcccgatcgcgactaaacgaatgggtggcggctgtacgcaggttagtcgaccggctaatcaggagaatccggcgcacccgaaggcgccctgcgcacagccaccataaaacctcatggaggacgatgcacctgattaagaatccgggcgactaaacccgatcactgatgagcagtgacggaccgcagaccagccaccgattccagcaggcacaaggcggcagggattgtctaggaaacgtcctgcaattaaaagggacacagcttgccggccctttacaaacgatgaccaaatgccatgaccgtcatggtgcacgatggtgaatgactaacggcacataaggaacattccgtcagagactggcacgagcatcgtacagccagtggaaccactttcctgtcataacccaataggagacacggcgtacctgttcgggcgcccttcaacacttattcagcaggtgcctatgtccttccccattggttttcaacctcctagtattttcccggatgctcataaaaacagccaagccactgagcaaaaaccaacattcacccctgatgggaaccccgttcgtacggtgtctacccactcgtcaatgccgccggcatcgcgaggtgaaatgaacacgtcgcacctgcctgcgcgcggagaaaccaggcctgtggatgatcgacgttcagcatcggaaatctccgaaaacaaccccattttgaacgtaggaatactcgaggagaaatggggcaggggagcgctgggtcacgcgcgctgggaagccttgatcgatggcctgaagcaacaggtgggtgactttacccctgccaatacagaccctgaatcgcgtaatgaggccatgtttcgcttggcgcgtgtggttaactacattgatcacgatccgggcgttgaaaggatcagaaaccattctgtcggggatggatttttggacgctatcggctcttacgattcttcttccgaggtgggccgcctggaggcgttcagtcagcaggggtaccccgcgctggaggaggttttcaacggtcgagtgaggggcgactaccgtacagtcgaagaaattacagatggccctttgttcaaggggcttcacgcggccctgagtgatgaggaactgaacgctttcaaggcgaaaataggtggagattgggaaagccccgaattccccgcagaccgcagagctgaacttgctgctaatgcagagcgagtgctgcaaatcattgatagaaaaggtggcaaagaatcgaccgccggtaacggcaagatagatggcttgagagaatacgcttccttacttcctaatctgtttcaaccagacttcctttacacgctgccgggctctgaagcgcgccggttggtacagttcgccactactgggttttccgctttgcaccaacaatgatagcgcgctacgggcggtggctttgacggccaccgttgtgcattgcgatgacttctacatgctcagccagcagcgtttcaaccgcttcacggatgcgcagggctttattcacgcggcaagcccgccaagcatttaaagcaggcgttgtcaggtaaagcaggcgctgtcaggtgctgtcatttacccgatggcacgaacgccacgctgccgctcgtacgcttctggaacatccgctcgccattgtccggctgggtggtgatcaccttgtgatccgcacccagataggccagcggcgtagggtcttccttggaatactgcgcgacgataatggtgtgctgcgggtcgaagccctggccgctggttttctgtagccaggccatcagcgcggcgctgtcgccctggcgggggtagtcctgggtttcgctcacgtagtagaacggcttgccgccattttgcaggtacatcggcagcttgttgtcgacttccaccagcactatttgccactggttccacggcgcacttttgacggcttcggcttgcacgtcttcagcgaagcgggtcacgccgccgttgccggtggtccagggatagatcacaccgagtaccagcagcaacgcgcccgcggtaaggccgaaacctttttgccagcgtggccaactggccgttttttgctgcaggcgctcactcagccaccaggcggccaacaattgcgcaaacggcaccagcggcaacacgtaataactgcgacggctgccactggcggtgaagaacacaaacagcaggcccaggccccacaccagccagcgtaagttgggtggcgtttgccgccaatgacgcagcgccaaccacaagccgagcagccagcatggcgcccagggcagggtgtaggcgggcaagtagatcaggtaggtgtagatcggccccatgtggtcgaaggggtcgaagaagcgcacgacgttttccttgaacaccagttcaagcccgctctcgccgtaagtgggtgcgccatacaggtgggagagtacgaaggggatcgaatagaacgctgccgcaatcagcatcgccgccaacaggcgcaggttgaggtggcgcttgtagcggtgttcgctgagcaggtgcggcaacagcaccaggccgggcagcacgaagccgatcaagcctttgaacaatgaggtggccgccaacagcaggaaaaataccgtgtagcgccccagccgggtgtcatccggcccgcgccaataccaccacaccgccgccagcacgccacacacggtcagcacgtcggcggtggccacgcgcgcccagaacagaaagtagaaggtggtggccagcatccagccggcaatcagcccggtgcctttgcgaaacagacgttcgccgatcaggtacaccagccagatgctcagccacgccgcaatcaccgacgacaggcgcagcgaccacgggccgagcccgcccagcaagttggcgaagccggtgatcagccagtaggagggcaggggtttgtcgtagtagggcgcgcccttcagataggggtcgaagtagtcaccgctctgcaacatctgcaaggcgatgttggcccagcgggtttccggcccccacaagtcgcgactgcccaggcccagcagcaggagtaaagccgagacgcccagcagcaacagcagggcgccgcgttcggttttccacacgctcatgggcggttctcacggcaggcgtaacgttaaggaagcttcgggtagatgatcagtagcagggcgcccttgcgatagcgcttgcctcccgctggcagttgcccttcttcgcggtgctcgctggtgcttctgacgcgcatcagcacaccgaccgagccttgctggcgcgcatcggcgagccacgcctggacgctgtccagatcgactttgcggtgtatcgagtcggcatacttgaggccatagcgcagttcgccctcggtgtcgtaaaacgccacctcagggcggcgcaggcgccaggacaaggcggatgccgagcccaactcattgctgatcagagcatgggtttgttgcaattcatccatgtgttcaagcacgaactgatcgggcatttcggtatcggtgatcatctccggcatgccggccggcaacagcgccaccagcaaaccaatgcccagggccggcattgcccacaatgtcagcgggcgaaccgcttgcagcaggttggccaggatccagaacaacagcacgataaaggccagcgacaggctgaacatctcggcgtggctgtgcccgtacatcgggttactgacttgcaggtagatcagccccaccatcgccaccagtccgatcatggcgttgaccaggccgttgatgaggatcgcgcgcggcttgccgtgtttgatcagctcgaccagcgcatggcccatcagcaacgccaatggcagcaggcacggcatgatgtaggtgggtagcttgcctttgctcaggctgaaaaaaaccagtggcaacagcagccataaggccaggaacacaatcgacggttggcctttgtctttccaggccttaagcacggtgctgggcagcagcgcggcccacggcaggcatgccaccaccatgatcggcaggaagaaccaccaggcccgcgcgtgctgggcattgtcggaggagaagcggcggatatgctcgtgccagaagaagaaccgccagtagtccggttcctgcagatgaatcgcccacacccacggcaggcaaagcagcagcgccacgccaatcgccagcgggccgtagcgcagcaactcgcccaggcggcgctgccagagcatgtacggcacggcgatcagcaccggcaacagccaggccagaaaacccttggtcataaagcccatggcgcaggccacgcccagcattgcccaggcgcccagccggccacgcggtgtgcggctgtccagcgcgaaccacagcgctacgaggctgaggttgacccacaaggtgaattgcggatcgaggttggagtagcccgcttgcccggccaccagcccgaagctcatgtagagcagggcgcaggcgaagctcttgcgtgggtcgttccacaggcggcgtgcgatcaggtaggccagcaccacgctcaggccggtggtcagggccgaggcgatgcgtacgccgaacaggttttcaccaaacaccgcctgcccaagggcaatcagccaatagccggcggcgggtttttcgaaatagcgcacacccatgaagtgcggtgcgacccagttgccgctcaggagcatttcctggctgatctgggcgtagcgggtttcatccggtatccacaaaccgtgcaggcccatgggcaataggtaaaacacggcgaaggcgagtagcagtaatggcaggggtttcaaacgggtcatgaaaacgtcgctccttgacgtttagtggttgagaagtggtgtaagcaagtaggagttataagaatcacaacgttcactaagtcgatgaaagtattcatgacatccaaaaatagcgggtgcaacgaaacatgccagaacgggcctgtcgtattcctgaacatgcgtcgtgatagatgtaaaaaattgttagagctttttcagaactgcggcccaggcctggctgttcatgaggcccagtgtttcgaacttgccgttggctttaacccggatgaacagggcgctgccgtattcggggaacgctgcacgggggaagcccagggtggattcgaagtcggcgatgcaaccactgtgagtgacaaataccaggttgcgcccaggctgtttgtggctgagcaattcgtcgcccatggctttgccgcagatggcctgttggccggaggtcagctcggctttaccgaacatgaattgcaaggtctgggccgtgcgcagggccgggctggcgagcacatcgctgccttccatgccgagcctgatgaaggctttgcccagcgcttgtgcgcgttgggtgccgacgaccgtcaggcctttaggtgcgccaaagcatgggtttgccgagcgatcgcagcgctcttcatggcgcaccagcacgatcaaatcaccatcgcgccagctgggtaaaacttgcgacgtcagcaagcgattgccgatgcccaggtcgcgtggcgatgacggccacagcaggaagccggtgagcagcaaggcgatggcggcaaggcctgcgccccactttcgcagccgcttgatagaggcccggcgcgagcgcggtttggtcagggtaaggtcaaccacatcattcaccatgggcactgtcgaagcagtgttttattcaagtaggcgcaatgcattgacgaatgcccgtcgtggagtaagagactgtcacagggctgctgtcttttcgctgaacacgttgcggttagaaagttgccatgcaaggcaactaacaagttgccgattagcggcacttggcgggcaatttagaggggcgggggtgggcaagcagtgaaatccatgtgaaaaatttgcgtggggctggcggtcagccgttattctcgttcggagtccttcgagcgagcgttcttatgttgcaagtgcaaggtgttcttaaaaactatgccaccccgcaaggcccactggcagtgctggcaggcgtcgacttgcatttgggtgagcgcagcagcctggcgctgatgggcgagtcgggcagcggcaaaagtaccttgctgcacctggtggccgggctggatcgcgtggacggtggcagcatccaggtcggtgagcagcgcctggatcagttgagcgaggcgcaactggcgcactggcggcggactgaaatcggtctggtgttccagcagttcaacctgatcggcagcttgcgcgtcgacgacaacctggccttccaggcgcgcctggcggggcgctatgacccgcagtggcaggcgcagttggtcgagcgcctggggctgggcgacttgctcaagcggtatcccgagcagctgtccggtggccagcaacagcgggtcgcagtggggcgtgcactggcgtcgcgccctgggttgctgctggcggatgaacccaccggcaacctcgacgaagccaccagcgatgaagtgctgcaactgctgctggacctgctgcgcgacagccccaccagcctgttgatggtcacccacagcccgcgcattgccgcacgcctggaccaacaggtggtgctgcatcgtgggcgcgtcgtgcctgcggatgcacgctgagatggccgtattttattgggcgttgcgcgcgttgctgagccattggcggcgccacccggtgcagtttttcagtgtgctcacgggcctgtggttggccaccgcactgttgaccggcgtgcaggcgcttaacagccaggcgcgggacagttacgcgcgcgccagccaactgatcggcggtgagccgcaggccagcctgagtgcgccggacggcgcgagctttccccaggccatgtttgccgagttgcgccgcgccggttggccggtgtcgccggtggtgcaggggcgattgctgctcaaggggcacgaagaccaacgcctgcagttgatgggcatcgacccgctgtcgctgcccggcggtggggcggtggcggggcagcggttgagccaggcgcagatggtcgcgtttttcaacccgccggggcgcacctggatcgcaccgcaaaccttgtcggccctggggctgcgcgaaggtgagcaaccgctcacggccagcgggcaagccttgccgccgttgcaggttcagcaggacatggcccccggcgtattactgaccgatatcggctttgcgcaacccttgctcgacatgcccgggcgcctgtcacgcctgctgctggataaggccttcgccgccacgcatcccacgccacccgccgcgctgcaactcaagcagggcgaggacaataacctcgcgcggctcaccgaaagttttcacctgaacctcgacgccctgggttttctgtcgtttgtggtagggctgtttatcgtccacgccgccatcggcctggcgctggagcaacgccgtgggctgctgcgtacgtttcgcgcctgtggggtcagtgcgcgcatgctgattctcagcctgggtgtggagctgggtgtgttgtcgttgctcggcggcgtgctcggcgtggccagcggttacctgctggccagcctgctgctgccggatgtggccgccagtttgcgtggcctgtatggcgccgaggtgccgggccaattgagcctcagcccgtggtggtggatggccgggttgggcttgagcctgttgggcgcgctgctcgcgggtggcagcagcctgtggcgggcggcgcgcttgccgttgctggcgctggcgaacgcccaggcctggcacgacgcgcacgggcgctggttgcggcgccagggttgggtggcggcgactgcgctggtgatcgccttgctggcactgtggctgggcgacagcctggccgccggttttgtgctgatggccgccttgctgctgggcgcggcccttggcttgccggtggtgcttaacggcctgttgacggcagtgctcgggcgcagccgttcggtgctgggccagtggttcctggccgattgccgccagcagttgccggccttgagcctggcgttgatggcgttgctgttggcgctggcggcgaatatcggcgcgggctcgatgacctcgggcttccgccagacgttcaacaactggctggagcagcgcctgacggccgagctgtacctcaacccgcaaaccccggcccaggccgagcaactcacgacctggttggcgcagcagcccttggtgcaaactgtgctgccgacctggcaagtcgccgtgcaattgcagggctggcctgcagatgtcttcggtgtggtcgacgaccccacctatcgccagcattggccgttgctgacggcggcgagcgcgccgtgggaccaattgcagcaagacgacacggtgatgctcagcgagcaattggcgcgccgcttgaacgtgcagttgggcgatgcgctggctattccgacgccgcagggtatgtggtcgccgaaggtggtggggatttacgccgactatggcaaccccaagggccatctgctggtcaattcgcagcacctgctggcgcactggccggcgctgacaccggcacgcttcaacctgcgggtgttgccgcagaatgtgcaaccgctggtgcaagaggtgcagcgtgcgtttgcgttggaagacagccgcatcgtcgatcagcagcagctcaaaggctggtcgagccaggtgttcgagcgcaccttcgccgccactgccgcgttgaacagcctcacccttggcgtcgccggcgtggcgctgtttatcagcctgctgacccagagccaaagccgcctcggccaactcgcgccgctgtgggcgctgggcgtgacgcgacggcaactgatgctgctcaaccttggccagacctggctgctggcggtgctcaccctggtgctggcattgccgctgggcctgttgttggcgtggtgcctggacgcggtcatcaacgtgcaggccttcggctggcgcctgccgttgcaggtgttcccgtggcaactcgcgcaattattggggttggcgctgttggccacgttgctcgcctcgacctggccgctgtggcagctgtaccgcagtcgcccggcggatttgctgaggacttttgccaatgaagattaaagcgctgtggtgggccgccgtgttgctgctgacggcatgcgacaaagcgcctgcaccgccggaaagtttcgccggccttggcagcgctgcggcggactttgcccaggtggtgcccggcaaagtcttcagctttcccgaggaccacggcccccatgacggttttcgcatcgagtggtggtacgtcaccgccaacctcaaggacgcgcaaggcaatgtgttcggcgtgcaatggacgttgtttcgcaatgccttgaaggcggggccgacgcaaccgggctggcacgactcaaccatttggctcggccacgccgccgtgacctccgccacacgccattacgccgccgaacgctatgcccgtggcggcgttgggcaggccggcgcccaggcgctgccgttcaacgcgtggatcgacgactggaatttcgccacccgacccggcgcaaccagcccgttggccgacatgcaactcaaggccggtggtgcgcaattcgcctacgacctgcacctgacctccagccgcccgctggtgctgcagggcgacaacggctacagccgtaagtctgatcagggccaggcgtcctactactacagccagccgttttttaccgcgaccggcagtgtcagcatcgacggcaacacctatcaggtcagcggcccggcctggcttgaccgcgaatggagcagccaaccgctggcggccagccagaccggttgggactggttctcgctgcacctggaccgtggcgagcaactgatgctgtttcgcgttcggcaaacagacggcgcgtgctatctcaccggcacgtggatcgatcaacaaggccacacgcagaccttgcacaacgccgatatccagctcacacccgtggccaccactgacatcgacgggcgcagtattcctacacgctggtcgctgaaaattcccggtaaacagttggatatcaccacacaggccgtcaacccgaaggcgtggatgaacctgagcattccctactgggaagggccggtgcagtttgacggtggcgtgggttatctggagatgaccgggtattgatgcgccttttttgtaggcgcttgagcggttgacctatttttcgaggggcaaattttttcaaaaaaatactgtacatacatacagtcgtgttctacattctatcctaggtgaccggatgtcaccgatcacctgagcttcaattttttaactatggatggataaaaaatgaaacctgcaaaagcctttatgctgggcgcggccatgatggcctcctgctttatttcggcctctaccctggccgagcaaacccttcccacactcacccccggcacggtcaaccagaccctgattgacgcgctgaaaccgggcggcacgctgacgccggtgccgatctcggacgaggtgctgcaaaagtttctcgacgccaaaaatggcaaggtaaaacccgctgtcaaagcagccaaatccgcaccgttcaacaccgccgtcggcgagttgaaaaagccgagccaggccaacctgaaaagtgctgccgtcgccgcctttgaaccgttgttcccaaccctggatatcaacaccctctacaccatcgaccaagtgcaaacgggtcaggagtttccttaccacttcaacctgccgcacaacgcccgtgtattggtgcagttgatcaaccagagcgccggtgccgatatgtcgctgagcctgttccgtgatgacggccagggcaatccgcaactgatcgacacctccgacagcccaggcaacgctgatgaatacctgggcggcatcctgccggcgggggattactactggttcatggtggccaagaccgcgagcaacgcgcagttcagcttcggtgtggcggtggacaccaatatcgatgcctatgaacccaacgacacgccgcaaaccgccttcgcgctgccggactcgatgaacaaggtgaccggcaacctcgacaacgccaatgacgtcgattacttcgacttcaaggcggtgcgtggccaaagcgtgagcatgtacctggcgggcgatgagagtggcagccgtaaccagtggatcttcgaccgcttcgatggcgtgaactggatcaccgtaccggccggttccacctcgacttacccgagcgtcacgccgggctctaccgtcaaggtgcgcgtacgcgccaacccggccgtgacacaggacccgaccaaacagtacagccttagcctgggctctacgcctcgcttgaacagctcggatgtgaagggcgacaacatcgtgcgggtgccggcctcggtattctggatggcaacccaggcggggcggacgttgacctggagcaccaactggtccgattccacgggcgcaccgttgttgggtgtcacgccgatcctgcgcgtcgacaagcactttgtaggcaccgagtacaactggaccgactacaaggccaccaccaacagtgcgggcacgtccctggccagtgccgcactcggtacctgcttcggtgaaaaccgtgtgcggtacccggacagcagcaccggcgtgaagtacaactgggagaccaccttcaacttcggcggctggcgtatcgagctggacgaatacccaggcgtgggtgtcggtggtgacaatgtgtcctatgtgaccttcgggcacatctgcacccaggatatcgttcactgatccattgctgcaggcgtgaaggggcagtccatgcggactgccccttttttaattgcagggtttattcgcaggatttattcgcgggccagtgcgagcttcaagggcaggcgcgccatgctcgtgctgttcagcgagcccaggtacaaccagtcgccatattcgcgcgcggtggtgatgggcgagtaattgcccgcgctgtcatcctgcaaattggcgatgaccttgccgtcggtgtccagccccagcacgaaggctttgcgctcgatgggcttgggcaccaccatcagcgcgcgcaccatcaccttgcgcatcagcggatagccggcgaacccatccagcaacgggttgcgcggcgaatacagggcgacccaaaagcgctcgttgccgttgaaactgaggttgtccggcaggcctggcaggttgtcgataaacaggtcgtggctgccggtgcgctcgccttttagccagtagcggctgatgcggtaggcgccggtttcattcaccagcacgtagttttcatccgggccgagcgccacgccgttggcgaattgcaggtggttcagcaacacctcggtggtgcgggttttgaagtcgtagcgcaacagccggccatcgccaccgtgctcgatcacggcttcgccatcctggccgtagccccagcggcttgaggcatcactgaaataggcaaagcgcccactggcatcgatggtcacgtcattggtaaaaccaaagggcaggccgttcgcgctgctgctcaacggcgtgagttggcgatgggcatccagtgcgagcaagcccttgacgccgtctgcgatgatcaagcgcccatccgggtgcagcgccaggccgagcgggcgcccaccggtattggcgagcacctctaaggtatgactgtcaggagatgtgcgaatgatgcgcccgtcctgcaggccgctgaccagaaagccctgggcatccaataacaacgcttcaggcccggcgatgtccggcgcgccaatgcgttgtaccgcctgaagccgctggttctcggcgtaggtgccgtgtttcagcgaaggcgccttgggcggggcccagttcaccggttgtacgtgggtgggcatcagcagcagaaaggcaatcagcgccagtgatagaacaaacagcccatggcgaagatttttgcggcggtggttcatgactattcctggttgtcgtgggcgttcggttcccagtgcagagtgccgaacaggtaatccatcagcggtaggacgatattgaaattgcgcccctgcatcagctcacggcgatgatgcaacgcgtgcagttggtgcatctggcgaatccagggcaggcgcgccacggggtgattggcgggcaggtgctcgcaggcgtgaaacacttcgtaaagtaaataaccgaggatcatgcagccagcaaacagcccggcgatgttcgggctcaggtgcgcgagcagccaccaggcgggcagggtgatggccaggctgtgcagcacgatcagccacgccgggaacaggatcacgcgccagtcccgtgggctgtcgtaggtcatgtgaccgggcgtgaagaaactgtggtggtcgccggtatggcgtgcataaaacagcttggcgaggctgtgtttgtgatggcccaggtggcggtggacgaggtagatgcacaggttgaagaacaccagcgtcagcggcaccgtcagccactgcagcggggtgatggcctcggtggtggaccaggccagggtgatgcagaaaatgccgtaggcaaggacgaaaccggcgtgcagccatgggtggtaatggcggcttatggcggcgcgatagcgggcacggaaggtctcggtagggtgggccatgacgggaagctcggtatttttttgttggaggctgagcttagttgccgctgagaaatgtgcgagtttttgccctgcgcatgagacccatgtgggagctggcttgcctgcgatgcaagcacctcggtacatcaggcacgccgggttgatgccatcgcaggcaagccagctcccacatccgaagcgaccagtgggggcttgcacagccccgatttacttgctagtttctcgcaaaatgttaacgataacatttgctctaaaaataaaaacaaaacagagaatcacgccatgaaaatgctcccgaaaaccctgtgtttactggctgtcagcatcaccctcggcgccgcggcccctgcctttgccgacgccgccaagcccatccgcatcggcgcgtccttccaggaaatcaacaacccctatttcgtcaccatgaaaaacgccctggaagaagccggcgcgaccatcggtgccaaactgatcatcaccgacgcccgccatgacgtgtccaagcaggtcagcgacgtcgaagacatgctgcaaaaaggcatcgatatcctgctgatcaaccccaccgactcggtcggcgtgcaatcggcggtcaaatccgcccacgccgccggtgtcgtcgtcgtcgcggtagacgcccaggctgacggcccgctggactccttcgtcggctcgaagaacttcgacgccggcttccaggcctgtgaattcctggccaagaacatcggcgacaaaggcaacatcgcgatcctcgacggcatcgccgtggtgccgatccttgagcgtgtgcgcggctgcaaagaggccgtggccaagcacccggacatcaagatcgtgagcatccagaacggcaagcaggaacgtgaccaggcgctgaccgtcaccgaaaacatgctgcaggcccagcccacgctcaagggtattttcagcgtgaatgacaacggctccctcggcgcactctcggccatcgaagccagtggcctggacgtgaaactggtcagcgtcgacggcgcgccggaagcgatcaaggcgattcagaagccgggcagcaagttcatcgccacctcggcgcaatacccgcgcgaccagatccgcctggccctgggcattgccctggccaaaaagtggggctcgcaagtgccggccaccattcccgtggacatcaccttgatcgatcaggccaaggccaaggacttcagctggtaactcgcccaggccccacctaaaccgtggggcttgagctctccttctgaatacgaggtcggcggtatgagcagtcttctgaagctggaaaatatctgtaagcgttacccaggcgtacaggccctcaagtccatcaacctgcaagtggagcgcggcgagattcatgccttgctcggggaaaatggcgcgggcaagtcgaccctgatgaagatcctcggcggtgtcgagcatcaggacgaagggcacatcctgatcgatggccaggcgcagcagttcgccacctaccgcgacgccattgccgccggtatcggcatcgtgtttcaggaattcagcctgattccctacctcacggcggtggaaaatatcttccttggccatgagctgagcaaccgttttggcctgttgcgcaaacgcgcgatggtcgaagcgtccgaggcgttgttcaagcgcctgggcgtgagcatcgacctgcagtgcgcggtcaagcacctgagtgtggccgagcagcagtttgtcgaaatcgccaaggcgttggccctggacgcacgcctgctggtgctcgatgagccgactgcgaccttgacgcccagcgaagccgagctgctgttcgagatcatgcgcgagctcaagcgccagggcgtggcggtgatttttatctcgcaccacctggaggagattttccaggtctgcgaccgcatcagcgtattgcgtgacggcggcaatgtcggcgtgaccgatgtggccgacagtgacatcgaccgcctcgtcgagatgatggtcggtcggcgcctggaaagcagttttccacccaagccgagcaaagcacgcggcccgctgttactcgaggtcaaggacatccagttggtgcgcaacggcccgcgcaacagcttccaactgcacaaaggcgagattctcggctttgccgggctggttggctcaggccgcaccgaactggcgctgggcatgatgggggcgctgccgtcggtgagcaaagaggtgtggctgcgcggtgaaaaagtcaccctcgatgatccggcccaggcgttggcccacggcatcggcctgctgccggaaagccgcaagagcgaagggctgatcaccgacttcagcattcgcgaaaacatctccctgaacaacctgcccaaataccaaaacgcttccgggctgatcgacaaggccaaggaatgcgccagcgttgaagacctgatgcgccagctgtcgatcaaggcgcccagcagcgaaagccgggtgttcaacttaagcggcggcaaccagcagaaggtggtgattgcgcgctggatcaaccaccactgcgacgtgctggtgttcgacgaacccacgcgcggcatcgacgtcggtgccaaggcgcagatctacgcactcatgcgcagccttaccgaacagggctacgcgatcatcatgatttcctccgaactgccggaagtcatcggcatgtgcgaccgcgtcgccgtgttccacaagggcgccatcgtcaagctgctcgaagcgtccgccgtcaacccacaagaggtcatgcgccatgcaacagggggctcaagtgaatatgtccattaacaccggcgacacccgccggctgcgcctgaacctggcgcggctggtgcgctcgccggcgttctaccccttcgtggggttggtggtggtgacgctggtgatgatcttcgccagcgataacttcctcactgccagcaacctgtcgaatattgcgcgccaggtgtcgatcaacgcgattatcgcggtgggcatgacctgcgtgattctcaccggcggcatcgacttgtcggtgggcccggtgatggcgttgtccggcaccctgacggcggggttgatggtcgcgggcctgccgcccggcctggcgattggcgccgggatgctgatcggtgtggccttcggcatcggcaacgggttgttcgtcgcttacctgcacatgccaccgatcatcgtcacgctggcgaccatgggcatcgcccgtggcctgggcctgatgtacaccgacggctacccgatttccgggttgccggaatggttcgggttcttcggccgccaaagtctgttcggcattgaagtgccgatcctgatcatgctgatcacctacttcgccgcctacgtgctgctgcagcacacgcgcatcgggcgctacatctacgccatcggcggcaatgaagaagcggtgcgcttgtccggcgtgcgcgccgcgcgcttcaagctgctggtgtatggcatcagcggcctcacggcggcgattgccgggctggtgctgacttcacgcctgatgagcggccagccgaatgccggcgtgtcgttcgagctggatgcgattgcggccgtggtactcggcggcgcctcgattgccggtgggcgcggggtcatcgtcggcaccttgctcggcgccatgctgctcggcgtgttgaacaacggcctgaacatgcttggcgtttcgccctacgtccagagcgtgatcaagggcgggatcattttgctggcgatttttatcagccgtcagcgccataaataaactcctacaagacaggaccgaacaccatggacaagcacaccgaaatgcaagccgtcgtctgccacggcccgaaagactaccgcctggagcgcatcggcaaacccaaggcgcgccccaatgaactggtgattcgcatcgccgcctgcggcatttgcgccagtgactgcaaatgccattcaggcgcggcgatgttctggggtggcgacaacccgtgggtcaaggcgccggtggtgccgggccatgagtttttcggctacgtggaggaagtgggcgagggcgccgaggaacactttgaagtcgcggttggcgacaaggtgattgccgagcagatcgtgccgtgcggcaagtgccgcttctgcaagtcgggcaaatactggatgtgcgaggtgcacaacatcttcggcttccagcgtgaagtggccgaaggcggcatggcccagtacatgcgcattccgaagacggccatcgtgcacaagattcccgagtcggtgtcgctggaagactcggcgctggtggaacccatggcgtgctcgatccacaccgtcaaccgtggcgaaatccagctcgatgacgtggtggtgattgccggcgcaggcaccctgggcttgtgcatggtccaagtggccgcactgaaaaccccgaaaaaactggtggtgatcgacatggtcgacgcgcgcctcgaactggccaagcagtttggcgccgacgtggtgatcaacccgtcccgcgacaacgcccgcgacatcatcaacggcctcaccgacaactacggctgcgacgtgtacatcgaaaccaccggcgtgccggctggcgtgacccagggcctggacctgatccgcaagctcgggcgttttgtcgagttcagcgtgttcggcgccgagaccagcgtcgactggtcgatcattggcgatcgcaaagaactcgatgtacgcggcgcgcaccttggcccgtattgctacccgattgccatcgacctgttcgaacgcgggctggtcacctccaagggcatcgtcacccatgacttcccgctggatgacttcgccgaagcgttcgagttggccaattcgaccaagtcgatcaaggtgctgctgaagccggtggtctgagctatgaactatgtaatgggcgtcgacattggaacccagagcaccaaggcactgctggtggatggtcaaggcacgatcatcgcccagcacagccagggttatcgcgtggataccccgaaagtgcgctgggccgagcaatggccgcaggtctggctggacgccgtcgaggcctgcgtcgcgcagtgcatggccaaggccggcgtggcgcccgcgcaggtcaaggcgctgtgtatcagcagcctgtacggcggctcgggtattgcggtggatgcgcagattacgccgctgcacccgtgcctgatctggatggaccgccgtgccggcgaacaagtggcgtgggtgcgtgagcatgtcgacctggagcgtttgttcgcgatcaccggcaactcggtggacagctactacggcttcaccaagatgctctggctcaagcagcaccagccgcaggtgtgggccgaaacccgctacctgctgccgcccaacagctatatcaactggtgcctgaccggcgagttggcggtggaccacagcagcgccggcaatgtcggcggtgtctacgatgtggcgcagcgcggctggtccgaagagatgctcgcggcgctgggcatccccttggcgatgatgcccgagcggctggtgtattccggcgacgtggtgggcgggctgctggaaagctgggccacgcgcctgggcctgcaggcgggcacgccgattcttgccggtggcgtggacgccgccatggcgacgttggcggcgggtgtcacgcaaccgggcaaccatgtggcgatgattggcaccagcatgtgttggggctacttgaaccagcacgtcgatgcacgccatggcttggtgagcatgccgcacgtctacaacggccagcgcgacctgtacatcttcggcggggcgatcaccgcgggcgcgtcggtcagctggtttcgcgagcagttctgccaggccgaggaacagcaggccaaggccaccgggcaggacagcctagtgttgctggagcagagcgcgatgaagatcccggccggcagcgaaggcttgttgttcctgccgtacttgatgggcgagcgcagcccggtgtgggatgaccgcgccagcggcagttttgtcgggctgaacctgtatcacagccgcattcacctgtaccgcgcggtgctggaaggggtgagctttgccctgcgccacaacatcgaagccggaacccagggcgcgcactcgctggacccgcgtttgattgtggtgggtggcgcgagccattcggatttgtggatgcagattattgcggatgtcacgcggtatccggtctacaccatcgtgcaggaggtggaagcggcactgggcgcggcattgttggcggcgcacacggtggggttggtgagtgatggggaaatggagaagggctgggtgcaattggcgttgagggcgcagcccaagcgcgagaatgtcgtggtttacgaccatgcgtttggcgagtatttgaagttgtatcccgcgttgaaacccatcatgcacaccctgcaaaccaactgaatttacacacggcccaaatgtgggagcgggcttgctcgcgaatgcggtgtatcagcagcagatttttggctgacacaccgcattcgcgagcaagcccgctcccacaggggatcttcattgttttgagatctatacccatgaacgcagccttcaacttcacccaccaacgcatcctcgtcaccggcgccagcagcggcatcggtcgcgagatcgccctgcaactgatcgccagcggcgccgaggtattcgcgctgggccgcgacgcgcaagccttggcaacgttgggctgccacagcctttgcctggacatcgccgacagcctcgccctcgacaacgccctgcaagacctgcccccgttgcatggcctggtcaactgcgccggcatctcgcgcctggaacccgccgccgcgatcagcgccgaggcgttcgaccaggtgatgcaagtcaacgcccgcgctgccgcccaggtcgccagccgtgtcgcggcaagcatgatcgaagcgaagatcgccggcagcatcgtcaatgtctcaagccaagcctcactggttgcgctggatgatcacctcggctactgcgcctcaaaggctgcactcgatgcgatcacccgcgtgcaatgcgccgagtggggccgctttgggattcgcgtcaacagcgtcaaccccacggtcaccctcacgcccatggccaccatggcctggtccgacccggccaagcgcgacacggcgctggcggccattccactggggcgatttgctgaaacggtggaagtcgctttgccggtgctgttcctgctcagcgatgccgcgagcatgatcagcggcgtcagcctgccgattgatggcggctacaccagccgctagccgttttccaatacgcctgcgatcaccactttgtcgcgtggcttgtacgggtcttccaggcgatccagcagcaggcgcaccgcgctgctgccggccagggaggcgtcgtgggccacgcaggcgatgggcacgccgaagatatcggcgaagggcaggcggtcgatgccgcagatggtcaggctgtcgtgggcaatgttgtgcatgcgcagcgcgcgcaacgcgccgagggtgatcaattggttgaagcccatgatcgcgtccggcgccgagtgctcggccaggtagtcgagggtgtgcaggtaagacggcatcagcgtgtagtcgccggcctgcacttcgacctggatgtgcgggtgttcggcgagcacttcacgcaggcctttgaggcgttccacggtaatgcgtgagtgctcggggccggtcagcaccagcaggcgcttgaggtccggcgtttggcgcagcaagtaatgcgcggcctggatgccgctgtggtagttgtcgagcaccacgcggctgaacgggctgtcgtggatcgtgcggtcaagcagcaccaccggggttttaccgttgcccaggcgctccaggtagtcgggctggtagctcggttcgtcggagaccggcgacaggatgatccccgccacgcggtagcccagcaaggtatcgacggccttgctttccagctcttccaactcatcggtgtcgaccagcatgatggtgtagccgtgctttttcgcctcgcgggaaatcgccttgatcatctcgctgtagaacgggttgtcgaccgaggcggtgatcacgccgatgatcaggctttcactgcgcttgagcccgcgcgcgaaggcgttgggcacgtagtccagctcccgcgccacttcgagaatgcgcgccagggtggcgggcttgaccaagtcgggtttgctcaacgcgcgggacaccgtgatggtggtcatgccgacccgtttggcgatgtcgctgatggtgacggactttttcttgttcatcggtaaggctgcaagaggaaacacccgcaggctagcatgtgcgcaggcgcagggtgattcaaatcagcgggtcccagcgttgcgaccagtcactttcggccttgaccacctcgcgcagcaaccccaacgcctgttgcaacaccgccgaatcccgcgcccgtgaatacaccaggtaagtcgggaaactgaactccggcgccttcggcacgcgctgcatcacgccgctgtccaggtagctctgcacgacgcgcgtgcggaaatacccggcgccgccattttccagaatgtactgcaacgccagcggcccgaggttgaagctcagcgcggcgcgggctttgtcgggcagggcggcgtcatgctgctggcgaaaccctgggccccaatcgatatacacgtaaggggccggcttgctcaccagttgcaccaggatcagcttttcttccagcacctgctccacctgcaaccccggccagtattgcggctggaacaccagggcggcatcgagcacacccagttccagttggcgcagcaggtattcaccctcgcgtatctcggtgcgcaacgcgtgcccggggatgtgttcacgcagggcctgggcccatccgagcatcagcgggttgcacaggctgacctcaccgccaatgtgcagcacgttgcggtagccatcgggcagcggcaggtcacgttttgcggcttcccaggtttgcagcaactggttggcgtacaccacaaaggcctcgccatcggcggtcaggcgtgcacctgcgcgattgcggatgaacagcgtgctgccgagctggctttcgaggtttttcacccgggcggtgatggcggtctgggtgacgtgcagtttctcggcggcggcggccaggctgccgcagcgggtgatttcgaggaaggtgcgtgccagttcgatgtccatgaagcccccaaggatgatggacgggcattgtagaccagagggtttactccccggcctctgtttagcgataggcggtttagtcttgttacacaagctgatgcaactggcgttggaaaaagtccacacaggggtaagcaagacatcacccgtagacctatcatgagaccatgatccttatgataaatccttcaacgtactccctactcgactgggtcatgtcagggccaagtctggatgaccagcgtgcctctgagtcacaagtaaacaccgcaggtgcgaacgaaaatgcaggacccgcagcgtatgagcaggccattcagaaatttgtacgcgatggtaaaaatcccgagctgcttcaattaagggaggggctcgtgcgcgttttggatgatgttagtaggctagagaggtatttgcccggaccgcctagcgctgaccagaccgccaatatgctgtctttttttatgcaacattcggaagtgacgctggaagccggatctagtggcgttttaggttttgggcaacaggtgagcctttcaacgtttatgaaaaacagaggcctgaacccgcctgttaacaaagacgaactgcagcaaacaatcgacgcgttgccttcaaaacctgaattacccccacgtacatccgcgggcggcttgcgcgcattgcttcagttggggaataaatcggtgtgactgcttactgacaaatgggcgttgaggtgggatgcggttaacgctgtgagcgggttggcgtacaccacatggacgggcattgtagaccagagggtttactccccagcctctgtttagcgataggcggtttagtcttgttacacaaactgatgcaactggcgctggaaaaagtccacacaggggtaagcaagacatcacccgtagacctatcaagagaccatgatccttatgataaatccttcaacgcactccctactcgacctggccatgtcagggcggcgtcttgatgagcagcctgcctctgagtcacaagtaaacagcgcagatgcgaacgaaaatgcaggaccagcagcgtatgagcagaccattcagaaatttgtacgcgatggtaaaaatcccgagcttcttcaattaagggaggggctcgtggacgttttgaaacaatatgagattataaggggtgattccaaatcgcctgagggtaatcaaaatttgctcgatttgattttccataacaacaaagcagtcgtgaatctggtggagcccattgttgtgacccaccgtggccgagttatatattccaagtcggaaatgcgcattgaagagtttatggctcaggcaggtttgaaaccgcctgctaacaaacgcgaactgcagcaagtaatcgacgcgttgccttcaaaacctgaattacctccacgtacatcagcgggcggcttgcgcgcattgattcagttggggaataaatcggtgtgaccgcttagtagtggaatgcgattaaaaactgtgggagcgggcttgctcgcgaatgcggtgggtcagttacaaataagctgactgacccaccgccttcgcgagcaagtcgaatcgtcgcaccgccgctcccacaatttaaccaagttcggccgccagactgctgtgctttgcttttctgtgggagctggcttgcctgcgatgcgggcacctcggtctatcagtgagacacagttgatgccatcgcaggcaagccagctcccagatttgattgagttcagcttcaatgaaaaggtcggctgtcgggccgcctcggctagcttttgatctaaccactcaggtcggctaccaggccgccgtgctgtagattttgattttgatcttaggcaccccgtcgcccgccgtaagggcggaaccaatattagccatccccagataacggataggtccccaccgctaattgcattccagctaaaggtcgactgatcgttactgaatcccgatagaccaactgtgggttgtctggtcgtcgtggcgctgctccaggtcatcttcatactggcagcgcgggcctttacagttgtagtcgaatgtcaccggcggcttggtcgtcaccgggaacaacgatttggccgtagccggcgcagcctggggtacagccacggtgacaggcgcttcataggtcaaatccagcgctgtagcgagggctacggtcggcaggagggcgagcactgcgctcgccagaacggtccttgtgaatagcatctgaaacaatccgcgcaacaaaaatgaagcgcgaattataagccaggtgcgtgcgcagatgcacagcgcgatgcgcggtcgaacgccgcagttcagagcccgcgcggtgcttgaaggtgttcggtggggaacgccttggcgtaagcctggcacacccgcaacacctgctcatcggcaaaccgcgcgcccaccacatgcaaccccacgggcaagccgttcgccgccagcccgcagggcaccgacgcggccggttgttgggtgaggttgaagggataggtaaacggcgtccactccatccactcattcatccccgagcccggcggcacgttgtgcccggcctcgaacgcggtgatcggcatcatcggcgagaccagcacgtcgtaatgctcatggaacgccgccatccgcgcgaccagtgcggcgcgggcttcgagggcgtcgttgaagtcgcgcaggctgagttgttcgccgcgttgcgcgatgcgcagcaggcccgggtcgagcagctgtttttgcgcctcgctcatcgagccggtcaggcgtgcggcgcccgccgcccacaaggtgctgaacacctccagcgggtcgctgaaacccgggtcgatttcctcgacctgcgcgcccagttgcaccagaccgtcaacggcttgggcgacgactttggcgacctgcgggtcgacattcacataaccgaacgtggggctgtaggccacgcgcaagcctttcaggtccgtacctggcgtgagccatggcgtggtgcgcggcgcgccgatcaggccatcgcgcgcatccgcttgcgccacggtttgcagcatcagcacggtgtcttctaccgtgcgtgtcatcggccccaggtgcgacagaatcgtcatggaactggccggccattgcggcacataaccgaaagtcggcttgatgccgaaggtgccggtaaacgcacacggaatacggatcgagcccccggcgtcgctgccctggtgcaacacgcccaggttcaacgccgccgccgcgcccgcgccaccggacgagccgcccgccgtggtgcgggtgtcccacgggttgcgggtgatgccgtacaacgggttatcggtgacgcctttccagccgaattccggcgtggtggttttgcccagcagcactgcgccggccttgcgcatcaaggccgagaagggcgcgtccacgtcccacggcccctcggcagatgaggtgcgcgagcccttgcgggtcggcatgccgatggtcagcgtcaggtcttttatcgacgacggcacgccatccagcgcgccacagggttcgcctttgaaccagcgttgttccgaggcgcgtgccgcgttgagtgcgccttgtggatcgacatggcagtaggcgttcaccaccgggttgtagcgctcgatacgcagcagggcgtcttcggtgacttccaccggcgacaaggacttgtcgcgaaaatgctgcagcagttgcaccgctgtcagttggccgatctcactcatgcctgttccccctgcgccgcgttgaccatggcgcgcagcaataccgcgcagcccgccgccaggtcatccggcgcggcattttcgatttcgttatggctgatgccgccttcgcatggcacaaagatcatcccggccgggccgagttcggcgacgaaaatcgcgtcatgcccggcgccgctgacgatgtccatatggctgaagcccagggcactcgcgccgtcgcgcacggcgttgacgcaggcggggttgaagtccagcggcgggaagtcggcagtcggcgtcagttcaaaactcaggccgtggcgcttggcgctggtctcgatcacgccgcgtacttcatcgaccatggcctgcagcttgtcggcatgcaggtggcgcaagtcgagggtcatgtgcacctggccgggaatcacattacgcgagccggggtgcaggctcaggcaaccgaccgtgccgcaggcatgtggctggtgctgatgggcgatacggttgaccgcgctgaccacttcggcggcgccgaccaaggcgtctttacgcaggtgcatcggcgtagggccggcgtgggcttcgacgccggtgagggtcaggtcgaaccacttctggcccaggcaacccatgaccacgccgatggtggtggcctggtcttccagcaccgggccttgctcgatatgcgcctcgaaatatgcacccaccgggtggccgagcaccgcacgcgaaccggcgtaaccgatgcgctgcaattcagcacccaccgacaggccgtgctcgtcctgtttgtcgagggtgtcctgcaggtcgaacttaccggcaaacaccccggagcccatcatgcacggcgggaagcgcgagccttcttcgttggtccacaccaccacttcaatcggcgcctgggtctcaatgccgaggtcattcagggtgcggatcacttccagcccggccatcaccccgtagcaaccgtcgaacttgccgcccgtaggctgggtgtcgatatggctgccggtcatcaccggcgccaaggcgggattacgcccggcacgccgggcgaaaatattgccgatggcgtcgacactgacgctgcacccggccgcctcgcaccactgtacaaacaggtcgcgggcctgacggtcgaggtcggtgagggccaggcggcacacaccgcctttgacggtggcgccgagctgggccaggtccatcagcgattgccacaggcggtcgcggttgatcagcggggcgttgctctggagcggttgcgcaaagctattcatgggcaatctccggtcaggcactcagggccaaataacggtttttgatggtcgggtcggcgcggaaagcagcggcgctgccctcgtacaccacgcggccctgttcgagcacgtaatggcggtcggcgagcttgtcgcagaccatcaggttctgttccaccagcagcacgggcaggccgtcgtccttgaccttgcgcaggatcttcaccagctcgtcgacgatcaccggcgcgaggccttcggtgggttcatcgagaatcagcagcttggggtcgttaagcagcgcacgggcgatggcgagcatttgctgctcgccaccggacagcgcgtggccggcgtttttgcgccgctccttgagacgcgggaacatgccgtacacatcctccagctgccagcggctggtcttgcgcacggcgatgcgcaggttttcctcgacggtgagcaggcggaaaatcccgcggttctccggcaccaaggccagcccctggcgggcgatttcaaagatcttctggcccaccaacgcctggccattgaagtgaatctggccctggcgcgggcagataatcccgagaatgctgcgcagcgtggtggtcttgccggcgccattacgcccgagcaaggtcaccagctcgccagggttgacggtcagcgatacgccttcgagcacgtggcttttgtcgtagtaggaatggatgttctcgacgatcagcatcaggcagcctccccaaggtaggcggtgcgcacacgctcatcggcgcgcacgaattccggcgtgccttcgaccagaatctgcccgtggctcatcacggtgatgcgttggctgatggacatgacgatgctcatgttgtgttcgatcaacaacaccgtgtggtcgcggccgaggtcgctgatcagttgggtcatgatcgggatgtcgtcgatgcccatgcccgaggtgggctcgtcgagcatcaacagtttgggcttggagcagatcgacatgcccacctccagcacgcgctgttggccgtgggacagctcgccggcgagggtgtctgcgcggggcgtgagttgcaggcgttcgagtacctggtcggccatctccaggtgctcgcgctggctgtcgacgcggcgccagaagttcagggcgcgcgcgccgtcgcggccttgggcggccaggcgcaggttctcgcgcacgctgaggttctggaacaggctggtgagctggaacgaacgcgccatgcccaggccgacgcgggcgtgggcgggcttgcgcatcaggttcttgccgtcgaattggatcgccccggccgtggcctggcgctcgccggtgaggcagtgaaacaggctggtcttgcccgcgccgttggggccgatgatggtgtggatggtgccggcttcgaccttgaggttgacgccattgaccgcatggaacgcgccgtaggccagttccaggttttgggtttccagcaggatgctcataacacttcctccttggcgacgacggcggttttgcggctgccgcgcaggcgttcgaacagcgacgacagcccgccccacaagccgccgcgcataaagatcaccacgaagatcaggatgattccgagcaacatcagccagcgcggccacaggtcagagaggaaatcccccagcagcacgatggagccggcgcccagcaacgagccgaacagcgagccggtgccgccgacgatggtcatgatcagaatattctcggacatcgccaggtcgatgttcgacagcggcacaaagtgcagcagcatcgcgtacagcgccccggcgatgccggtgaccgcgccggacagcacgaacaccaggatcttgaagtggcgcgtgtcatagccgatggccgaggcgcgggtttcgttttcacggatcgccatcaaggtgctgccgaacggtgaggcgatgacccggcgtgcgccgatgaaaatcagcaggaacagcaccgcgacaaacccatagaacgcacgggcgtcggccagcgacagcagcacgtagtcaccgatgcggatttccgggcgcggcacgctgagcaggccgttgtcgccgccggtccagtcgctcaaggtgtaggcgacgaagtaggccatctggctgaacgccagggtcagcatcacgaagtagatgccggtgcgccggatcgccagggcgcccaccagcagcgccaggaacccaccggccacggcggcgccgagcagggcagggaacaggcccagttgcaggtggatcatcaacaacgccgcgcagtaggcgccggcgccgaagaagatgccttggccgaaagacagcagcccggtgtagcccagcaacaaattgcaggccagggccgccatggcgaagatcaggatctcggtggccagggtcgccgagggcaggatcaacggcaggccgatcagcacggccagcacccacagcaacatcgcgcgcgattgcgtcttggcaaacggcagggggtttttctcgctcatgtcaggctctcccaaacaggccgtaagggcgtaccagaatcaccacggccatcgcgccgtagatcatcaggctcgcgccttggggccaaagtgtggtcatcaggctttgcaccacgcccaccagcaaaccgccgaccagcgccccactgaacgagcccatgccgccgatcaccaccaccacgaaggccacgccgagaatctccgggccgacaaagggctgcgcaccgcgcaacggcgcgaaaagcacgccggcgacaccggccagggccacgccgagggcgaaggtcatggagaacaggcggaagatattggtgcccagcagcgacacggtttcagtgctttcactgccggcgcgcaccagggcgccgaagcgcgtgcgttccagcagcagccacaggcccagcccgaccagcccggaaaacacaatgaggaacaggcggtaataggggtagacgaaatcgccgaccaccagcaccccgcgcagcagttccggcacggcgacacttttgcccaccgggccccagatcatcacgctggcttcctggatgatcagcgctatccccagggtcaccagaatctggaacatgtgcggcaagtgataaatccgctggatcaacaagcgctcgatcacccacgccagcgcggccaccaccagcggcgcaatcagcagcgccagccagaagttgccggtgaggctgacggcggtgtagcagatgtaggcgcccagcaggaagaacgcgccgtgggcgaagttgacgaagttgagcaggccgaaaatgatcgtcagcccaaccgcgatcaggaaatagatcatccccagcccaaggccgttgaggatctggaacaggtaaagattaagcatgcagaagccctcggcaggaagctgctcgcgcagccctgcggtgcactgtttcgggggatcaggcgagcgtgcagcccgtcgcctcgaccggcgggaacgactggccggcattgagcaccttggccaggtcatccttgtcggccatgtcgctgctggccttgccgatcatcaagtagtaatccttgatcacctggtggtcgccggcgcggatcgattccttgccggtcgggccgtcgaaactcaggccttgcatggccttggccaccgtcggcccgtcgaagctgccggtggagatgatggtgtcgagcatgaccttggtgctgatgtagtcggcagccagcgggtaggtggggttaatgccgtatttggcctgggtcagcttgaccagctcgcggttgagcgggctgtcgacctggtgccagtactgcgcgccgaggtacacgccttcgagcacgtcgctgcccagctcctggaactggtcgaggccggcggaccacaccagcagcactttcatgcgctccttgatgccgaagttcaccgcctggcgcagggtgttggacgactggctgccgaagttgagcagcaccagcacgtcgggtttggcggcgatggcgttggtcaggtagccggagaattcctgctcctgcaacgagtggtagctgttgccgacatgctccaggccgttttccttgagcacggtcttggcgccttcgagcaaggcctcgccgaacacatattgcggggtgatggtgtaccagcgcttggcgtccggcagcagcttgatcagcggcaccatggtttcgcggatcgcgccgtaggtgggcaccgaccagcggaaggtggccttgttgcagtcctttccggtgacttcatcggcgccgaccggggtcatgaacacgccaccgaccttgtcgacttccttggccaccgccagcgccgatgacgacagcgtgcagccctggaagaaccgtgcgccgtcctgctggatcgcctcctgcaccttgcgcactgccttgccggcgttgccttcggtgtcgatgactttgtagttcagcgggcgcccgagaatttcggggtgttgttccaccgccaggcgcgaacccatgtcggcaaacttgccatagctggcaaaggcgccagacatggacttgaggccgtaaaaggtaaagggctcggcggcgaatgcagagcgcacactcagcggaaggctgagcgcggcggcggcggtgagactggctttcaacaacgtacgacgctgcatggggtgactccctggtttagttattggcaggagcggcaatggcgatacggtggagcaagggcctgtgggcaggcctgttattggaagattggcttcagcgagttgaactcggtcaactgtgggagctggcttgcctgcgatagcatcgactcagttcaactgatgcaccgaggtgtctgcatcgcaggcaagccagctcccacattgattgggttttaacaggtggatgtggggtgtttttaagagtgatcgaactccaataggaagtgcgggctgacctcgccttccagtgcggtcatatggtgttcggcgtcgcacatgtgttcatgcatcaagctgcgcaccgcactttcatcacctgcgcgaaaggccagcagcaactgcttgtggtagtcgaggttggccgcgtcgaactgcttgcgcttgggtttgtaggcttttttcagcaccaccaggtcacgcagcaggtcgttaagaaactgcgccatgaagctcaagagcgggttggggcaggccttggccagcaggttgtggaactccagctctgccaggcgctgttcgcgctggccggcttcgctgtcttccggcgcgctgcaaaaatccacattgtcttgcagggcctggtagtcgtcttcgctcaaccgcccgagcaccgacaccgccagttccacttcgatgaccttgcgcagctggtacacctgctcgccatccaggtgctgaaaatgcaggtagttacgcaatgctcggctggccggttcggtgccggcctggttcaggtaggcgccgccgctggggccggtgcgcgtactcactaggccttccacttccagggccttgagcgcttcgcgggccgagcccttggaacactgaaaactctccatcagctcacgctcggtgggcaaccggtcaccgggcttcagggcgtcagtgacgatggagcgcttgaccgactcgacaatcacatcggagagcttctggcgtttgcgtcgtaacgggcgactgagcatgctggtctattgatcctattaatgcggattaatagcacttaataacgattgggcgggagcgtcaacgcagggtgtcgttttcgacgcgaagaggtcgtaaacgtgcgggttattcccaactgccaaggtcgacgcagcgtgtggcggggggcggttgcttgccgctgaccagaaagtctgcgacccaacgcttgatgcacccggcaccgtcgggccgagacgattctttgagcaacagttgctcgacgccggtgtcgaacgcttcactgtgcccggcgttgactaaaaccatgcgtgccacgtgctcggaaaacaatgccgcataccggctaccgatccgggcggcttcagcgttacccaggtagttgagctgtgcctcacccagttgtgcgcgcacaaactccatatcgcgcgccgcctgctcgacgccgttctcgtggctcaggtcgcgcggtgtcagttcgatgacgtcataacggttgaccaactgtttataggctggcgtggcatacgactcccagcggctgaccaggtgcacaccaaaggtggcaccttggcccagttgcggctcgccggcctggataaacaccacgccttcacgactgagcggatcccgggcgccgacacgggtcagggccaggcgcacgttgccacgcttgggcgcggcatagtcgcggggcacgctgacactggcgcattgcgtgcgttccagtacctcggggtctggttgtttgaaggcggggaatgggcagtccagcagccagtcaatcgcggtgggcgcgatcaggggctcggcaaaagcctggcctgcgaccagccagaggctgatgcacgccaggcgttttacaagaacgctgggtttcatcaagagataccgggcagccgtatgaaggtggcttttttaccaagtaccaggggtagacgaatgtaggtttaataaacggaatgtgtaggagttttgagttttgttatcggaaatcggcgttccagccgccacccaaggctttgtacaaggcgatactggcttgcaggcgtgacagccgcaattgcacattcaagtcctgcgctgcgtataaggtgcgctgggtttccagcaccgtcagcaagtcggcggcacctgcctggtagcggctttcggcgatctggaaggcggtttgcgcctgccgcagttcttcgctctgccaatcgcgttgctcatccaggcgcgtgatgctgctgagggctttctccacgtcggcaaagccgttgatgatggcgccgcggtaggtttgcagcagctcgtcctggcgggcgcgggccttgtcgcgttcggcgctcaagcggccattgttgaaaatcggcgccaccaggccggaggtcagcgtgtagaacgggctgcgcaaaatgtctgcggccctgtcggagcccgagcccagggtcgcgcccaaggttactgtgggcagcatcgccgcgcgtgccaccgtgacgtcggcactggccgccgccagctgcgcttcggcccgggccaggtcggggcggcggctcagcagttggctgggtacgccagcgccaatggccggccaggtcagtgcctggaacggctcgtcggtcaggttcagggcttgcaccggctggccgaggagggccgccagggtgatcagcgattcctcagccacctgctgaatctgcggcagttgccgttgctggctggccaccaggcttttctgctgggccagctccagggcagtggcagagccggcgtcgtagcgggcctggaccaggccgagcacactgcgcgcattcgccaggttcagctcggcgatctgtcgttgttggcgcgcggcgagggtttgtgcatagcggtcggccacgttgctgagcagggtcagctccacggtggcctggtcgaactcactggcgcgcagggtttgcacggcgctgtcgcgggaggcagcgcggccaccccagaaatccacttcatagctggcggtcaggttggcgccgaagctgtcgacggtgttgtcagtctccgtggcgtccagtgtcgagttgccgctgccgcgcagcagtttttgacggctggcggagaggttgaaattaacctcaggcaacaacggtgcgccggcaattaccgcactggcctgggcctggcgcacccgcgccatggcggcgcttacgtcataactgtcacggcgcgcctggtcgatcaggcggttgagttgcgggctgccgaactgcgtccaccagcgctggttggtgacttgggcagcgtcacgctcggcgtactgccaggcggcaggcgctgcgatgccgctgtcgacggcgggcgggttgccggtgcaggcgttgagcaacaggcacaggctgagcaccgacaggcgcggtgcgatggagggtttattcactggtcaacgccttaaccggatcgagccgggcagctttacgggccggcataaagccgaatacgacaccggtgaccagcgcacagccaaacgcgccaagcaccgccaccagggagaactgcaccgccacctcggccagcaccagcacgccgccgaccagcagggccagggcaataccgcacaggccgccgaccaccgagagcatcaccgcttcagtgaggaactggcgcagaatgtcgcgctggcgtgccccggtggccatgcggataccgatttcgcgggtgcgttcacgcacggtcatcagcatgatattcatcacgccgatcccgcccaccagcagggaaatcgccgcaatcgaaccgagcatcaacgacagcgtgttcgccgtgcgcgcctcggcctggatcatggcggcgtcgttggtcaggtggtagtcgcgcttgccgttgtgcagcttttgcatgagctgatcgatggctttttcggtttcattgaccttgcgcgcatcggcggcggcaatcaccacgtattcggggttataggtgccgaacaggcgtacgctggcggcggtgtaggggatcgcaacacggtcgtcgctgtcttgcatgccggagctggagcctttttcggccaacacgccaatcacctggaagggcacgttctctatcaggatgtattggccgatggggtcgacttcgcctttgaacaacttttcgcttacgcgatgaccgatcaccgccaccgtggcgcccgcgcgttcgtcggcctcggtaaagtagctacctttggccactggccagttgaaaatggtcgggaagttggtgtcattaccgcccacataggccatgtagtcgacgttgccgaagcgtactccggcgtaggtgccgttgacgggcatgatgcgcttgacctgcggcagtgtggccaaggctgcgacgtcattgggggtcacgataccctgcggtgtacgcgggttaggcgagaaaccgctgaggtagatgatgttggagccgaacgctgccatctgcgccatgacctggcgcttgctgccttcgcccaccgccagcatgaccaccaccgacgccacgccgatgatgatccccagcagcgtcagcgcggtgcgaaagcgattgatccacatcgcccgccaggccgcgagcaccgcgtccagcagttcggctttccaggcaccgttgtgttcggcaccgtcggccaggcgctggcgcaggtccacggcttgcagggcgtcactgttggccgtgacgggcacgtgggtgtcactttgtgccgagtcgctgacgatcagcccgtcgctgatctcgatgatgcggttggcgtgcgcggcgactgcgcggtcgtgggtaatcaggattaccacgtggccctggctcgccagttcatcgagcagcaccatcacttcggcaccgctgtggctgtcgagggcaccggtgggttcgtcggcgaggatgatatgcccgccgttcatgagtgcgcgggcaatcgagacacgctgttgctggccgccggaaagctgatgcggacggttggcggtgcggtcggccagacccaaccgggtcagcagggccttggcgcgggcatggcgttcggcggcgctgataccggcatagatcgccggcatctcgacgttttcctgggccgagccggacgggatcaggtggtagccctggaacacaaagccaaaggcttcgcggcgcaaccaggccagttcgtcgctgtcgaggtgggcaacgttttctccggcgaacaggtaatcaccgacagtggggcggtcgaggcagccgaggatgttcatcagcgtggacttgccggagcccgatgcaccgacgatggcgacgaattccccggcatggatcgacaggtcgatcccgcgtaatacatcgacttgcgggctgtcgccgccgccgtaggatttgcggatgttcttgagttcgatcagcggcgtggtcaaatcaacccccgctgccgtcggttgggccgatcagcaggtgatcgccttcgttgagaccgtccagcacttcgacccgcaggcggtcgctgatccccaggcgcacttcacgttcctggacgctgccatttttggccacaacccgggccacctgtttatcgtggccttggctgcccatcaaggctgcgaccggaaccgtgagggcgtccttgacttggctggcgacgaaaaatacctgggtggtcatttcggccatcagcgcgttgtcggtgttgtcgacatccagcagcacggtgtacagcaccacgcggccgctgccggttttgcttgtactgctggggctgccattgccctggctggtttcattcagcggcttgggcgggatcggcaggatctggcgcacggtgctggtccagcgccggctgccaccggcgagggtggtgaaataggcggtcatgcccggtttgacatgactgatgtcggcctcggagacctcggcccacacagtcatcggcgacaacttggcgatgcgcaggatcagcggcgtctgttgctgggcgttgagggtctggccgacccgtgcgtccaccgccaccacggtgccgctcatgggcgcgtagatgcgggtataacccagttctgcctcgtcactgcgcaggctcgcctgggcctggcgaatctgtgcctggaacatattgacgcgggcctgggtggcactcagctcggccttggcggtttgtacgtcttcttcgcgggtggcgttgccggcgaccaggcgctgctggcgctggtacttctgacgggccagttcgtgctgggctttctgctcctgcaactgcgcctggaggttttcgatggcgtagcggctggcgtcgagcttggcctgctgtgtggcagggtcgatttccaccagcaggtcgccttccttgacctgatcaccggcctccacgtggatcttgcggatttgcccggacgcctgggcgcctacgtcgacgtaccggcgcggctgcagagtgcccaatgcggtaacgctgttttctatgttaccgcgcgttacggtgacagttggcaggctatcgcgccccggctgcagcagttgccaggcagccaccgcaaggatggggatcaggcacgcgacagcaagcagggcgcgtcgggcggggcgggggcgtttcatgcgttggttccagccagaagtttgggccgcggttgcggagggctgactgttatacgagaaaattgcccgaagatttagacgtttacatacgccgtaacagctctgtcgaataaaaaaaatcgtgcgtgggtgcaagacttctttaaaagtagatgagaattactataaattgcacgcactcaaactgccatcaccgatggcctgtcttctttagcactcaaggatctgataccgcttccccaggcggtcgggagtcatgttggaaaactactatcgcgagctggtgtgtttcctcaacgccaagctgggcaaccgtcaggtggccgaggatgtggtgcatgacgcttatgtccgggtgctggaacgcgcaagcgacacgccaatcgaacagccgcgggcgtttttgtatcgcaccgcgctgaacctggtgatcgacggccatcggcgcaacgccctgcgccagtccgagcccctggaggtgctggacagcgaagagcgtttcgcccccagttcaccgcatgccagccacgatcagggccagcgcctggaaatgctcgaacgcgccctggccgagctgccgacggcctgccgcgacagcttcctgctgcgcaaactcgatggcctttcccacccgcaaatcgctgaacgcctgagcatttcccgcagtgtggtggaaaaacatatcgtcaacgccatgaagcattgccgggtgcgcatgcgtgagtgggaagcgcactgatcactgattagttaaattttatttcactgtcctcgtttcctatcaacacatgacctgttgttcaggtcttgaaaggtattcccgccccaccgccaaggggcttatccagaggacactggaatgacacaggcaattgcttcgcccgcggttcacgacctgatcggtatcggtttcggcccttcgaacctggcgctggccatcgccctgcaggagcgtgaaaaagcccagggcaaactcgatgtgctgtttctcgacaagcaggccgactaccgctggcacggcaataccctggtgacccagagcgaactgcagatttcgttcctcaaggacctggtgaccttgcgcaaccccaccagcccgtattccttcgtcaattacctcaaggcccacgaccggttggtggacttcatcaacctgggcaccttttatccgtgccgcatggaatacaacgactacttgcgctgggtcgccgggcagttccaggcccaggcgcactacggtgaggaagtgctggccatcgagccgatcctgcaacaacagcaggttgaagcgttgcgcgtgatctcccgtgatgcgtctggcgaacagcatgtgcgcaccacccgttcggtggtggtcagtgccggtggtacgccacgcgtgccggaggcattcaaggcgctcagggatgacggccgggtgttccaccactcccaatacctggcgcgcatggcccagcagccgtgtattgaaggcaaggcgatgcgcattgcgatcatcggcggcggccaaagcgcggcggaagcctttatcgacttgaacgacagcttcccgtcggtgcaggtcgacatgatcctgcgcggttcggcgctgaagccggccgatgacagcccgttcgtcaacgaagtgttttcaccggcgtttaccgacctggtattccagcaggtcggcgccgagcgtgagcgtctggtggccgagtaccagaacaccaactattcggtggtggacctggacctgatcgagcgaatctacgggattttctaccgccagaaagtctccggcgtcgcccgccaggccttccgcaccatgaccgtggtcgagaaggccagcgccagcccgctgggcatcgaactggtgctgcgcaacaacgccaacggcgaaaccagcgtcagccattacgacgccgtgatcctggccaccgggtacgagcgccagatgcaccgcgaactgcttgcgccgctggaagcctatatgggcgacttcgaggtggcgcgcgactatcgcatcgtcactgacgagcgctgcaaggccgggatctatatccaggggttcagccaggccagccatggtttgagcgatacgctgctgtcggtgctgccgattcgcgcggatgagattgcggcgtcgctgtatgaaaacgatcgccatcggggcaaagcgcgttcggtgcaggatttgctactcgccaccgcgagctgacaagctgcacttgtgacaggcagggctgcctgatactgtacaaaaaaccagtatcggtagccctccatgcagttgatcgaaaaactcagcatcctcgccgacgccgccaagtacgacgcttcctgcgccagcagtggcgcgcccaagcgcagctccgaaggcaaggccgggctgggttctaccgatggcatgggcatctgccacagctacaccccggacggccgctgcgtgtcgttgctcaaggtgttgctgaccaacttctgcctctacgactgccaatactgcgtcaaccgccgctccagcgacgtgccccgcgcgcgtttcagcccggaggaggtggtcaccctgaccctggatttctaccggcgcaattgcgtcagcgggctgtttctcagttccggcatcatccgttcggccgactacaccatggagcagctggtccgggtcgccaaactgctgcgcgaagagcatgactttcgcggctatatccacctcaagaccattcctgaagccgacccggcactgatcgccgaggccgggcgttacgccgaccggctcagcgtgaatatcgaactgcccaccgatgccagcctgcaaaccctggcgccggagaagcagatcgtctcgatcaagcaagccatgcaaaccatctacaccggtgagcaaaccgtactcaacgagccgcgcgcgccgcgtttcgccccggccgggcaaagtacacagatgatcgtcggcgccgatgacaccgacgacagcaccatcctgcacggcgccgaggcgttgtatggcaacttcaagttgcgccgcgtgtattactccgcgttcagccccatccccaacagcccgaaaagcgtgcccctggccgcgccaccgctgatgcgcgaacaccgtttgtatcaggcggatttcttgctgcgcagctacggtttcagcgccaacgagctgtttgaaggccccggccacctggcgctggatatcgaccccaagctggcctgggcgctggagcatcgcgaggtgtttccgctggacttgaatcgcgccgaaccgaccctgattgctcgcatccccggcatcggcctgcgcaccacccagcgcctggtcgacctgcgtcgcgaacgcaagatccgtttcgaagacctggcgcgtatgcgttgcgtgctggccaaggccaagccgtttttcatcaccagcgactaccacccgcaacaggccgacagcaccagcgtgttgctgcgcgagcaactgcgcgaccgccctcagccgcaacaaatggggctgtggggatgatcagcctggaatgcgacaacctgttcagcacctggcgcgaacaggcgcgctggctgctcagccatcaggtcgaccccagccaggtgagctggggcgaggccgaggtggcggacctgtttgcgaccgacgagccgattcctgagcagcttgggccgtttcaggcacgaattcccaaggcgctgctggagctgctggagtcggccgcctgttaccacggtgatcagcgttggagcctgttatatgaggtgttgtggcgagtcagccatggcgaccgcaccgcgatgcttgcgggcgacaagctgggcagcgagttgcagcggcggatcaagcaggtcagtcgtgaagcccatcacctgcatgcctttgtgcgctttatcgcgttgccggcagaggcgggcagcgagttgccggagtatgtggcgtggcacgagccggcccatgacattctgaaatcagccagccagcacttcgtcgggcgcatgggccgtcatcgctggatgatcgccacgcccctggacggggtttattacgacggtgagcagttgattcatcagcgcgagtgccccgaggcgtggcggcaactggcgcaaaatgtcgaagacccgcacagtgccatgtggctgacctactacagccacatcttcaacccggcgcggttgaaccccaaggtgatggaagggcacttgcccagccggttctggaagaatctgccggagggcaagttgattccggggctgatcagcgaggcgcgcacaggcaagcagaaggatgggcaggcgaagctgattggggctcggccagggaagaaaattgtgcaccccgccaatgtgggagctggcttgcctgcgatagcggtgtgccagtcaaatcaaagttgactgataaaccgccatcgcaggcaagccagctcccacatggggtttgtgttgttgatgctcgttcccacgctccgcgtgggaatgctgcgccggacgctccgcgtccgctttgaggtcgtgacgcggagcgtcacaggatgcattcccacgcagagcgtgggaacgatctgtcgatcggtcttttgtgtttgagaaatcaggccaactcagtcgcagtgttcttcaccaccgccaactccgggtgcgccaccaatttatcaatgtgcaactcgtcgttgttcaaccaggtctccgtcagcacacggtagtgttccatgtcccggcagcgcatgcgcaggctgtaatcaaacggcccgctgatcagctggcattcgaacacctgcgggcaggctttgacgcaggcttcaaaagccttttgcgccgagcgcccgctttgattggacaaggccaccagcaccagcagtgacagccccggcgagaccatctgcacatcgatgatcgccccatacccgcgaatcacgccgcgtcgctccagcttgcgtacgcgctccaggcagggcctgggtgtcaggtgcaccagcgacgagagcttttcgtaggtgatacgcccctggtgccgcaacacgtcgatgatggcctcatcgatgcgatccagcgcaggggaagaatggggtccgttggccttggtatccatgagttcacttcaaacggttggaaagaaattgctgcaagcgttcgctgctggggtggtcgagaatctcggcgccgccttgctcttcgacccggccctgatgcaaaaacagcacttggctggacacctggcgggcaaagcccatttcgtgggtgaccatcaacatggtacgaccttcctcggccaacgtctgtatgacttttaggacttctcctacaagttccgggtccagcgcggaggtcggttcgtcgaacaaaatgatttccggctccatcgccagcgcccgtgcgatggccacgcgctgttgttggccgccggacagaaacgccgggtattgatccgccacacggcccggcaaaccgactttgtccaggtacattcgtgcgcgtttttctgcctctgccgcgctcacattcagcacccggcgcggggccatggtgatgttttccagcacggtcatgtggctccacaggttgaagtgctggaacaccatggccaggcgcgtgcgcaggttctgcagttgcgcctggtgcggcgcgcgggtgccggcgcggccttgctgcatctcgatgctgatgccgtcgagggtgatcactccagcgtccggctgctcaagaaagttgatgcaacgcagcatcgtgcttttgcccgagccgctggcgccgatcaggctgatcacatcgccctggcgcgcattgagggacacgcccttgagcacttcgtggtcgccgtagcgtttatgaatgccttcgacctggagtttgacggctgccgtgactgccttggcggacggcgcggtgtgtacatcggcgggataagtggccagggcctgcgcggactgattcatgggttagcctcgggtaggaacaagaaaacgcatccagcgacgttcggccagtcgaaacaggcccaccagtgcaaaggacagcagcatgtagagcagggcggcgatgccgaaggcctggaacgtcaggaacgtttcggcgttggcatcgcgggccaccttgaggatgtcggcgacggtggcggtgaacgccagcgaggtggcgtgcagcatcaggatcatttcgttgctgtaggccggcaacgcgcggcgcagcgcggcgggcaccaccacaaacaggttgagccgccagccgtgcaggccgtaggcgcgcgccgcttcgatttcgccatagggaatagtgcggatcgccccggcgaagatttccacggtgtaggcgcaggtgttgagcacaaacgccagcagcgtgcagttcagcgcgttacggaaaaactggttgagcagtgcgttgtcctgcaccacctccaggctgtatagcccggtgtagcaaatcagcaactggatatacagcggcgtgccgcgaaacaggtaggtgtagacctccaccggccagcgcagccagaagtgctccgagacgcgcgccagcgccagtggaatcgacagcacaaaacccagaaccaccgagatgataaacagccacagcgtcatggcgaccccggacaagccggcgccatcgctgaacaggtaggccaggccgtattgctggaacagttcgatcatcgcgccatccccttgatgccgaggttatagcgccgttcgaggcgcttgaagatgcggttggagagggtggtgatcaccaggtacaccacgccggcgaggatcagaaagtacagcggctcgttggtgcttttgccggcgttttgtgcagccttgaccaggtccgacaggccgatgatcgacaccagcgcagtggacttgagcagcaccagccagttattgcccaggcccggtagcgcaaagcgcatcaactgtgggaacagcaccaggtgaaagcgttgccagcggctcaagccataggcggtggcggcttcaagctgcccggccggcacactgagaattgcgccgcgaaagttctcggtgaaatacgcaccgtagataaaccccagggtgatcaccccggcggtaaacgggtcgatttcgaagtagtcccagccgaacacttcgctgaggtcgttcagccacagttgcaggctgtagaaaatcagcaggatcagcaccaggtccggcacgctgcggatcagcgtggtgtacagcgtggcgggcacccgcagccatttgacgctggagagcttggcgccggccgcaatcaggcccaaggcgaggctcagggccagcgccaggaacgccaatttgaccgtcatccaggcaccctgggcgagcatggggccgtagccttgcaggttgaggaattcgttcatggggaaagatctcgatggagcgcagagatttactgtgggagctggctttttgtggcgagggagcaagctccctcgccacaaaaagccggctcccacaggggacaaggcgtcactcgttgtaaatatcctgatcgccgaagtacttcttctggatctgtgcgtaggtgccatcggcctgcaccgcggcgatgcctttgttgatcagtgcgcgcaagtctgcgtcgtttttgcgcaggcccatggcgatgtccagtggcagcgtcgggtccttgaaggccgggccggtcttgaagtcggcgccttcaggcttggacaggaagttgagctgggcttcgagtttgtcggtcaaggtggcgtcgaggcggccgttttgcaggtcggcgtagttctgttcctgggactggtacgccttgatctgcgcgccgagcttggccagatgggcacgcgcgtaggcttcttgcagcgagccttgcagcacgccgacctgtttgcctttcaacgattccggtgtgtcgccgaagtcggcgctcttgcgggtgatcaccgaggtcgggctgaggaacagacggtcggtgaagtcgatgactttttcgcgcgccggcgtcacggccattgaggacatgatcgcgtcgaacttgcgtgcgcgcagggccgggatcatgccgtcgaattcgttgtgcacccaagtgcatttcacttcgagtttggcgcagatcgcattgcccaattcgatatcaaagccttgcaggctgccgtcggcggccacggattcgaagggcgggtattcggggaatacgccgaagcggatttctttccagtcctgggcgtgggcggcgctggcgcacagaggcaacagcaatgcagcgaggagtgatcgcagtggagtcatggggcgtccctatattttgtaattgatgtcagggcagtgaacggataaagcacacattgttttaatgcagcgttttttgcggtgaaggggcttgcctgtggcgagggggcttgtcccccgttggactgcgcagcagtcccaaaaccattcaccgtgtttttttcagtttttatgccgcgtttttattggggctgctgcacagccgaacgcggggcaagcccgctcgccacaacgggtctgttcgtcacagagaatgcttcatggtggtgcgttttttgtgtcgtttacccggtgcataaagcgcgaattgcgctgttaaaaagtgcaatgcagcggaatcggctgctgcacgcgctaaatcggctttttaccggtgaagttcaggcctgccctgggcgcaaagcggcaggccagagcggtctcaggcgcgctttttctgctgtacgcgcggctgttgtgccaagcgtgcaaacaggtctttcgggtcggccaggtccggcaccagttcgagtgtgctgcccacatccaacgcgttggccacatcgaacacatagcgcagtgccgaataatcttcgatggcaaaacccaccgagtcgaacagcgtcacttggcgtgcgttttcgcggccgggcttctggccgttgatgacctgccacagctcggtgaccggcgaatcttccggcatgtgctggatttcgccttcgatgcggctttgcggttcgtactcgacgatcacgcgggcgcgttcgacgatacgtcggtccagctcggtcttgccggggcagtcgccgcccacggcattcaggtgcatgccaggttcgatcatgtcgtcggtgaggatggtggcgtaggccttgtcggccgtcacggtggtgacgatgtccgcgcctttcaccgcttcggcgacgctgccggccaggatcactgtgattgccgggaaggccttgaggttggcggccagtttggcggtggccttggcgtcgatgtcgaacaggcggatttcgttgatgccgagcatggcgtggaaggccagggcctggaactcactttgcgagccgttgccgatcagcgccatgctgcggctgttgtcgcgcgccaggtaacgagcgaccaacgccgaggtggcggcggtgcggatggcggtggtcagggtcatttccgccagcagtacgggtttgccggtgtccacgtcgcccagcgcgccgaaggccatcaccgtgagcatgccggccagggtgttcttggggtggccgttgacatatttaaacgcgtacagcgaagcgtcggacaccggcatcaactcgatcacgccatccggcgagtggttggccaggcgcgcgcatttttcgaaatcctgccagcgcaggtagtcggcgcggatgtactcggccatttcggtgatgcaggtttgcaggcctttttgcgagaccaggtagctgagatcgttgacgtcgatataacgggtcatggcaagactccttattgaaatgaggggcgggcaggcaggtgcacttccgccaacatgcagcgggcactgccgccgccgatgcgttcgatgttgtcgatgttcaccaccaccggccgcgtatggcgttccacctgttggcgctgggcagggtgcaaggcgccccaggcgctggcggacatcaccagcagcggctggccgtcgcggtcgtggacttctagcatgttgccggcgaaggcttcgagctggttgaagtcgagggcgaggatgtctttgccggtgtcgcgcagtgagcgttccaggcccaggcgttcactcgcgtcgggcagggcttgcaggcacaccaccgagaggtcgcggccgacgctcatcatcacgttgctgtggtagatcggcgcgtggtggcggtcaacggcgtggaacacgcagagtctgtagtcgaggcgttcggcgaactggcgcagggcgtcctggtgagtgcgcccggagtggcaggcgtagctgatgcggtgctggcggtcgagcaccatgctgccggtgccttcgaggaagatgttctgttgttcgaggtggctgaggtcgatggtgtggtggatcgcaaagcgctgctccagtacttgcagcacgcctttgtcgcgctccaggcgtcggttctggccttccatcgggtacagcaccaggctgccgtcggcatggctgctccaccagttgttggggaagatcgagtcgggggtgtggggcgcgggagtgtcctgcaccaccagcacttcgacgccgtgttggcgcagggtgtcgacgtagccgtcaaattcttccagcgctttctgctgcgcgctgagtgggtcgaggggcgggcgctggaagcggttgttgatcgcggtatccgggttgaaggcaaagcgcgccggacgaatcatcaggacagtgtttgttgtttgcatgggtgcacgggtccatggggggctgagctgtgggggtattttgtgcgttgtggtgggtgaatcccggctgaaacagaggggcggctcagccgggaaagctgaaaagtggggtgaggcagccgaatcggctgagaggcttgaaatgcgctcaaactgtgggagctggcttgcctgcgatagcggtaggtcagtactaaatgttctgactgacagaccgctatcgcaggcaagccagctcccacattagtatggtggcggtcgtgacacccgagccaggaaggagaatgcatgtctaccgctgttcgtcttgcccaaaccaccgatgccgaagggatcagccaggtcatcctggcggccttgcacagcagtaatgcgcgggattacccggcggaggtgattgctcgggttgcgagtaattttacgcctgacgctgtgctggctttgctccagcgccgggtggtgctggtggcggttcaggagcaggtgatcgtcgccactgcggcactcgacggcaatgtggtgcgctcggtgttcgtcaacccggcgctgcaagggcaggggattgggcggctgttgatgatcgaaatcgaattgcgtgcccgcgaagccggggtgacggtcttgagcgtgccgtcttcgctgaccgccgagccgttctatatcaagctggggttccacacggtgcgcaatgtctaccacggcaacgagcgcacgttggtgatggagaaggcgttgttatcccgccatcccattgggccgtaccgcgaccggcagcaccgtgcgcaagtggtggccctgtggcaggaggcgtttggctatgacactgcgcacaacctgccgacgttggcgattgataaaaaactggcggtcaacgatgggttgttctttgtggcgacggataaaaaaaccgtggtcggcagcattctcgccggctacgacgggcatcgtggctggctgtattcggtggcggtgcacagcgattatcggcggcagggtttgggcgcgtcgttggtgcggcatgccgagcaggcgttgacggcgctggggtgcatgaaaatcaatttgcagattactggcgggaatgacgcggtggtggggttttacgaggcgttggggtatggggtggagccgaggattagtatggggaagaagattggcgtgaatatcccgccgcaatcctgagagcaaatgaggtcaactgtgggagctggcttgcctgcgatggcggtgggtcagtcaacttgtttagtcactgatagaccgctatcgcaggcaagccagctcccacatgggttttgtggtgtggctggcttttgggtttagaccttgacgatccagccttccggcgcttcgacgtcgccggtttgcacgccggtcagctctttgtagagggcctgggtgatcgggcccacttcggtttcgctgtggaatacgtgcagtttgccgttgtactggatgccgccgattggcgagatcacggcagccgtgccgcaggcaccggcttccttgaactgatccagtttgtcgatgaacacttcgccctcgaccactttcaggcccaggcgcgactgggccagttcgatcagcgacaggcgggtgatgcctggcagcaccgaaggcgacttcggcgtgatgaactggttgtcgtgggtgatcccgaagaagttggccgaaccgacttcttcgattttcgaatgggtcatcgggtccaggtagatcgcgtcggcgaaaccggatttcttcgcttcggcgcccggcatcaggctggcggcgtagttgccaccgaccttggcggccccggtgccttgtggcgcggcgcggtcgaaggtggagatctggaagttgtggggcaccaggccgcctttgaaataggcgccgaccgggatggcgaagaccgagaagatgaactccggcgcggtccgcacgccgatgttgtcaccggtgccgatcacgaacgggcgcaggtacagcgcaccgccgctgccgtacggcgggatgaaccgctcgttggccttgaccacttgtttgcaggcgtcgatgaagtcttcggtcgacacgtgcggcatcagcaggcgtgcacagctgcgctgcatgcgagcggcgttctggtccgggcggaacaggttgatcgaaccgtctttgcaacggtaggccttgaggccttcaaagcattgctggccatagtgcagggcagtcgagccctcgctgatgtgcagcacgttgtcgtcggtcagggtgcctgcctgccattcgccgtttttccagacttggagaaaccgcttgtcggtcttgatgtagtcaaaacccagcttgtcccaattgatgctttcgttacccatgacaccctctatctctggtcaaccgcctggtcgaaggcaggcttgtcggtttttttctggatgggcgcaacaatacttcattcttggccggtgtgggagcgggtgggcgggccattcggcatgtgcgttggctgatccgccgctatcgcaggcaagccagctcccacatttgcaatgcgttcccctgtgggagctggcttgcctgcgatggcctcaccgcggttttacaggtgcagcgcgtggcccaaggcccttaaagcggcttcttgtaccgcttcaccgagcgtcggatgggcgtggatggtgccggccacgtcttccaggcgcgagcccatttccaggctcaggccgaaggccgtggacagctcggacacgccaacgcccaccgcttgccagccgacgatcaggtggttgtcacgccgcgccaccacgcgcacgaagccggttttcgactccagggtcatcgcccggccattggccgcgaacgggaagctcgacacgatgcagtccaagccggcggccttggcttcgtccggggtcttgccgaccaccaccagttccgggtcggtaaagcacaccgccgggatcgctgccgggttgaattcgcgggacttgccgctgatcagttcggcaaccatctcgccctgggccatggcccggtgcgccagcatcggctcgccactcaggtcaccaatggcatacacattgcgcatgctggtctggcaacggctgtcgatcttgatcgccgaaccgttcatgtccaggttcagcgcttcgaggttccagccctgggtgttgggtttgcggcccacggccaccagcacttgatcggtttccagcgacaaggtgtcgccattcggttcgcgcacttgaaggcagttgttttcaaagccggtgacgctgtgcttgaggtacagctttacgcccaattgcttgagggattcggccaccggcaatgtcagctcggcgtcataggcgggcaggatatgttcctgcgcctcgaccacactgacctcggcgccgagcttgcgataagcaatgcccaactccaggccgatatagccgccgccgacgacaatcaggcgcttgggcacacgggtgggcgccagcgcttcggtcgaggagatgatcggcccgccaatcggcaacatcggcaggttgacgcttttcgaaccggtggccagcagcaggtgttcgcattggatacgctggtcgccaacctcaaccgttttgccgtcgaccaccttggcccagccgtggatcacttgcactttgtgcttcttcaacagcgcagcgacgccggtggtcaggcggtcgacgatgccgtctttccattccacgcttttgcggatatccagcgtcggcacatccacttcgatgcccaactgcgagccctggctgtggtgcacggtttgctggaactgctcggccacgtggatcaaggctttggagggaatgcagccgatattcaggcaggtgccgcccaacgcctggccttcgaccagaatggtcgggatgcccaattgaccggcgcgaatcgccgccacgtaaccgccagggccgccgccgataatcagcagcgtggtgttcaatgtctcagacatgccttactccaaaaacaggctggagggttgttcgagcaggccgcgaatggcctggatgaattgcgccgcgtccatgccatcgaccacgcggtgatcgaacgagctggagaggttcatcatcttgcggaccacgatctggcccttgatcaccatcggccgctcaacaatgcggttgacgccgacgatggccacttccggcaggttcagcaccggcgtgctgacaatgccgcccaaggcacccaggctggtcaatgtaatcgtcgaacccgacagctcatcgcggctggccttgccattgcgtgcggcagtggccaaacgcgcgatttcctcggcattgccccacaggctgcgggcttcggcgtgacgcaccaccggcaccatcaggccgacgtcgctctgggtggcgacgcctacatgcaccgcgccaaggcgggtgatgacctggttttcgtcgtcatagcgtgcgttgatctgcgggaagtcgcgcagcgctacgaccatggcgcgcacgataaatggcaacaaggtcagcttgccgcgtgtagcgccgtgtttttcattgaggtgcacgcgcagctcgtcgagggcggtgacgtcgatctcttccacatagctgaaatgcgcggcgcgccgggtggcgtcctgcatgcgttgggcgatcttgcggcgcatgccgatcaccgggatttgtgtttcgtcgttgcgttcggcgtaagggttggcggccgctttatttttcgccggactctggagcaagaaagcctccagatcttcgtgcaaaatccggcccgccgggccagagccctggaccaggcgtagctggatgccagcatccaacgcatgtttgcgtacagccggggaggccagcggacgttcgtcggcctcacgggccaccggggcctgaacctgggtcgcctgaggtattgtcactgccggcgcgggcttgctttcaaccggcgcgggtttggcttcaaccaccggcgccgccttcgcaggcgccgccactggcggtacatccttggcgttaccggcgccttccacttcaatgctgatcaaaatactgcccacggccatgacttcgcccggctcgccgccgagggaaatcactttgccgtgaaccggcgagggaatgtccaccatcgccttgtcggtcatcacatccgccagcacctggtcttcaaccaccaggtcgccgacctttacgtgccataccgacagttcaacttctgcaatgccttcgccaatgtccggcatcttgataacgtgcgtgcccattcagacctccatgacccgtttcaacgccgcgcccacgcgggacggccctgggaaatacgcccactcttgcgcgtgcggatagggcgtgtcccagccggtgacgcgttcgatgggcgcttccaggtggtggaagcaatgctcttgcaccagcgacaccagctcggcgccaaagccgcaggtgcgcgtggcttcgtgcaccaccacgcaacgaccggtctttttcaccgacttgacgatggtttccaggtccagtggccacaggctgcgcaggtcgatgacctcggcgtcgatgccggtttcttcggcagccacttgcgacacatacacggtggtgccgtaggtcagcacggtgacggccgaacccggacgcacgatggcggccacgtccagcggcacggtgtagtaaccgtccggcacttgcgcttgcgggtgtttcgaccacggcgtcaccgggcggtcgtgatggccatcgaacgggccgttgtacaggcgcttgggctccaggaagatcaccgggtcatcgttttcgatggaggcaatgagcaggcctttggcgtcgtacgggttggacggcattaccgtgcgcaggccgcaaacctgggtgaacaccgcttcgatactctggctgtgggtctggccgccgtagatgccgccgccgcaaggcatgcgcatggtcagcggcgcagtgaactggccggccgagcgataacgcaggcgagcggcttcggagatgatctggtcggtggcggggtagacgtagtcggcgaactggatttccgccaccgggcgcaggccgtaggcgcccatgcccaccgccacgccgacgatgccgctttccgagatcggcgcgtcaaacacccgcgagctgccgtacttgttctgcaagccttcggtgcaacggaacacgccgccgaagtaaccgacgtcctggccgaacaccaccacgttatcgtcacgttcgagcatcacgtccatggccgagcgcagggcctggatcatggtcatggtggtggtggtcatggcggtttccagttcaatactgttgttgtgatcgttcatgtcagatccccaactcttgacgctggcgcttcaagtgctccggcatctctttatagacgtcttcgaacatggtcgcggcgcttggaatctggccaccggccagggtgccgtactgttcggcttccttttgtgccttgaccacttcggcctcaagttcggcgctgaccgccgcgtgttcctcttcggaccactggccaatcttgatcaggtgctgcttgagacgggcaatcgggtcgcccaacgggaagtggctccagtcatcggccgggcgatatttcgacgggtcatcggaggtggagtgcgggccggcgcggtaggtgacccactcaatcagagttggcccaaggttgcggcgcgcgcgctcggcagcccaggcggaggcggcgtacaccgcgataaagtcgttgccgtccacgcgcagggaggcgatgccgcaaccgacgccgcgtccggcgaaggtggtggcttcaccaccggcgatggcctggaaggtggagattgcccactggttgttaaccacgttgagaatcaccggcgcgcggtacacgtgggcgaaggtgagggcggtgtggaagtcggattcggcggtggcgccgtcgccgatccaggccgaagcgattttggtgtcgcccttgatcgccgaggccatgccccagcccacgccttgtacgaattgggtggcgaggttgccggaaatggtgaagaagccggcgtccttgaccgaatacatgatcggcagctggcgccccttgagcgggtcgcgctcgttggacagcagttggcagatcaggtctaccagcgggacttcgcgggccatcaggatgctttgctggcggtaggtggggaagcacatgtcgtcgatgttcaaggccagggcctgggcgctgccgatggcttcttcgccaaggctttgcatgtagaacgacatttttttctgacgctgggcgaccaccatgcggttgtcgaagatccgtgtcttgagcatggcgcgcatgcctttgcgcaggatctcgacgggaacgccttcggcccatgggccaagggcctggccctggtcgtcgagcacgcggatcaggcctttggcgaggtcggcggtgtcggcgggttctacgtcgatggcgggtttgcgcaccgtacctgcgtcagtcaggcgcaggtaggtaaagtcggtcttgcagcctgggcggcccgagggttcgggcacgtgcaggcgcagtggttcgtactgctgggtcatggctttctacgctctatcttgtgaatttcttgtagtgggcgcgctagctgacagtcagtctccggataggagaaatcttgtcctacaacaatcataggcgtggcgtagaagaatatttatctctgtttcgttgcgctcgtgatcatttgcggataaaaaaactgcataaacataataaacaggtgattttgtctcatgcgtaaactggaccgtaccgatattggcattctcaacgccctgcaggagaacgcccgcatcaccaacgccgacctggctcgctcggtcaacctgtcgcccacgccgtgtttcaaccgggtcaaggcgatggaagaactgggcctgattcgcgaccaggtcacgctgctcgacgccgacctgctgggcctgcacgtcaacgtgttcatccatgtaagcctggaaaagcagaacgagctggcattgcagcagttcgaaggcgcgatctcggaccgcccggaagtgatggagtgctacctgatggctggcgacccggactacctgatccgcgtgctggtgccgaccatccagtcgctggagcgcttcatgatggattttctgaccaaggtcccaggcgtcgccaacatccgctccagctttgcgctcaagcaagtgcgctataaaactgcattgcccctgccagccaatggcatcagcctggggagctgaatcacctcagtcaaaatgtgggagctggcttgcctgcgatagcggtgggtcagctgagaaatttggtgtcagcaataccgccatcgcaggcaagccagctcccacagtggattcggtgtccttacagttggttaagcggaatcttcaggtaaaccaccccattctcctccgccggcggcatatgccccgcccgcacattcacctggatcgccggcaacaacagtgtcggcatccccaacccggcatcacgttgcgtgcgcatcgccacaaacgccgcctcatccaccccgtcatgcacatgaatattccccgcgcgctgttcagcgacggtggtcagacacttggcctcccggccttcgggcgggtagtcatggcacacgtacagttcggtttccaacgggaaggccagcaacttgcgcatcgacgcatacagctgccgcgcatcgccgcccggaaagtcgcagcgcgccgtacccacatcgggcatgaacagcgtgtcacccaccagaatcaaccgatcttcgatcaggtaggccatgtccgccggagtatgccccggcacatgcagcgcttgggctttgaggttgccgatataaaagacctcgtccggcgcaaacaaatggtcgaactgcgaaccatcgacgcgaaactccggttccaggttgaacaggttcttgaacacgccctggaccttgctgatcgactgaccaatcgcgattttgccgcccaacgtgcgccgcaggtaaggcgcggcggacaggtgatcggcatgggcgtgggtttccagcagccattgcacctgcaagccgtgctcacgcacaaaggcgatgactttgtcggcttgggctgtatcggtgcgccccgaggccgggtcgtagttgagcaccgagtcgacgatggcacacggtccaccgtcattttcatggatgacgtaggtgaaggtcgacgatgcctcgtccagaaaagcgtggatcaacgctggcatggcggctgtccctgtttagaaaaatacgatgaaaaaagtggttacaatcagtttacgtttacacataatgttttgagcttaagtgacgtaaaggacccgaagcaaatggaatctactctgagtgagggcgaagtcgcccagttgcgcgcatcggcgtccaaggcctgctccttgctcaaggcgctggccaacgaggatcgtttgttgatcctgtgccagctgacccaaggcgaacgcaatgtcggcgagctggaaaccatgaccggcgtaagacagcctacgctgtcacaacagttgggcattttgcgcgacgaagggttggtcgccacccgtcgggaaggcaaatacattttctacgggctggccagccatgaagtgattcaagtaatgaagaccctctccgggctgtactgcggtgcggtcatcaaaagctgggcgtgacgccatccggcagcgacccttgtgtgcatgtataaaaaggcgatcgacatgaacgaccaacactgtggccccaccatcagtggcgatatcgtagtcattggcggcggttcggcgggcatcggcctgctggccagcctgctcaagcgtgatccgcatctgaacatcaccctgatcgaaccgagtgaataccactgctaccagccggcctggaccctggtcggcggcggcgcctacgacgtcaagaagacgcggcggcccatggcggatgtgttgcccaatggcgtgagctgggtgcagtccgccgtcagcgagttgctgccggatgagcaaaccctggtgctcgacagcggccagcgcgtcacctggaacaacctgatcgtgtgccccggtttgcgcctggcctgggaaaaagtcgaaggcctgcaagacacgctgggccagaatggcgtgacgtccaactacagctacgagcacgccgcctacacctggcaattggtgcagcagctcaagggcggcaaggcgatttttacccagccggccatgccgatcaaatgtgcgggcgcgccgcaaaaggccatgtacctgtcctgcgatcactggctcaagcacggcaacctgaacaacatcgacgtcgaattcgatcttgcgggcgccgcgctgttcggcgtggcgacctttgtgccgccgttgatgaaatacgtcgagaaatacaacgcgcggctggcgttcaactccaacctggtcaaggtcgacggcccggcgcgcaaggcgtggttcgaggtcaaggacgccgaaggcaacgtcaccgtcgcggaaaaaaccttcgacctgctgcacgtggtgccgccgcaaatttccccggactttatccgccaaagcccgctggccgatgccgccggttggtgtgaagtgaacccgcacagcctgcaacatctgcgttatccgcacatcttcggcctgggtgatgtgtgcggcaccaccaacgccaagaccgccgccgccgtgcgcaagcaaatcgtggtggtcgccgaaaacctgctggccctgcgcaaacaggcgccgctgccgctcaagtacgacggctacggctcctgcccgctgacggtagagaagggcaaggtggtgctggccgagttcggctacggcggcaaactgctgccgacgttcccgctggacccgacccaggcgcgccgttcgatgtggttcctcaaggccacgctgctgccgtggttctactggaacggcatgctcaagggccgcgagtggctgacccgtctgagcaaggtggactaaatgctattggcaagtctgttgggcgtgttgatgggcctggtcatgggcctgacgggcgcaggcggtggcatcctcggggtgccggcgttggtgttggggttgggtttgaccatgacccaggcggcgccggtgtcgctgctcgccgtgggcgcggcggcggcagtcggcgccatcgatgggttgcgccatggcctggtgcgttatcgcgcggcgatgttgatcgcgttgctgggtgcatcgttttcgccgctgggggtgtttgtcgctcaccaaatgcccgaacccgcgctgatggggctgttcagcgcgctgatggtgctggtggcctggcgcatgttgcagcgcgaaaaggtcgaggccgggccgagtgaccatggcgccgcgtcctggggccagaagaactgcatgcttgatcagcagaccgggcgctttgcctggaccgccaagtgcagcgccaccctggccgccctcggcgcggtgaccggtgcggtgtcgggcttgctcggcgtaggtggcggctttctgattgtgccggcattcaagcagctgaccgatgtgcagatgcgcggcatcgtcgccacctcgttgatggtgatcagcctgatctcgctgatcggcgtggccggcgcgtttcatgccggggtgagcatcgagcccatgggctgggtgtttatcggcgcaagcatcgtcggcatgctgatcgggcggcgcctgtgttcggtgatcaaggcgcgcaccctgcaagtgggctttgccagcctgtgtgtggtagtggccgccggcatgctgctcaaggccgcgctctaattccgacctgaaatacatctcaactgtgggagcgggcttgctcgcgaaagcggtgtgccagatacggaatgagtcgactgacccaccgccttcgcgagcaagcccgctcccacagttttgactatgcccgctcaagcaatcaattgcggccctgacatggcaagatgaactctgctcaggtttactactccctgagtaacggatttaccgaccttgcacgtcggctcatcaaggccaccgaatggacaacaaatacacccctcacacctggcagccccacgagcgaccgagcctgcctggctcgccgtcgacgccgctgcacagcaacccgaagcgctgggcctttgcgctggtcggtgtgctggtggcaatcaccggcgggctcggcaacgcgttggtgatcgccaacctgcaatacttgcaaggcgccttgggtgcaaccaccgccgagatggcctggctgcccgccgcctatgtcatgaccaacgtgtgcatgaacctgctgctggtgaagtttcgccaacagtttggcctgcgcgcgtttaccgaggtgttcctggtgctgtacgcgctggtgaccttcggccacctgttcgtcaacgacctgagttccgccattgcggtgcgggcggcccacggcatggtgggtgcggcgctgagttcgctgggcttgtactacatgatccaggcgttcccggccaagtggcgcatgaaagccctggtgctgggcctgggcaccgcgcagttggcgctgccgctggcgcggctgttttccgaagacttgctgcaaattgccgaatggcgcgggctgtacctgtttgagctgggcctggcgctgatctgcctgggctgcgtgttcctgctcaaattgccgccgggcgaccgcttcaagacctttgaaaaactcgacttcctcaccttcggcatcctcgccaccggcgtcgccttgctgtgcgcggtgctgtccctggggcgtatcgactggtggctggaagcaccgtggatcggcgtggcctccgcctgttcgctggtgctgatcatggctggcctggccatcgagcataaccgcgccaacccgctgctgatgacccgttggctgggcagtggggtgatgattcgcctggcgctggcggtggtgttgattcgcatggtgctgtcggagcaatccaccggcgccgtgggctttatgcaaatgctcaacatgagctatcagcagatgcacacgctgtacgtggtgatgctggccggggcgattgccgggctggtggtcagtgcgctgacgatcaaccccgcgcacctgctgatgccgctgattatctccctggcgttgatggccacgggttcggtgatggacagcttctccagcaacctgacccgcccgcaaaacctctatatcagccagttcctgctaggctttggcggcaccttctttctcggcccgaccatggtgctgggcacgcgcaacgtgctgaccaacccgcgcaacctggtgagtttttcggtgatgttcggtatctgccagaacctcggcggcttgattggcgcggccttgctcgggacgttccagatcgtgcgcgagaagtaccactccagcatgattgtcgagcacctgaccttgctcgacccgcgtgtggccgcgcgggtgcagagcggcggttcggcgtatggcgggatcatcgccgacccggagttgcgcaacctgatgggcattcgcagcctggccacggcggccacgcgtgaggcgaatgtaatggcctacaacgatgtgttcatgctgattgcgatcatcgcgatcctcaccatgctctggatcttcacccgcagcctgtggctgatgagtaccaccaaggcagcagcccctcccgttcaacccagcggcgttacttcatgaccgaaccgactaccagcactacgacaaccaccaacgccatcgcctccaccccggaaggcaccacgccggcgggcgcctcggtcaccgagccgcgttcgctgcgggtacgcattatctcgtcgttgggctttgccgcgattgccatcgtcggcgtactgatcgtgctgtatgcctggcaattaccgcccttcagcagcgcggtggaaaccaccgagaacgcgctggtgcgcggccaggtgacgattatcggcccgcaactcgccggctacgtgttcgaagtgccggtgcaggacttccagttcgtcaaggccggcgacctgctggtgcgcctcgatgaccgcatctacaaacagcgcctcgaccaggcgctggcgcaactggcggtgcagaaagccgcgctggccaacgtggtgcagcaacgcaacagcgccgaagccaccatcaagctgcgccaggccgcgttggtcgacagccaggcccaggcgcgcaaaagcaccgccgacctgcgccgcaatgaagaactgatcagcgacggctcggtgtccaagcgcgagctggatgtgacccgcgccgccaatgcacaaaccatcgccgccgtggcgcaggcccaggccagcctggaaatcgcccggcaggacctgcaaaccgtgatcgtcaatcgcggttcattggaagctgccgtggccagcgcggatgcggcagtggaactggcgcgcatcgacctgtccaacacgcgcatcctcgcgccgcgtgacggccagttggggcagatcggcgtgcggctcggcgcctacgtcaactccggcgcgcaattgatggcgctggtgccgccgcagctgtgggtgatcgccaatatgaaggaaacccagatggataacgtgcaggtcggccaaccggtgaccttcaccgtggatgcgctgaaccaccgcaagtttcacggtacggtgcagcatatttccccggcgaccggctcggagttcagcctgctgcaggcggacaacgccaccggcaactttgtgaagatcgcccagcgtgtgccggtgcggatcacggtggacccggatcaggccgagagcgaacgcttgcgaccggggttgtcggtggtggtgagtatcgataccgccggccgcctcaaaaacaccccgccctgaccgacgcgaaccctgtgggagctggcttgcctgcgatgcaagcagctcggtctttcaggtacacagagtcgatgccatcgcaggcaagccagctcccacagaccccggcactcgcggataaccgcatcaccgctagagcacgaagctgggttcgggcaacccatgcacgcctggattgagggcaaatacgccacccgacagcgactgctcactctggtcgtcacgaatcgaggtgacgaacagcgtgtccaggcgactgccgccaaaggcgcacatgctgggttttttcaccggaacgctgagggagcgatcgaggcgaccttccggggtgaaacggtgaatcagcccagcgtcgttggcgcagatccagtagcagccgtcagcgtcgaccgccgcgccgtcggggcggccgggcagcggctgcatgtccacgaacacgcggcgattggagggcgtgccggtctcggtgtcgtaatcgaacgcccagatctgctgcaccagagggtgtgagtccgaggcgtacatcgtgcggccgtccgggctgaacgccaggccattaagggtgataaacccgttcaattgggcgcgcggcgccgaacccgatgcgtagcgatagagcgtgccctcggctgcgttcaaacccatgttcagcaccatgctgccggcccagaaacggccctggcgatcgcagcggccgtcgttgaggcgcatgtcggcgcgcgggtgctcgacactcgccaggggcgtggtgtcgaggctgccgtcgttatgcggggtgagctggaaaaagccggtttccatcccggcgacccagttgcccgcggtggtgcgggcaatgcaggcgagcatctgcggggcggtccaggcggcgatgtggccggtggcggcgctccagcgctgcaggccaccgttgggaatatccacccaatacagcgcgttttcctccggcacccacaccgggcattcgcccacggcattgcgggcgtcgacgatcaattcagcagtcatggccactcattcccttgggttgctgtgcactcagtcaccgaacggccccgccgcgcagaacgcgccgccctgatagaccttggccggatcatcggcggccaccggtggctgggtttcgacctgggcgcggaacacttcggagctgtctttgggcgcgtaacccaggtgtgcggcgtagcggttgtcccaccaggtatcgaggttatccgacatgccgtagaccacggtgtgcccgacattgggcgtgtacagcgcgcgttcgagcagttgggtcaggtcttcgaagctcagccaggtgtgcatcatccggcggttttgcggttccgggaatgaagagccgatgcggatgctcacggtttcgatgccgtagcgatcgaagtagaaactcgccatgtcttcgccataggatttggacaagccgtagtaactgtccggacgacgcggcgaatgggcgtcgagtttttcgccctgcttatgaaagccgatcacatggttggaactggcgaagatcacacgcttcacaccatgacggcgggcggcttcgtagatgtggaagatgccgctgatgttcgcgccaagaatctcttcgaacgggcgctctaccgaaacgccaccgaaatgcaggatggcatcgacgccttccaccaagtggtgcacggcttgtttatcggcgaggtcgcacggttgcacttcttcgctggcatcggcagccggggccatcgaggcgatgtccgacaggcgcaacacctgggcataagggcgcaggcgttcgcgcaagactttgccgaggccgccggcggcaccggtgagcaacaggcggttgaatggagcaggcgtggtggtggtcatgggaattccattgttgttgtaggttgtcgtatgacttgtcggaagtatcgttttggactccccaggttgtcaacgccttgccagacgacaggtttcaaaaggtgggagcaggtaagccagctccccatgcctgctcgttcccacgctctgcgtgggaacgcctcttgtgacgctctgcgtcacgctttggacgcagagcgtccagggctgcattcccacgcgggagcgtgggaacgatcagcaatctcaaaaggtgggtgctggcaagccagctcccacatgcctgctcgttcccacgctctgcgtgggaacgcctcttgtgacgctctgcgtcacgctatggacgcagagcgtccagggttgcattcccacgctctgcgtgggaacgcctcttgtgacgctctgcgtcacgttttggaagcagagcgtccagggctgcattcccacgcgggagcgtgggaacgatcagccagctcccacattgaccgagttataacagcgagatcggatagctgataaaaatccgattctcatcgaactcattgttgctgaaatcccgacgcatgctcgaattcctccagcgcacgttcaagtccctcagcgcgccgctctgcaccgtgtaggccagttccgattcgcggccccattccttgccgtcggtaatcgccccggtgtgcacgttactgccgctgatatagcggttcatcatggtcagccctggaatgccgagcaccacaaagttgaagtcatggcgcacctgccaggatttttccttggcgttatcgtagctggcgttgtaactgtcgttggccagggtgccgccgctggtgccattgaccctcatccacaggctgtcgccggtgagtttctgcaggcccacgtagaacgtgttgccgttgtagcgggccgagagcagggccgagacggtcttgttgtcgaggtcgccggccagtgcgcggccatcttccttgccgttgaaataaccaaggttggcgcccagggtccagtcgccgacaggttggctgtgggtcaggttgaagtattgctgctggtagatatcggttaattcggcgtaccacacgccgacctgggtgcgcttgtcattgaagctgtattcgccgccgccaaagttgaaacggtcggaagtgaaggccgctttgccgttcatgaacatgtcttccatgctcgcgtcgttgcgcgggctgttgccgcgaaactgcccgccgtagagggtcaggccggcaatttcgttggacgtgacctggccgccgcgaaaggtctggggcagcgagcggccatcgtcggagcgcaggatgggcaacaccggcatccactcgccgaccttgagttcagtcttcgacagcttggttttcaaggccacgccgaggcgcccgaagttgtcggcggggcgcccgtcgctgtggatcggcagcagttgcgtgccaccggtgcctttgccgccgtcgagcttttgcgagtacaggcccagcacatcaaggccgaaacccacagtgccctgggtgaagccggatttggcatcgaggatgaagttctgcgtccattcctcggccttggcctgcgggtaggtcgggttggtgaagttgcggttgaagtaggcgttgcgcaggttcagcgtggctttggcgtcttcaaggaaaccgtcggcccgggcgttgtggggcagggcgaaggccaggctgctgaggccgataaggcggatgcacgaggaggaattgcgggcgaatggacgcactgtgaagctcccttttcttttgttgtttttattatttgttatacgttgtcgtacaacgttgggcgggatatttgcggggttttactggagtgtcaagtagaagttatacgatgacctggcattgcccgacctgaagtgggcaccgtcactgtgggagctggcttgcctgcgatggcatcgccgaggtgtagttgtgggaccgaggcgcccgcatcgcaggcaagccagctcccacaggtcgagcacatttcaaagctgatttttagttggccatgaccatcggcggcagggtgcccagcagggaaaccgccgccaccgccgccacacccaatacccattccagcatcacgctggccttcaaactgcccaagcgctcttcacagcgctcaatgcgcagccggttcagcagcgccagtgccaacatacccagcaccagcagcaccttgatcaacagaatcagcgcaaagccgttgaacagcggcgtaggccacagctgcccggtcagcacacgcacattgatcaaaccggtcaccagcaaaccggcgaccagcccgtaccccacgccgctgaagcgccggaggatgggctccagcgcaggccgttgccgctgcctgaggatcaacaccagcaacagcaacccaccgagccaggcgccgacacacaccaaatgcaccacctggttgaggatcagcaattgcccgctcagcccattgagcatggcgccgtggccgaccggggcgagcgtggccaacagcagcgcagtcagcggcaggcgcagggccggccaaggtttgatcagcacgatcaccagcagcaggttcagcaccaggtgccagacccacacctggccaaagaaggttttgctcagcaccaactgcacggtggccggttgcagggccgccgcccaactgccggccatgctggcggtgatcaacaacagccacgccacgccggagaccaaccccagccaggccagtacacgggtgatgcgctgcaggtaccggtccagcgccggctgcggttcagcgccgagcagccagggcctgaacgcacaggccccgaacatcaacaacacgacgatgaaatgcaggaagcggcacagcaccagcagggtcgccatgggttattggccgaccttgaagctgtattcaccgttgctcttgtgggtgtcgaccgacaccgcgttccacaccactttgtaggtgccggctgccagcggtgcggcgggcgtgacgaccagggttttcttgtcggcgtccggggtttccaggcccttgatcgcgacttcggtgccgtctttgctcagggacaccttggtgaacgtggcttcgacgccttcgctgaaggtcaggcgcaggtctttcggcgcggtgacgctgctgtctgccgcaggttccgaggttttgaggtgagcatgggcaaacgccgccgaggcgccgagcagggacgccagcagggcgacggtggtcagggttttcttgatcaacattgttcaataccttcaggtttagagagtcggtaaagccatgtgcagcaagggaaagggtttgccttcgccatccagcggcgagcgcgcgacctggataaaaccatagtgcaggtagaagcccacggcttgcgggttttgttcgtttacatccaccgtcagggtgtcgtggcgggcgcgggcgtggtcgagcaattggcggccaatgccctggccacggcgatcggggtcgataaacagcatttcaacgttgtgcccgccggtgccgataaacccggcgatgccttggcggtcttcgaacacccagacatccagtgcaggcatcggcaggtaggcgtcacgcaccaggggcagcaggcgctggatgtcatcctcggggaggaagtcatgggtggcccgcaccgaacgctcccacagtgctcccagcactgggtcgtcggcggccacgcgaggtcggatagtcatggcaatgatccttcatggggatcgcgatcctaaccaatccgttttgcaggggaaaggttcgcgtaagaagtttcattatgccctgtcgccgcgatctagagccgatggtagtcttgaggccatgttgttgtcagggagcccttatgggcaatcacaaaatcggaattcgtcgggtcaacgtcgaaaagatcctgctggcggcggagaaaatcttcgctgaaaaaggctatggcagcaccgccatggccgacatcgctgaagaagtgcaactgccgcgctccaacctgcattactacttcaccaccaaaagcgagctgtacagcgcggtgctgttcgacttgctggaagtgtggaagcaggacgccctgagctttgaaaccttcgatgacccacgggtggtgctcagcagctacatccgcgccaagatgcagcgctcgcgcacgcggccgtatggctcgaaagtctgggccaatgaaatcatccacggcgcgccgacactcggtgaggcgttggatgaaagcctgtacgactgggccaagatgaaggaagcgaaaattcgccagtgggtggaggacaaacgcatcctgccggtggagccgtcgagcctgctgtatatgatctgggcctcgacccagcactatgcggactttgaccaccaggtgaagattttgaatgatcaccagccgttgtcggacatgcagtttgagaaggcgattcagacggtgacgggggtgattttgcgcgggattggcttggagccgtaatgatcgttcctacgcgtgatcgttcctacgctccgcgtgggaatgcctcactggacgctctgcgtccgctcttgggacgcggagcgtccctggctgcattcccacgcggagcgtgggaacgatcaatcaagcgctacaccgcctcccgatacggattgcgcggatcctgggtccaattcaaaaacggcttgcccgtgtccatcggcaccatctcaatgcaatcggccactgggcaggtgatctggcacaaattgcagcccacgcactcatcgtcaatcacctcgtatttatgcgtgccatccgcctgcttcaagctcgcaatcgcctggtgcgaagtgtcttcacaggcaatatggcaacgcccgcaaccaatacaggccgcctggtcgatcttggcgatcacctgataattgatatccaggtacttccagtcggtggtattgcccaccgcccgcccggaaaactcctgcaggcttttgtagccttggctgtccatccagcgcgacagcccatccttcatttcttcaacaatgcgaaacccatgcagcatcgccgccgtgcacacttgcactgcgccgcaacccaacgcgacgaattccgctgcgtcgcgccagttgccgatgccgccaatcccgcagattggcaagccttgggtctgcgggtcgcgggcgatttccgcgaccatgttcaaggcgataggcttcaccgccgagccgcaataaccgccgtgggtgctttgggtgccgaccaccggcagggcgaccatgcgctccaggtccacgctggtaatggagttgatggtgttgatcagtgacaccgcgtccgcgcccccgcgatacgccgcacgcgccgccacccggatgtcggtgatattcggcgtgagcttgacgatcaccggcagcgagcagtacgtcttgcaccagcgcgtcacctgctcgacatattccggcacctggccgacggccgcgcccatgccgcgttccggcatgccgtgagggcagccgaagttcagttcgatgccgtcgcagccggtggcttccaccagcggcaggatgtttttccacgattcttccacgcacggcaccatcagcgacacgatcagcgcgcggtcgggccaatcctttttcacctgggtgatttcgcgcaggttgatctccagcgagcggtcagtgatcaactcgatattgttgatgcccagcacttcacggttggcgccatagtgcgcggaataacgcgacgacacgttgaccgccgccgggtcttcaccgagggttttccagaccacgccgccccagccggcttcgaaggcgcggaccacgttgtaggccttgtcagtgggcggcgcggaggccagccagaacgggttgggggctttgataccggcgaatacaatcgagagatcggccattacgcagcctccacattcagcatgagttgggcgtgcatggcttcggcggccagcttgccgtgttgcactgcctgcacggtgaggtcctggccgaggctgacgcagtcgccgccggcgtagacgcctggaatgctggtttgcaggtgttcgtcgacgaagatgcgctcacccacgcggtgcagttgttgcgccagcgggtcgtgcagcgctgcgttatcgaaaccttggccgatggccttgaagatcgcatcggcggccagttcgaaggtttcgccggtgggctgcaggcgaccgttttccatgcgcgtgcgggcgaagcgcatgccgcgcacacggccctgatcatccaacagcacttcttccggttgagcccaggtcagcaggcgcacctgattggccttggcaatctcctgttcatgcccagtggcgcccatgtcggcgaggccacggcggtacaccaggttcacatcacgggcgccgaggcgagccatttgcacggccatgtcgatggcggtgttgccggcgccgagcacgatgcagcggtcggccaagggcagttgagtgaggtcgtcggcctggcgcagttcgcggatgtagtcggtggcggcgagcaaaccgggggcgtcctcgtgcggcaggccgagctgtttgctggcggcaaggccgaggccgaggaacaccgaatcgaactgctggtgcagttcgctcaaggtcaggttgtcgcccaggtgctggccgtggcggatctcgatgccgccaatctgcaggagaaaatccagttccttctgggcaaagtcatccaccagtttgtacttggcgattccgtattcattcaggccgccggccttttcccgcgcttcgaaaatcaccacgtcatgaccgtgcaaggcggcgcggtgggcgcaagccaagccggcaggcccggcgccgaccacggcaatgcgtttgccggtgggcgcggcgcgctggaacgggtgttcgctgaagtgcgcgttgtcggtggcgtagcgttgcaacaggccgatcagcacaggtgcgcattcttcggcgttgttacgcacacaggcttgctggcacagaatctccgtagggcaaacccgcgcgcagctgccgccgaggatgttcgccgagaggatcttttgcgccgcgccttgcacgttgtcggtgtggatattgcggatgaatgacgggatgtcgatttcgctggggcatgcattcacgcacggcgcgtcgtagcaatacaggcagcgcgaggcttccagttgtgcctggcgggcgttgagcgggggcgccaggtcggtgaagtggctggcgagggtcggcccatcttcatggggatgggggaggtggttcagggtctggatcacggtgtgggcctcacggttttttttgcctctgacgggcgatcgttcccacgctctgcgtgggaatgcctcactggacgctctgcgtccgctcttgggacgcggagcatccctggctgcattcccacgcagagcgtgggaacgatcatgtgcgctgtatgttcagcgctttacagcagtgggcctcgaatgctcggcccgcttgctcaactgctcaaacaccgccgggtacgccggccgttccacataccgtccggcaccgcgttcggcgcgcaggtcgccatcggcccagaccaatttgccctggctgatggtgtggctcggcacaccgcgcacggtcttgccttcgaagatgttgaagtcgactttttgatggtgggtcttggccgaaatcgtccgcgtgcccgcagggtcccacagcaccaagtccgcatcggcacccacccgaatcgcacctttacgcgggtaaacgttgaagatcttcgcggtgttggtggaggtcagcgcaacgaattcctgcatcgacaggcgaccggtgttgacgccttcgtcccacagcaacgccatgcggtcttcgatgccggcagtgccgttggggatcttgctgaaatcgtcacggccagcggctttttgctcggcgcagaaacagcaatggtcggtggcggtggtgtgcaggttgcccgattgcaggccgtgccacagcgcttcctgatgcccgcgcgggcggaacggcgggctcatcacgtagccagcagcggtttgccagtcagggtgttggtagacgctgtcgtcgagcagcaagtggccggcgagcacttcgccgtacaccggctggcccttgccacgggcgtaggtgatttcatccagcgcttcctgggtggacacgtgtaccagatacagcggcgtgccgatggtctcggcgatgcggatcgcccggctggccgcttcgccttcgacctgggaagggcgcgacagcgggtgcgcttccggcccggtgatgccttgggccatcagcttgcgttgcaggtgatacaccagctcgccgttttccgcgtgcacggtgggtactgcgcccagttccaggcagcgttcgaagctcgcgaccagggtgtcatcggcggccatgatcgcgttcttgtaggccatgaaatgcttgaagctgttgatgccatgatggctgaccagctcggccatttcctcgcgcacctgctcgctccaccaggtgatcgccacgtgaaagccgtagtcggaagcggatttttccgcccagccgcgccactggtgaaaggcttccatcaaggactgctgcgggttgggaatcacaaagtcgatgatcgaggtggtgccgcccgccaggcccgccgccgtgccgctgaaaaagtcttcgctggccacggtgcccatgaagggtaattgcatatgggtgtgcggatcgatgccgccgggcatcaagtattggccgctgccatcgagtatttgagtgccggcgggaatatccagattcgtgccaatagcgcgaattagaccgcctgcgcataacacatcggcgcggtaactttcatcatgggtaataacggtggcgccacggatcaacagcgacatgtcgagttcctcacaggcttgaccggcttgtgccagttctaagtgttgtaatgcggcttgccgatggtcggttaaatcctgtcatcggtgacaggaatagaaactagcccgagtttttagattgagcaagaagatttttcctaagcttataacgattttaactacatgatttataacgataaaaacagttaatcaccaaaatgtagcgacctctcaccattttgacgcacttgacaggttctcgatttgagcaacatttcttattgcaaatcagacgcttgagacatgcctcttgacggggccggtaaataaaaataattgtgttgcaccagattgagtcctgagggttcgggaacttgcgcgttatttagcctgagtaaggcgacaagtactgtaggcacaatcggaaagctgattaacatcagcacgttagttaagcggtgcgggttaaagtcgggtggtcggcacggttattgagtgcagtggcggctggccgggcccgtgatgtcatgttgtttacgaggtactccggccaccctgcgccaagcgttgggtgagcaacaataattcaaaaaacccgtggagcggccatgcaacagaacagatcgcaagtcattgaacgcaacggcctgtacgaactcgacgccggccccgacgtcctcgacagccctcgctataaccacgacatggcacccaccaaggtgcacgaacgcacctggaacaagtggcacatcaccgcgctgtgggtcggcatgtcgatctgcgtgcccacctacacgctgggcggggtgctcaccgcgtacttcggcttgtcggtgggcgaggcgctgatggcgattctgctggccaatatcgtggtgctgatcccgctgacgcttaacgcctttcccggcaccaagtacggcattccgtttccggtgctgttgcgctcgtccttcggcattctcggttccaacgtgccctgcctgattcgcgcgctggtggcctgcggctggtttggcattcaaacgatgttcggcgggctggcgattcacctgtttctgggctcgattttcgacggctggaaatccctcggcggcaccggcgaagtgatcggcttcatgatcttctggtgcctgaacttgtgggtggtgttgcgcggcgccgagtcgatcaagcgcctggaaaccctgtctgcgccgctgctggtggcggtgggcattggcctgctggtgtgggcgatgccgaatgtgtcgctcagcgagttgatggcaattccacccaaacgccccgaaggcgcgagcctcaccggttacttcatggcgggcctcaccgcgatggtgggtttctgggcgaccctgtcgctgaatattcccgacttcagccgctacgccaaaagccagaaggaccagatcctcgggcagattttcgggctgccgctgaccatgttcctgttcgccgcccttggcgtgatcatgaccgccgcgtcggtgaaactggtgggcgtcagcgtctccgacccagtgagcttgatcgggcatatccagagcccggtgtgggtggccatcgccatggcgctgatcatcgtcgccaccttgtccaccaacaccgcggcgaacatcgtctcgcccaccaacgacttccagaacatcgcgcccaagctgatcaaccgcaccacggcggtgatcctcaccgggctggtcgggttggcgttgatggggcatgaactgctgaaaaagctcgggctgatcgtctcggacgtgagcctggaaaccgtgtattcgaactggttgctgggctactccagcctgctggggccgatcgccgggatcatggtggtggactacttcatcacccgcaaacagcaactcgacctggccggcctgtaccgcgatgacgtgtacccggcctggaactggagcgggtttatcgcgttcggcgtgccggtggtgctgaccttgctgtcgctgggcagcgatgcgttcagctggttctacagctatggctggtttaccggttcggcgttgggtgggttgttgtattacgggttgaatgccaaacgcagggccttgccgctcgcagtaaaaacacccctgtaaaaggttgaaatgcaatccaaatgtgggagcgggcttgctcgcgaatgcggtcttccagctgacatttgcagcgactgacacggcctcttcgcgagcaagcccgctcccacatttcagaccccattccaaccgttggaatcgagttaattcataagaacagtagcctgaggagatccccatgaacgctgccatcgacgttctgcaatcgacccatcagcacatcaaccgcgaccgcctgtggcagtccctgatggacctggccaaactcggcgccacgcccaaaggtggcgtgtgccgcctggccctcaccgacctcgaccgcaaggcccgcgacctgttcgtcaaatggtgcgaagacgccggttgcaccgtgaccgtcgacggcatcggcaacatcttcgcgcggcgcccagggcgcaatcccaacctgcccccggtgatgaccggcagccatatcgacacccagcccaccggcggcaagttcgacggctgcttcggcgtgctggcgggtgtggaagtgctgcgcacgctcaacgatctcaagatcgaaaccgaagcgccgctggaagtggtggtgtggaccaacgaagaaggctcgcgcttcccgccgtgcatgatgggttcgggcgtgtttgccgacaaattcaccctggcggataccttggccaaggtcgatgtggacggcgtcagcgtcggcgatgcgttgaatgcgattggctatgccggcacacggcctgtcagcggccacaaggtgggcgcctatttcgaagcgcatatcgaacaagggccgattcttgaggatgagaaaaaaaccatcggcgtggtgctgggcgcccttgggcagaagtggttcgacctgaaattgcgcggtgtcgaagcgcatgcggggccgacgccgatgcacctgcgcaaggatgctctggttggggctgccgccgtggtggcggcggtgaatgcggcggcgttggggcatcagccgcacgcgtgcggcacggtgggttgcctgcaagcctatcccggctcgcgcaacgtcatccccggcgaagtgcgcatgaccctggacttccgtcacctggaaccggcacgcctggattcgatgattacccaggtgcgtaaagtgatcgatgagacctgcgccaagcacggcttgagttttgaaatggagcccactgcggacttcccaccgctgtatttcgacaaaggctgtgtggacgccgtgcgcgatgcggcgaatgggttgggcctgtcgaacatggacatcgtcagcggggcagggcatgacgcgatcttcgtcgccgaactcggcccggccgggatgatcttcgtgccgtgtgagggcggcatcagtcataacgaaatcgagaatgccgccccggatgatttagcggcgggctgtgcggtgttgttgcgggcgatggtggcggcatccgctgcaatcgccagcggaaaactggctgcctgacgatcgttgcctgacgatcgttcccacgctctgcgtgggaatgccgccccagacgctccgcgtctgccttgaggtcgtgacgcagagcgtcacaggatgcattcccacgcggagtgaactgaccccacaaagctggacgattacatgcctatgcctgaacggcctgagttctatatgcaacagggctcaggccgtttagcttcagcttgatacgcgagtgattgtaatact

SEQ ID NO: 36 - DNA, 132858 bp, Pseudomonas poae FL10F
tcaggttgaaatttgcagcaatgactgagggtattgagctcaaggtcgtgtgcaaaccctaaggccagcaccttccaaatgtgggagcgggcttgctcgcgaaagcggtgtgccagccaccagcagtaacgactgatccgccgccttcgcgagcaagcccgctcccacattttgcctgcgtgcaccgaacaatatattaagcggacactttccagggtgggagctggctcgcctgcgatagcggtcggtcaggcaaataatgtcggcaggcctgtcgtcatcgcaggcgagccagctcccacagtttcgatctgaatacaccaatcagcctatattcaggcctgtttggccaacagctccaacccttcatgcaacgccgggaacaggctgttgttgaagttgttccagcgcagttcgaggatggtgtcctcgggggaaatctcggttttcagtacgtcgtggaacacttcaccggaatcgatgccgttgtccacgtagtggaacgacgcgccggtgaggtacagcggttccgacggcgtagtggccttggtcgcccaatccaccacggtttgcccacgcgcgccgtaaagggcattccaggtggcataggccccacggcgctcatagggcgactcgatgcgggtaatgcccgggtgaatgttcatgatccgccgcgcaaacggcgcgcccggccgcaccagctcatccagaatcaccagcaaaccatccagcaccacgatatcggccttcaattccaccagcgtgtcgtgcaggcgacgctcgaagtcctgcttgccggcgatgtgttccgcactgccgcgcggcaggcggcggtaggtggacggcacgctcaacagcaggtcattgaccagacgcccttgtaccttcaggtccgccgggtatagccattggcggcccggcttataggcaaagccgtaatcgctgaccaactgctggtcccgcgggttctgctcatcatcgtcgtagaccacgccgaccaggttgtaagcctcgcccaacggcgtgtcgttcagcgaccccaccagaaactccagcacggacttcatgtagcgctcgtggtccttgtaggccaccggctgcccggccttgtcggcggcggcatttctcagggaccacacatacaccaggttctttttcgtcatttttcgctctcgctgagtgggctgcgcagcgcgtcgatacacgtgcgcctacagcacaagaacgaaccagccccggcgcaatttatcccactgcgctggcgccgagcacgccgagctaaatagtcgcgccgacgcttcgtttgtcatgggtaagggtctgtgtgcccagcccctcttttcactctccgggatgtatttatgaccgaccccaaacgcagcgccttcaagggcctgctcgccttgctcaggcccttccgtaccatcgtgacggtctccgtcgccctcggcatggcgggcggcctggccatcaccttgcttctggccaccatcaacaatgcgctgcattcggccaacggcatgacccaaggcgtggtcctgacgtttgcggcgttgtgcgtgctggcgctggtcagctcgatcatttcggacatcggcaccaactacgtcggccaacgcatcatcgccgccctgcgcaaagacttgggtgaaaaagtactgtcggcgcccatcggccagatcgagcgctaccgctcgcaccgcctgattccggtgctgacccatgacgtcgacaccatcagcgatttttccttcgccttcacgccgttggccatcgccgccacggtcaccctcggctgcctgggttacctggcctacttgtcggtgccgatgttcctgatgatggtggtggcgatcattatcggcagtgccgtgcagttcattgccggcggcaaaggcattcaggggttcgacctggcgcgcagccacgaggatgaattgcagcgctactacaacgcgatcgcttccggtgccaaggaactgcgcatgcaccggccacggcgttttcgcatgaacacccatcgcatccaggaaaccgccgaccgcatcagcgacattcaggtgcgatcggtgaacatctacatcctcgccaagaccttcggctcgatgctgttcttcgtggtgatcggcctggccctggcgatgcaggcctacaacccgaacccggaccctacggtgatcaccggcttcgtgctggtgctgctgtacatgaaaggcccgctggaacacctgctcggttatctgccggtggtgggcaaggccaagattgcgtttggccggatcagcgagctgtcggagcgcttctcttcccccgaaccgcacttgctgatggatgacagcgaagcacccaaaccggtggtcaacagcctggaattgcgcggcgtgagctacagcccaccggcgattgaaggcagcgaaccgttccatctggggccgatcaacctgagcatcaagcaaggcgacatcgtgtttatcgtcggcgagaacggcagcggcaagaccaccctgatcaaactgctgctgggcctgtatccgccacaggccggcgagattcgcctcaacggcgaggccgtcaccgaccccgagcgcgatgactaccgccaactgttcaccacgattttttccgactactacctgttcgacgacctggtgcaaggcagcgccacccagtctctggacagcgcggcgaaatacctggagcgcctggaaattgcgcacaaggtcagcgtcaaggacggcgtgttcagcaccaccgacctgtccaccggccaacgcaaacgcctggcattggtcaacgcctggctcgaagaacgcccagtgctggtgttcgacgaatgggccgccgaccaggacccggcgttccgccggattttctacaccgagctgctgccggacctcaagcgcctgggcaaaaccatcatcgtgatcagccacgacgaccgctatttcgatatcgccgaccagttggtgcgcctgcgcgccggccaggtggtgcacgaaatggaaccggcctgaaatttattttccggtttttccaagtaggaacgtctcactagtggtaatgagaataatactcaatagccacctataacttgcccacttaaacatagaagagaacgcatccatgccagcaagactcggtctcagccccctgagcaaagcgctatccatgcgcagggccctgaacatcaatcttcttccgagcgcactggccctggcgatatcactgccggttgcaggctatgcgcaggcacaggagatcgagctggatattcctgcgcagtcgctggggagcgcgctgcaggagtttgggcgccagaccaacgtgcaggtgctgtacagcccgagcgatgtgcagggcaagagcagccgcgcagtcaaaggcaaactggacccgcagcgggcaatcgacaccttgctgggtgggaccgagacaacccacaccctcaatggcaactcgctgaccgtgaccgccgtcggcacctccgccgggctggaattgagcccgacccaagtgaccggcaacgccttgggcaacatcaccgaagactccggctcctacacgccaggcaccattgccacggcaacccgtttgaccctgacgccgcggcaaaccccgcagtcgatcacggtgatcacccgccagcacatcgaagacttcggcctcaataacgtcgacgacgtgatgcgccacacgcctggcatcaccgtgtcggcctatgacaccgaccgcaccaactactattcccgtggtttctcggtcaacagcttccagtacgacggcattccgtccaccgtgcgcaacgtcggttattcggcgggcaacaccctgagcgacatggcgatctatgaccgcgtcgaaatcctcaagggcgccaccggcctgctcaacggtgccggctccctgggcgcgaccatcaacctgattcgcaagaagcccacctcggaattcaagggccatgtgcaactgggcgcgggttcctgggacaactatcgcagcgaagtcgacgtcagcggcccgctgaccgacagcggcaacgtccgtggtcgcgcagtggcggcgtaccaagacaaaaattccttcatggaccactactcgcgcaagaccgaaacctactacggcattaccgaattcgacctgtcccccgacaccatgctgaccgtgggcttcgactaccaggacagcgttccacaaggctccagctggtccggttccttcccgctggtgaaatacgacggcagcatcaacaaaatgccgcgctcctacaacaacggcaccacctggagttcctgggagcaaaacacccgcaccgcctttgccatgctcgaacatgacctgggcgatggctgggtcaccaagttccaactcgaccacaagatcaacagctaccacgccgaccttggctcgatccagttcgttgagccccagtccgatggcagcgcgtcgatcaacgggcagaagtacaccggcgaaaccaaaagcacatcggccgacctgtatgccaccgggcctttcagcctgttcggccgcgatcatgaattggtcgtaggcggctcgatcggcacctcgcgctggcagggcaagggctattggtcgccggaatggccaggcggcaacaaagtcgatttctacaactggaatggcaagatcgccaagcctatctacggcccggtccagcagtacaccgacgacaatatccgtcaaaccggctactacgtgaccacacgcttgaacgtaatggatgacctgaacgtgatcctcggcgggcgcgtcgccaactatcacgtcaccggtatcaacccttcctacaaggaaaccggccggtttatcccgtatgcgggtgtgatctatgacctgaacgacaatttctcggtgtacaccagctataccgatattttccaacctcaggaaagcacctataaagatcgcaaccaaacgctgctcgaaccggacgaagggcagaactacgagatcggattaaaaggcgaattcttcgacggccgcttgaacaccagccttgcgtatttcgaggtgcatgagaccaatcgcgctatcccggatgatgcctacaacaaccaaaccccgacacccgacaactatgcgttcaagggttccaaggccgttaccaaaggctacgaggcagaaatctccggtgagttgagcccaggctggcaagtgcagggcggttacacgcacaagatcgtgcgcgacgaagacggcaagaaaatctccaccttcgagccggaaaatcaggtcaacctgaacaccacctacaagctcaagggcgctctggacaagttcaccgtcggtggcggtgtgcgctggcagaccaaggcctggaacgagatctggaaccagccgttgaataaaaaccaggacatcacccagtcgtcctacaccgtggtggacctgatgacccgctaccaggtcaccaagaacctctcggccaccgtcaacctcaacaacgtcttcgacaccacctactacaccaacgtgggcttctataactcggccgcctacggtgagccgcgtaacgtgatgttcagcacccgctgggacttctgatcggatgcactgaccgccccaggcgatcaacccaacgcccgatgaaagcgccgctttcatcgggcttttttatgcctgtgtattaagcccatgctcggtcaactgtgggagctggcttgcctgcgatgcaggcacctcgaactatcaggcacccagtggatgccatcgcaggcaagccagctcccacagaaaagcatgtctgcccgggctgaaatccagcacaaaaaaacccggatcgatgatccgggttgatgagtgcagcagcttcttacttcatggcggccaccaggctgttgatgaacgcggcgctgtcgatgatcccgtcatgatcggtgtcgatcatgaccgaacgctcaatgcgcccctggccaatcacacttgccatgttctgctcgatcaggtccttgaactgccccgcgcggcttaacgaggcccaccagcagctgaccggcgccttgatcggcttgaagtccgcggcctccaggcgctcgctcaacgcacggtctacctcccaggaaatctgcgcctcgttgccacgcagcaattcttccttgatgccggtaaatgcctcacccagggtctgttcggcccaggcaacaaacgcttgccattgctcgtcttcatccgcagcctgacgctggcactgctgccacgcgccttcaatctgctcggcaaacgccgggaacatcaccccaagcaacgccgcacggcgctcattggcggatgcctcgcgcccctgctcgacgaccaccgcgtcccaatacggcgtgagccactgcggcggcgccgaatcgatccagccgacaaactccacctcgcgccctgcttgctcaagtgcgtaagcgacctccatcgccaggttgccgcccaacgaccaacccgccaggcggtaggcgccctgtggctgagccaccagtaattgcgcagcgtaatcgtcaaccatcgcctgccactcaggcaccgacgcgccctcttccaccagcgcacggcagatcaccccataaaccgggcgttgctcgcgcaacgccaaggcaatcgcggtgtagcaatgcaccgaaccaaagctcgggtggaacatgaacagcggcgtaccttgggtctggctgttgagcttgacgatcaactcgctgcgcgcgctgccctgcaaacaattgacctgcccgcgcacagtcgggttgagcattagttgactgacagacaggttgaccccgctgacctgccggaggcgttccttgagcaacagcacacgcaaggaatgcccacccaactcaaagaagttgtcgttcagccctactcgctcaacaccgagcacctcgctccagatcgcagccacctgttgctcgatctcgctgtgcggcgcctggtattcccctgcgccgttggcttcaggcttaggcagcgccttgcgatccagtttgccattcgggctcagcggcatctgctcaagcaccacccactgcgcgggcaccatgtagtccggcaagtgcgcggccaagtgcgcaccgaccagggttttccaatccgcactcggcacctgcaataccacgtaacccaccaagtgcgtgccgtccacggccagcacggctgcctcacgcacagcgtcatgttccagcagacgcgcctcgatttcacctagctcgatgcgcagcccgcgcaacttgacctgatggtcgatgcgccccgcgtactcgatcaccccgtcgtcgcgatagcgcgccaggtcgcccgtgcgatacagccgttccccgttgccgaaggggtcagtcacaaaacgttcggcggtgagcgccgggcgacggtgataaccccgcgccaggccaataccgcccaggtacaactcgcccaacacgcccaccggcgccggttccaggttgctgtccagcacgtagcagcccaggttggcgataggtcggccaatcggcacggtgtcactgccttcgtcaacgcacgtccagtgggtcacatcaatcgcggcctccgtcggcccgtacaggttgtacaaccgtgcagcgggcaacttggcaaatacctgttgttgggcgtccaccggcaaggcttcaccgctgcacacaatgcgttgcaggctatggcaggaacccactgccgcatcctgcaagaaggcctgcagcatggagggcacaaaatgcagcgtggtgacctgctcggcgttgatcaagctgaccaaccgggccggatcgcgatgatccccgggcgccgccaccaccaggcgtgcgccggtcatcagcggccagaagaactcccacaccgacacgtcaaaactgaacggggttttctgcagcaccgtatcgcggccatccaggctatacgcctgctgcatccagcagagtcgattggtcagtgccgaatgccgattaccggcgcccttgggctgcccggtcgagcccgaggtgtagatcacatacgccaggttctcaccatccactgcgacatcagggttgtgctcgctgtagccatccagccacgccgcgccgctctccagcaccaagctctccagcagcaggctctgcacgcctgccggcagcggcagctgcgccagcacatgagcctgggtcagcagcagattcacgccgctgtcctgcagcatgtaggtgagtcggtcacgcgggtattccgggtccagcggcacataggcgccaccggccttgagcacggccagcaggccgacgaccatctcgatggaacgctccaccgccaacccaaccagcacgtccggccccacacccgccgcgatcaagcgatgcgccaagcggttggcacgacggttcagctcggcgtaactcagctgctgaccggcaaaggcgagcgccggtgcgtccggcgtacgcagcacctgagcttcaatcaactgatgcacgcccagttgcagcgggtaagtctgcgccgtggcgttccaggcctgcagcatctggcgctcggcctgcgtcaccgacggcagcgcgctcaggcgctggtcggcatcgacaatcagcgcgttcagcaactgctggaagtgctcggccaggcgctggatatgcgcagcactgaaagcctgccggtcgtagttgaattccagcccgaggctgtcacccatgcccaacagcacggtcagcgggtaatgcgtctgctccaggctgtgcacggcaccaaagcgcaggcccgacggcgcgccctgctccaacgcttcggacaccgggtagttctcgaacaccaggatgctgtcgaacagcgcctcgccgcccaacccggcccagcgctgaatctcgaacagcggcgtgtgctcctgctcgcgcaagcgcacgttctgcgcctggatctgctgcagccactggctgaccgacagctgcgcctcaggcgtggccaccacgggcagcgtgttgataaacaaaccgacttgctgctcgataccgcgcagctccgccgggcgccccgccacggtggcgccgaaggccacagtggcctgcccggtgtgatgttgcagcagcaatagccaggcggcttgcaccaaggtgttgagggtaaccttgttgctttgcgcgaacgctttgaggcgttcggtgtgagcggcatcaaagctcaggcgatgttcgccgttggcctccagggccgcaggcgcttcagtcgaaaggtcacgcgccagacgcgtaggcgcctgcaggttggccagttgagctttccagaaggtttcgctgacggccttgtcctgggcctgcagccaggcaatgtagtcgcgataacgcccggtcggtgccgccagcggctcgccggcgtagtgttgcagcacctcgccaaacagctgcgaaccgctccagccgtccatcaggatgtggtgattggtgtagatcaggtgataactcgacgcacccgtgcggatcaccgacaagctcaacagcggcgcctgttccagcacgaaaccctgggcgcgtgccgaatcggccaggctgtcgagcgccgcgaggcaatccgcgcggccttgccaatcaagctcgtccagtggcatgcgccgctgcttgtagaccacctgcaacggttgctccacatcggtctgccagaggaagccgctgcgcaaaatctcatggcgatccaccgccgcctgccaggcctggcggaagcgcggcacatcaaggccgtccacatcgatgcgcatctggttgatgtaatcgcccgagccctcgccatacaacgactggaacaacatgccctgctgcatcggcgacaacgggtacaggtcttcaacctcggcgacgctcagtggcagcgcgtccagttggccttgagacaaacgcgccagcgggaagtccgacggcgtcacgccttggtgggccgccgcgcagcaatgctcgatcaaggccttgagttcccgcgcgtagtcatccgccaattgctgcacggtggcttgcgcgaacatttcctgactgaaactccagttcagtttcagctcaccgccgtacacctggccattgatctccagccagttacccagcggcgcatccaggctttgctctgcgccactggcgtcaccggaaggcgcgaacaggccttcttgttcgccgccttcgaaactgccgtcgaattgccccaggtagttgaacgtgatgcgcggtcgcggcaaggcacccaatgcctgttgcgcctgcgcattgcccaggtaacgcaaagcgccaaaaccgagacctttgttcgggacggcgcgcagttgttccttgatctgtttgagcgagcctgccagcgagtcggtcggcgccagttgcaacggatagaggctggtaaaccaaccgacggtgcgggtcaggtcgatctcgtcgaacaggtcttcgcggccgtggccttccagacggatcagcatggattcatcaccggtccagcgcacaatcacgcgcgccaaggcggtcagcaacaggtcgttgatctgggttcgataggcacttggagcgtcctgcagcaggcgacgggtaaacccttgatccaagtgcgtcgtcacgctcagggcgtgacggttactcacgctggcctgcgggtcggcgcccggcaaactggcgcgactgccctgcaactgcgcctgccaccacgccaactcccgcgccagcgctgggctggctgcgtatgcctgcagccgctcggcccaggcgcgggtggagctggttttggccggcagtaccacgcgggcaccttcggccagttggcggtaggcagtttgcaagtcttccaacaggatgcgccaggacacaccgtccaccaccaagtggtggatcaccagcagcaagcgctgcgcgccgtcagccatgtccaccaacaccgcgcgcagcagcgggccttggctcaggtcgagactgcgctgagcttcatcgcccagggcctccagctcttccacgctgttcagcgtggtttgccacagcacctgttcggcctgatgctgctgggcgcctcggtacaccgcgttccagccgtctgcgccttgggcaaacgtggtgcgcagggcgtcgtgatgcacaatcaacgcctccagcgccgctaccaacaccggcacgtccagccgttggtgcggttgcagcaccacggactggttccagtgctcacgctgcgggatgtcatcggcaaaaaacccgtgttggatcggcagcagcagcaactcgccggtcagcgccgactgatccagcaccaccgcgccctcgccctcgcgggccacggctgccaggctctgcacggtctggtgctggaacaggtccttgggcgtaaagcgcacacccgcttggcgggcgcggctgactacttggatcgaaataatcgagtcgccgcccagttcgaagaaattgtcatgcaagcccacacgcggcaggcgcagcacgtcggaccagatcgcggcgattttctgctccagttcgctctgtggcgcgacatacacctgctgcatctggctcacgtcgggcagcggcaagcctttgcggtccagcttgccattcggcgtcagcggcatgcgcggcaagaacatcaggtgcgtgggcaccatgtaatcgggcagccgggttttcaaggcacggcgcagcgcttcgcggccgttcgattgcgccacggcatcgtcgatcaatgccgcgtccaaaggcaccacgtaggcgaccaactgcttgccggtcgggccttcctgggccaccaccacggtttcaccgacgctgtcctgctcacgcaggcgcgcttcgatttcacccagttcgatacggaaaccacgaattttcacctgatggtcgacacgcccgaggtaatccaccacaccgtccgggcgcccacgggtcaagtcgccgctgcggtacacgcggctgccgggtttgccgaacgggtccggcacgaagcgttcggcggtcagtgccgggcgctccagataacccctcgccacgccctcgccgcccaggtacaactcaccggcgacgccgatgggttgcaggttcaactgtgcatccaatacgtagccgctgcgattgcccagcaacgtaccaatcggtgcgtagacggcgccgcatgggtcgcctttgcgcgccttccacagcagcggcgtcaccaccgtctcagtcgggccgtaaccgttgaacaggtaagtcggtttcagtgcgcgccaggccaggtcatagctggcttgcgccacggcgtcaccaccaaagcagtaaacccgcacggccggtgggttgccgtcacgctcggcgtgctcggccagttgttgcaggtaaaccggcgggaatacggccatcgtcacgttgtggcggtgcatctgcgcgtaggtgtattccggcagccacaggctgtcatcgcggatcagcacactggcgccattgatcagcgggtgcatccagccttcgtgggaaccgtcgaacgcgaacgacatgaagtgcagctcgcagtcggccgggccggtttcatagcgctcgccggtggcgatgatatgcgccaccaacggcccgtgggacaccgctacgcccttcggcatgccggtggagccggaggtgtagatcacgtaggcgaggttttcgccgtccaatgcgacttgtggagcgctatcgtcaacgtcggcccaagcttcggactgatcaactgccagtgcttcgaggccttcgggaatcggcaagcgctgctgcaccgccgagtgggtcagcaacagtttggcgcggctgtcttgcatcatgtacagcaggcgatcgcgcgggtattccacgtccagcggcacgtaaacgccaccggacttcatcaccgccaggaacgccaccatgatctcggcactgcgcggcatggcaatcgccacgcgcacttccgggccgacaccgcgggcaatcaaggcgtgcgccaggcgattggcctggcggtcgagttcaccgtaggtgagggtttgcgcatcgaatttcaccgccacggcagtcggggtttcccgcgcgcggtcggcgaccaattcgtgcaccagccgtttggccgagaagcccgagtcggtgcagttccacagctgaagaatctgttgctgctcggcactgtccagcaatggcaattgactgaggctttgctgcgggtcggcgaccatgccctgcaacaggttctgccagtggcgagccatgcgctgcacagtggcggcttcaaacaggtcctgggcataacccagcgtggcccagataccctcgttggattcctgaatatccaggtccagatcgaaatgcgcggtcttgctctcccagtccagcccttctacccgcagctgcggcagttggtgctggacctgggcctggccgacatcggtctggtggttgaacatcacctggaacaacgggttgtggctgaggctacgctccggttgcagggcttccaccagttgctcgaacggcaggtcctgatgcgcctgggcatccagcgcgcgttggcgtgtgtgctgcaataactgctcgacgctcatctggccatgcaggtcggccttgagcacttgcgtgttgacgaagaagccaatcaggcgctcggtctcgctgcgattgcggttggcaatcggcacgccgacgcggatttcttcctggccgctgtagcggtgcagcaaggtctggaacgacgccagcaacagcatgaacagcgtcacgccttgctgctgggccaaggctttgaggtcgtgggccagtgtcggcgccagctcgataggcaggcgcgcgccacggtggctctgcaccgccgggcgtgggtggtcgaagggcagttccagcaggctttgctcaccgcccagcacctcgcgccaatacgccagttgacgggctttttcgccggcgtccatccacttgcgttgccacacggcatagtcggcgtactgaatcggcagcggcggcagctgtacgccctgcccttggctgtaagcggcgtaaagctgcaccagttcttccaccaccaactgcatcgaccaaccatcggacacgatgtgatgctggaccagcaccagcacatgctcatcatcggccaggcgcaacagcgtcacgcgcagcaacggcccctgttgcaggtcgaacggctgggcgatttctgcctctacccgggccttgagctgggcttcgtcgacatcgcccagcgcgatttgcaccgacgccagcgggtcaatcacctgcaccgcgccgtcgtgggtctggcgcacacaagtgcgcaggctttcatgccgggccagcaaggtgtcgaaactgcgctgcaacgcggcaatgtccaactgccctttcaaacgcaaggcgctgggcacgtgatacgccgcgctttgcggctccagttgccagaggaaccattggcgctcctgggcatacgacaacggcagcggttggtcacgccctaccggcaccagtgctggcgccttcggtgcagtcggggaatgggcttcaatggcggcgacaaatctatccaggcgcggctgctcgaacagggccttgagcggcacttccaggttcagcgcgtgacgaatacgcgagaccacctgcattgccagcaacgaatgcccacccagctcgaaaaagtgctgggtcaggcctacacgctcagtgccaaggatatcggcccagatcgccgcaacctgctgttgcagggcggtgactggcgcttgccaatcggcttgcaccgcggcggcatcgggtgttggcagggcctgacggtccagcttgccattggggttcaaaggcatgcgcgcgaggaagatcaggtgcgccggcaccatgtaatccggcaattgctcgcgcagcgtggccttgagctgttcacccgccgcaacctgctcgtgctcgggcagcgcgtgagtgggtactacgtaggccagcagttggttgtcagccgccagaagcagggtttcgcgcacgcctggctgggccagcagcaatgcttcgatttcacccagctcaatgcggaaacctcggatcttgacctgatgatcgacccgcccgacgtactcgatcacgccgtcggcgcgacagcgagccaggtcaccggtgcgatacaggcgcgcgcccgaatgactgaaagggtcggcgacaaaccgttccgccgtcagcgccgggcgttgcagataggcacgcgccaggccgctttcactggcgatatacagctcacccacggcaccgaccggcagcaggttcaaatcccggtcgagcacatacaacccacgacccgccagcgcgcggccgatagggctggcgctggcgccgatcatagtggtgtcggcgctgcagtccagcacgctggacaccacggtcgcctcggtcggcccataagtattgagcaggcgcacatgcccaagccctgcacgacgccacaacgccgggccatccagcggcatggcttcgccgccgatatgcacctggcgcagtgcgccgtaagcgcgcgggccggctgccaggcaatcctgcaaaaagagtttccagtaggcggtgggcaagtcggccagggtgatgccctgagcaataacttgccggtacaactcggcaccgtcccacagttgcgggccacgcagcaccacggtggcaccgagggtcagggccgggtacagctgctcgacgaagccgtcgaagttcaaggtcgcgaactgcagaacccggtcatccgcagtcaggcacgaatagtcagcggcaatgctcgcgaactcactcaaggcggcatggttgatggcgacacccttgggcttgccggtagagcctgaggtgtagatgacgtaggccaggttgcgcggttcgaagtcgagcccaggattgtgctcggcatagtgcgccaattgcgcctcggccaaatcgatgtccagggtcgccaagtgctcaggcagcggcaggcgctgacgcagcgatgattgcgtgagcaccagcctcacgccgctgtcttcaagcatgtgcagcaggcgctcacgcgggtattgcgggtcgagcggcacatacgcaccgcccgccttgagcaccgccagcaggctcaccaccatggcaaacgagcgctccacggcgatgccgaccagcacttccgggcctacgccctgggcgatcaggtagtgggccagacggttggcctggcggttcaactcgccatagctgatggcctgttcgtccagcgccaaggcctggcgttcagggtgctgccgggcctgaacctcgaaccgttgatgcaccgagtgcagttcgaggccggtagccggcgcgttccactccttgagtaccaccgtttgttcggcggcgccaagcatcaccacatcactgagacgactctgcggtgcgttcaccactgcttgcagcaggttctgccagtgctgcgccaaacgctcgatcgtcgcggcctcgaacaggtcggtcgcataggtcagcgccgcccagatgccttctgcggactcatgggtgtccaggctcaaatcgaagtgcgtggtctggttgtcccagtccagttccgagacgcgcaggccgggtaattgctggccctcgcgcccgccctgggcgtcggtctggtggttgaacatcacctggaacaatgggttgtggctcaggctgcgctcgggctgcaacgccaccaccagctgttcgaacggcaggtcttgatgggcctgggcttccagcgagcgacgcttggtctgctgcagcagttcgacgaagctcatctgcccgtcaaggtcggccttgagcacttgggtgttgacgaaaaagccgatcagccgctcggtctcgacccggttgcggttggcaatcggcacgccgacacggatgtccgactgcccgctgtagcgatagagcaaggtctggaacgcagccagcagcagcatgaacggcgtcgcgccctcttgctgtgcaaggcgcttgataccactgaccagcgtcggtgacagatgcacttgcaaactggcgccgcgatggctttgctgggccgggcgcgggtgatcgaggggcaattccagcaccggttgctcgccgcccagcagtgcctgccagtacgccaattgacgggctttctcacccgcttccatccagccgcgctgccacagggcatagtcagcgtactggatcggcagctcgggcaattccaggttgcggccctggctgctggcggcgtagagctgcaccagctcctcgaccatgacctgcatcgaccagccatcggaaatgatgtggtgctgcaccatcaccagcacatgttcatcgtcggccagttgcagcagcgtcacgcgcagcagcggcgcctggagcagatcgaaaggccgcgcaacttcggcttccacctcagccatcaagcgctgttcgtccgtgcgcctgtgcacgatttcaacccgggcttcaggcatcacggcctgggtcagctgttcagcctcctgcaccaggcgggtacgcaggctttcgtggcgggccagcaggcggtcgaaactgttttgcagcgccgccaggtccaactggccttgcaggcgcagcgcaccaggaatgtgataagtggcgctgtcagggtccaactgccacaggaaccactggcgctcctgggcgtatgacaaaggcagtgcctcgacaccctcgcgggtgggcgcaatcggcaattgcgcgaagctcatgccgcgcgcttgcaggcgctgataaaactgctggcgttgttcaagcggcaggcgaagaaagcgcgagaccagatcgatattagggttggaaagcatggttcaaatcgcctctagttcgctcaaaaagtcacgaagatcatcaaaatcttccgcgctgccggcgcggaaagtggctgcggcctgtacataggcgcgcagcgtttcggtctggaacacttcaaccaggggcacttccaggcccagttcggactgcacccgcgaggtgatctggatcgccagcaaggaatggccgccgacttcgaagaagttgtcgtccaggcccacttgcggcaggcgcaacacttcggcccagatcgccgcgacctgctgctccagttcggtttcgggggccacataacgttgctgcatcaagctcgcatccggcgcgggcaagcctttgcggtcgagcttgccgttgggggtcagcggcatctgcgccaggcacataaagtgcgtgggcaccatgtagtccggcaggcgggtcttgagcgcacggcgcaaggcatcgcggaactcggcctggtcgatcagggccggatcagccggcactacatacgccaccagttgcttgccggtcgggccttcctgggccaccaccacggtttcaccgacgctgtcctgctcgcgcaggcgcgcttcgatttcacccagttcgatacggaaaccacgaattttcacctgatggtcgacacgcccgaggtaatccaccacaccgtccgggcgcccacgggtcaagtcgccgctgcggtacacgcggctgccgggtttgccgaacgggtccggcacgaagcgttcggcggtcagtgccgggcgctccagataacccctcgccacgccctcgccgcccaggtacaactcaccggcgacgccgatgggttgcaggttcaactgtgcatccaatacgtagccgctgcgattgcccagcaacgtaccaatcggtgcgtagacggcgccgcatgggtcgcctttgcgcgccttccacagcagcggcgtcaccaccgtctcagtcgggccgtaaccgttgaacaggtaagtcggtttcagtgcgcgccaggccaggtcatagctggcttgcgccacggcgtcaccaccaaagcagtaaacccgcacggccggtgggttgccgtcacgctcggcgtgctcggccagttgttgcaggtaaaccggcgggaatacggccatcgtcacgttgtggcggtgcatctgcgcgtaggtgtattccggcagccacaggctgtcatcgcggatcagcacactggcgccattgatcagcgggtgcatccagccttcgtgggaaccgtcgaacgcgaacgacatgaagtgcagctcgcagtcggccgggccggtttcatagcgctcgccggtggcgatgatatgcgccaccaacggcccgtgggacaccgctacgcccttcggcatgccggtggagccggaggtgtagatcacgtaggcgaggttgtcgccgtccagtgcgacctgcgggtcggcatcgctgtagtcggcccagtcttcgctgcgatcgattgccagcgtgttcagcccttgcgggatcggcaattgctgcaaggcgctcgtgtgcgtgagcagcaattgggcgcggctgtcttccatcatgtacagcaggcgatcacgcgggtactcaatatccagcggcacgtacacgccaccggctttgagcacggcgaggaacgccaccatgatctcggcaccgcgcggcatggcgatggccacgcgcacttccggccccacaccgcgagcgatcagcgcatgcgccagacggttggcctgactgtcgagttcgccgtaggtgagggtttgcgcatcgaatttcaccgccacggcatccggcgtttcccgcgcgcggtcggcaaccctttcgtgcaccaggcgtgtcgcggggaagcccgactcggtgcaatcccacaattgcaggatgtgctgttgctcatccgggttcagcaggttcagttgcccgatggcctgctgttgatcgtcaaccatcgcctgcaagaggttctgccagtgcccggccatacgctcgatggtgccgggggcaaacagatcggtggcgtaactcagggacgcacgcagcgcctcgcgggattcctccacatccagcgccaagtcgaactgggccacgccttcatcccagctcaacacctcgacctgcaggccgggcaagtcctgcaaatggcggcctgccgaggtcacgcggtggttgaacagcacttggaacaacgggctcaggctcatgctgcgttccggctgcagcgcctccaccagttgctcgaacggcaggtcctgatgcgcctgagcgtccagggagcgttgccgcacctgatccaacagttgcgccacgctcatctgcccgttgatgtcggccttgagcacttgggtgttgacgaagaagccgatcaggccttcggtttccaggcggttgcggttggcgatcggcacgcccacgcgcacatcttcctggccactgtagcggtgcagcaaggcctggtaggccgccagcagcaccatcggcaacgtgacgccagctccatttgccaggcggcgcaagccggccagcaattgcggcgttaactcaacgtcaaggcgcgcaccgcgatgggtcggcaatgccgggcgctggtagtcgaacggcaactccagtaccggttgctcgccgcccagctgctcgcgccagtaagtcagctgccgcgctttctcacctgcttccatccagtggcgctgccaaagggcgtaatcggcgtactggatcggcagcgccggcagctgcggcgtatggccggcgctgaaggcggcatacagtttcaccagttcttcgaccatcaactgcatcgaccagccatcggagacgatatggtgctgcaccagtacgatgacgtgatcgtcctcggccagttgcagcaacttgacccgcagcagcggcccgcgcagcagatcgaacggccgcgcgaccgcctcggccacctgcgccttgagcccggcttcatcggtgctggcccgttcgatgtcgatcaggcccagctcttcaatcacttgcaccgcgccgctggcgtcctggcgcagatgcgtgcgcaggctttcatggcgcgccaacaaggtgtcgaaactgcgttgcaaggcagccacgtccagcgcgcctttcaaacgcaaggcgctggggatgtggtacgccgcgctgtgcgggtcgagttgccagaggaaccattggcgctcctgggcgtacgacagtggcaacggttgtgcgcggtcggccttgagcagcgccggtgcggtaacgccctgctcgcccaatgcacgtacgaagtcaccgagcaccggctgttcgaacagggttttgagcgccacttctagcgccagcgcctggcgcacgcgcgacacgacccgcgtggccagcagcgaatgcccgccgagttcaaagaagtggtcatcgagccccacctgcggcacctccagcacctcggcccaaatggccgcgacgtgctgttcacgcgggctgacgggcgccacatgcgctttgtgtagcacgctggcatccgccttgggcaaggccttgcggtcgagcttgccgttgggggtcaagggcaggctatcgaggaatatcagctgcgcaggcaccatgtagtccggcaagcgctcgcgcaaatcggccttgtagcggtcacgcagcgccgcctgttgttcaggggcgaaggtcaccaggtaggcgaccaggcggtcgttgtcggccagcaccacggcttcacgcaccgctgcatgttcacgcaggcaggcttcgatttcgcccagctcgatacggaagccacgcaccttgacctgatgatccacacggccgatgtactccactacgccgcctgggcgatagcgcgccaggtcgccggtgcggtacaggcgctcgccgggcgctccatatgggtcaggcacgaagcgttcggcggtgagcgatggccgcgcgtgataaccgcgcgccaggccaaccccgccgatcagcaattcaccggctgcgccctgcgggcagggcgtcagcccggcattgagaatgaacagcgaggtattggcaatcggtcgaccgacaaaaggctgcgccgccaataaacgatgggcggccgaccagatggtggtttccgtcgggccatagaggttccacaccgggccctgcaggtcgagcagccgttgcgccaggtcgaccggcaacgcttcgccgccacacaggcacttgatgcccttcagcagaacggcacgcgggctttccagcagcatgcgccaggtcgatggggtggcttgcagcaccgtggcggattggttgtgcagcagatcgagaatcgcctccgggtcgagcgccagcgcctgatcgctcagcagcaccgtggcgccgacggtcagcggcacgtacagctcgagggcaaagatgtcgaacgagaaggtcgtcagcgacagcacccgcgcatctgcgccaatttccagcgtatcggccatgccgcaggtaaagccgcacagtgcctgatgacgcaccatcacgcccttgggcttgccggtggaaccggaggtgtagatcacgtaggccaggtgctccggcgtgacagtgacctgcggattgtgttcgtcgccgcccgcgtcatcgaccaacagcacacgcaggccgtgcggttgcgccaggcgaccgttcaggtgtggctgggtcagcaatacccgggcgcggctgtcttcaagcatgaacgccagacggtcggccgggaattgcgggtcgagcggcacatacgcgccaccggccttgagggttgcgagcaagccaaccaccatgtccagcgagcgctcgacatgcaccgccaccagcacgtccgggccgacgcccgctgcgatcaggcgatgggcgaggcgattggcgcggcagttgagttcgcggtaagtcagagtgtcgccattgaattgcagcgcactcgcctccggggtcgccagtacttgcgcttcgaatagctgatgcacgcagcgtgtgtgcgggaactcaacctggctgtcgttccagctgtgcacggtctgctgccattgctggtcgctgagcatcggcagctcatccagcgcctgcgacgcgtcgttcaccaccgcacgcagcatgttctgccaatgctgcgcgaggcgcgtcagcgtcgcgggctcgaacagatccgtggcgtaggccagcgaagcccacaggccttcggcggactcttcggtttccaggctcaaatcgaactgggtggtgttgcctgcccaatccaacggttgcaaggccaggcccggcagatgcaccgggccggcacgcaaggtgtcctggtggttgaacatcacttggaacagtgggttatggctgaggctacgctctggttgcagcgcttccaccaattgttcgaacggcaggtcctgatgggcctgggcttcgagggcgcgctgcttgacctgggcgagcaattggtcaaaggccatctgcccgtcaaggtcgacctggatgacttgggtgttgacgaagaagccgatcagccgctcggtttccaggcggttgcggttggcgattggcactccgacacgcagcctggactggccgctgtagcgatgcagcaaggtctggaacgaagccagcaagagcatgaacaaggtcacgtcttcgcgctgggccaaggttttcaggtcggccagtagcgcaggctcaagttgaacctgctcacgcgcgccgcgaaagctctgcactgccgggcgcgggtggtccagcggcagttccagcaccggatgttcatcgcccaggtgctgttgccagtaatcgagctggcgctgtttttcaccggccgccatccagttgcgctgccacacggcgtagtcggcatattggatcggcaacaccggcagcgaagcctggccctggtacagcgctaccagctcatcgaccatcacctgcatcgaccagccgtcagagatgatgtggtgctgggtgatcaccagcacatgatgatcggccgcgatcaccagcagtttgacgcgcatcagcgggccgttgcgcaggtcgaacgggcgctgaatctcttgctccacacaggcctggatcgccgcggcctccgccctcgcctgctcgacaggcatttgcaggtcgggatgaatcacttgccaggtatgctcagcgtcctcaacaaaggtggtgcgcaacggctcatggcgcaacaccagcgcctggaacgcgcgctccagcgcgctgatgtccagttggccgcgcagatgcagcgccgtgggtacgtgatacgcggcgctgttggggtccagttgccacaaaaaccattggcgttcctgggcgaaagacagcgccatcggctgcccacgctccagcgccaccagcggctgagcgctgtgttgctgcaagcccgaacaggccgtcgcaaacccttgcagcgtcggctgctcaaagagtgcgcgcagcggcacttccagtttcaagtcatggcgcacacgtgaaatcacctgggtggccagcaacgaatgcccacccagctcgaagaagtgatccgtgaggccgacctgctccacctgcaacaccgcttgccagatcgccgccagttgcacgtgcagcgggctgtgtggcgccacatacgcctgttgccgcaggctcaggtccggcgccggcaacgcgcggcggtcgagtttgccgttgttgttcagtggcaaggcgtccagcacctgccagtgcgccggcaccatgtagtccggcagtgactggcgcagagtggccgccaggttctgggcgtgcagggtgtgaccgtgggcgggcaccacgtaggcgaccagttgcatgccgacggcacttggctgggcgatgactgcggcttcacgcacctgcggcaaggcttgcaggcaggcctcgatttcgcccatttcgatgcggtagccgcgaattttcacctgatggtcgatacgcccgacgtactccagcgcgccggtttcgttgtaacgcgccaggtcgccgctgcggtagagccgtgcacccggcaccgcggaaaaagggtccggcaggaagcgttcggcggtcaaggccgggcggtcgaaataacgctgggccaggcccgcttcggcaccgatgcacagttcgccgacgccgtcggtggccagcagttcgaaaccactgtcgaccacatacaacgaacggccggcgatggcgcgaccaatcggcacgccgaacgcatcactggcatccgccagctggcaatcgtgcacgctggacactaccgtcgcctcggtcggcccgtaagtgttgaccaggcgcacaccgcccagccctgccgcgtgccaggcgcgcacgccttccaccgacatagcctcgccgccgacgtgcacttggcgcaggttgcccaacgtgcgtgggtcggcggcacattccttggcgagcaaataccagtaagcggccggcaagtcggcgagggtcacgccctgctcgacgatctcgcgggccagttggccggcgtcccacagctcatcgccgcgcatgatcaacgcggcgcccacacacagcggcgggtagcactgctcgacaaaaccgtcgaagctgaaggtcgcaaattgcagtacgcggtcgtctgcactcagccggctgtaggcctcggcgctgtcgcagaactggccaagggcggcgtgttcgatggccacgcctttgggcaggccggtggagccggaggtgtagatcacataggccaggtcggcagccgccgcttggttgggtgggttggtcgccgggtagccgtccagctcttcaccggacgtgctgaaatccacgcgggtaaggccctgcggcaatggcaagtcggcaagcaacccggcttcgctgagcagcaggtccaaacggctgtcggccagcatgtaggccaggcgttcggccgggtagttcgggtccagcggcacgtaggcggcgccgcttttgagcactgccagcaggctgacaatcagctgcgggccacgccgactggccaggcctacgcgctggcccggccccacgccgagtgccaacaggcgatgcgccaggcgattggcccgcgcattgagctgggcgtagctcaggcgctcactgcccgcctggactgccagcgcgtcaggggtggcgtgggcctgagcagcgatgcgctcatgtacccgctgaggacgttgggcggcaccggcagattggctgagcgcaagtacgtcgtgctgtgcggcggcgtccagcagttgcaggttgcccagcggcgcactggcgtccgctaccagttgcaccagcaggtgacgcaagttggcgcccagccgcgtgacctgttgctcgctgaaatgcgcgcggtcgtagctgaagtccaggcgcagaccggcacccagctcgacgcccagggtcagcgggtagttggtgcgttcatggttgtgcatgcggccgaaggtcaggcctgcgggtgcgccttgcttcaatgcttcggccaccggaaagttttcgaataccagcagggtgtcgaacaacgcggcaccttgctgaccggcccacgcctggatgtcgtagagcggcacgtgttcgtggtcacgcaagctcaagttcagggcttgcaactcaccgagccaggcgccagccgattgcgcgggcgacgcggcactgatcatcggcaaggtgttgatgaacaagcccagttgctgctcgatccccggcagcggcgctgaacgcccggcgacggtggcgccgaacgccacgcaatcctggccgctgtagcgttgcagcaacaggctccaggcgccttgcagcacggtgttgagcgtgactttttgctggcgggcaaattcgccgagtgcctgggtaaagtcgttgtccaacagcacttgatggtcagccatccccgcgccatcgaccggcgcacgcagtgcttgcgccagcaaggttggcgcttgcaacggcgccagggcctgtttccagaacgcctcgcccgaaggctgctgttgcagccagccgaggtaatcgcggaactgccccagcggcgccggcaacgcctggcctgcgtagtgagaaagcacttcgccgagcaactgcgcgttactccagccatccatcaggatgtggtggctggtgaacatgaagtgccaggcagaaccggcaccgcgcaccagcatcaggcgaaacagcggcgcggtatttaattcaaagccgcgtgaacgctcggcatcggcgagcgcatcgaggtcggcattcacgtcttcgatcacttgcaactgtacgtcgacctgacgcttgatcacctggtgggcgctgtccaggcccagccaatggaagctgctgcgcaggatgtcatggcggtcgagtgccgcttgccaggcacggccaaacgtcagcaggtcgaggccatcgatgtccagacgcagttggttgatataggcctgggcctccggcgcgtacagggtgtggaacagcatgccctgttgcatcggcgacagcgggtaaagatcggcgatgtcgggcccggccacgggcagtgcgtccaactgctgctgggtgaggcgtgccagtgggaaatccgacggcgtcacctgcccggccggcgtggcgcagcaatgctcgatcaacgccttgagctccgtggcgtagtcatccgccaggcgctggatggtggcggcgttgaacatctcgcgactgaaaccccattgcagcgacagctcactgccatacacctgcccttccacggtcagccagttggccaacggtgcttcggcgtcctgggcctggccgctgctctcgctggcggggacaaacagcgccgcctcgttgaactggcggtcgaactggcccaggtagttgaaggtgatacgcggcgcagccaggcccgccagggtttcgcgtgattcggggttacccaggtagcgcaacaggccgtagcccagccccttgtcggggacggcgcgcagttgctctttgacggatttgatcgcgtccgacagctcaccttcggcctgcaagcgcaccgggaacaggctggtgaaccagccgaccgtgcggctcaggtcgatgctgtcgaacaggtcctcgcgaccatgcccttccagttgaatcaaggccgcgtggccgctccaacggctgatcacccgcgccagcgcggtcagcagcaggtcgttgacctgggtgcgataggctgccggagcatcctgcaaaagccggcgggtgagctcggcgtccaggcgggtttcgagcttggcacccaggcggttttgcaggccgccgtgggggttgtcgcagggcagttcgacgtcgctggtctgcgcccgccagaaaggcagttggtcatcgagggtttgcgcataggcctgcaactgctgcgcccattgttggtagctgctggtcttggtcggcaagctggcttctcgataagcctgttgcaggtcttccagcaggatgcgccaggacacgccgtcgaccgccaagtgatgcaccaccagcagcaggcgctggctgccatcggccatctgaaccaaggccgcgcgcagcagcaggccttgctccaggttcaggctgcgctgggcttcatcgcacagcgcggccaattgtgtgtcgtcgcctgcagcggattgccacagtgtcagctcagcgactggcgcaccgtgggtttgctgccacgtgtcgccctgctgcacaaaacgcaggcgcagcacgtcgtgatggttgatcagttgggtcagcgccgcttccaggcgtgcaggctccagcgcctcacgcggggtcagcagcagcgactggttccaatgctgccgcgccgggatggcctggacgaaaaagttttgctgcacgggggtcaggatcacgtcgccggtgactgggccttgatcgatagcggccgcctgttcaaagctcgccaccagcgccaggcttcgcacgctctgatactggaacaggtcgcgcgggctgagacgaatgccggcctgacgggcacggctgactacctggatggagatgatcgaatcgccgcccagctcgaagaagttgtcgtccaggccgacctgttcgacgccgagcacgtcactccagatcgccgccagggctttttgcaatccgctggagggcgcgacaaacgcctgttgcggtgccgcatccggcagcggcagcgccttacggtcgagcttgccgttggcggtgacgggcagcttggccaagtgcacgaaatgcgtcggcaccatgtattccggcaggctgctgagcagccaggccttgaggtcggtcggcgcttcgccctcaagcacccagtacgcgaccagttgtttgccgccctgcaccagcaccactgcttcacgcacgttaggatgttgcatcaggcgcgtttcaatttcgcccagctcgatacgcaggccgcgcagcttcacttggtggtcgaggcggccgaggtattcgatcacgccatcggcgcgctggcacacgcggtcgccggtgcgatacaggcgctcgccgtggataaacgggctgggtacaaaccgctcggcggtcagcgccgggcggcagtggtagctgcgcgccaggccgacgccgcccaggtacagctcgccggacacgccggccggcaccgggttgagctgcgcgtcgagcacgtaggtggcgaggttggcgatcgggcggccgatgggcacgctgtcggcgccttcgtcgacgcaggtccagtgggtcacgtcgatggcagcttcggtcgggccgtagaggttgaacagtccagctcccggcaacttggcgaacacttgccgttgcgcgtccaatggcagcgcttcaccgctgcacacaatgcgcttgaggctgacgcaggcgtgtacgcccggctcatggataaacgcctgcagcatcgacggcacgaagtgcaacgtggtgatggcgtgacggccgatggtgtcgatcaggcgcgccggctcgcggtgttcgccaggggctgcgacgaccaggcgggcgccggtcatcaatggccagaagaattcccataccgaaacgtcaaagctgaacggggttttctgcaggacggcgtcgctggcatccaacccgtaggcgtgttgcatccagcacacgcggttgaccaacgcgcgatggctattgcctgcgcctttgggcttgccggtggaaccggaggtgtagatcacgtaagccaggttcaacgcctggatctgcaccgcaggtgattggctgctatagccgtcgagccaagtgggtgcctggtcgagggcaatcacttggacgccgtcggtgggcagtaaccccaacagactgtgttggctgagcagcagcttaatgccgctgtcttcgatcatgtaggccaggcgttcctgcgggtattccgggtccagcggcacgtaggcgccgcctgccttgagaatcgccagcaggcctacgaccatttcgacggagcgctccacgcagatgcccaccaacacatccgcgcccacgccctgctcgcgcaaggcatgcgccaacctgttggcacgggcgttgagctgggcgtaggtcagtgtggtgtcgccaaaaatgagggctggcgcatccggcgtgcgctgcacctggtcttcgatcaggtgatggatgccgcgctcggtcgggtaaacctcggcggtctggttccaggcatgcaccagcacgtgctggtcttgcgccgcgagcatcggcaactcaccgatacgctgttcgccatcggccaccatggcctgcaacaggctgatccagtgctcggccatacgcgcgatggaaggcgcatcaaacagatcgttggcgtacgtcagcgcggcgtgcaaggtgccggacttttcataggtgtcgagggtcaggtcgaactgcgtggtacggccctgccactccaccagggacagttccaggccggaagccgtgctgaccgaggcaatgtcggccaccaccggctggtggttgtacatgacctggaacagcggcgtatggctgaggctgcgctcgaccttcagggcttccaccaaacgctcgaacggtaattcctgatgggcctgggcacccagtgcgtgctctttgatgccttgcagcagctcggcaacgcgggtctgcccggtcaactcggtgcgcaatacctgagtgttgacgaagaagccgatcagcccttcgacttcactgcggttacggttggcgatgggcacgccgacgcggatatcgccctggccggtgtagcgatgcaacagcacattgaaggcgcccagcagcagcatgaacagggtgacattgtgctgctgcgcacagctgcgcagctgcgcggccaggcctggatcaatcgcaaaattgtggcgtgtgccctggtagctgggcatggccgggcgcgagcgatccgtcggcagctccagaaccggatgctcatcccccaggcgtgcctgccagtactccagctgccgcgcttgctcgccggcttccagccagcggcgctgccacagggcgtagtcgctgtattggatcggcagcgccggcaattgcggcgcctcgttgcgctcatgggcgtcgtagcagcggatgaactcgtcgatcagcacgttcatcgaccaaccgtcggagacgatgtgatgcaaggtcagcagcagtacgtgctcctgggcgtcgagcttgagcagttgcacacgcagcagcgggccgtgctccaggtcgaacggcagcagcgattgacgcgtcgccgcttcgttgacggcctgctcgcgctgggcagcagccaaggtgctgaaatccagctgttcgatggcaagcgaaggctctaccgagacttgctccaggcgctcatcggcctggcgctggaacaccgtgcgcaaggtttcgtgccgcgccaccaggctggcgaatgcttgctccagtgcgcgcaggctgagggcacccttgagccgcacggcgccgggcaggttgtaggcgccgctggccgggtccaattgccacagaaaccacatgcgctgctgcgcgtaggacagcgcctggcggtcctcggcctccacccctgccggaatcggaaaccgggaaaaatccacgccttctttctgcagggcttgcaggaacacgtggcgtttttccaggggcaacccgataaaccggcgagcaagtttcaaggagtcttcagcattcatttcttggagtccggaacaataggcaggaagcacaaaggcacgtcgtccctataaaacgaaccgggcggggaaaaattagcgggggataaaaggcgtggagcgagctgtcatcaagggttacatcaatctcaggaagaaaccgctaggcggagctagcattgacgaacaccactttttgcaactacatttagttacacgcagggaacgccgtgtccaaaaatgaaaagctgctcgccaaactgctcaacgagcgcatggcctttacctggccagagctcgaaacgctactcaagcgtcttggctacacacagattgaaggggctgggagccgggtcaaattcgacatcggcgaccccagtgcaatgatcaccttgcacaggcctcaccccggcaacgaactgaaacactacattcggcgccagatcatcgaacaattgaaatcaggagaactgattcagtgaacaaccaactgaaacacaatggctacatcggctctatcgaagccagcctcgaagataactgcctgttcggcaaagtgctgtttatcaaggcactggtcagctatgaaggcaaaaccgtcgcggagctggacgtggcgtttcgagaggccgtggaagactacctcgctacctgccacaccctcgggcaaacaccggagaaaccgtgcaagggttcattcaacgtgcgggtcggccatgacctgcatctggctgcagccctggcagcgacccgtaagaaagtgacgctcaatgacctgacacgccaggcgctgaatgagtttttgcaacatcattgcgcagaacctttcccggcgatcggttgatcagcccaaccttcggtagcccagcagcgctgagcccagcaccaccgcacccgccatcagcgccacccaaaacccgctggtggcacccaaatggtcgatcatccaacccgagctggcggcaccaatggccacaccaatgctcaggccggtgatcaaccaggtcatgccttcggtcaggcggctgggcgggacgatttgctccaccagcgccatggacacgatcagcgtcggggcaaagaacagcccggaaataaacaccgccacggccaacccgggaatgtgggttaccagcagcaacggcaaggtggtcaacgctgtcgccacaccgcagaacaagaactggcggggcaacggcgccttgagcttgagcgtgccaaaggccaaccccgccaggcacgagccgatggcgtacaccgaaagcacgatgctcgccgccgccggttggccctgctgttgggcaaaggcgacgctgaccacatccaccacgccgacgatgacgcccatggccagcagcagggtcatcaggatcagtaccgagggtgaggcgatcagcatgcggccgtgcttgccgtggtgttcatgcaccggcggctcagtcgcgcgttgcagcacgaacgtggtcacgcccaccgccagcagcagcgccgccaccaacggcccggcttccgggaacagcactacactcaggccgaccgagatcggcgggccgataatgaaacacacctcatcaagcaccgactccagggcaaacgcagtctgcaatttgggttgcccccgatacagttcggtccagcgcgcccgcaccatcgccgacatattgggcatgcaaccggccagggccgcacatacaaataacgtccagctcggcgcctgcaaccgggtgcatagcagcaacagcaacaacgacccgccgccgatcagcgccgccagcggcagcaccctgccctggctataacggtctaccaaacgcgaaacctgcggcgcacaaaacgctgtggccaaggcaaataccgccgccaccgagcccgccaggccatagccaccatgcacctgcgagagcatggtgatcaagccgataccggtcattgagatcggcatgcgcgccagcataccggccaatacaaaagcccggctgcctggggcctggaacaactcggcgtaggggtttgccatcctgctcaacctcttcctcaacgccttgaaacttgctatctgcaatcatcaaggcaaaatacatacggtgcgtatgtggcaaatcatgcgtaacatacgcagcgtatgtcaatcattcaaatccccatcgtgagccttacccatgagccgagcccgtgctgaacagatcgaagaaacccgcgcccgcctgatcgccagcgctcgcgaagccttcgctacgcaggggtatgcccacacgtcgatggacgactttaccgcccgcgctggtttgacacggggcgcgttgtaccaccactttggtgacaagaaaggcctgttggcggcagtggtcgcccaactcgacggcgagatggatgcgcacttgcaacgcatcaccgatgaggcaaccgacctctgggacggattccgcgaacgctgccgtgcctacctgcgcatggcacaggacgcggaaattcagcgcattgttttacaagatgcacctgcggttctaggcgccactgaatcaagccatcagcaacactgtgtggattccctggctgccgtgctggaacacctgatgcgtgagcgtatcatcgaaccggctgccagccaggcgttggcgcgtctgatcaatggaagcctggtcagtgccgccttgtggatcgctgccgatgaagacccggaccagcgactggaagaaagcctgcaagggctggaactgttcctgcgggggctgaagcagccaccggcagcccttccaggcaaaacctaaacactcgagacagctcgccagcccttttcccggagcccatcatgcagtgtatcggtttcatcaactttcccggcttcggcatcatgagcttcgctgcgccgtggtggtgcaattcggcgagccgccacgggtgatacgacgcacggcgcaaaaccccgacgatgcgagctcaatgtccagaaacgagggttaaatggccgttgccggtgtttgagatggcctaagcttgacctcagcgaccatcccctgaggaacccttatgaaacgttgtgcactggccgttggcgccctcttctcgttactggctctgacccctgctttcgcgaccccgcaagaggacgaaacccgggcgttcttcacgcgatttgtcgcagcgcaaaacgcccatgacctcacccggataagggccatgctttgggattcaccgaagatgctctggtttgcccggggcgaagccaactggggcccggatgccgtcgtaagcaaactcaaggagtactacaagggcacctggcagctgcaacccgacatgagccacttcagtgtggtgatgctcaacgacgacgtggcccaactgatggtgccggtcgcctttacccgaggccatccaggcgaggccgctcaggtggataccttcctgatcagccagacgttattgaaaggcaaggacggctggcatgtcgcaagcatcatgccgctggccgatacccacttcaaataatcacaccaaccgcgtgatctgcttatgccgccacaccaaccggtaataagcagtctgcagcgccagcatcgccaggtaggtcaccgggaatgccatccacacgccttccaggccgaagtgcgcattcaggaagtaagccatcggcaactcgacacacagcacgcagaaaatcgagatggccaccggcatcagcaccacgccgctggcgcgcatgatcccgccgaccacggcttggaagccgaacaccaaaatgctccacaacatgatgtgcagcaggtgttcggcattcagtcgcgccgcatcgtcggtaatgaacaggcccagcaaccagtgcgacagcacgtagccaagcacaatcaggccgcccgtcaggcaggtgttgatcagcaagccagtacgcaggatcggcccgatacgctccagccgcccggcaccaattgcctgcgcaccaaggatcgaggcggtgatcgcaatcgacagcgcggggaattgtacgtaattgacgatctgcgtcaccgcgccataggccgccgtggcctgggaaccgtggctgttgaccagcgcgaggatgaccaattccgacagcgacagcaccaccatctgcaagccggtcggcaggccgatacgcaggactttgccgaggatcacgcggtccaggcgcaaggcagcgagcagctcacggtccggcgccatcacatggttcttgtggcgcaggcgcaggatcagaaacagcatcgccgcagcgttgcccaccagcccggcatacaccgcgctctggatgcccatgggcggcaagccgatccagccgcgaatcagggccggggtcagcagcaggccaaccagggtcgagaccatcagcgccagcaacggcgaaatggtgtcgctgacgccgcgcagcagctgggtatagagaatgaagaccagcagcagcggcatgatcagcatcatcatctgggcatacccaacggcatcgtcgaggacatcaatcggcgtacccaacgcctgcaaggccgggcgcgcgaacaggctgccgagcacggccgcgatcaaccccaccagcgcgcccaaggtcagggtcgcgcccgtaatcaccttgaccaccccggtttccccggcgccccaggcctggccgatcagcaccgaagcaccggcgcccaagccgatcaccaaggcgataaagaagaacacgatgggaaacatgcccgacaccgccgccagcgcctgggtgccaagcatttgcccgacataaatgccgttgagcgtgccggaaaagctttgcaggaagttggacagcaccatcggtgccagaaagatcaggtagacctgccacaacggccgttgctgggtgacttgcatggtggttcgagtcccggaattattgttagacggggaaagcattgcgggacagccatgccaggtaagcctgcacgtcgatgggccagtgcgcgatcctggtcgcaaacgccgccgcatcctcagcgaacagcgcgcgcgaggcttcttcaaaaccgggtaagtcgccaccgatagcgctcatgaaacgatagctggcctccttggcttggcgcgcctgatcacgcgcggcgctggcattacgcgcttcatcgactagacggcgcaaggccgccgaggcaccgccgcgttgttgacccagccattcccagtgacgcggcagcagcgtgacttcccgcgcgaccacgcccagcttggggcgacccaccgaaggggcagcaggcagttcttcctcgattgccgcgtctgcgggttgctcaggtgcataaccgcttggccacgggtaatcgacctgcgtgccagtggcgtcgtcaaagaccagaaaggcgcccgctgtcaggtcctggcccgccagggcagcggccacagccgaataggaaccggccgccacacgctggtgacggacgaaggcagtgcacagcggcgtgtgttgcgtaggcatgacttattacccggatattatttgttttacccggatcatattagcggtaatttcccagcgtgcaaggctattgtcgtgatacgtccaaatgctcgccacgcaacgctgcctgcatgccctgcacagtgggatcgcgcagcacacattcagcaattgccggctccagttccacccgcaggcgtcggcccaacgcccgtgcgccgaaacgtgcatcgtgttggcgacacaaccacgccctcgccggctcatccacactcagccagcgttgctgcgccgccaggcgttgattgagcttgcccagctcaacctccagcaacgcttccagccagtggctatcgatgggatcgaacagcaagatgcggtcgatgcgattgagaaactccggctcgaaatgaccgtgcaacgcctcttccaacaccgccgcctcatcccgcacaaacacacgcagcagtcggcgccagccctgggcaaagcgttggcgatgccgacgcgcctgttgcgcgccgacattgctggtcatgaagatcaggctgttgcgaaagtccaaggtgcgcgtgccgcccgccaaggtcagctggccgttttccagaatgcccagcaggctgtgcaccacttcctggctggctttttccagttcatcgaacaacacgatgccggggcgactgtaagtgccctggatcagctcgctattgaacaggctgatgccctctttgctgcccacataccccggcggcgcgccggtcagcgcggcggcgtaatgctcctgggccaaggtgtgcatgtcgatacggcaaaacccgtcggcgcgaccatgcagcgcctgggccagcaggcgcaccacttcggtcttgcccacaccggtcgggcccatgaacaggttgacgctcaacggtcggtcgcgctcaccgatgtcggccttgaccacgttgagcaagccttccacctgcgccagcgcagcctcctgccccacgattcggctacgcagcaacgccatcacctgcgccggttcaaaggtaaaacgcatgccctactccgccgttctttctttaccgccatggggcagttgccccaccgggcactcggcgacacccacggtgctgcgggtgattttctcgacgttttcctgggctttttgcgcatccagcacccaggtgcgatagaactcgaacgggcagtccgccacgcccttgtcgccatcgcccgaggcatgcatcccggtgtagccacggtgcagcaacttgaacaggtggttctgcgactggtcattggcccgcgcatcgcgaatctgcgagaccgagagctgggcgtactgaatgcccatctcttcctcgccacactcgcccaaggtgcgcccgtcaaaaccgatgatcgccgagtgcccgaagtacgaatacaccccatcgaagcccgccgcattcgccaccgccacatagcagttatttgcccaggccatgctcttggacatctgcacctgctgctccttggccgggtacatatagccctggcagcgcacgatcaactcggcgcccttcatcgcgcagtcgcgccagatttccgggtagttaccgtcgtcgcagatgatcaggctgatcttcatgcccttgggcccttcacacacataggtgcgatcgcctgggtaccagccttcgatcgggcaccagggaatgcacttgcggtaacgctgcacgatttcgccgaggttattgatcagcaccaacgtgttgtaaggcgccttgtgcgggtgctcctcatggcgctcgccggtcagggagaacacgccccaggtgttcgcctggcggcacgccgccgagaagattgcggtctcgtcgccgggaatgctcgcggcggtcgccatcatctcctcatggtcgtacatgatgcccatggtgctgtattccgggaacaccaccaggtccatgccgggcaggccctgcttcatgccgaggataatctcggcgatcttcttcgcgttttcgatgacctcggccttgctgtgcaggcgcggcatcttgtagttcaccaccgcaacaccgacggtgtccgggctgctggaaatgtcgccatgacgcatgacaatgctcctggtctagtgactgatcatccacggccgtggcccggttctggtcttgaggcccaaggggttggccttgctcggctcgactttcttgctggtgccgcagcagctgcaacccgccggatgtttgcggctttgctggtattcgccgaccgtttgcggcgcatgggcgctgcgctcgttgccggcgatggccttgcgctggttggccgacagcgtttgcagcgccggggccgagaccatcagctgcccgcccggcccttcgcagtacgggcattggctgggctcgttgcgctgggcaatcgggcgcagcatggtgaaggtgccgcaggtggcacaggcgtattcgtaagtcggcatggctacaggtccggggcgatgggcaggtcgatactgccgtcgaggaatttggtcgggccgttggcattggggttgatgtcgaactcgaagatttccgtcggcagccacaacgtggcgcacgcattcggaatgtccaccacgccgctgatatgcccctgcaccggcgccgagccgagcaatgcataaccctgggccggcgagtagccgaacttggtcaaatagttgatcgcattcaagcaggcctggcggtaggcaacgttgacgtccaggtagtgctgctggccctgctcgtccaccgaaatgccttcgaagatcaggtagttcttgtaattcggcgtgatcgggctgggtttgaacaccgggttcttgatcccgtacttggccatgccgcccttgatcagctcgactttcatgtggacccagccggccatttcgatagcgccgcaaaaggtgatttcgccgtcgccctggctgaagtgcaggtcgcccaccgacagcccggcgccgttgacgtagaccgggaagaaaatcttcgagccacgcgacaaatccttgatatcgcaattaccgccatgctcacgcggcggcaccgtgcgtgcgccggtggcggcggcgtcgtcacgggcctggcccttgagcttgcccatgtgcgcggtggcagccagcggcgcgttcgccagtggcggtacgcgggtggggttggtgtcgatcagttcctgctcgcggcggttccagtcggcgagcatcaccgggtcgggcaggcagccgatcaggccggggtggatcaggccagcaaagttaacccccggaatgtgtcgcgagctggtgaacatgcccttgaaatcccagatcgctttttgcgcgctggggaaatgatcggtgagaaagccgccgccgttctgccgcgaaaagaagccgttgaagccccattgcgaatccgccttggcgccgatgtcgagcaagtccaccaccagcaaatcacccggctcggcgccgtgcacacccaccgggcctgacaggtaatgcacggtggagaggtcgacgtcacgcacatcactggcgtcgtcgttgttcttgatcgcgccggcggtccagtcgtaggtttccaggatgaagtcatcaccgggcttcacccagcacgccatggggatatccgggtgccagcggttatggacctgctcgttctcggtgacgggctggttgaggtcgactttgatcagcgtttcggtcatggactggctcctggacggatgacgggatgcgttcaatccagtctcgtggagccaggtaaaacggggaatacgttggatgacgtatgaccgaccgccagcgcaaaaagcaaacagcgcgaggatcagcccgacaacggaatcacccgcaaccgccgcaccgacttatacgaaaaactcgaataaatctccttgacgcacggcaacgtctgcaacacctcccgggcaaactcgccaaatgactcaagatccctggccacgacctccagcaaaaagtcatagcgccccgacacgttatggcacgccacaatctcgggaatctccaacagccgctgctcaaacgcccgcgcaatttcctgggtatggctttccatcatgatgctgacaaaggccgtcaccccataccccaacgccttgggtgacaagatcgcctggtacccgctgatcaccccgctctcttccaggctgcgtactcgccgccagcacggcgacgtcgtcaacgaaactcgatcagccagctcggccacggtcagtcgggcattgccttgcaacgcgtttaaaagagccttgtcagtgcgatccagattggcgggcatatcttgcctctattcattatttttatggatgtttcgtcccttggcgcgggatttggcagcaaactttgcaaatttcttctttagttatgagcatagcattgtaggaaataaggagcgcccgacatgaacaataaacacaatacattcggcttttccacccgcgccatccaccacggctatgaccccaaagaccaccacggcgccctcgtgccgccgatctatttgtctgccactttcgcgttccccaccgccgaatacggcgccgcctgctttgccggtgaagccagcgggcacttctacacacgtatttccaacccgaccctggccctgctcgaatcacgcatggccagcctggaaaacggcgaggcggccgtggctttcagctccggcatgggcgccattgcggcgacgttctggaccctgttgcgcccaggcgacgaagtaatcgtcagccagaccctttacggctgcaccttcgccctgttgcaccacggcatcggcgaatttggcatcaaggtgcgccatgtcgacctcaccgacctcgccgccttgcgcgcggcactgtcgcccgccacgcgcatgatttactgcgagacgccggccaaccccaacctgcgcctggtggacatcgccgccgtggcccagctcgcccacgcgcaacccaacatcaccctggtggtcgacaacacctattgcacgccgtacctgcaacggcccctggagctgggggctgacgtggtggtgcattcggccaccaagtacctcagcggccatggcgatatcaccgcgggtattgccgtaagcaaccacgccttggcgcaacgcattcgtctgcaagggctcaaggacctcaccggtgcggtgatgtcgccccaggatgcatccttgctgatgcgcggcctcaagaccctggccttgcgcatggatcgccattgcagcaatgcccaggcagtggccgaagccttgcaggcgcacccgatggtgcaatgggtgacctaccctggcctgcgttctttcccacaatacgaactggcggcgcggcagatgaggcagtccggcggcatgatcgcctttgagctcaagggcgggattgaaacgggccggcgcttcatgaatgccctgaagctgttcacccgcgcggtcagcctcggcgatgccgaatcactggcccagcacccggccagcatgactcactccacttacaccccagaggagcgcgcgcagcacggtatcagcgaaggcctggtgcgtttgtcggtggggcttgaggacatcgccgacctgctcgcggatgtgcagcaggcgctggccaaatgcgcccgcgccgcgccacgtcaggcgaggatagaagagcacgccgtaaaataaggcctacgcgccaggtaatgctttcccacacaggacggtcggacaggtccgaccatccttatgcgtttttaatctgattttttccagattggatccccctcatctcgcgatgctgtactagcatacgtctcggcgggagcactatcactgtaggttattcatacacgttaccttcttaaaccccgtcgctataaggctggatacctacactcgaaactcatggacgaattgatgaactcacacctgttcccacatataggcaaggtcatcgccagcaccggcagtcgccacttcccacgtatgctgcatgatctgatcctcacccaactggcagtggacgccacccatatcacccaattgcgggtgagcgccgaaggccagacccggcgcctgatcagcccggtctacaccgattcggtggtggctttaggtgaagagcaacccgccgcgcaactgcacctcacgcgccgcaaggacgacatgcgctacgtgctgtcggtgtaccgcgcgcaccactccgagagtttctcagcgcaggaacgcagcatgctgcaggacttctccacgctgttgctgcccatggtggaaaaacacatcaccgcgatccagccgtgccacccgaacagcgaaccgctggtgccggaaagccaaggcctcgaaaccctgcgccgccgcatcgaagaacgcctggtgcaatcggggctgaccctgtccaagcgtgagcttgaagtgtgcgtcggcctgctggccgggcgcactgcgccggagctggcggagcaactggcgctgaaggtcaacaccatcgaaagttacctcaagcgcgcggcgatcaagctggggatcagcgggcggcattcgttgttgcggtggatgtatgcgacggatgaagggataaccacccccctgtaaatcaccacaaaccctgtgggagctggcttgccagctcccacagttgatgtgtgttgccagggacaaatcagtccctggccaacgcctcaatcgggtccagccgcgccgcattcctggccggtacaaaaccaaacacaatgccgatcatcgtcgagcacgcgaacgcggtgatgatcgagcccagggagaacaccatctcccactccttcacaaacaacgaaaacagataaccgattgcgaacgacagcgagatcccgatcatcccgccgatcagacacaccatcaccgcctccaccaggaactgctggcgaatatccgattgccgtgcgcccaccgccatgcgaataccaatttcgcgggtacgctcggtcaccgacaccagcatgatattcatcacgccgataccgcccaccagcaacgagatcaccgcgatcagcgacaacagcagtgccagggagcggctggttttctgcaccgtctgcatgatgctgtcgaggttattggtaaagaagtccttggtgccatggcgttgcagcatgagtttattgacgttgtcttccaccaccttgctcggctggccatccttgatccgcaccgtgatgctgtccaggtgacgctggcccagaagccgccccgccgcggtttcgtaaggcacccacacgttcagcgccttgctggcggcgaacatgtttttgttgtcggccgtcacgccaatcaccgtgcacggcaagttgcccaccaggatcacctggcccaacggatcgacattcggcccgaacaggcgatgccgagtgttgtggtcgatcaccaccacctgggcctggcgccgagcgtcgctttcgctgaaggcgatcccggcctccagcttcaaccctttgaccttgaagtagcggtcgctgacgccattgacctgcgcatccagatcgatattgccaaaacgcagcagcaggttacgccccaccaccggcgtggcgctgtcgacgtaatacagttggttcaacgcctccacatccgagggcatcaacgtctcgatggctgacgcgcggctgtcaccaaagctggtgccggaaaagatatcgatggtgttgctgccgaccgcctggatgtccttgagcacatagcgcttggcgccctcaccgatggccgagatcgacaccaccgaggtgatgccgatgacaatcccgagcatggtcagcaaggtgcgcatgcgatgggaaatcagcgcgacccaggccatgttgaaggcttccttgaacaaccccaggctcgccaccagccggcgtgcgccgctgcgtcgggtttctatcggggcctcgccaggcagctccaggccgacgctgtcgttggccttgtcgctgacaatctcgccgtcgcacacctcgacaatgcgctgggcattcgccgccaccttggggtcgtgggtgacgataatcaccgtgtgcccggccgcgtgcagctcggcgaggatgcgcatcacctccttgccgctgtgggtgtcgagggcgccggtgggttcgtcggcgaggatcacttcaccgccgttcatcaacgctcgggcaatactcacacgctgctgctggccaccggaaagctggctcggccgatgagtcgtgtgccccgccaggcccaggcgtgtgagcaactcacgtgcgcggctgtggcgttgagtctccggcgtaccggcatagatcgccggcatttcgacgttgtgcaaggcactcaagtgcgcgagcaaatggtagcgctggaagataaacccgaagtaatcgcggcgcagttctgccaactgttcatcgcccagcgagcgggtttcgatgccattgatcttgtagctgccggcggtggcgtaatccaggccgccgagaatgttcatcagggtcgatttacccgagccggatgcgccaatgatcgcgaccatttccccggcatgaatcgtcaggtcgatgcctttgagcgcaatgaattcgcgctcgccggccatgaaactgcgggtgatgcccttgagttccaacaggggttgggtcatggctcaactccccgccacagcaggcgtggcgtcaccgatcacgactttatcgccttcggccaggccgtccagaatctgcactttgacgttgttgttgatcccggtcttcacagtgcgcgacacggctttgcctttggcatcgagcacgcgcagcgaatagctgccatcggcattgcgcgcgccaagcgccgccaccggcaccatcaacgcggcctgggcggtgtcgagcacaatacgcacctgggcggtcatggcgatgcgcaggcggtggtcggggttgggcacgtcgaacaacgcgttgtagaacaccgcggtgttctgcttcggcgtgccggcggtctgggtttcgaggaagttctgcggcgccggctccgtaccgcgcagcttggcgtagtaacgcttgtcggcctcgccgaggatggtgaaatacacctgctggccggggctgatgtgaatcacatccgcctcagacacctgggccttgacggtcatggtgtccaggtccgccagcttgagcagtaccggtgccaactggctggcgatcacggtctggccttcctgggtgacaatgccgaccacatcgccgtcgatgggcgcgacgatgcgcgtataggccaggttgaccttggccgtgtcgatctggatatgcgcgcttttgatctgcgcgtccaaggacaacaagttggcctgctgcacctgaaaggtggactcggcatcctcgaaatcctgacgcgaaaccgactcgtcaacctgcaaacctttgtagcgttcatagacggacttggcctgcttgagctgcgccgccgtcgcccggcgttgggcctgcaggttttcctcatccacctgggctttgcgcagggtgttctgcaggatcagcggatcgatttcggcgagccactggccctttttcaccttgtcgccgaccttgaccttgagcgacttcaactgcccggacacctgggcgccgacgtcaacttgcttgacaccttcaagcaggccggtggctaacaccgcgttttcaatatcgccgcgttcagccgtggcagtgaggtactgcggggcatcggcgggcgcttgcaccgtgtacacgacaaggccaatggcaaccgccaacaccgcgagcattccgagtttgcgaaactttgacttttccataaatgaccataaaaagatgaagagggcctacagctaacacgctctagtgtgggagctggcttgcctgcgattgcagactgtcagtcacaaagtgcttggctgatacaccgctatcgcaggcaagccagctcccacatttggatctccatgcatcaggaacggatctcgcggcttttgatttgctgttgatcttgatcttgatctggcttttgatctcaagcgccccgttaaaccacgctggccgaacgcaggcttgaatccgtgggtaacccggcaggacgccgggttagccgcgctgggccaaggatggcccatcgcggcggcccacgctccaaagccttcgttcgggcacaccgagcctgggcgaggtgccgagtggtggggcgaggaccttttgcttacttttgggtccttccaaaagtgagccgctgtaagagcggaaccataagtggccgttaccaatacaatggatatgtacacagacataccgctatcgcaggcaagccagctcccacatgtggatcgacaaacggccatcacgacaccacctccccaatcaccacaccctcaagccaccaccgcgacaacgccaccacattcggcgccttgagcaacgtaaagtgattccccggcccataccaaacctccaacccactgccctgccgccgccagccttcaaccatcaacccctgctcgcgctgattcccggcggcatccagggaaggatcctcagccaacaccaaccgcaccacaccgtggtaacgctgctgcggccgatacacggtgcgcaacgccgccgcgtacgtgcgcgccgggccgtccatcgcgtcaaccgaggcacgccccggcaacaaccccaccgccaccatccccgcatgcaagcccgtgcgctgcgccacctcatcacgctcggcaaaatccaccaggtcgatgcccagcgactgcccagctgccagctgcatcgcctcgatcaagcgcagcaacgccgccgtcgtcgtgtaaggccgccccgcgccgcctggcgcttcactgtcaatcaccgtcaacgacgccacctcacggccttgcgcctgcaaccgcagcgccagctccagcgcgacccagccgccgaacgaatgtcccaccagatgcaccggcccttgggggcactcctgcgtcagcgccgccagataacactgcgccgccgcttctacctggctatggggtaccgcctcgccatccagcccgcgcggctgcaagccaaacaacggccagtcccgcccgagtgcctcgctcaagcccacataaccggtaacgctgtccccggccccaggcacacagaacaccggcgcataccccgctcgcccactctgaatgcgcaacagcggttgatgcgccgcctcggcgaccggcacacccaccgccagcgcctcagacatcgcacgccccaacgcctggatatgcggcgcctgcatcatgctctggtgatcgcctggcacttccacctggcgcaattgccccggcgccagcgcgtcctcccaacccagcgaaacacggcggcgcgacaactcggtgggccgctcctgcgcgctgaacaaatgcaccgccaccggcagtgggaacaggctgtaatgcgccagcgcatgcccgtgccccacttcacgctggataaaactcaagaggtccgcgtccgtcgccgccgccatttgcgcgtacagcagaccttcatcgcgacagcgttgcagcaaacctgcaaagtccagctgtccaatgcccgcctccagttgttcaaggctcgccagctcatccacacctccctgtgctttccaatacgccgtgcactgcagcagcagatgccgcttgagcgcatccggcccgctccagcgcgccttgccctggtcggtcatgcgcggcacgtagctgtcgatcaaaccgagaaacgccaccggctcatccagccccagcaattgcatcgccacttcatacgccaacaccccgccaaacgaccaacccgccagccggtacggcccatggggttgcaggccacgaatcaacccgaccatacgcgccgccaggccttccatggtgttcaggtgcgactcgccaagcgccgcgcccggcaggccatagatcgggtagtcaccgggcaggtgctggcccagcgccgggaagtacacgtccatgccgctgaactcgtggaccagaaacagcggcggctgcgagccgctgctgcgcacggtaatcacccaactgtcgcgcaccggttcatccgtgcgctggttcagcatcgcggccacagaggccacgctggcatgctggaaaagctccgccagcgacacctgcaaccccgcctcttccagcaggttgaccagtcgaatcgccagcaacgaatgccctcccagctcgaagaagctgtcatgccgcccgacctgctccagcttcaacacctcggcccacagttgcgccagggtctgttccagcgcatcggccggcgcttcgaaatctcgccggtgcaacgcctccagggccggagccggcaaggctttgcggtcgatcttgccgttggccgtcagcggcaactgctcaagcgctacataggctgacggcagcatgtaatccggcaattggctgtgcagatgggcacgcacgctgtcgacctctgcgggttcgcccgcccaggtgaaatacgccaccaggcgcttgtcacccggcacgtcttcacgcgccagcaccaccacctcctgaatccccgcacaggtcgccaggcgcgcctccacctcgcccagctcaatgcggaaaccgcggatcttgacctgatcgtcattgcgcccgatgcactccagcaagccctgcgccgtccagcggccgaggtcgccggtgcggtacatcaaggcgcctgggttgagcgggtcttgtacaaatttctcggccgtcagctcgggccggttcaaataacccttggccacgccgtcgccgccgatgcagatttcaccggtcacacccaccggcaccggctgcagctgcgcatccagcacatggatttgcgtgttggagatcggccgccccaccggcacgctgtcagcgcctgcggcaagcgtgcgcacctcataagtggtggcgtaggtggtggtttccgtcggcccgtagcaatgcaccagacgcaacgccggcgcctgggccagcagcgtgcggaacgccgccgggtcggcacgctcgccgccgcacagcaggatgcgcaagccggccagcgcctcgggaatcatctgcacgtattgattgaacagcgccgtggtcacgaacagcaccgtcgcgccttgcagcgcagtgccaaaggcgcgcgggtcgagcagggtcgcgtggtcgatcacctgcacctggccgccgttgagcaacgggccccacacgtccatggtgctggcgtcgaacgccgggttggaggcgaaggctacgcggtcggccgcattgaagtcggcataaccgttgttgagcaccagccgcgtgataccgcgatgcggcaccaacacacccttcggtgtgccagtggagccggaggtgtacatgatgtacgccacgctgtccgaagactgcgacaaatccgggttgtggctgggttgcgggtcgagggtaagggtgtcgaggtccaggcgctgtgccgcgtactcgacgaccgcctcactgcgggtcaacaacagggccgcgccgctgtcctgcagcataaaaccctgacgctcggcgggcgcgttgatatccagcggcacatacgccgccgcgcacttgagcacggccagctggctgaccagtagatccatagagcgcggcagcaggatcgccagcgtgtcggcgggccgcacgcccaggctcaacaggtgatgggccagacggttggcgcgggtgttcaattcaccgtagctccacgcctgctcgccgtgcagcaccgccacggcgtcagggcgcgcctgcgcctgggcttcaaacagccgctgcaccgtgtgttcacgggggaacgcacgggcagtcgcgttgaacgccgacagctgcttacgctcggcagcaggcagaatcggcaagcaaccgatcgcgctttcagtgttgtgctccagcgcctcaaccaattgctcaacggcgacttgcaagtagccacacacacgccgggcgccctgccccgtggcttccagcctgaagccctcaccgaggtcatcgacactcaccgacaatccgtaattggtgtgttcctcggttttcagcagttgaatgccctgccatgcctcggccacgccgccctgttgcggcgcgctgtgacggtagttgaacagcacgttaaacaacggcgtggccaccggcaccgcgctgcagcgctgagccagggccagcggtgcatgctcatggctgagcagttgggtcaggcgcgcatgggtggcgcgcactgcgctaagcaccgactgctcacccaggtcgacgcgcaacggcaaggtgttgatgaatacgcccatggctcgctcggcgccttcgccaccttgcaggcggccgagcatcacagtgccgaacaccacctgctcgcggccactgactttgcccaacacctgcgcccaggccaagtgcatcaggctggcggcactcacacccgcatggcgcgcctgggtgcgcaggcgctggctcaactgcgggtcaatcggcagatgcgcctgttcatcgacgcccaggttgtcgacggccgtcggctcgtcaatctcaccaagcatttcgcggaagaacgcttcgtggtcgtcaacgcccaagcgggtctgggcgacgtaattgcgatacggcaccgccgcactcagctcaccctcacgaccgagcaggaacgcctgcatttcatgctgcaggatatccagcgcgatgtggtccatcaccaagtgatggaacagcaacgtcgccaccacacgctgcggctcttgcacataaaccaggcgcatcagcggcgcttgagccaggtcgagacgcgccggcaacgggccggtttcgacgctcagcctggcgtcacgccaaaccacctgcaccggctcttgcaggccgtcccaatggaacgatgagcgcagcacgtcatggcgctggatcaccgcctgcaatgcacgggcgaacgcctccaggcgcaacaggctgtcgaaggcaaactgcgcctgcaacaggtacgcatcgccggtcgctacggcccgatggtgatagagaatgccggcctgcaacggcgccagcgggtagatatcctgcacattcgccgcgccgccagggatgcaggcgacgagtcggtcgatggccgcctggtccagttgaatcaatggcagcatggccggcgtgatctgcgtgcagtcggcggtaatgccattggccggcaccgccacttcgcgaccgccgcccagtgccgccgccagggccgagagtgtcggctggccaaacagcaccttcacatccgccgacaacccgagccgacgcatacgccccatcaagctgacggccagcagcgagtgcccgcccagctcgaagaagttgtcgtgacggcccacgcgttccacgttgagcaattcggcccagaggctggccaaggcaatttccgtgtcgccctggggcgcttcgtattcgcgtaccaccaccgaatccagccccggttcgggcaaggccttacggtcgagtttgccgttggggctcagcggcaacgcgtcgagatgcacgaacaccgccggcaccataaattccggcaagtgctgcagcaaatggctgcgcagcgcgtcgatgtcgctgagtacgccggtgtagtacgccaccagccgttgctcgcgggcgatcacggcggcttcattgaccgacgggaactcggtcagccgcgcctggatttcccccagttcaatgcgcaagccacggatcttcacctggtcatcattgcgccccaggtactcgagagtgccgtccggcaaatagcgcccgacgtcaccggtgcggtacaggcgcccctgggtaaacgggtcatcgaggaaacgttcggcggtcagctccggccggttcagatacccgcgcgccacttgcacgccaccaataaacagctcacccaccacgcccagcggcaccggctgcaactggctgtcgagcacgtacatgcgcgtattggcgatgggcttgccgattggcgtgttgtccggcacgtcaatgcctgcgcaattccacgcagtaacgtcgacggcggcctcggttggcccatacaggttatgcaactcagtgcccggcaaccgctgcttgaagcgccgcaccaggctgcccggcaaggcttcaccgctgcacatcacgcgcaccagcccggctgcctggctcacatcgccatgggcgaggaatacgtcaagcatcgacggtacaaagtgcagcgtggtgatctgttcggcctcgatcacatcacacaggtactccggttctttatgcccgccagggcgcgccatcaccaggcgtgcgccggtgaacagcggccagaaaaattcccacaccgacacgtcgaagctgaacggggttttctgcagcactgagtcgtgcgccgtgaggccgtattcgtcctgcatccacagcaggcggttgaccacgccacggtgttcgttgatcacacccttgggctgcccggttgagcccgaggtgtagatgacatacgccgccacgcccgctacgtcggggttgtcgacgggttgctgctgccagcaaggcctgtccagatcgaccaccggcaccgcgccaagcaactcgcgcgtagcaccctgggccagcaccacaaccggcgcactgtcctccagcatgtaggccaggcggtccagcgggtacgccgggtccagcggcacataggcggcgccggccttgagaatcgcgtacagcccgaccaccatcccaaggccacgctccacgcagatcgccacccgtgaatccgcctgcacgcccagcgccagcaggtgatgggccaactggttggcctgtgcgttgagttcggcataggtcagttgctgcgtgcccgccttgacggcaatcgcgtccggcgtgcgctgcacctgcgcttcaaacaggccgtgcaaggtctggtcgaggttgtagttcacttcggtggcgttgaaatccaccagcaggtgctggcgctcacgctcatccagcagcggcgcatgcgcaagcaccgcctggtcgttatcgaccatcgcctgcaacacgcgggtgaaatagccgacgtagcgctgcacggtcgactgatcaaacaaggccaacgcatattcgagcgcgccgagaatactgccctgcacttcgccgaggttcagcgacaaatcgaatttggcaaagtggctgttctcgacaataccttccaaggccaggtcgcccaacgccagggtcggcgcgctgctgtcctgccagctcagcagggtctggaacaatgggctatgggccaggctgcgcacgggccgggtgatttccaccacttgttcgaacggcaggtcctgatgggcctgggcttgcagcgtcagcgccttgacccgcgccaacagcgcttcggtgctcaactcgcccgaggtgtcgatgcgcaccgccagggtgttgacgaacaagccgatcaacccttcgacttcgctgcgcgtgcggttggccaccggcgaaccgatcaccaggtccgactgcccggacagccgcgccagcaatgcggcccaggccgtcatcaaggtcatgtacagcgtggtgccatggcgttggctcaaagccttgagcccagcggtcagacgttcatccaggcgcacttcgacgctgctgccggcgtagtcctgttgcgcaggccgtggtcggtcggtgggcaaggccagcgacgccggcgcgcccgccagggcggtttgccaatagctgctctggcgctgcaacacttcaccgctgagccacaaacgctgccacacggcaaagtcgccgtactggatcgccagcgccggcaacgggtcaggcaggccatggctgaaggcttggtacaacgccatcagctcgcgggtcagcacgcccatcgaccagccatcggagacgatatggtgcaaggtcagcaacagcacatggtgatcgtcggccatcaccaccagacgcccacgcagcaacgggccgcgctccaggtcgaacggtgccgaggcttcgccgtggatcaaggcgtccagcgcctgctgcggttgcgggtggcggcgcaggtcctgcacttgcagcggcagcacgtcttcggcgggcacgatcagcaccttggcgtcgtcgccgtgctgggcgaagcgactgcgcagggtttcgtgacgcgcgacgatacgcgccagcgcccgttgcagcgcctcgacgtgcagctgcccacgcaggcgcaggccgataggaatgttgtaggcggtgttggcgccttccatcaacgccaggaaccacaggcgctgctgggcgaacgacaacggcacgtcgtcctcacggttcggcagaatatccggcaaggtgctgcgcccggattgggccagcacttcagccacggccgccagctcggcattcgcaaacaggtcgccgaggatcaactcgacacccaggcgctggcgcacttgggaaaccatgcgcattgccagcagcgagtggccgcccagttcgaagaaatggtcgcgacgcccgacgcgcgcgacgtgcagtacatcggcccagatctgcgccaatacgctttcgatctcgccctggggcgcttcgtactcgcgggtgaaaacggcggccatgtccggcgccggcaaggccttgcggtcgagcttgccattggcggtgagcggcaacgcatcgagcttcacgtaggcaaccgggaccatgtagtccggcaggtgcgccaccaggtgagcgcggatatcaccgaccgccagcgggtcgagctgcgggttttcagtgaagtacgccaccagccgctcttcacgcaccaacaccacggcttcctgaatgccgggcaactggttgagctgggtttcgatttcgcccaactcgatgcgcacgccacggatcttcacctggtcgtcattgcgccccaaatactcaatgttgccgtccggcaaccaacgcgcgaggtcgccggtgcggtacatgcggcccgcattgaacgggtcttgcaggaagcgttcggcgctcagctccgggcggttcaagtaaccacgggccacgcccttgccgcccacatacagctcaccggccacacccaacggcaccggccgctgctgctcgtccagcaggtacaccgtggcattcgcgataggcttgccgatatgcaacggctggcctgcctcgaccttgccggaggtggcgaccacggtggcctccgtcgggccgtagttgttgatcagctcgaaacgctgggcgcgcgcgaactggcgcaggcgatcaccgccgatcagcaaggtgcgcaacgtcgggtgttcgatctgttggctgaaagcgtactcggccaccggcgtgggcaggaagcacacgtccaacggttgcgcgcaccaccaggcgagcaaggcgtcgatgtcttcggcaccgtcgttggccggtggcaggtgcaacgtcgcgcccacacacaatgccggccacacttcccaggccatcgcatcaaagccgaacccggcgacgctggccgtgtggcgcccggcgcacaggtcaaaggcgcggcaatgccagtcgaccaggttggccacggtgtggtgctcgaccatcacgcctttgggtagcccggtagaaccggaggtgtagatcacataggcgaggttcgagggcgtgacattgaccgtggggttgctcgccgagtggtgctgccaggtgaagcggtccaggtctatcaccggcacgtccagtgcgggcaggcgctccagcagcgactgctgggtcagtacggccaccggcgcgctgtcggtcagcaggtagttcaggcgctcggccgggtgcgacgggtcgaccggcacgtagcaggcgccggccttgagaatcgccagcagcccggccagggtgtcgaggccacggcgggcgacgatggccacgcggtcgtcgggcttgacccccagcgccagcaggtgatgggccagcaggttggcttgctggttcagctcggcgtaggtcaattgccgaccttggtaaacggcggcgatggcgctgggcgtgcgggccgcctgggcctcgatacgcgcgtgcagcgtggtgccctgggggaagtcggcgtgggtcgcgttgaactgttccagcagctgttgttgctcggcggcaggcactaccgaaacgtgattgagcggtgtctgtggcgcctgctccagcgcagtcacgaggttttccagcgcagtttgcaggtaggcgcacacgcgctgcgggtccacctgagtgctggcgagcaagctcaaaccaaagccctcgccgaggtcatccacgctcaaggtcagcggatagttggtgcgttcttcggcactgagcgcggtgatgccttgccaggccgatacggcttcggcactggcggccggggcactgtgacggtagttgagcaaggcactgaacaatggcgtcggcgccaccacaccgctgcagcgctgggccagggccaacgccgcgtgttcatggcgcagcaaggtggtcaaccgcgcgtgggtggtcttgacgccggcacgcacgtcctggccgtccacatccacgcgaaacggcagcgtgttgatgaagatgcccagcgcccggtccgtgtcatggctgccctgcatgcggcccatcagtaccgtgccgaacaccacatgcgctttaccggccagcgcccccagcacctgcgcccagcccatatggaacaggctggcggcgctcaccccgagttgccgggcttgcgcacgcaaacgctggcccagcgccggcggcaacggcaggctgacttcggcgatcccacgggcatcgccctgcacgtcctgcaagccgaacggcaaggttggctcgctgatgtcgccgagcatctggcggaagaaactttcgtgttcctgctcgctgatccccagccgcgcctgcgccacatagttgcgaaacggcacggcctggccgagcgccgcgccctgccccagcaggcacgcctgcatctcgtggcacaccacttcgagggcgctgtggtcgagggccatgtggtggaacagcaaggtggcgacgatgcgctgattggccggatcgtgcgcgtgcaccaggcgcaacagcggcgcctgggtcacgtcgaggcgatagtggcgcgcatcgaaccgcgcgtgcagttgcgccgcgatatcgccgtcggccgggtccagctccagggcctgcaccggcagctgcgcctggcgccacaccacttgcgacggttcctgcaaaccgtcccagaccacgccggtgcgcagaatgtcatggcggtccatcacccgttgcagggcttgggcaaacgcctcgaaacgcgccaggctgtcgaacgcaaactgcgactgcatcacatacgggtcgccctgctcggcactcacatggtggaacagaatgccttcctgcaacggcgccagcgggtagatatcctggatattcgccacaccgcccgcgacggtcgcgacgatacggtcaatgtcgtcctggctcaacgtcgacagcgtgagcatgtccggcgtaatgcttaccgcgcccggcggtatgccattggccggcacctcgacgtcaccggccttggtcgccgaatactcaccggccttgatcaactcgatcagcgccggcttatgttcacgcaacgcggcgaggatcgcagggtcgctcaaggcctgtttgttcccttgcaccgacaactgctcgcccttgagcgccagttggatgtccttggttttcagcgtcgccaacagctcaaaaatgctcacaggacgatctccattcgttcagttatggcggcgtagccggccagggtcggctgctcgaacagcgcccgcacatcggcttccatgccttcctggcgcagacgcccgatcaagctcacggccagcagcgagtgcccgcccagttcaaaaaaattgtcgtcacgaccgacccgctccactttgagcaattcagcccagagcctggccaggaggatttcggtgtcgccttgcggcgccacgtactcacgcacgatcagcgcttccatgcccggcgcaggcaaggccttgcggtcgagcttgccattggggctcaggggcagtgcgtcgaggtgcatgaacagcgcaggcaccatgaagtccggcaggtgctgcagcagatgggcgcgcagctgttcgatgtcggtgtgtaggccggtgtaataggcgatcagccggtcgtcacgggcgaccacggcggcctcgttgacctgtggatgctccagcagccgcgcctggatttcacccagctcaatgcgcaagccacggatcttcacctggtcatcgttacggcccaggtactcgatattgccgtcgggcaggtagcgcccgacgtcccctgtgcggtacatgcgcccgccatggaacgggtcgtcgaggaagcgctcggcggtcaactccgggcggttcaggtaaccccgcgccacctgcacgccgccgataaacaactcgccaaccacacccagcggcaccggctgcaattgcgtatccagcaggtacatgcgcgtgttggcaatcggcttgccgatcggggtgttgtccggcacgtcagggcgtgcgcagttccaggcggtcacgtccaccgccgcttcggtcggaccgtacaggttgtacaggccgatccccggcaattgcgctttgaagcgtcgcaccaggctgcccggcaaggcttcgccgctgcacatcacgcgcaccagcccggctgcctggctgacatcgccatgggcgaggaatacctccagcatcgatggcacgaagtgcagcgtggtgatgtgttcggcttcgatcacttcgcacaggtacgccggttccttgtggccgcccgggcgcgccatcaccagccgcgcgccggtgaacagcggccagaagaattcccacaccgacacgtcgaagctgaacggggttttctgcagcactgcgtcatcggcgttgaggccgtaggcgtcctgcatccacagcaggcggttgaccaccccggcgtgttcgttgatcacgcctttgggctggccggtggagccggaggtgtagatcacgtaggcctggtgctgggcggtaagccccggcacgtgcggattgctctcgggctggtgctgccaggtgtcgtggtccagatcgatcaccggcacgtcacccagcaattcacaggttgcgccttgcgccagcaccaccaccggcgcgctgtcttgcagcatgtaggcaatgcgttcggctggatacgccgggtccagcggcacataaccgccaccggccttgaggatcgcgaacaggccgacaaccatgtccaggccacgctcgacgcaaatgcccacgcgcgaatccgcttgcaccccgagttcgcgcaggtgatgggccaggcggttggcgcgccggttcagctcgtcataggtcaggaacctgtcaccggccttgaccgccagcgcattcggggtgcgctcgacctgcgcctcaaacattccgtgcagggtttggtcgaggttgtagtccaccgcggtggcgttgaactccaccagcagtttctggcgctcttcggcccccagaatcggcaggcgattgagcggctggtgcggcgcctgttccaacgcggcgaccaagccggacaaggccatctgcatataaccgcacacgcgttgcgcgtcggcttgcgccagggcggtgacgtcgtagccatcgcccaaatcatccacgttcaatgtcagcgggtagttggtgcggccgtcgttgaccagcgtctgcatgcctgcccaggcttgttgcgcgtcagccgagcgcgtcgcggcgccgcgatggcgatagttgagcatcgaactgaacaagggcgccggtgccgcgacgccgctgcaacgctgggccagggccagggacgcgtgttcatgccccagcaatgcagtcagccgtgcatgcgtcgcacgtaccgcagcgcgggcgccttgttcgtcgatatccaggcgcagcggcaacgtattgatgaacacccccagtgcgcggtcggcgccctcgccgccttgcaggcggccgaccaacacggtgccgaacaccacgctgtggcgacccgaggtggccgccagcacttggccccaggccaggtggaacaggctggccgtgctcacgccgagcaaacgggcctgggcgcgcaggcgccggttgaggtcgccgtcgaggtgcaggcagtgttcctggatggcactgccgtcgccgcgtacgtcctgcaagccgaacggcaaggtgggttcatcaacatcaccgagcatctggcgaaagaacccttcgtgcgcctgctcgctcacccccagacgcgcctgggccacgtaattgcggtacggcataggcgcggcagtgggtgccgggtggccgagcaaataaccctgcatttcccgcagcaccacgtcgaacgcggtgtggtcgagggcgatatggtgatagagcaacaccaccaccacgcggccgttggccgggtcgttggcatacatcaggcgaatcagcggtgcctggctgatgtcgaggcgatagcgccgcgcgtcgaaacgctcgtgcaagccggccagcacatcgccgtgcaaatgcagttcctcaacactcagctgcgcctggcgccacaccacttgcagcggttgcgccaggccttcccagaccacgccggtgcgcaggatgtcatgccggttgatcacctgttgcagcgcctgggcaaaagcgttcagacgctcgatgctgtcgaaggccaggtgcgattgcagcaggtacgggtcgccgctttcggcggtgatgtagtggtacagaatgccttcctgcagcggtgccagcgggtagatgtcctgcacgttggccgcgccaccgggcacgccggcaaccagctgatcaatcgtcgactggtcgaggtcgaccaaaggcaacatatccggggtgatgcgctggcagtcggcggcgatacggttggccggcacttgcacttccaggccactgcccacggcggcggccagggcagccagggttggctggccgaacagcacgcgcacgtcacagctgaggccgacctggcgcatgcgctcgatcaggctcacggccaacaacgaatggccgcccagctcgaagaagtggtcatggcgaccgacttgctcaacttgcagcacctcggcccagattcgcgccagggtggtttccacctcgccttgcggcggcgcatagtcgcggctcagcagcgcggtctggtcaggttgcggcaaggccttgcggtcgagcttgccgttggcggtcagcggcaacgcatcgagtttgacgtaggccaccggcaccagtgcctcgggcaattgttcctgcagttgtgcacgcagggtttcaatcgccagcgggtatgtttcagtgaaccaggccaccaggcggccctcgcgcaccaacaccacggcttcagcgacgccgtccactgccgccaggcggctttcgatttcgccgagttcgacgcgaacgccgcgcacttttacctgatcatcgttacgaccgaggtactcgatattgccgtcgggcaaccagcgcaccaggtcgccggtgcggtacatgcgcccgctgttgaacgggtcttgcaggaagcgttcggcggtcaaatcggcgcggttcaaatagccccgcgccacgccgctgccgcccacgtacagctcaccggcgacacccaccggcaccgggcgcaactgcgcattcagcacgtacacactggcattcgcgatgggccgcccaatatgcagcgcctgcccggcgcgtacgcggccagaggtggcaaccaccgtggcttcggtcggcccgtagttgttgatcaccgcaaagcgccgctcgtgggtgaactggcgcaggcgatcgccgccgatcagcaggatgcgcaaggtcggatgctgcaggttctggctgaacgcgtattcggccaccggcgtcggcaggaagctcacgtccaatggctgcgccagccaccaggcgagcagttcgtcgatgttttcattgccgacctgggcaggcggcaggtgcaggatggcgcctgcgcagagtgccggccagacttcccaggccatggcgtcgaagccaaacccggcgacgctgctggtgtggctgcgcgcatccaggccgaaggcctcgcaatgccagtgcaccaggttttccacggtgcggtgttccaccatcacgcctttgggttggccggtggagccggaggtgtagatcacataggccaggtgcgccggggtcaggctcgccagttgcgggttgccgacggggtgatgcagcaagcgtgcgtcgaacaggtcgaccgtggcctgcgtacccaatagatcaagggtgcctggctcggccacgaccgcgaccggcgcgctgtcctgcagcaggtaggcgatacgctcggcggggtaagccgggtcgatgggcacgtagcccgcgccggccttgagaatccccagcagcccgaccagcatctgcgggccacgccggcagcagatagccacgcggtcgtccggctgcacgccgagcgccagcaggtgatgagccacctggttggcgcgctgattgagttgctggtaggtcaggacttcgccgtcctgctgcacggcaatcgcgtggggctggcgttcgacctgggcttcgaaggccccgtgcacggtgaacccggtggggaaatccgcagcggtcgcattgaattcacgcaacagggtttcgcgttctgccgggggcaaaatcggcaggtgattcagcccggtgtttgtcgagttttccaatgccgcgaccagttgctccacggcgctgtgcatgtagccacacaggcgctgggcgccgatctgcggcagcgccagcacgctcaggccaaagcctgcgccgccaaagtcgtcgacactgagggtcagcgggtagttgctgcgttcttcgccgcccagcagttgcacgccttcccagatgccgtggccatcgcgggccatttcgccggggctgctgtggcggtaattgagcaacgcgctgaacaacggcaccgtcgtcggcaccccgctgcaacgctgggcgagtgccagggacgcgtgctcatgaccgagcagtgcgctcaaacgcgcatgggtggccttgaccgcgacggcggcgccagcagccacatcaacacgcagcggcaaggtattgatgaacatgcccaacgcgcggtcggcgcccccaccggcctgcatgcggcccatgagtacggtgccgaacaccacagcatcacgcccggcaaccagccccaacacttgcgcccaggccaggtgcatcaggctggctgcgctgacacccagcgcccgcgcctgttcacgcacacgcacggccagtgccgcgtccaggtgcagctcggcctcttcgatatcgcggccatcgccctgcacatcctgcacgccaaacggcaaggtcggttcatcgacctcggcgagcatgtcgcggaagaactgctcatgctcggccacgctgacaccgaggcgagcctgggcgacatagttgcgaaacggcgccgcctcgggcaatgcatccgcctggttgaacagaaacgcgcgcatctcctggccgaccacttccatggcggtgtggtccagcgccaggtggtggaacaacaggatcgccgcaacccgattattcgccgggtcctgggcgtagaccatgcgcagcagcggcgcctgggtgatgtccaggcgatactgacgggcatcaaaacgctcgtgcagttgctcgataatgccgccatcggccgggtccagcgtcacggcctgtacaaccagctgcgcgtcacgccagaccacttgcaccgggctgtcgaggccttcccagaccacgccggtgcgcaggatgtcgtgacgcgccaccacctgctgcagtgcgcccataaaggcgtgcaagcgttccaggctgtcaaacgccatgcgcgattgcagcaggtacgggtcgccctgctcggcgctgatatggtgataaagaatgccttcctgcaacggcgccagcgggtagatatcctgcacattggcggcgccgcccgggacgttggcgacgatgcggtcgatagccgtctggttgagctgcaccagggtcaacatcgacggcgtgatgtgcgtgcaacccgctggaatgccattggccggcaccacaatttcgcggccactgccgactgccgccgccagtgctgccaggctgggctggttgaacaacacgcgcacgtcacagctcaggccgacctggcgcatgcgttcaatcaggctgacggccagcaacgaatgcccgcccaactcaaagaagtgatcatgacgcccgacgcgttccagcttgagcacgtcctgccagatctgcgccagcagggtttccacttcgccttccggcgcctcgtagccacggctgagcaacgcgctctggtccggcaccggcaggcccttgcggtcgagcttgccgttggcggtcagcggcagcagctccagccacacataggccgacggcaccatgtagtccggcaactggccttgcaggtgggcgcgcagtgcttggatattcaacgccgcctgggcggtgtagtacgccaccaggcgcttatcgcccggctcgtcttcgcgggccagcaccacggcgtctttgacgccggggaaggcggccaggcagctttcgatttcgccgggctcgatacggaaaccgcgaatctttacttgcaggtcattgcgcccctggtacagcaatgtgccgtcggcctgccaactggccaggtcgccggtgcggtacagctggccttcgccgaaggggttcgggataaacttttcagcggtcaattgcggctggttcaagtaccccttggccacacccgcgccgccgatatacagctcgccgaccacgcccagcggcagcggttgctgacgcgcgtcgagcacataggcctgggcattcgcaatcggccggccaatcggaatgccgccctcgcccagcgcggtgatttcaaaggtggtggagaacgtggtggcttcggtcggcccgtagccattgagcagatgccggggtttgccgtgcttgagcacgcggccgatcacctgcgggtcgagcacgtcgccgccgacgatcaggtagcgcagttggcggaacaccggcagcaacgcatcggcgtattgatggaacagacccgccgtcatccacaacacgctgacggcttgctcttgcaacagcgaggcaaacgccgcctgggacagcagcacggcatgctcgaccaccaccacacaaccgccattgagcaacggcgcccacacgtcgagggtgctggcgtcgaaggccgggttggaggcaaaggctacgcggtcgcggtcgttaaaatcggcgtagccgttgttcagcaccagccgcgagacggcgcggtgcggcacttgcacgcctttgggcgcgccggtggagccggaggtgtacatgatgtacgccacgctttgcgaagactgggccaagtcggggttgcgtggcgactgcgcgtccaggttcaggtcggccagggtattgaggacacgatgcgcgccgctgtcttgcacgataaaggcttggcgctcgagcggggcattgacgtccagcggcacatacaccgctgcgcacttgaggatcgccagttggcacacgagtaaatccagtgaacgtggcagtgcaatcgccacgctttcgccgggctgcacaccttgattgatcaggtgatgggccaggcgattggcgcgacgattgaggtcgcgataactcaaggacaaggcgccatgcaccgccgccacagcttcggggcgcgccagggcctgggcttcgaacagctggtgcacggtgagctgcgacgggtattcgcgggcggtggcgttgaagtccaccagcagttgttggcgctcgcccgccggcagaatcgacaccgcctgcaaggccgtggtcggcgcttgctgcaacgcagccaccagatggcccagcgcggtaagcatgtagctgcctacgcgctgtacatccacgctggccacgccttgcaccgtcagcgcaaagccgctgcccaggtcatcgacgttgagcaccagcgggtagttgctgcgctcttcggaactcagaatctcgatcccggacgccgcgaacgggctgtcgccgggcgcctcgcccggcgcactgtggcggtaattgagcaaggtgctgaacaacggcagcgaacccggtacgccactgcaacgctgggccagtgacagcgaggcgtgttcatgcccaagcaactgcgccaagcgtgcatgggtggcacgcaccccggcttgcacgctgacggcaccgaggctgacgcgcaacggcaaggtgttgatgaacatccccagcgcgcggtcggcgccctcgccaccctgcatgcggcccagcagcacggtgccgaacaccacgtcgtgctggccggagacttgcgccaacacctgcgcccaggccaggtgcaccaggctggcggtgctcacaccgagttgccgcgcctgttcacgcaggccgtggctgagtgccggtgccagtggcaaatgcgcttcgacgatgccgctgccgtcgccattcacgtcctgcaacccgaacgccagcgtcggctcatcgatgtcgctgagcatgtcgctgaagaaggcttcgtgttgtgcctgcgtgacacccaggcgcgcctgggccacgtaattgcggtactgcaccgcgtccggcaactgcgcgcctgtgccggcaaggctggcgctcatttcttcgaccagcacttgcaaggcggtgtgatcgagcaggatatggtgcagcagcagaatgccgacatagccgcccggctgctcggcgtagccaaaatgcatcagcgaagcgcgcgacaggtcgaggcgatagtggcgcgggttgaagcgttgttgcagctgcgccagcgcgtcaacgccgtgcatatcgatgcgctcgaccgccaacggcgcctggcgcaacaccacttgcaccggctcatccaggccttcccagagaatgctggtgcgcaggatgtcattgcgttcaatcacgctgtgcagcgcgcggataaacgcgtccaccgccgtttggtcggcgaagctgaactgcacctgcagcacataggggtcgccctcggtggttgccaggtgatggtaaagaatgcccgcctgtaacggtgccaggccgtagatgtcctgcacattcgcgatgccgccaggcacgctgttgaggatatggtcgatcgcggcctggtccagcgtcaccagcggcagcatgtccggcgtgatctgagcgctcgtcgcgctgatcaggttggccggcacctgcacttcctgctgcccgcctaccgccgccgcaagcgcagccagtgtaggctggccgaacagcacgcgtacgtcggcgctcaggtccacctggcgcatgcgttcgatcagtttgaccgccagcagcgagtggccgccgagttcgaagaagttgtcgtcacggccgaccttgtcgagcttcaacagctcctgccagatcgccgcgatggcggtttccaccgcgccttgcggcgccgcgtagccacgccgggccaatgcgtcggcatccggtgccggcaaggccttgcggtcgagtttgccgttggtggtgagcgggaatgtatccagcagcacgaaggcgctgggcaccatgtagtcggccaggctcagcagcaagtggtcgcgcagttcggcagcaccgagttcacgctcggcaatcacgtaggccaccaggcgtttgtcacccggttggtcttcacgggcgatcactacagcgtcgcgcacaccgtcggcggtggccaggcgggcttcgatttcgcccagttcgatacggaaaccgcggatcttcacttggtcatcgttacgccccaggtactcgacgctgccgtcggccagcaggcgcccgaggtcaccggtcttgtacatgcgcaggccggtggccgggtcggccaggaagcgttcggcattcagtgcgtcacggttgaggtaaccgcgcgccaccccggcgccgccgacgtacagctcgccgaccacgcccatcggcaagggctcgcggcgctcgtcgagcacgtacagttgcaggtcgggaatgcgcacgccaatcgggctgacgcccaccagctgcgcgtccgccgcttccagcgcgcggtaggtgacgtgcacggtggtttcggtgatgccgtacatgttgaccagttgcgtaccggcgttgatggcgcgcgcgtaccacggcttgagcatgccgggctcaagggcttcgccgccaaagatcacttggcgcaacgaatgtgactgggtgctttgcgcggcgatcagttggcggaatgcgctgggcgtctggttgagtatgctcacaccggcgtcgcagatcagcgcgtaacactcatccggcgaacggctgaccagttgcggcacgatcagcaattggccgccgtgcatcagcgcgccccagatttcccacaccgagaagtcgaacgcgaaggaatggaacagcgcccacacgtcgttgcggttgaagccgaaccagtgctgggtggcggtgaacagccgcgcgacttggcggtgttcgatcatcacgcctttgggcaggccggtggaacccgaggtgtatatcacataagccaggttggccgggctgagttgaatgcgtgggttaacgatggactcgccgcgcaggctgttgaggtcgatctgggccaagtcgcccaccaagtggcgggtgttggcttgcaccagcacggccagcggctcgctgtcggccagggtgtaggcgatgcgctccagcgggtacgccggatcaatcggcacgtagcccgcgccagccttgaggatacccagcaggccaatgatcatctccgggccgcgctctacgcagatggccacgcgatcatccgcgcgcacgccctgggccagcaggcggtgggcgacctggttggcgcgttcgttgagttggcggtaggtcaggcgctggttgttgaagcgcaaggcaatggcttcaggctgggcggcggcgtgggtttcgacgtgctggtggatcagtgctgtgtcggcgtaatgcgtggggctttggttgaggctgtgcagcaggtggtggcgctcggtttcaggcaggatggtcaggccgctcagcggctgatccggtcgctgctccagggcatcggccaggctgtgcagcgcggtctgcaggtagccggcgacacgttgcgcgccaatgctcgcgtcgaccatgacggtcagcgcgaagtcttcgcccaggtcgtcgacgttgacggtcagcgggtagttggtgcgttcctcggcgcccagcacctgaatgccttcggcgacgtcgatgaccgcggccatatcggtggcggcgctgtggcggtagttgagcatcgcgctgaacagcggcgtcggcgcggccacgccactgcaacgctgggccaaggccagggacgcatgttcgtggttgagcaaggtggtaaggcgttcatgggtggccttgactccggcgcgcacgccctgttcgcccacgtccacgcgcagcggcaaggtgttgatgaacatgcccaaggcgcgttcaccgccctcgcctgcgcccatgcggccgagcatcacggtgccgaacaccacggcgtcacggccggacaccacgcccaatacgcgcgccagcgccaggtgcatcatgctcgccacactcacgccgagtgggcgtgccaggctgcgcagacgacggctgagtgcgctgtcgacggcgacgcgcgcctcatcaatgccctggccatcgccttgcacatcctgcaaaccgaacggcaaggtcggctcatcgatatccgccagcatctcgcggaagaatgcctcgtgcgcctgctcactgacgccatgacgcacctgggcaatataactgcggaacgcgaccggctcagcggcctgagcctgctcgccggccaggtacagctggatttcgtggcgcaccacatcgagagcggtgtggtcgaggatagtgtggtgaaacagcagcatcgccaccacgcgtctgttgaccgggtcgtcggcaaacaccaggcgcagcagcggcgcctggcccaggtccatgcggtacgtgcgtgcgtcgtaacgcgccagcagttgggcgagcacgtcgccgccgttgaagtgcgcctcgtcgcaggccagcgtcgccttgcgccacaccacttgcagcggctcgtcgaggcgttcccaggccatggacgtgcgcaggatatcgtggcgatcaatcacccattgcagcgcttgcgcgaaggcctcgaagcgggtgcggctgtcgaacacaaactgcgcgtgcagcacgtaagggtcgccctgctccgccgaaagatggtggtagagcatgccttcctgcagcggcgccagcgggtagatgtcctgcacattcgccgcaccgccagggatggcggcgacgatgcggtcgatggccggctggtcgaggctgaccagcgccagcatgtccggggtgatgcgatacgccgggctcagccagtcgccgccctgtgcggccacccattcaagcaagcgcggcttgtgtgcgatcagttgatcccacagcgcgtcgtccagcgcttcatcgtcgccgaggatgatcaggtcgccttcttccagttgcagacggatcgcgtgagtggaaatcgctgccaataattcgctgaactgcatggggtaacctgcctgataagtcacggtggaggagaaaatccgttttcagctgccgttttggatcgggtgtgctgggcgccgctaaaaagcaggcgcagccgcaagcctggagaggcttccggcaggcttggaaaattaagggatttggcaggcggggggtgacatgggaagcggggacaagcgggaatcaggcaacgttcagttttttttacgtcgacacgctatcgatatgccgatagtccaggttcagctcacgcgccagctgggtggcgcgcccgagtttgatcggcccgcgttcgatatccaccagtagcccagggcaatcgagcagcggtaaaccggcgatatccttgaggcgcccatcggtaattaccagcagacgctgttgctcggcgggataacgctggcgtcgcgcttgcagccactgcccggcctcggacaaggccgccagcaacggcgtgccgccgcccgcaccgagctgggacagccaaccggtcaggcctttggcggccttcaagccctgcacctgccaggtgggcgcttgcccgctggcggtgagtaacgccatgcgtgcgcgttgccgataggcatcgtcgaacaactgggcgagcaagcctttggcgtcggtcaacgcgccatggcgccgggtggacgccgaggcatccacaatcaccagccacaactcatgggccgcgcgactgcgcaggtggtagagcaaatccgcgcggcagtgcggccgaccgccaagcaaggtgcccggccagttgatcgcaccgtgtttggcgctgcgcgccttgccgtgcctgccgttgtccagtcgccccagcttgggccgggcatccgcccccccgtcagatcgagggcgaatgcctagggcttttttggccaggtgggtacttcgcggcgtgcgcccgtgggcaaggccggcgcgggcatgtcgccccactggccctggccgggtgaagtgtctgaaggctggggcgcctggccctgattgggcgggctcgacggcggggtttgcgcgtggcggcgatggcgcaaggcaaattcggccaccgcttcgatgtcttcttcggcgatggcggcagcaccgcgccaggccgcatgggcgcgtgcaccgcgcaaccacacgaggtcggcgcgcaagccgtcgacgccagcggcgaaacagcgctcggtgatctgcgccaaggcctgatcatccagctcaatgctctcaagccgcgcccgcgcctgggtgcagcgctcgcgcaaggccgcttgttgctcggcccattggctgcaaaacgcggccgggtcagtgtcgaaatccaggcgccgacggatgatttgcccacgctcggcaggcagggtgtgcccactcaacgccacgttgaagccgaagcggtcgagcagttgcgggcgtaactcgccctcttccgggttcatggtgccgatcagcacgaagcgcgccgagtggcgatgggaaatgccatcgcgctcgatcaggttggtgccgctggcggccacgtccagcagcaggtccaccaggtgatcgggcagcaggttgacttcatcgacgtacagcacaccgccatcggccttggccaatacgccgggggagaattgcgcacggccttcgcccagagcggcgtccaggtccagcgtgccgaccaggcgttcttcggtggcgcccagcggcagggtgacgaactgaccgctggcgagcagatccgccaggcctcgcgccagggtggatttggccatgccgcgcgggccttcgatcaacacgccgccgattttggggtcgatggcggtcaggcatagcgcgagtttcaactcgtcggcgccgaccacggcggacagcgggaaatgtggaatgtcggtcatattcaactctaaatggatcgttcccacgctcccgcgtgggaacgccttactggacgctctgcgtccgctcttgtgacgcagagcgtcacgggctgcattcccacgcagagcgtgggaacgatcggtcagctgtcttcttctatgtccattaacaggttttccaatgcctcgcggtacgcacccggttcctgccacaggccgcgttgctgggcttcgagcatgcgctcggtcatgtcgcgcagcgccgcggggttgtgctgctgcacaaaggcgcgggtgtcggggtcgagcaagtaagcgtcggcgagcaaggcgtattggtggtcatcgatcagcgcagtggtggcgtcgaaggcgaacaggttgtccacggtcgccgccatctcgaacgcgcctttatagccgtgacgcttcacgccgtcgatccacttggggttggcggcgcgggaacgaatcacccggttcaactcttccttcaaggtgcgaatcttcggcaggtccggctggctatggtcgccatggtagctggcggccttgtcgccactcagggtttccacggcggcgagcatgccgccctggaattgatagtagtcgttggagtcgagcaggtcgtgctcgcgattgtcctggttctgcaacacggcctgcacctggctcaagcgctgggcaaactggtcgcgggcggcagtgccttcatccgagccgccataggcgtagccgccccagttcaggtagacctcggccaaatcctcgcgactctgccacaggcgcccgtcgattgcgccctgcacgcccgcgccatacgcccccggtttggcgccgaaaatacgccagccggcctgtttggccgcggcgtcttcgtccaggcccgacaggcgcagggcttcgcgctcgctgcgcaccttggcggccagcgggttcatgtcatccggctcatccagggccgccaccgcctgcaccgccgcgtcgaacaggcggatcaggttggcgaaggcatcgcggaagaacccggacacccgcagcgtcacatccacacgcggccggtccagcaagctgatcggcaggatctcgaagtcatccacccgctggctgcccgtggcccacaccgggcgcacgcccatcagcgccatggcctgggcgatatcgtcgccgccggtgcgcatggtcgcggtgccccacaccgacaggccgagttggcgcaggtggtcgccatggtcctgcaagtgccgctcaagaatcaggctggcggattgaaaaccgatgcgccaggccgtggtggtgggcaaattgcgcacatccacgctgaaaaaattgcgcccggtcggcagcacatccaggcgcccacggctcggcgcaccgctggggccagccggtacgaaacgaccgctcaaagcatccagcaacccgcgcatttccgccggcccacaggcgtccaggcgcggcgcgacgacaatgcgcaggctctcgatcaccgacttcacgtcatgccagcccggctcttccagctgttcaatcggcccttccagcgcctgctcgatcaagcgcgcggcgtacagctccaggcgctcgcgggtatcgcccgccgtgcgccagagctgcgcatcgatgttctgcaacacctgcgggcggcgcccggtccagggctcggccagggcgcaatcgagtggatcgaagcccagctcgaaggccttggccaacacccgcagcaagctcgattgcgggccacggccatcgccgcgcgggatgcgcagcaaggccagcaaggtgtcgatgcgcaagcggccttcgggcgactcgccaaaaatatgcaggccgtcgcggatctgcgactccttcaagtcgcacaggtaagtgtccaggcgcggcaaccacacggcggcgtcggcgtcgttgtccagctcaagctcctggtcgatacgggtttcgcgcaccagcttgagaatgtctttttgcagttcaagggcgcggcgcgggtcgagcagttgcgcctcgtaatactcgtccgccaacagctccaggttacgcagcgggccgtaggtttcggcgcgggtcagcggcggcatcaagtgatcgatgatcaccgcctgggtgcggcgtttggcctgggcgccctcgcccgggtcgttgacgataaacgggtagatattcggcagcggccccagcagagcatcgggccagcagttttccgagaggcccacgcctttgcctggcagccattcaaggttgccatgtttgcccacgtggatcacaccgtgggcgccataggtgtggcgcagccagaagtaaaacgccaggtagccatggggcggcaccaggtcggggtcgtggtacaccgcactgtggtcgacctgataaccgcgtgccggctggatgccgacgaaggtcaggcccaggcgcaggccggcaatcatcatgcgcccgtcacggcacatcgggtcgttgtgcgggctgccccaacgcgccaacacggcttggcgattggcttcgggcaggcgctggaacatcgcctcgtagtcgtccaggccaaggctttgatggcaggggcgcaggtcaaggctgtcgaggtcgttggtcacgccgccgagtagctcgtggatcagggcagtgccgctgtcgggcagctccgtgggcaccgggtaaccttcagcgtgcagcgcgcgcaggatattcagcgctgcggccggcgtgtccaggcccacgccgttgccgatacggccgtcgcgggtcgggtagttggcgaggatcagtgcgatgcgtttttgcgcattcggcacccgcgccagttcgacccagcgccgcgccagctcggcaacgaaatccatgcgctcgggcgcggcgcggtagcacaccacgtcggactggctgcgttcactgcgccaggccaggtccttgaagctgatcgggcggctgataatgcgcccatccaactccggcaaggcgatgtgcatcgccaagtcgcgcgggccgaggccttgttcgctggcttcccagccgggctggttgtcctgggcgcaaatcgcctgaatcaccgggatattgcggcgaaacgggcgcaaatgcggcgcttcggggctggattgggcaaagccggtggtgttcaggatcaccgccgcctgcacgtcatccaacaggtcctcgaccaccgcgaggcagccgggctctttcaaactggccaccgccatcggcaacgggttaaggcccgccgcctgcaagcgctggcagaacacgtcgataaaaccggtattggccgcctgcaagtgcgagcggtagaacagcaccgctgccacgggccagtcggcattccagtccgcctgccaatcgttcagtcgagcgttggcgttatgcgggtgataaatcgcggtgcgcggcagggtttgcggctcggcccaggcgtaatcgcggcccaggcaggtgctggccaggcagcgataaaaatccagtgcgttgcccaggccgccctggcgcaggaagtgccagaggcggttgcgcgcttcctcgcccacggtactcagacggctgagttccgggtccgggcggtcatcgccgggcaccaggatcagttgcacgccgcgctcggccaactccaccaggcgctcgatgccgtagcgccaataaccgatgccgccgtgcagcgaaatcaggatgaccctggcgtggcgcaatacctcatcgacgtacaggtcgaccgaagcatggttttgcacctgcatcgggttggccaggcgaaaacttgggtaatcgtcaggcagctgttgggccgcctcggcaagcagcgccaggctggagtcgccgctgcacaggatcaccagttcagcgggggtttggcctaagtcggcaatattgtcgtcggagacgaaaccaccgggctgggtcctgagcaggtgcatgggttaaacgctgagggcagcgcgcagttgcgcttcgaggcccgccgcatccagctcctggccgatcagcaccaggcgcgtgatgcgcgcttcgtcggcgccccaggcacggtcgaagtgtttgtcgaaccgcgtgcccacgccctggatcaacaggcgcatcggcttgttcgggatagcggcgaaacctttgacgcgcaggatgccgtgctgcaccacgagctgggtcagggcgtcgagcagcagggcttcgtcagcttgcggcaggtcgatggagatggagtcgaaggcgtcgtgatcgtggtcatcgtcgtcaccgtcatggtgatgatcgtgatggctgtggcggccgtcgatgtgctcttcggagccggcgcccaggccgatcagcacgtccagtggcaggcgaccgctgctggcttcgatgatcttcaccgccggcggcagttcttcggcgacttccaggcgcacgcgggccaagtcttcagggctgatcaggtcggatttgttgaggatcaccaggtcggcgctggccagttggtcggcgaacagctcgtgcagcggcgactcgtggtccaggttcgggtcgagtttgcgctgggcgtcgacctggtccgggaaggcggcgaaggtgccggcggccacagccgggctgtcgaccacggtgatgaccgcgtccacggtgcaggcgctgcggatttccggccactggaaggcttgaaccagcggtttaggcagggccaggccggaggtttcgatgaggatatggtcgaggtcaccgcgacgggcaaccagttcgcgcatcaccggaaagaactcttcctgcacggtgcagcacaggcagccgttggccagttcgtagacgcggccgttggcttcttcttcggtgcaaccgatggagcactgcttgaggatttcaccgtcaatgcccagctcgccgaactcgttgacgatcacggcgatgcgacggccctgggcgttgtcgagcatatgccgcagcaaggtggttttgcccgagccgagaaagccggtaacgatggtgacggggagtttggccagtgttttcatcggatgccctttggggcgggcatacgggacgaggggccctgcggcggcgcgcagaagcggatttcgtcaccggatcaccccgcccggttgaattggaaaatcggttgcgaggcaggtctcctggcttggggcttgcgggtcttgcgaccggcgctggctgcgccttcccgccttaatggcagtggcgtggcagtcagttgaacccttcacagttgcgggggcagccgcggcttggaccgcgttcccttcttagcttcggcatgggccgaagaacctcgaaggtgcaaggctacgcagtgcggggaaacgggtcaatgttgattgatacacggaccgggacgctcgccgccaggcgggttgaaacacttccaaatctttttaacggaatgcgccgggaacgcaatcaacgcagtgggcacatagaagcgacacccaccctaaaatggaaataatcatgtcgctctcaatctccccctctgtcaattcacacttgcccgtctcgcccctctcccaacaagcagcgccaacgactgcaatttggagagagcctattgaccaactccagccccgggaactggcgcaagcgctccaaacctattttgatgccatgatcgacccgcgcttcggcgagactattaccaaagagtccctccagcgagtggcagatggacgaccgctgaacggggtgcccccaacccaaacgcagatcgagatcgcccaggaagtattgaagcgcaaagacctgttccagcagctggacttcaccagcggtaaggacggaaaaatcagtcgagacgatctcgcaactgaaacaggtgacttccaatacctgagcgatcgagcactgatcaccctggtgggcaaaaacttcaatgagtacggcggcggcgacacctatgtgaacttcaccgagttgcgagaagccgccggtgaacagccaagcaccaaaaaattcagtccgcaggcgcggggggtcgctcaggaactgctcaaacgcatagagttgctggaccggttggatatcggcgtaggctttttggggttcgcaggcaaacaagatcagcgcttcgatctgcgcaacgttgagtacacacgcactcacagctctccccaatcccgttacccagactgattgattcaccctgttggccgatagcggctcccgaatgtcgagagccgcaaacctctatttgacgcctatcccccgcccatgctctcctacacatcttgtttcgggtgcccttcacagggtgaaacgggaaaccggtgagtcatcgcgttatgacgagtccggtgctgcccccgcaacggtaagcgagtgaaacgtcagatccactgtgccttttacggcatgggaaggcgatgttttcaagacccagcgtccctcgcaagcccggagaccggcccgaaaattcagataacaaacccgcggtgggcgggcgctgttcagaaccctgcgtgcctggctcgcggggttttcatgcgctcgtttcaccctgacaccctgaagggacgcgccatgtcgatcatcagcagcacctcgcacgccaccagcagcaccgccaccctgagccaacgcctgaccgccgccatcggcgcgtcgatcctcggcgcgtgcctggtgtatttcgccggcttctcgcacatcgaggccgtgcacaacgccgcccacgatacccgccacagcgccgcgttcccgtgccactgagacctgccgacatgatcaagcgtatcgctcaaaccgcaggcttcaccggcttgctggccgccctgctgctgactctgctgcaaagcttctgggtcgccccgctgattttgcaggcggaaacctatgagaacgcccccgccgctgccgaagtcgcgccccatgcacacgctgatggcgccgctgcgcatacccacgatgcccaagcctgggaacctgaagacggctggcagcgtgtactgtccaccactggcggtaacctggtggttgcggtcggtttcgccctgatgctggccggcctctacaccttgcgcgcgccaacccgcacggctcaagggttgctgtggggcctggccggttacgcgacgtttgtactggcgccgaccctgggcctgccgccggaattgccgggcaccgccgccgccgacctggcacagcggcagatctggtggatcggcaccgcagcctccacggctgccggtattgcgctgttggtgtttggccgcaactggctgctgaaaatcctcggcgtggcgatcctggccgtgccgcatgtgattggcgcgccgcagcctgaagtgcattcgatgctggccccgcaagccttggaagcgcaattcaaaattgcctcgcaactgaccaacgtcgccttctggctggccttgggcttgatcagcgcctggctgttccgccgcaaccgtgacgctcactactcggcatgacctgggtagtcggcatgggctgccagcgcggctgtgatgttcacaccctgctcggcctgtttgacgctgccctcgccgagggcggcatcgagcgccagcgcattagtgcgctggccagtatcgaccgcaagcgagatgaaccggggctgctcgccctggcgcaggtgttgaacttgccattgcagtgtttcagcgccacgcaattggccgtgtttgaaccgcgcctgagccacaaatccgagctcgcgtttgcacataccggctgttatggcgtcgccgaaagcgccgcattggccctggcggaacagctctgccatggccctgcccgcctgctgatcacgcgcaaaaaagtcgcccaggccacctttgcattagcctgcgccgactaaaaacccgataatcgccctgctcgatcatgagcaattttcatgctcgcccgtttttcaacaggaattccccatgaccgtctacttcatcggcgcaggccccggcgacccggaattgatcaccgtcaaaggtcagcggctgatccgcagttgcccgatgatcatctacgccggttccctggtgccggctgcggtattggagggtcatcaggcggaacaggtggtcaacagcgccgaattgcacctggaacagatcattgagctgatcaaggccgcccacgccaagggccaggacgtggcgcgcgtgcactccggtgacccaagcctgtatggcgcgattggcgagcagattcgttatttgcgcgagttgggcataccgttccagatcatcccgggcgttacggccgtggcggcgtgtgcggcgttgctggagacggagctgaccctgccggatatcgcgcaaagcgtgatcctgacccgctacgccgataaaaccagcatgccggccggtgaagacttcgacagcctggcgcgccacggcacgaccatggcgattcacttgggggtcaaccacctggacaagatcgtcgccgagctgctgccgcattacggcgcagactgcccgattgccgtggtacaccgggcgacgtggccggatcaggactgggtggtgggtacgctgagtgatatcgccgagaaagtggcggctaaaggttttcggcgtacggcgttgatagtcgttgggcgcgtgctggcgaatgacagcttcagtgaatcctcgctgtaccgtgcaggccacgcgcacctctatcgcccctgaatgtgggagctggcttgcctgcgatggcggtgcgtcagtcggtaattctctcggctggcttatcgctatcgcaggcaagccagctcccacagttgatcctatttggcaggaataccgcgcaaatcactgaattttaagcataaaaaaacggcgctcacggggcgccgttttttatgttcgcagcgaacaccttactcagtagtaggcgttttctttctgcgtgtggtcagtcacgtcacgtacgcccttgagctcgggaatgcgctcgagcagggtgcgctcgatgccttcgcgcagggtcacgtccgcctggccgcagccctggcagccgccaccgaacttgagtacggcgataccgtcttcgaccacgtcgatcaggctgacctggccgccgtggctggccaacccagggttgatctcggtttgcaggtagtagttgatgcgctcgttgaccgggctgtcggcgttgacgttcggcaccttggcgttgggcgccttgatggtcaactggccgcccatgcggtcggtggcgtagtcgaccacggcgtcgtcgaggaaggcttcgctgaagttgtcgatgtacgcggtgaagcttttcagccccagggcggtgtcttcaggcttctcttccccgggcttgcagtaggcaatgcaagtctcggcgtattgggtgccgggctgggtgataaagacgcggatgccaatacccggggtgttctgcttggacagcagatcagccaggtaatcgtgggcggcgtcggtaatggttatggcagtcatggaaactcctcacaggcttgccgccagtttacgccaaattattacccagatacaaagtcctagtatttttgtcgggataaattcgaccgttcgtcgccatcaaaccaccctttaagcagacgataactgccctgctcaagccatcggtagctgcccagggcgcccaggccgatgatgaccacgcacatggccagcacggcatacgggttcaggccgtagcgctgggcaacatagccgccggccgacagcaccagcacgtgcagcaaatacacggaatacgagcagtcccccagcactttgagcaatcggttgttcgcgaagaaccgctccagcgccatgcacgcaaccaccagcaccgcgctgggcaagccccaggtcaaggcgcgcggcgatgccggccaatgatagatggccagcagtgcagcggcgatcccgagtagcggcaaccacaagcccggccggatccaacccttgcgatacagcatgccaatgccgatgcccagcaggaattcaacgacgatgtccgagcgatagaacgtgctgatccagccaaacgaggtccaggcctcgcacacggcgaacagcaacgccgcgaccaccagcagtcgccactgccgacgaaacaacaacgcccacgcaaacaacaggtagaagagcatctcgtagttgagtgtccagccgacattaagggtcgggtacacaccatagccaccgggattttcagagggaataaacaacagcgacatcagcacatgggcggcatcgacgctctggtccggcaacattggccgagcgaccaccaccagcaacgccatcaacagcgtatagaaccagtacgcgggcacgatgcgcagcaggcggtacaacaggaagcgccagggtggcaggtccttgtcctgggtagacaggaagatcaccaggccgctgatgacgaaaaacacatccacgcccgcagcgcccttttccacaaataatcttcccaaggccgtgtccgccttgaaaccgaagaaaatctgcatgaagtggtgccctaccactgtccaggccgccaacgcgcgcagcgcctgtaccgagatcaacatcgtccgccacccttcccaactcatcaacatgaagttgggaccgtggcggacggtcaaaggtcgatcaaagattctcgtagcggttcatgtccagcacgccttcttccagtggcgtggtttcgcggatgtactgcgacaagtcgtgaaagtactgccagaacaacggatgactacggcgtacgccccatcggtcgacgattttctcaaagcgcttggcgtccttggcattttccatcgccgcaacaaacgcgggcacttcctgcgccggaatgttgaacatgaagttcggataactgctcagcacgccagggtaaatagtcagcgtgtccagccccggttgatagcgataagcctcacccagcaaaaacgccacgttactgtgggcacggttacgcaacaggctgtaaaccacccgcttgccactggcggtttcaactcgcagcatggtggcctcaggtaactggtcgatcaccttgagcccccccgccgggcgcgaggtcaggcgactcagcgcctgctccgcatcctgcaacgccggctcgatcccatcgcgcgagcaataggcgccggtgcaacggttgatcgggtccgggctggcgttgaggtcgccataacgcgtcaataactggttggcaaaatcgcgcttcgggtctctttcatccaaatgcagcccagtcggcttgtcatcatcgatcgcttcataatccagccacagcttgagcttgccgctgttctgataccaatcatccataaagtcatcgcgggtatcggcgggcatcaagcgtagaaagttctgctcggcaccattgcgaatcaaatcgaagtacaaccgtgtctgggcctggtgcgagacgttgccgaacacatcgaagttgacggccaactgataataggtgcgctccagcaacgggtaatcgaacagccacagggtttgcggcacctcgccgatcaggcctttggtcaccgaagcgctgtcgaaatggcggaatatgctcaacaaggcgttgtcattaccggcccacaaggtcgaccaactcggcggcggcacatccgcgtagctgtcacggcgcaacgcctcgtactgattgcgcttgtcgcgataggccagccacaggctcagcacgctgcccacatcatcgttttgccccggcatcgccagcaacggcgtggcctggccacggtaacgcgcgtcggtgatgtacaggtcgtggtccgggtcctggaacaaggtccagaagttgtcacggatcacgtccgtcgcgatttgcccacggcacaccggcccgcgaataaaggtgcgcacgaagtattcggcgttatcgagcatgaactggtaacgcgccttggccggaatcgcctcaaaggtttcgaacgggttggcgcggcgccccgggccgtagcccggcaaggcattgacctgccagtcgccggcgtagaacagctgcatgatccgcgccattttcgcggcgctgaacgggtacgtgatgtgggttttatgcacgatcacgccctgtaccggccacaggcggtaatagacttgggtgccggggtcgtcgttggggcgacgggtggcaatcaggtcaatcggttggccgctcggcgtgcgcgatcgcacccactggaagaaatgccccggctcgccgttttcaaaatagatgtgcgccaggaataaatgctcatacagccagcgtgccaccaggctttcgcgggcgcccggctggttgaacaggttttcccattgctgcacctgcaaggcttccttggcgctgggtgccaggccttgcgcatcaatcggggcgccggacgccagccagcgctgcagcgtctggtattgctggtcggtcaggccggtcaccgccagcggcatgccttccttgggatgggcgccggcgtaggcattgaattcgccgggcatggcgcacatgttctggcggttcaggcccagcatgatgtcgtcgggcaatttggcgttcggctcaagtggtgcgttatgccccagttccagcatgcgcgccatcaaggccgcctggctgccctgggcgtcgagcaccgaatagaagcccttctgctgccaggcctgcttgccgaaggcgtcgtagaacaaacgggtggtcggcgtagcctggctgcgttcgccgtcgtagacgggcactttggtcgcgccacgcgccgcgccctcggcactgcccaggttaagttggcacgcggagtcgtagcaggcatggcaggccacgcacttttcggtgaagatcggttgaatgtcgcgggtgtaggaaattgtcggcgcgggactgttttccggtaaaacgtctgcctgggcagtactggcgatcaaggccaggacggcgctgatgatgaggcgaagtgacatgtatccggtcccgattcaatgcgtgcgatctataagtgccggcaattctaccgggccatgacggcccccaacatgaacgatattcatgcaaaacctgtacatgctctaaatcggcacaggtttgttatgattcacgccctccgaaatgcctgaccagagtagtcccatgtccgatcgtagcgctcgtctgcaagcccttcagcaagccctcaaggaacgtatcctgatcctcgacggcggtatgggcacgatgatccagagctacaagcttgaggaaaacgactaccgtggcaaacgcttcgccgactggccgagtgacgtaaagggtaacaacgacctgttggtgatcacccgtccagacgtgatcggcggcatcgaaaaggcctacctggatgccggcgccgacattctggaaaccaacaccttcaacgccacgcgcatttccatggccgattacggcatggaagaactggcctacgaattaaacgtagaaggcgcgcgactggcgcgcaagatcgccgacgccaagaccctggaaaacccggccaagccgcgctttgtcgccggcgtgctcggcccgaccagccgcacctgctcgctgtcgccggacgtgaacaaccccggctaccgcaacgtgacctttgatgagctggtggaaaactacaccgaagccaccaaaggcctgatcgaaggcggcgccgacctgatcctgatcgagaccatcttcgacaccctcaacgccaaggccgcaatcttcgccgtgcaaggcgtgttcgaagagctgaacgtcgaactgccgatcatgatttccggcaccatcaccgacgcctccggccgcaccctgtcgggccagaccactgaagcgttctggaactcggtcgcccacgccaaaccgctgtccgtaggcctgaactgcgccctgggcgccagcgagctgcgcccgtacctggaagagttgtcgaacaaggccaacacccacgtttccgcgcacccgaacgccggcctgccgaacgaattcggcgagtacgacgagctgccgtcgcaaaccgccaaggtcatcgaagagttcgcccagagcggcttcctcaacatcgtcggcggctgctgcggcaccacgccaggccatattgaagccatcgccaaggccgtggccggttacgcgccgcgcccgattccggacattcccaaggcgtgccgcttgtcgggcctggagccgttcaccattgatcgcagctcgttgttcgtcaacgtcggcgagcgcaccaacatcaccggttccgcgcgcttcgcccggttgatccgtgaagacaactacaccgaagccctggaagtcgccctgcagcaggtggaagccggcgcgcaggtgatcgacatcaacatggacgagggcatgctcgattcgaagaaggccatggtgaccttcctcaatctgattgccggcgagccggacatctcccgcgtaccgatcatgatcgactcctccaagtgggaagtgatcgaagccggcctcaaatgcatccagggcaagggcatcgtcaactccatcagcatgaaggaaggcgtcgagcagttcattcaccacgccaagctgtgcaagcgctacggcgccgcggtggtggtgatggccttcgacgaagccggccaggccgacaccgaagcgcgcaagaaagaaatctgcaaacgctcctacgacatcctggtcaatgaagtgggcttcccgccggaagacatcatctttgacccgaacatcttcgcggtcgccaccggtatcgaggaacacaacaactacgccgtcgacttcatcaatgcctgtgcctacatccgcgacgagctgccgtatgcgctgacctccggtggcgtgtccaacgtgtcgttctcgttccgtggcaacaacccggtgcgtgaggcgatccactcggtgttcctgctgtatgcgatccgcaacggcctgaccatgggcatcgtcaacgccggccagctggagatctacgaccagatcccggccgagttgcgcgatgcggtggaagacgtggtgctcaaccgcacgccggaaggcaccgacgccctgctcgccatcgccgacaagttcaagggtgacggcagcgtcaaagaagccgagaccgaagaatggcgcggctggccggtgaacaagcgcctggaacacgcgctggtcaagggcatcaccacgcacatcgttgaagacaccgaagaatcgcgccagtcgtttgcgcgcccgatcgaggtgatcgaaggcccgctgatgtccggcatgaacatcgtcggcgacctgttcggcgccggtaaaatgttcctgccgcaagtggtgaagtctgcgcgggtgatgaagcaggccgtggcccacttgatcccgtttatcgagttggaaaaaggcgacaagccggaagccaagggcaagatcctgatggccacggtcaaaggcgacgtgcacgacatcggcaagaacattgtcggcgtggtgctgggttgcaacggctatgacattgtcgacctcggcgtgatggtgccggcagagaaaatcctgcaggtggccaaggagcagaagtgcgacatcatcgggctgtccggcctgatcacgccgtcgctggacgagatggtgcacgtggcccgcgagatgcagcgccaggatttccacctgccgctgatgatcggtggcgcgaccacctccaaagcgcacacggcggtgaagatagaacccaaatacagcaatgatgcagtgatctacgtcaccgacgcctcccgcgcggtgggcgtggccacgcagttgctgtccaaggaactcaaggccggctttgtcgagaaaacccgcctggaatacatcgatgtgcgcgagcgtacatccaaccgcagcgcgcgcaccgagcgcctgagctacccggccgcgattgccaagaagccgcagttcgactggagcacgtacacgccggtcaagccgacctttaccggcgccaaggtgctggacaatatcgacctcaaggtgctggccgagtacatcgactggacgccgttctttatttcctgggacctggccggcaaattcccgcgcatcctcgacgacgaagtggtcggtgaagctgccacggcgctctacgccgatgcccaggaaatgctcaagaagctgatcgacgaaaaactcatcagcgcccgcgccgtattcggcttctggccgaccaaccaggtgcaggacgatgacctggaagtctacggcgacgacggtcagccgattgccaggctgcaccacttgcgccagcagatcatcaagaccgacggcaagcctaacttctccctggccgacttcgtcgcgcccaaggacagcggcgtgaccgactacatcggtggtttcatcaccaccgccggcattggcgccgaagaagtcgccaaggcctatcaggatgcgggcgacgactacaactcgatcatggtcaaggccctggccgaccgcctggccgaggcctgcgccgaatggctgcaccagcaggtgcgtaaagagcattggggctacgccaaggacgagcaactggataacgaggcgctgatcaaggagcaatacagcggcatccgccctgccccgggctacccggcgtgcccggatcacaccgagaaagcccagctgttccaactgctcgaccccgaggcccgcgagatgcatgccgggcgcagcggtgtgttcctcaccgaacactatgcgatgttcccggcagcggcagtcagcggttggtatttcgcccacccacaggcgcagtactttgccgtgggcaagatcgacaaggaccaggtgacaagctacaccgcgcgcaaggctcaggacctgagcgtcaccgagcgctggctggcaccgaacctggggtatgacaactaaacacgcgttgcggtatcccaatgccgcctgcgtcatcgcaaaatccgtttttctgtgccgggccgatcattcggtccgctggcccggcagctcacccaacaccggggtgcacacagaaaaaaggattttgccatgcccgatctacccatcgccctgagcgcattacccgcccaggccatccatgcccatttcgctacccgcccggccttgttttcagtggtgttcaaggcactgctcggtggtattcgcgagcgttatccgcgcctgaagctcgacctgctcacgctcaaactggccagccccacgcccgctggcggctacacgttcccgctgctgatcagtgtggcggtggcccatgtcctgaacccgcgcctgctggacctgcgcccgcagaacgacctgccgtactatctgtcacccatgaccggcggccgcctggccgatatcgacatgcaggtgattgcgcacatcatcgacgagctgccaggctcgctttacctgcatttccaagcggacctcgccgcctactggagcgagaccgacagcctgggcagtagccgctggcaatggcttggcgaatggctcaatggccagatgaccgcagcggcagccggtcgccagggcctgagcgacacccacagggacatgctggccaccaccgccgcctggccgtcacgtgtggaacgcctgccccgctccacgccgaccacctacgcgtatttcatcgaaaccacactgtctaaagccgacaaggaggtgtgcctgttgacgccggacctgttgctggtacgcgacaggcaggtgctgttgtgcagcgtggcaggcgttgtcgagccgtttggctccctggacgcctttggcgaagcctggggcgcgcggatgcaggcgcagtttcagttcgacagcctgacctggcggcgcaatgaaccagacggcaacgtgtttgaacaacaggccgggcttatccttaatcagcaactggaagacctggaaacgctggcctatcaagggcaaagcgaagcggcactcgaccgcaccctggaaacgctcacgtacccggccctgctgtttacccaaaccgccgtgccagcccctgttcacctgcaaaaggtcgacgaaaaactcccggcgtggctcaagcaagcgaccgccaatgagcgctttgcctaccaccgccacctgcaggacatggcccaggtgctgcgcctcaatcaggggcgttcattcaacgagggcgtggaaaacatccatgctttcagccgcaatgcactgcgcaaacagatgcaggccgaccacggcgatcaagaccccgacgctgtgctgctggacttcgccgtggcggctggctacccaggcggcgccggcattatcgaacatgtgcagctgtcgctgacggaactggcggtgaagaacctggccggcaagcctgacggcacgctgacgctacggtccaaaaccgccgaggcgctgccgggctggctgagcgaagactacctgctgggcagccatggcctgatccagcgtgtcgacatcggaaccgcctacccacagaagatcaaagacctgttgctgtcggacaccgccgacgcgcgccgccgggaaaaactcttcacccgcgaactcaaggtgcagctgccgatgcgcgccctggaatgcgcgattcggcaacagcacggggtcaccgccaccggctatcgctatgtgacagcgctgatgggcgagacacccgcagaccgagtcgtcgacggtcaggaaatcgtcctgcgcccactggccctgtgccgcaaagccggggcaacgcccgatgccgtcaacaacttctttgtcatcgaacctcgcgacgctggcgttggcccgcacgtgctgtaccgaccgctgtacgccgaggccctgtctcaatatccgacacgccaggccctgctcgaagcgcttgccagccccggcgaactgcaaagcagtgtgttgacctggttgagcgacacggctcggccgatttatgacaacggcgggttcaaacagccgcacatcattcgcttcctgccaggggatgagttcgcaccgcctgaagaccctgcaccggcgacgctggccgtcgatgaaggcgccgaggaatggctgcagtcacaggtcaacggccaactgctgagccacttgttcggcagcaccgcgcgggcgatggtcgacctggcggaccgcgagtcggtgtccaaccacgaaagccgctgggccattgtgatggagggcgcgtggctgctgttcaacactctgttattgccgttggtacgcggcccggccatgctggccggctggttcctggtgttggtcagcagcctggagcaggacctggccggcctggacagcagcgacccgaccacgcgtgaactggcgctgattgacctgctgctcaataccgccatgctgttgttgcacgccaccagcgcctcccctcgaagccgccagcccttggcgcgccccgcgcccgaagagagtgtcttgcgcctggccacctggcgccatccggcgggccaggcgcctcagcccggcccctcgctgattcgccccggcgccgtgacgctgcccggcgaacccccggcaagcggccgcaccgccctggatttcagccgctcgctggccagcccgcaggcgagtgcgaaattgctcaaggcgctgctcgacgtccacgtgccctggcccgagactttgccgccgccagaggccagcggaccgctcatggggctgtaccgcattggccaaacctggcacgccagcgttggcgggctgttgtttcaggtcagcgtggtgccggggtttggtgaggtttacctggtggatccacaacgcccgctgcaccctggtttcaagctggtcagcgacaatcaggggcattggcgccttgagcgtaaggcgcgtcttgaaggcggcatgcccaagaaaaggctggatgcacagctgcgcaaacaacgcgatcgaatcgctgcgctcaagcgtgacctgagtgcactcgaggagcgattcgtgccggtggcgataaaatcggtagagcttaaagtcgcgctggacgacgcccgcgaccggctggcgaaacagatggtagacctgcgcgcagattggtcaaggctcgccaacacagctgcgattccagcattgcacgccagaatgactcaacgccatgagcaacggcgcctttccaccgcacgggccagggtcgagtgggagatcgccgttgagcagtatctgaagcaaggtcatgagtcagtgtccatgctgcaggaaatggaaagcctcggcggtgaactggtggcagccgacaggaccgacccggaatatgtaaaacgtcgcaacaggaacaccagggccctgtttgattattgggtagcggtctatgaggtcatgtcgcaaaaactcttggacacgcttcaaaccgcgcgcggcgaaacggaagatgaagtgcaggcccgtacaaatacgcagttacccaacggcatcaccgacgcctacgaggaattcaggcacatcaggaagcagcaatttgaagtgctcaaacagaagatcgagcctgcccggcacgtcgagaatattctccagcgcgcagcccctgccttgcgccaattgctattgcaggacagccccaccgatcaacacatctcctcaagcacgctcaaccagcatgcactgatcttcctgactgaactggtactggatcgcactcacccaacccgggaactcgccgagtttccttacctcatggtgctcaccgacgccaaaaccgtcaccagtgtgttggcgcatacggaaatgcgcaccaaccgtggctactcgacgcttgagcaaattgacgtactcaaggacgtccttgagcgctatgaacggctggagaacgccgtcaggtcgctggctgaaatgggctccggctttgtgcgcgaggaatatcgagcaaccttcctcgatgagatcagcagcgcccgtaccgaccttgaagccgaactggccgacctgattctttcagaggaagggttcgctcaccgccccagaacaacggctcccatccgtgagaaacccgccacccgccgagtcatcaagacgcgcaaccaacgcacgctggtgggtgatctgcgcgcacctcagccaggcatgccgggcaattttgtcgatatcaccgacccccacaccaagaagattgtcgccagttaccacgagcacgcggctgaaggcgtgtgggctgaggttgtccaagcggcgccggtcgtaccaccgagcgcgccggtaaagcgctcgttgaacacgattaaacgcagtgcagaatccgtcttggccgaaagagcaaaaatcgagcgcacgatacgcgaccaacagcgcaaactcctcgacccctcccgacgtgaaaccctgcgcccggtggaatgggaagacatgttgacccagcatgcgagcaaaatcgaagccttggccaatgagatcaaagaagaccatgccacccacgccgaggctgacgacttgatcaaggcctacggtgacagggcgcaggccgcacgcaaactggccagcgaggtgcgcgcccagggttacatgcaacagctccccaaagctgaaaacatcgactacctgcaccaaaaaggcttcatcgatatcaacctggtcaaaagccgaaaactactggcaaccggtgattttctgaccgaatactcagtgaaggacaaacaaacgctcacggtgttgtggtatgcgcacttccattaccccacggcgctgacgccggcagcgcaacacagctttgcccacttgaaactcccggagcagcaatcattgacgcgccggcaggtgatcgaacaagccgcggcagataaccgcactgccgtcctgatggataaagccttgatcagaccgcctctggatcagaaattgttcctgatactggaacccgagccacaagcgtaacctgccaaccaatggcccccatacccgcacctgcgggtatgggggcttgaaaaactactgcctccaggacggaccgggttgcggcgacgccggtctcggcggtgaggtctcaaccgtgccggtcgatagctccagcacctcctttctcgacagctcaagcagcttctgcgcccgcacgctgcccaactcgatctccaacagggtcaactccacctcgtagcgttcctggctgtcggtgccgggttgcctggcactgtgtacgtcctccaatgcatcctgacgccgtaaagcattttgctccagcgtagtgaaagcgtcggggtagcactcgcgcaggtaactgagccaataatcccgggcaatcaagctttcataaaacccatcggcctcctccgccgcgagcaccagggcacgcgcgctattcaaggcctgcccgctgagcggcgtagcgaacgccatgtaggtaggttgccctggcaggtcgaggccgtctggccaaccgcgagtcatgccgatgcggtactgcaagcgtacttcggccctgtccagcccctgggcattgcgttcggccaaggtgtcgacctggtcgagtcggaacagttgccgggacaggtccaataaccgttggccgcgcagcctcacgttgtggaccggaacgtcacgcaacacacgctcctcgaacaccagcacctccattgcactgaacgtcagggtgcgcccgtcgatacaggtgttgtgggtttgcgaggccgcgaataacgtctcgcgctgttgcgcattgctggcggccgcttcgatcacctcccagacccgccgggtgagatcagtgcgggtgaacctgaactcgtgggtatcccgcagttgcgagagcaaatgaaaaaagggtgcgtggccgggctcctgggtcagttgcagccacagttgccgcctggatgcggcaagggccgacggcgtgttcatcagccaggacgccagcgccgtctcacccgcctcacccgccgggtcaagcatgatttccaggggctcataggccgccccggcgtcattatcatcgtcggagtcaccgtccgaatcagcgccggagtcgcttccagagccgatgtcggagtcgctttcaagcgcggcaatcctgaggttgatgtcctcgcgggtcaggcccatgacgccctgcccctggtgggcatcgctgtagtgcctgagctgctccagcgcgttgagcgacagctggtgattgtcggccaggttcgtaccgctcaccaattgatcgtgactgccccccagcaagcggtccggaaatgtcgtcagggtattgccgctgaggttcagcgtacgcaggtcggtggcctccaatgcgccgtcgggccattgggcaatgtcgttgtagccgaggtcgagggcttccaggcggttgaaggcgctggtgctgaactcgctcaggttgttgtggctgaggtccagacggcgcaagcgttcaccgcccaattgccggtacaggggctcgggatcactgaaagcgttggcggccaattccagttgctccagctggcccatgtgttgcaccgcctcgggcaacgccgtcagctcgttgccgctcagaaccagcttgcgcaacgccgggaagctgttgagaaagccatcggcgcccttccccgaaaagcgcacaccggtcaagtccaggctgcgcacatgctgaaactgcaggtccacttcaggcagatggtcgatttgcaggccatgcaagctcagctcggcctctgcatcaccagacaccccacgccgccagcattctctgattctgtccactgccagttgccgttccacggccaggacactcacgtctgcggcctgcagttcgcgggtatacagccagccattgagttggcgcgtcagggactcgcactcccggagccatgcgctcagttgcgtgtctatctgtgggtcgctcgacccgctgtcacgcaggtgttccagccgttgcagcgcctgatcctcggtcagcgccgggttcaactgttgcaagcgcctggcaaagcccgcaacaccatccgcggcttctattggtccaggcaatggcaataaataacgcgccatcgaaaagccggtctcttcgggtggaaaagcgcctggcacagcttgctgttcgaaccggctcagtgcgccttcgggcaaaccttgagcggtttcgatccgctggcgtgccgccttgagcgcaacctcaccgtccggactgaagcggttgcctgccaggttgaccttcatcatcaacgcgtcgttcgccaacacggatgacggcaaagtgggcagttgattatcgcgcaaatcgagccacgccaactgcggcaaaccttcggccccggctggccaggcctgcaattggctcgctcgcgcattcagcgccttgagatgcgtcaactcactgacatccaacgccgccagtgggttatggctcagattcaattgctccaggctgctcagaccattgagttgcgcctggaccgctggcgtgaccaccaggctgttgttggacaggtcgaggcggctcaaggcaggcaggtcgcccgggccgatgggtaattcggtcaaaccatggccgcgcagttcaagggtttgcgtgccgctgaacgcgcgaataaaaccacgggtctgctcaatcgactcacccagccagcccaggcgcaactcgcgcacatgggaaaaagtggccgccggcagttgcggcagttcaacggtgctcaccggcaaggagccggcgtccactcgaaactccggcgccggcaactcaagcaccgatacgttggccgtcaacccataacgctgggccaccgccccgcgccagctggtttcgagggcattgataacgtgtgcgttggcacccgtttgccagggtatcgaacgtaacctgaggcgcgacgccggcgtggccgggtgatagaaccgcgcaaaaagcccgttgtactctgcccccagggcttcgatagcagcaaagcgggtgactggggtattccaggtggtcatgattttttcgtgcaaggcgcccgtcagcggcgacgggcccagcaacgactgcaactcacccctggcgtactcgcggaccatctggtgcaggtcagccaggtgaacccgttcgccgcgatagtctttcacgtacttaaacgcgggtgtgaaggcctcgcgggtgaagtttgaccagtccagcgacaggcccgcccagaggtcttcatgcccggcatacaggctctcaggcaatgcgcggatgctggtgttggccaggtccagacgctccagctgggccaggttttcagcataagcaggccactgcgacagcgcgtgaggtgcatcgaacttcagctgtttcaactgcacaagcgcggacagatccaggttgttgagtgccgccggagaaaacccgctgcactcgatatgcagcgcctgcagcgaagtgagcgcattgagtttcgaggagaaatccgacgccagcgaggacgcatctgccttgaacgtcaggtgcttgagctgggccatttcgctcaccgcgtggggcaccgttgtcagcggcgatatgccgaaggtagccggggcccacacgcgaccgctctcgccaatagacagactgttcacattgggaaaccgcgccagaaaggcatccgcgttggcgtcgctcaaaccgcgcccgcccaccgacagctcgcggatatgcgcaaagtcagccgtcagcggcggcaacggctcattgatcacaatcgacagccgttcggcacccggtacgtccctcgccagcggtgcgcgccgccactgcgccttgagcaactgggcgacttgggttctatgcaggtacgcagaattgtccggcgccgcgctgaacgggtccagcgccaccggaggccgtcccacccactggtcaagggttgacgccaactcttcatattcgcgcctgcggttttccaggaggttgaagattgccttgtcgctcctgccctcttgttgcatccggcgaatataagcactggcctgggcgtcgctcagttccgggtagatcaccctcgcccgcgccgcaagatttgccctcacgtcgaccttacgtccgctggcgtagtaccccacccgtgtgtcgttgacccgcacgggcggcttgggacgctggctttgcggtgccagcagtgacgctgtttcactgcgataacggtcggcaaactcaatgattttttcctgcaactcggcgctctggccgacctgaggcacgcccagcccgcgccgtgcttcatcgggcaacgcgtgcatcagcgaggcataaaaattgtcgccctgtttgggcaggctgttgagtgcctcaccgcgcgcattgaaagcctgaaagcgtgagttttttctcaccaggtacttcttgtcgcgtgccgactcactgccaatgctgtacagcagcgtgccgctgtcactgtctgcgcgcacctccaggcgtagcgtgtccggccagcctggcagtttttccaggcaatgcaacgccaggcgtcggctgtccgccgaggccatgttttcgctgcgcaaaccggcataggcgcgggtttggcgaccctggcgcgcataccagcgggcctcttccagcaaggtcaagggcgccgggtgtgcggcctccagttggttgaggtcatcaggccgcgcgtgcgccaaggcttcctcggcgccggcttcgctaagcccgggacattggcgctgcaaccgccggacctggctcgtcaccggctccgtgccggcgtaaaggctgtcgaaaatcgccggcttgcgggtctgggcgtaatcagtgagctgcttgccaaactcttgcgggcgcagctccgccacccgtgcgccctgcgcgcccagcaggctgacaacttcctgctcatcaagcaccgccagaatgtgcgccggcagttggccgccgaggatatcgccgcggctgatcctgatcggcgccctggcagtcgcgtcgcgtggcagacgctcggagccgtacttgaccgacgcgcccgataaacccggtgcctcaaacacctcaagcacccgcgttttcggccaaccgggcatttccgccaccaacggcagcgcgtacagatagcggtcatcaatcggctgggtgccgcgcaattgttcgatcacctggccggtgtcggcgtcggccttgaacaggcgcatcgcatccgtcagctcgggcggcggcggcgcgaggtccatgtgcattttgcgcagggcgttgtcgctgacaccgctgacatccgccaccttgatcagctcggtatcggaaaacgcctcggtggtatggcccatgcgccgcaacagggtcaggcggtcccattccagtggccgttccagggtgtggcgccaggcgccacggccgttgctttgaagaatcggctggtaggcagcggcgtcgctcgggtgcttgatgcgccactgctgcttcggctcctcgaagaactgctcgtaaaccttattgcccaggcggatataggtcttgccttgcagctgatgctgccccagcgcgttcggccctgggccggcatccagcgcgaccgggctttcatagccactcaagtcgggcttccacaggcgggtttcgccgttgggcaaggtcacggggctaaggtgttcaatcaccggttccggcttgacggccctgaatctactcaccgctgcgcccacgccggccatgacagccaattgcgcgaggttctcggccacgtcgaccaggtgcgccttggccgcgcgcttgtcgccctcggcccactcgatcgagccttcgagggtttcgtacagcaactgcccggccatcaccgtcaacatgatttcgcccaggaccggaacgaacatggagaccatgttcagccccagcaagccgatttccagcagatgggcgagttttgcttcccgcgccttgatatcgacttcggcggtgggcacagcgtggctgcgggcatcggcatacaccttgtcgcggttttgctcaaacaggtagtcccacaggtccacattgtccgcccacggcccgcgccccttgcgggtgacatacgagggcgcgatatacggatcgggtgccggttccatttttgccggacgcgccgggggcagctccttgatatgggtggcgggcgacagctcactgaccgtctcgatgatcgtgcgccacggcgacgtcaaagggccgcccggagaatcggcagccgcctgggtgaattggctgaagtaatacccgcgctgcgcatacggcacgaactggctgaaaaaacgctggtaggccgtggggctggcatcgttggcctgcatgccgtctctggcggtgaacaggcgcttgaattcctcgcgcatctgcgcggcggtatagcgcttgagcggatgctccgggtcctggggaatgtagagaatcacttcgtcgttgtagcggtacttcttgccgatcacgaaggccacgcagccggtcatgcgttttttcatcaggcccatgtcgttgaaccagacttgcttgtcacccatccacgggtgcacttcaccattgatcaccgagacgatcatcttgtggtccgcaggcaggatgtcccgggtcagcaatgcctggtcggcggcagcgcgcatcgcggctttctggctggcgataaaccgttggcgcagggtcgcctgggccgcggcatcggcaggctcgaagaacgtcttcaggtaggcctggtatttggcgcccacatccaggtcacggcacagcgtcaggaactggctgaccgtgaggttcagcggggtggcttcaaaggtgtcggggctggccgcctgcaccacaaagccggaactctcatggtaggcagcgcttttgcactcccaggcttcgaagttatgcaatgcagcttgcagcatcgacaacttgaggaattcgaacgacgacacttccagctccagcactgtcaccgccagcgggcggcgcaggcacagcagggttttgtcgacgtcaacgtccacctggtactggtctttcagggctttgagcagtaagggccgggcgaaagtgtcgacgtcctggaacgtggccatgcttttgtcgagctgggtttgggccagggtgctggccttgatgctggcggtgacggtcttgcgctgttcgggcgaggcgtttttgtaccaatccggcaacaccgccgtgctgtgtttaagcgccaggcggcgggccggtgtcgcgtcgaccaaccattgcggcacagccttttcgaggaagtcgccgtgaatgcttaaggttgccgccggtggtttagcgacgatggaatcaggggataaatcggacatgctgtcactcctgtgaaatgaagtgacagcacatcaccgttcagcccaaggccggtggtgtatagatacggggcgtctatgctgtgttggagagttttcgtgacgagggttttatggacgatccactcgacaacaagccgccgaccttctggcaaatgctgcacagcgtgatggcggcagcctttggcgtgcagagcgggaaaaatcgtgcgcgcgactttacccacggcaagccaggtcattttgtcgtgctgggcatcctgttcacggccgtgtttgcgctgacgctgttcggcatcgtccagctggtgctgcacctggccggggtttaacgcagcagcagttgcaggctgaacgggtaacggtaggacgccggcttgccgacggccgagagcgcacgaaaatctaccggtggcatcggccccagcaagcgcttggcctggtcgctatcgatcaactggaacagcgcttgctggcggtcgcgaccgccgtaggcgctgatgtcgacgcccttggcatcatcgttgaccaacaccatggcccacccgcccagggtgaaatgcccggcaaccaaggtcgtcagccgcccgtccaggcgtgcctgcaatatgcccggcgaactgttgaccgcactgaacaacacgtccttgccgggcactcgcccgctgtcttgcaaggcctgcatggcgcccagtgccatctcatcattggccgaccagaccagcgctgtttgcggatggcgcctgaacaactgcgtggcttgctcgaaggcgcgctggcggctccattccccgtagaccaactggcgcaggcgcacctcgggatgttcggccagcgcgcggcgcaggccttgctcgcgtcgttgtgcaacgggcgtgttcttggcgccggaaaacgccagcatgtcgagggttgcgcccggcgcgacggggccatgctggcgcaacaggtcgctgagcatcaggtaaccggcctgctcgtcgtcggccaccaggctgccgatccactgcgcgtctgtacgcgcatcaagcaattgcacctgatcggcggtcagtgcgttatggacgatcagcaacttcaccccactgccttgagccatgcgcagaatttgcggggcgacgtactgctcgtttaccagcaccaggtaatcgggccgttcggcaccctgcaacgcttcgcgggcctgggccagggtgttatcggcattgcgctcggaataacgcacgcgcaaatccaggccgaggtccttggcggcggcctgcatgaattgcgcgtagctgacccagaaggtttcggtggacgtgccggggttaagaaataccactgacgccgcatgggctatcgccccgtacgccgcccccaataaccacacacacgcaatcagaaccttcaacatggttgtttgtgcctcgaatgttgatcgccatcatagtggcaatgcgacagtcaatcgaggcgcaagcacccttctttactggtggctaacccagaatacggcggttccgaccaccaggatgatcaggaacagaatcgcccaggcatccacggtactgtcgggtttacgggctttggttgaattgctcatcgcatcgcctcttatcggttttataggtgattgcactcaaacacgctcacagtaaagtcgacgattgcccgcatgacaaatgtgggtatcgcgataaccgttctcattagtcaatttggttatttacatatactcaaacatcacttttgcgcataaacgcaaactggtatcgtgcgccggctccgttgggagtgcgcggccgtgcgcgcagatttgccgagaacaggacctatatgtacgtatacgacgaatacgatcagcgcatcatcgaggaccgcgtcaagcagttccgtgatcagacccgacgctacctagcaggtgaactgagcgaagaagagttccgccctctgcgcctgcaaaatggcctttatgttcagcgctttgcgccgatgctgcgggtggctgtgccttatggccaactgacctcacgccagacgcgcatgatggccaagatcgcccgcgacttcgacaagggctacgcccacatcagtacccgccagaacgtacagttcaactggccggcgctggaagacgtgccggacatcctggctgagctggccaccgtgcagatgcacgccattcagaccagcggtaactgcctgcgcaacgtgaccaccgaccaatttgccggcgtcgctgccgatgagctgatcgacccacggccgtggtgtgaaatcgtccgccagtggaccaccttccaccctgaattcgcgtacctgccacgtaagttcaagatcgccatcaatggctcgacctcggaccgtgcagccatcgaagtgcacgacatcggccttgagccggtgcacaacgcagccggcgagctgggtttccgtgtactggtcggtggtggcctcggccgtacgccggtggtgggcgcgttcatcaacgagttcctgccgtggcaggacctgttgagctacctcgacgcgattctgcgggtctacaaccgctacggccgtcgtgacaacaagtacaaggcccggatcaagatcctggtcaaagcgctgacccctgaggtattcgcccagaaagtcgacgctgaaatggaacacctgcgcggcggccagaccactctgaccgaagccgaagtacagcgtgtggccaagcacttcgtcgaccctgagtacaaggccctgagcaatcaggacgccgagctcgcagccctcgaccagcaacacccagggttcgcccgctggcgcacccgcaacaccctggcgcacaaaaagccgggctatgtcgccgtgaccctgtcgctcaaacctaccggcgtggcgccgggcgatatcaccgacaagcagctggacgccgttgccgacctggccgagcgctacagcttcggccaactgcgcacctcccacgagcagaacatcattcttgccgacgttgagcagagccaactgttcaccctgtggggcgagctgcgcgaaggcggtttcgccacgccgaacatcggcttgctgaccgatatcatctgctgcccaggtggcgacttctgctccctggccaacgccaaatcgatcccgattgccgaatcgatccagcgccgtttcgacgacctggactacctgttcgacatcggtgagctggacttgaacatctccggttgcatgaacgcctgtggtcaccaccacgtcggccacatcggcatcctgggcgtggacaagaaaggcgaagaattctaccaagtgtccctgggtggcagcgccagccgcgatgcgagcctgggcaagatcctcggcccgtccttcgcccaggaagccatgcccgaggtgatcggcaagctgatcgatgtgtacatcgagcagcgcaccgaagatgagcgtttcatcgacacctaccagcgcatcggcatcgacctgttcaaggagcgcgtctatgcagcgaatcattaagaacaacgaagtcctcgacgaaacctggcacctgctgcccaaggacgcgagcttcgacggtatttccaactgcgacgacctgatcgtgccgctggccctgtggcgcgaacacggccacgccctcaaggcccgcgacggcggcctgggtgtgtggctggacgccgatgaagaagccgaagaaatcggtgatgacgtgcagcacttccaggtcatcgccctgaacttcccggccttcaccgacggtcgcaactactccaacgcgcgcctgctgcgtgaccgttacggttacaaaggcgagctgcgggcgattggtgacgtgctgcgtgaccagctgttctacctgcgccgctgtgggttcgatgccttcgccttgcgccccgacaaagacccgtacgaagccctggaaagcctcaaggacttctcggtgacgtaccaggccgccacggatgagccgttgccgctgttccgtcgtcgctaacgtgatcgctcccacgctctgcgtgggagcgcctcccgtgacgctccgcgtcactcttcagcgggacgcagagcgtgcgaagcggcattcccacgcagagcgtgggaacgatcatcggtgatcgacgccagcacctgcttttgccccatggaacacggcacatctgccgggtgcgcccgcaccgcctcgatcacgcccaataactgggctttgctgtgggccagctgcgcctgcatcgcttcgatttgcgccaccttacgctccagtgcctcaatcaattcgtcgcgcttgctctcgcccggcgccggcatcagcgctttaagctcctgcaaggtgaacccggcctgctgcgcgctttgaatcaactgcagggtttgcagcgcttcggctgaatagcgccgatagccattggcctggcgccccacctggctgatcagcccttcggcctcataaaagcgaatacgcgacgccgccaacccgctcctctttgccagctcaccaatattcatcgccacaccctgcttgacattaaagttaactttaagcttagcctgaggcctcccccgctcaggagtcaacgcatgtcacctttcgaagccttgcaactgcccaacggccaagtcctctccaaccgcatcgccaaggcggcgatggaagagaacatggccgacgccaaacaggccccgtcgcgcgaactaaaacagctctacaaggcgtgggcagacggcgagcccggcttgctgttgaccggcaacgtgatgatcgaccgccgcgccatgaccggcccgggcggtgtcgccctggaagatgaacaacacctggacagcttccgcgaatgggccgaggtagcccgcgccaagggcgtgcacttctgggtgcagctcagccatccggggcgccagaccatggccaacctgggccagcaagccatggcgccgtctgccgtagcgctcgacctgggcggtttttcgaagatgttcgccaagcccagggcaatgaccgaagccgagattcaagacgtgatcaaacgcttcgccaccagcgcgcgcctggccgagaaagccgggttcaccggggtgcagatccacggcgcgcatggctacttgatcagccaatttctctcgccgctcagcaaccagcgcaccgaccgctggggcggctcgctggagaaccgcgcgcgtttgctgctggaggtgatcaacgcggttcgcgccgccgtcagcccgaccttttgcgtggcggtaaaactcaactccgccgacttccagcgcggcggttttgccgaggcggatgcacgcgcagtggtcgagatgctcaacccgctgcccatcgacctgctggaattgtccggcggcagctacgaagcgccggctatgcagggcgacgcgcgggacgggcgcacgttggcccgtgaagcgtacttcctggaatttgccaaggacgtagcgaccatcgccaccatgccgctgatggtcaccggtggcattcgccgcttgccgatcgtgcagcaagtgctggacagcggcatcgccatggccggcatcgccacggcgctgacgctggagccgcaattgatccaacactggcgcgagggccatgaccccaacccgcaactcaagcccattgactggaagcgcaaacccctggcctccctcgccacgcttgccgtggtgcggtatcagatgcgtcggctcagtcgcggccatctgcccaaggccagcgtcgcgccgtgcatggcgttggtgcgcgatcagtggtttatcgcccggcgcacccgccaataccgcgcggccatgacgcaatcttcacactaaagggtgaacatccgccgtgatcgaactgtcccctattgatcagcagtttttaacctcactgacgattggagtttttcatggcgaaaatcaacctggcccagcaattggcgaccacccttgaacaggcgggcatcaaacgcatctggggcctgaccggcgatagcctcaacggcctgaccgacgccctgcgcaccatggacagcatcgagtggatgcacgtgcgccacgaagaggtggccgcgttcgccgccggtgccgaagcggcggccaccggcgagctgacggtgtgcgccggcagctgcgggcccggcaacctgcacttgatcaatggcctgttcgactgccatcgcaaccacgtgccggtgctggccatcgcggcgcaaatcccctcctccgagatcggcctgaactactttcaggaaacccaccctcaggaactgttcaaggagtgcagccactttatcgagctggtgagcaaccccgagcaaatgccccacgtgctgcaccgcgccatgcgctcggcgattctcaatcgcggcgtggcggtggtggtgattccaggtgatgtgtcgctgctggaagtcgaagacaaactcaagccgtggccggccctgcacgcaccgcgcaccttgccggcggaacaggacctgcaacgcttgaccgaaatcctgcagagcagcgaaaaagtcaccctgctgtgcggcagcggctgcgccggtgcccacgatcaagtggtagccctggccgatgccttgggcgcgccggtggtgcacgccttgcgcggtaaagaacatgtggaatgggacaacccgttcgacgtgggcatgacgggcctgatcggcttcagttcgggttaccacgccatgctcaactgcgacacgctgatcatgctcgggactgatttcccctaccgccagttttaccccaccgatgcaaaaatcattcaggtcgaccgtaacccgcaagcgttaggacgccgggccacattggacctgggcatcgcggcggatgtcagcgaaaccattgacgcgctgctgccacgcctgacccgcaagactgatcgccgcttcctcgagacctcgttgaagcactacgagaaagctcgccaaggcctcgatgacctggcagaaccttccaaggccgaccggccaatccacccacaatacgttgcgcgcttgctcagcgagctggcggatgacgacgcgatcttcaccgccgacgtcggctcaccgactgtgtgggcggcgcgctacttgaagatgaacggcaagcgccgcctgatcggctcgttcaaccatggttcgatggccaatgccatgccacaggccatcggcgcccaggccgcgtttcctgggcgacaggtgatttcgatgtccggcgacggtggtttcgcgatgttgatgggcgatttcatctcgttggcgcagctgaaactgccggtaaaagtcatcgtgttcgataactcatcgctgggtttcgtcgccatggaaatgaaagccgccggttacctggacaccggcaccgagctgaaaaacccggacttcgcggccatgtccaacgccatgggcatcctcggcattcgcgtggagcaatccgaagacctggaaccggcattgcgccgcgccctggcccacgacggcccggtgctggtggatgtggtcacggcgacacaggaactggtcatgccgccaagcatcaagctggaacaggccaagggtttcagcctgtacatgctcaaggcggtgatgagcgggcgtggtgacgaagtgatcgaactggcgcgtaccaactggttgcgctgagtttcagtggcgtcgggcagcgcgggtagaccagcagtctaggtcaaatgtgggagctggcttgcccgcgcgggcatcaatggtgtgacactgcaccaccgaggcgcctgcatcgcaggcacgccagctcccacacccgccttagcccgactgcttctcgacccacttgccataggcatcgataaacgcctgcaagaacggcctgctcttctcagacaccttgccggcctcatcgaacacactgcccgcaccacccaggtatgcttctggctgctgcatgcaccgcacatcgagaaacaccagcgactgacgcagatggtggttggcgccaaacccaccaatcgcccccggcgacacactgataatcgcccccggcttgccgctgtaggcgctttgcccataagggcgcgaccccacatcgatggcattcttcaacggcgcaggcacggaacggttgtattcgggggttacgaacaacaccgcgtcggatgagctcacctgtttacggaaagtactgtaggctgcgggcggtgatgctccgtcgatgtcctcgttgtagagcggcaaatcgccaatttcaacaatgttcaactggagattggcgggtgccagttcggccaaggccagggcgaccttgcggttgatcgactcttttctaaggctgccaaccagtacggcaatcgtgtagaccttgctcattgaggttttcccgacgtctgactaaaggagctagtagttatagagtcttcgcggcgggttcaccagcgggttttgcaccgcccaacaccgcttgctacgccccacccgcgtaggaagcgtctgaaaacatcaaagaatagtattttttttccataggtaaactaccccgctccatgacggtctacagaaccgcaaatcgagtgtttatctccagaggttctaaacagatggctgcagtacttgtcggacagtttcatgccagagacgcggaaggacgcgtgtattcggtgcatgagttccaggaatccaacccggcgcaaggcgacctggctggctcggcgccctccactacctacaagctggccattggcgatcgagtagagaaactggatggcgaagagttcagactgatccagtcggggaccattatcacccgcgaatcgcagacggtcctcgcgtcgtaatagctcgcctcatctaccagctcagtcctggccattgacggcattgactgggccgggcgatcacggccgctgcatctgcgtcacctcgacgccctgctcgccgtccacttgcttgagcgtcaccagcaaccgcccccgctccccttccacggcatacagcgaacgcttgtagcccggcgtgccgtacgcaggatacgccaccacctgcctgaccagcgcaacctccagcaccgcgccaacttgctcgcccacctgttcctgagaacggataaacgcctcgagcgcgaagttttccgctgtgtgttcatcatgattattgaagagataagcagccacgcagccggcggtcgccaagaccagcagttgtttggccgttaccccgaggaatgtcgagggtagaggcatgtgagaccagacctgtttttgttttatgtaccggctagccggcagtggtcgttgatgatcagagcagccattctaatcaggtcgcggggtattaccagatgaatcagttgtcgccgtaggtaatatccttgttatcccctgcaccacccagtgtgcggtccttgccgaatgagaacaggtcaaaaggtgtttgggcttgagtgggcgggtagtgatactgataggcaaccccccaagggtccgtcaacaagtcttcattgacgtaaggccctttccatttcgcctcaccggcgggttgcgtgatcaatacctccaggccttcttcatcgagagggtagcgaccggtgtcctgatgaaaccgctcgatcgccttgcccaattcgccgacctgggcctttgcctgggcaatttccgcctgtgtcacgttgccgaacagccgtggccctaccgccagggccagcaggctgataatgaccaacaccaccagcaccgcccaacgcgtaaagccgcgctgggtgtgcacgctaccaatgactgcggttttgccggacatcgcaaggctccctgatggtttgtcggttattacacgctttgtgtgacctgcaggttgcagtcgcgagcaggcttaacggtagccgacccgcgctgttttttccccagccattgaaaccccaccgcactgaacatagactccggcgatgcgtttacgtcatatcgaagtgattcaggccatcttgcagacgggacacctcggcacggccgccgaatggttgcaactccccgtgggcgatgtagacgccacgctcaaggatgcggagcagcaattgggcttcatgctgtttgccagtgtgcgcggacgtttgcaagcgacacgtgagacgcttgagctgcaggccgcaatcggccacctctatgaggcgctggagccggtgcaacgcctggccagccgcctcaagcaccatcacgcgccaaccctgcgcgccctgtgcacgccaccgctggccaatcaattgctgccgcaaagcatcgccgcgctgcgccggcgcttccaggacacgccgtgcaacctgtcgagccagccgaccaaggagatcgtcaggagcctgctgctgcacgaggccgatgtgggcctgagcctgcatgacccggaacatccgcaaatccaaagcagcgtattggctcagggcaaactgcaattgctcgcgccccatggctggctcaagcccaagcagaaatacattgccctgcaagacctcgccgggcagtcgatgatcgggctcgaagggcacgaccccctgagccgcctgctggacgccaagctgcaagcgctgcgcccgctgccggtggtgcagacacgggtgcagacctaccagatgatgcgcagcatggtcgaagccggcgaaggcttggcgattgtcgacccgctcaccgcttccggcgcgcgggaagccgggctggatacctgcccgttatcgccgcccatcccggtcatcctttacgcgttgattttgaaggacgctgaacccacaccggcactgaatgcgctgctggagataatcacactcaaagccgaggccctgctgggcggcgcctcgaacaccccaccagggccttagccgcgcccccggcgcccgttagcgcaacatgccctgacaatcaccttggaaccccctccaaagtttttcacacccattcgctggaaagtgccaacggcgctttctatcggacgaatctgaaactaaggagcggttccctatgaatgccatccaccctgcggctgcaaagctgcctctcaccggtctggccacacaaaacccaacacccaccacacacgggacgaacgccctgcaggcctcctcgccgagggttgcggccaacgacacaagccctgacgcactcgacaacccggcagccctgaaaaaagcctacgcggaacactgcaactggacggaactggcggcaaaactgcgaccgatgcttgaggaactgaccaaggcctttcccggtgagttgtccagcgaacagcaaagccggcttgagacacaactggcaaaccagctgaacagcctttcactgccggtctgtgaactctccagctactaccagaaacacaacctgacgccgacgaccgtcgtcacgctacacacctatctcagcggcagtggcttgaacataccgaagaacctggacgcgttgctcgcgctgtaccagcgcgccatccagcaggtgcacacccatcccctgggcaacttcagcggtgcactgtcctggccaatcccgctggcaacgcagcaccaacaacgcctcatcgacctgctcagcgcacccggttcgaccgtgcccgggctgccattggccgacaaacaaaaaggcgtgctggactatctgttgtcagccgccaacctgtcgagcgatgacttcaaataccctggctcggcgatggaaacgctgctgggctcggccaaggcccaggcattggggcaagcgatccagaccgagttgggcggcatcgccacggatgccagcagcaatgactacttgttggcggccatccacctgggcctggacccggaagccctgaacagcccggcgcgtaatagcgtcgccggctttgacctcgggcagcgccagtattggaacaagcctgccacagcggtgatcgacggcctgagccgccatctggtggcgcaagggcgagccaccgcccaatcggccgacttcgccgctcgcctgttactggcacgtgtcgcgcctgaataccgagtcagggacatcccgcccaatgtgacctacggcagtatcccctggacccagttggcaatcgcggtggccaagctggaggcccagtcgccagggcgctcactcaccatgagctacagcgaggtgctcgccgccgccgagggcctcgacgtcgacgccgcgctctcccagcgtatccagcacgaagccttgcgtaattggggcgtcgtgcatggcctgctgagtgccggcgacaccgcgccctcacagactgaaatgcaggccgtacaaaccgcattcaatgcccagcaaagtgccttgcaagccacctcttcagcgctggcaacggctatccccagccgggaagcgatgggcctggcgctgctcagaaaagagtttccgggggttgcggacagtgtcttcaaggcacgcaacatcctcaaaacccatttgaatccgggacggcccggccgcttgtccggggcgctgtcaatgctggatatcgtcacgcagggcgacaaggtcaaacatgaggacaaggaacattgggtcaccgatgacaagcggatacccatcacggcgttttgcgaaaaatccgcaagcggcgcactcaccgtcgccgacgaatttgccacacgctacgcctcggctatcgaggcacagaaaaagggtcatacaggcctgacccactacctgatttcgaacttgccgcccgaggacaagctgaacttcgagtatggccagctcgagtttttccataccaatgaatacaaaatagccaccgacttctggaccaagacgctgagcaaacgaggccatacgctggaggtaaaaaccacgcgagacgggcaggtcaacgtgtattgcattaataccagcgacggcacgattaccaaaaaaaacttcctggcagacacgtactctgcgccttacgacaaactcgaaagaagagatggcaacaagctgtatcgaacggtccggttcaacccattcgaggacgagcacgccaaactgggcacggaaaaaccgacaacttcgcaaaatcctcaagtgtttgactctgcccgcacagactacatcgccagggtattcacgcattccctcgacttgaacaatgacgacctgctcgactatgccaaaggcatgaacgcctacgacaaaagcgcggcggccgacgatgccatcggcaattttttcctcaacctgattcccttcaggtcagcgattgtcaatttcagccaaggcaaaatcgccgatggcttgtttgaccttggtcttgacgtggtcggcctggtgacgttgggcgtgggcaaggctgcccaggcaggcaaggtatttgccaagggcgtggccagtctcaacgccgcctcgaaagccgcaaggttcctcggcggtgccgtgatcgaagcactcaacccgctgggtggcgccggcgatctgctcggaggcgccagccgcttcatctggtccaagggccgctcagcggtcaatacgctaaagggcgccagcggcagctacgacgtgctcaaggaggcgggcaaacagcacggcttggttgccgtcggcacctacaaagcgctggatcgcgtcgaggaaaccggcgccgcatttcgcaacggcaactggtacgactatgacgtggccaaggggtcgtcctatgggccgctgctaacagaattcaaaccacgcgtagtggcgaacgccgatggactcaaagtgctcaacccgcccgcgctgcgggactatgcggtcgatctctcgcctgacctgcagcaggtgaaaggcttgcaggccaatgtttacgtgggcccgggcaacaaaaactatataaaaatcgacggcaagctctatcagtccacactcaaggatggccagcgtgtcatccaacaccccaacgccaaccaacccgaccttgccgtcagagacctgggcagccatggttgggagctttcagccaccgcccaccgtttaatcgggggcggcgctccgcctgcctggaagctcgacgacagtacctacgtggtgccggtagatgacgtacaactcaggccgggctcttcttacccctactgcatcaactacagaggcgaaaaccatatcgccaaattcgatacgcaagtaggtgagtggagctacgaagcccgcaacaaattgtatttctggagaagtgcgaagaacacatggcagatggggacgctggatgagttgcgaaaagcaaaaaaaattgatgcgcacgaattccgcttcgttgaagtcaccgccccggccatattgaccaaaccccagaatgtccggccactgccaaaagacattcactatttctgggcaggcggcgaaataccggacaagctggtgagcaatatcagcaaaaacgccgagaaaatgccggggttcaggtccattgtgcacgtcgacgcggacaccccggagctgttccgaaccatgaagctcaagctggaaaaagacgcccccggcgtgacggtcatgaacctgcacgaagacaactttttccagtctttgaacaccaccgagatgtattcatatttccgcaacggccagggccagaacctcgccgccgcctctgacgtggcgcgctacccgttgatgaataaatacggcggcatctacctcgacaccgatgacgtgatcacgggatctgtcggcgcggcaggcctgaacgccggcgactcggacatcctgatcggccatccggtccgccataaagtcaccggcaacaaaccttttttcaatacaagcaacttcgcaacccaggcggacaacccggtcgtcactcaaatgatcgccgaacaaaatcggcgtttcgccgaaaaaagaccctactttgaggctaatcgaccaaccatcgctcgagacgaaaacggcgcgctcaaatacgacgatgactttttgacctatgaaggcgagatttttgaagcggtaggcccgaccatgtttaacgacgtattaaaagccaggcgacctgagatttacgaggcaggcttcgaagggctcagcatagaaggcagttttggcggtgagcgctacaacgtggaaaaaaacgctcgcaagtattattcggacaagggcgtaacggagcccgccgggctcccggaaacggtacgggagaacaaaacgcactaccgccagttcaatgaacagctaagagtccacgtcggcgcggaacactcctgggccgttacataaactcactggcagccttccggcgcggctttaaacgttacccataagccgcgttcaggccgcactcagctcggttttgaacaaccgataccagaagatcgccacttcgcgggtttgcgggtcaataccgcgataccgcaagtggtcgatcccgcccatcacataaccgcagcgctcatatagccggcaggcaccgaggttgttgttctgggtttcgagcatcatgcccggcaggtttttcttgcggctccagaactgcgccacatccagcaatgccttggccacaccatggcgccgcgcaggcaaggccaccgccagttcatcaacgtgggcaaaaccgttccaattggtgctgaccacaatatgccccaccgcacggtcatccaggtacgccatgaagattgcgctgtcggctgcatcgcgaaaactcgcgaactcttccgggtcgatgccataacacttgcggtacggcacgatgcgctcgacggcccactgatcgacgcgcttacccatctccggcacgccataggcactgacctcaaagctgaaatcattgccccacacgtaggcatcaaaaccttcgtcggcgacccgcacactgagccccgggtacttcgggttcattacagcttgcataaacatcctttagcctttgatgcaatcgacggtgtaacaacgaccattgccgtcatcttcgtgttgcaacccatgaacatcggcgacaaaaccgggaaaactgctatcgaacgtccgggcaaaagccaggtaatcgatgatcgaacgcgttgactcggtaaagcgctcgcccggcatgatcaacggaatgccgggcggatacggcaccagcatcacggcggcgacgcgccctggcaaagcatcgatggagacggcctcaacttcgcccctcaccaactggtcataggcgtcggccggcttcatcgcgatttccggcaacaccgtgtacatccgtttgaggtgtttggcggtggcgttgctacggtaacagctatgcaactgatcgcacaggtcgcgcaaacccaggccttgatagcgcgtcgggccttgcttgaacactgagggcaagcaactggccaggctcacattggcgtcgtagttgcgtttgaactccagcaattcggtgagcaaggtactccatttgcccttggtaatgcccatggaaaacaacaccaggaaggaatacagcccggtcttttccaccaccagcccacgctcccagaggaatttactgaccactgcggcgggaatcccgcaatcgctcaacgcccctccagcgttaaggccgggcattaccagcgtgactttgatcgggtcgagtagcacgtagtcttcggccacatcgccaaagccgtgccagtcatcttgcgggtgcagcaaccagtccgccgtggccactcggtcgatgccggccaccgtaggcggttgccagatagtgaaccaccaatcctcagcggcgatgtgctggcgcaaattggccagcgcccggcgaaagctcaaggcctcgtcaaacatctcctgcaacaacgagcgcccggccgggccttccatcatcgccgaggccacgtccagtgaggcgatgatgctgtattgcggcgaggtggagatatgcatcatgaacgcttcgttgaaacggtcacggtccagttgccgcgcaccgccgtcctgcacatgaatcatcgaggcctggctgaaggccgccagcagtttgtgggtcgagtgcgtggtgaacaccagcgggctgtcgggagtacgcgaggtgcccatgccataacgcccggcgaagaattcgtgaaaggccgcgtaggcataccaggcttcgtcgaagtgcaacacctcgacactgttacccagttgctgcttgatcagttcggcgttgtagcacaggccgtcgtaggtggagttggtgaccaccgccatcttcactttgggtggccggccacgggtcaaggggctcgcttcgatcttggcgtggatcgattcggggctgaattcgctcaggggaatcgggccgattatccccagttcgttgcgctccgggcacaggtacaacgggatcgcgccggtcatgatgatcgagtgcaacaccgacttgtggcagttgcggtccaccagcaccaggtcgtcacgaccgaccatggaatgccagacgattttattcgcggtcgaggtgccattgatcacaaagaacgtatgatcggcgccaaagttgcgcgcggcgcgggcctcggcttccgccaagggcccggtgtgatcaagcagcgagccgagttccggcactgaaacggacaaatccgaacgcagcgtgttttcaccgaagaactgatgaaacgcctgccctaccggactttttcgataagccacgccaccaccatggccgggcgtgtgccaggagtaattggagtcggcggtgtgttgcaccaaggccttgaagaatggcggcaacaagccatccaggtaactgcgtgccgcgcgcgcgacttggcgcgccaggaacggcacggtgtcttcgaacaggtacagaatgccgcgcagttggttgagctcgctcatggcatcggccggtgcattttccagggtgacttgctcacccagggcaaagatcggcaggttcggtgccctcacccgcgccagtcgaatcagctcgaccatgttttgcagcaagtgggtgttttcgccggcgccttcggcggcgatcagcatgcacgccaggccgtgatgggtagaagccaccagccggccttcggcatagtccaccgcggaaaaaatactgaagccctcttgttccagctcttgggcgatgcctcgaacccggtcaccggcaacggtgtcggccttgatgtcgcgatgtacgatcagaacagggaacttcaggtctttgtacatgagcgctcgaactctggagggctatgcactcagggtagaagctgggagcggatgtggcgaatgaagattttgccggcaatggagatcaactgtgggagctggagtaggcttttgggggggcttcgccccccagcgggagcaagctccctcgccacagaaagccagctcccacattttttaaccgtgttcgaccgaggttattgctgcgtcagctgcgaccacaacgccggcgcacccgccgacttggcaatcgcttccaaccgcgccgcatgctcagccaggtcctgctcactggcacggatgatcggtgttggcttgcggtcagccggcaagcggcggatttccgaagggcgattgcccgagccttctgccgaaccggtgccgtcggaggcgttaccggccagggacaggctggtttgcccgccggtcatggtcaggtaaacgtcggccagaatctcggagtcgagcaacgcgccgtggagttcacggccggagttgtcgacgccgtagcgtttgcacaacgcatcgaggctgttgcgctggcctgggtgtcgctcacgggccatcatcaaggtgtcgaggatcgagcagtgctgggaaatatccgcacgctcggtctgccccatcagggcaaattcgttattgatgaagccgacgtcgaacgccgcgttgtggatgatcagctgggcgccgttgatgaactcgaaaaactcatccgccacttcggcaaagcgcggcttgcctttgaggaactcgtcggtgatgccgtggacgccgatcgcgccttcgtcactgtcgcggtctggttgcaggtagacgtgaaagtgacggccggtgaggcgacgacccatcaattcgacacagccgatttcgatgatccggtgaccatcggtcaccggcatgccggtggtttcggtatcgagtacaacagatcggatggccatcagggttcagctctcaacggtggtaagcagtgtggtgtaaatcaaagggcgcgatgttaacacgtcagcggactcagctttgtttgtagccccgcacttcgtccacaccgcgattggccaactggtcggcacgctcgttgcctgggtgaccaatgtggccgcgcacccatttccaggtgatgttatggcggttgcattgctcatcgagcagttgccacaggtcggcatttttcaccggttccttggccgcggttttccagccgcgctttttccagttgaccatccactcgttgatgcccttcatcacgtattgcgagtcggtcaccaacagcacgtcacagcggcgcttgagttcctcgaggccacgaatggcgcccatcagctccatgcggttgttggtggtgttggcttcgccgccccacaactccttctccacgcccttgcacaccagcaaggcgccccagccgccggggccagggttgcccttgcaggcgccatcggtgaagagttctacgctatcggtcatcggttacatccatcaaaacgggctggcggcaatgggccgacagtatccctgggcccaaacactgggccggtaatcaaaaaagaaagttttacggttcgctctgcttgcgattgaccttggccatcggcatcggcaccagcttgcccatcggctggcgctgcacctgacgcaccggccgcagcccgaccacgatcttgcgcgccaccaataaatagaagccaccacccgacagttgccaagaccccgcacggcgttcccagccagccaggcggccttgccacttggtcgacgcaagcggcggacgatagcacccgaagcggcgtttctccagcgcaaagcccagcaggttcagccagtcgcccacccgcgagggcgagatgcagcgcgcctggcgcaggccgtcatgggcgaacacatgccgcaggccccaactgctccaggggttgataccgataatcagcaaatggccaccagggcgcacactgctggcggcttcgcgcagcaacccatggggcgacaggcaaaaatccaggccatgctgcaacaccaccacgtcggcggcgtgctcgctcaacggccaggcctgctcctcgcacacaatctcgacacccggcaacggcgcgcccaggcgcacattgcgctgcacctgcggcgcgggcggcggcgtctgcgccgaggggccgtaatgcaccaggtagccgccgaagaagcggcccagctcgtcttcgagcatgcggcgttcttcatccagcagaaattgcccgatcggcccggacagccattcacgggctgcgctgatcagggccagccactcaggatcggcctgggcgaacgctttatcagtcattgcattctccaactcgcctagacgttctaagatgcaccaatgtgttcagcttggcgaatcgaagaatgatacagatcactgccctacccgccttcaccgacaactacatctggttgttgcaggacccgcacacccaacgctgcgccgtggtcgatcccggcgatgccgcgccggtgctggcctggctcaagcagaacccgcagtgggccctcagcgacatcctggtcacccaccatcaccatgatcatgtcggcggcgtcgagcaactgaaaagtgtgacaaatgccaaggtctacggcccggcgaatgaaaatatcccggcgcgtgacgtggccctgcacgacaacgaccgcatcagcgtgctgggctgggacttcgacgtttatagcgtaccgggccataccctcggccacatcgccttttatcaccagggcgtgctgttgtgtggtgacaccctgttcgccgccggttgcggccgcttgttcgagggcacgccggaacagatgcacacctcgctggaacgtctcgccgccctgccggccgagaccttggtgtactgcactcacgagtacacacaaagtaacctcaaatttgcccaggccgtggagccggataacgccgatatcgccgaacgcgtcgagcacgtcaagcaactgcgcgcccgtggcgagatgacgctgccgtccaacctggccctggaaaaacgtactaacccttttctacgcaccgccgaaacatccgttaaacaaaaagcggacgaacggaatgggcgcgataaccgctctggggccgaggtgtttgctagcttgagggcgtggaaagataagttctaagccgatgcaatctgatacggattttctgaatggttgaccgcaaccaaagcgctttctagaatcgcccgacatttttgcccggaacttacttccagccaatgtcgtcatctattcgtaaatccatctcttcagacgcattgacccgcctggctcaagccgtggcggtggctgtgtccgctactctggcgggctgccaatcgactcatttcgctgcacaatccaccgtgcaacccaaacccaatcttgccgccaagatcaagcaaaaacctatttggctctcagagaagcccagccccgaagtcccccaggatgtctgggaacgcatgcgacggggctttcaattgcaggacggcctgggcgtcaacccgcgcatcgagcaacagcgtttgtggttcgccagcaacccgtcctttctggagaacgccggagaacgcggcagcctctacattcattacatcgtcgaacgccttgaagaacgcaacatgcccctggagctggcgctgctgccagtgattgaaagtgcctacaacccaatggcctattcgcgcagcgatgcggtcggcttgtggcagttcattccctccaccgggcgctacttcaacctgcgccagacccgcgcctacgacggccgccgcgacatcaccgcctccaccaccgccgccctggactacctgacgcgtctgcatgacatgttcaacggcgactggctgctggccctggcggcctataacgccggcgaaggcacggtcagccgggccatcgagcgtaacgagaagctcggcctgcccaccgactactggaacctgccgctgccccaggaaaccaaggactacgtgcccaagttcctggcgctgtcccaggtggtactggccccggaggcctacggcgtcaacctgagcccgattgccaacacgccgtacttcgaagtggttgaagtcaagcaaagcatggacctgtcacgggttgccgcgctggctgaaatcgatgaagacgaactgttccagctcaacccggcactgaaacaacgcaccaccctcgacggcccccagcatttgctggtgccgagttccaaggcgcagttgctcaccagcaccctttcgacgatgaagccggaagaattgctggcgatgcgcccgaaaaagcaggtgttcgacgaagtcgagaccgcgcgggtggctgggcgtacgcgcaattacaaggtgcgtacgggcgacaacctcacgctgattgccaaggcaaacaaggtcgacgtgcatgacctgcagcgctggaacaagctcaacggccaggcgctcaaggtcggccagaccctggtgatgcaggacacgcgcaagctggtggccaaggccgacagcaagaagccggtgcaatacaaggtcaagaaaggcgactcgttgtacatcgtcgccaagcgtttcaacgttgagatgcaacatctcaagcgctggaacccgcgcaccggccaggcactcaagccagggcagatgctggtggtttccgggccgcgctaaggcaaattcgatgcatgggcaggcttgtgtgggagctggcttgcctgcgatgcaaacacctcggtgtatcagtgacaccgagccgatgctatcgcaggcaagccagctcccacatttgattgaccccaggctcaagaccttgccagccctcggtcagcctctgaaacaacctttttccaaccggaacaagctgttactgtaccgatcataaagcccaagccgcctggatcggatctctgacttgaagcgtcccctccttctactaataagtctggccttgagctttgcagcgaacgcgacgattaccgagagccacggttatacgcagttcggcaggctcaagtacccggcaaaattcacccacttcgattgggtaaaccctgcagcgcctaaaggcgggacattgcgggtcatggcctttggcaccttcgacacgctcaacccctacaccttcaagggctccagcccggtttcaacccccaatttcctgcaatacggcgtcaacgagctgaacgagccgttgatggtcggcaccggccagtacgcgccctccggcgatgagcccacctccagctacgggctgattgcccagtcggtggagtacagcgaggatcgcagctgggtggtgttcaacctgcgccccgaagcgcgtttccacgatggcaagccgatcactgcctatgacgtggcgttctcctatcgcaccctgctgaccgaaggccacccgcaataccgcaccaacctgcaggaagtggcgcgggtcgacatcctcaaccgccaccgcatccgctttgtgttcaagcgcgccggcaacccactgctgatcctgcgcctgggcgagctgccggtattgccccagcattactggaaaaaccgcgacttcaaggccaccaccttcgaaccaccgctgggcagcgggccgtatcgcatcaccaaagttacgcctggccggcaattggtgttcgagcgggtcaaggattactggggcaaggacctgccggtcaaccagggcttctataactacgacaaggtcgaagtggagttctaccgcgacagcgacgtggccttcgaagccttcaaggccggcgaattcgacatctacatcgagcaccaggccaagaactgggccaccggctataacttcccggcggtcaaccgtggcgatgtcatcaaggcgcagatcgcccaccagatcccgacccagagccagggcctgttcatgaacacgcggcggccgaccttcgcccagtccaaggtgcgcgaggcactggggttgatgttcgactttgaatggaccaaccgcaccctgttcagcagcgcctataaacgcaccttgagttactaccccaacagcgagttctcggcgacgggcgtgccggtaggccatgaatggctgatgctctcgccgtaccgcgaccagttgccggccaacctgttcacccagccgttcagcctgccgcagaccgacggtcgcggcatcccgcgcgagaccatgcgccgcgccctggcgttgctgggcgaagccggctggaagctgtcggggcagcgcttgctcaacagtgacgggcaaccactgcgattcgaaattctgctggtcaacccgaacctggagcgcatcctgcagccgtacgtcgagaacctgatcagcatcggcatcgacgcacgcctgcgcacggttgatcgcgcgcaatacaaacagcgcctggatcagttcgacttcgacatgatcctgatcaccctcaaccagaccttgagcccaggccttgaacagtggcagtacttccactcaagccaggccaacatcaagggcagcaagaactacgccggcatcgccaacccggtggtcgaccgcctgctggaccaactgctggcggcgcaaacccgcgaagaacaactggccgccggccgcgccctcgaccgcgtgttgctgtggcagcactacagtattcccaactggtacctcaactatcatcgcttggcgtaccgcaaccggttcgcctttgtcaccacgccgccctacagcctgggcctgagcgcgtggtggctgaaagcatcggagaaagcccaatgatgtatttgcgctacgcgttactgagcagcctgttgctgtgcagcgcggccaacgccgcgccgcaacatgcgctgaccctgtacaacgagccacccaagtaccccgccgacttcaagcacttcgactacgtaaaccccgacgcccccaagggcggcaccttccgtgaatccagcatgggcggcttcgacagcctcaacccctacatcagcaagggcgtgccggcagacaatctgccgctgatctacgacaccctggccatgcaaagcctggacgagcccatcaccgaatacggcctggtggccggcaagatcgaaaaagccccggacaacagctgggtgcgtttctacctgcgccccgaagcgcgttttcacgatggccacccgatccgcgccgaagacgtggtgttcaccttccaggcactgatcaaggacggctcgccgttgtaccgcacctactacgccgacgtcgacgaagtggtggccgaagacccgctgcgggtgctgttcaagttcaagcgcaccaacaaccgcgaattaccgctgatcctcggccaactaccggtattgcccaagcattggtgggccacccgcgacttcgccaagggcaacctggaaataccgctgggcagcgggccgtacaaggtcgccgaggtcaagcctgggcgcatggtgcgctatgagcgggtcaaggattactgggccaaggacctgccggtcacccaaggcttctacaatttcgataaccgcatcaccgactactaccgcgacagcacggtgtcgctggaagcgctgaaggccgggcaattcgactactggctggagttcagcgcgaagaactgggcgaatgcctacaacatcccggcggtcgcccagggccggttgatcaaggaagaaatccccaacggcaaccccaccggcatgcagggctttgtgttcaatacgcgcaagccgatgttccaggacgtgcgcgtgcgcaaggccatcagcctgttgctggatttcgagtggagcaacaaacagctgttcaacggcgcctatacgcgcacccgcagttactttgaaaactcggaaatggccgccaccggcctgcccggccccgacgagctggcgattctggagccgtttcgcgacaagatcccggccgaagtcttcacccaggcgtttgaaccggccaagaccgacggcagcggcatgatccgcacccagcagcgcgaggcctaccaactgctgcaagccgccggctggaagatcgtcgatgacaagatggtcgacaccaccggcaaaccggtgaccatcgagttcctgctggcccagaccgaattcgaacgcatcctgctgccgttcaagcgcaacctggcggacctgggcatcaacctggtgatccgccgcgttgacgtgtcgcagtacatcaaccgcctgcgctcgcgcgacttcgacatgctggtgggcagcttcccgcaatccacctcgccgggtaacgaacaacgcgaattctgggcgtcgtccagcgccgacaaacccggcagccgcaattacatggggcttaaggacccggccgtcgatcaattggttgaagagctgatcgacgccaactcgcgtaaaagcctgatcgcccacgccaaggccctggatcgtgtgctgcagttcggctactacgtgatccccaactggcacatcaagaccttccgcgtggcgtattgggaccatctcggccatccgaaggtctcgccgctgtacgacgtcggcacctccacctggtgggccaaacccgatgtaaaacctgccgtcaccctggacacgagcgccgatccggcgagcggaggcgattaaatgctggcttatattgttcgccgcctgttgctgataatccccacgctgttcgggattttgctgatcaacttcatcatcatccaggccgcgcccggtggcccggtggaacagatgatcgccaagctcgaaggctttgacggcgccaccagccgcatcgccggtggcggtgccgaggtctcggtggccggctccagctaccggggcgcccaaggcctggacccggccttgatcaaggaaatcgagaaaatgtacggcttcgacaaatcggcgccggaacgcttgtggatcatggtcaagaactacgcccgcctggatttcggtgacagcttctttcgcgatgccaaggtcatcgacctgatcaaggaaaaaatgccggtgtccatctccctcgggttatggagcacgctgatcatgtacctggtgtcgatcccgctgggcatcgccaaggccacgcgccacggcagccacttcgacgtgtggaccagctcggcaatcatcgtcggctacgcgatcccggcgttcctgtttgcgatcctgctgatcgtggtgtttgccggcggcagttatctggactggttcccgttgcgcgggctcacctcgaacaacttcgatgagctgagctggagcggcaagatcctcgattacttctggcacctcgcgctgcccgtcactgcgctggtgatcggcaacttcgcgaccatgacgctgctgaccaaaaacagttttctcgacgagatcaacaaacaatacgtggtcaccgccaaagccaagggcctgaccaaccaccgcgtgctctacggccatgtgttccgcaacgcgatgctgctggtgatcgccggtttcccctcggcgtttatcgggattttcttcaccggttcgttgctggtggaagtgatcttctccctcgacggcctgggcctgatgagctttgaagcagcgatcaaccgggattacccggtggtgttcggcacgctgtttatcttcaccctgctggggctgatcgtgaaactgatcggcgacctcacctacaccctggtcgatccgcgtatcgacttcgccagccgggagcattgagatgaacctgtcccccctcaatcgccgtcggttcgaacgcttcaaggccaacaagcgtggctggtggtcgctgtggctgttcctgatcctgttcgtgctcagcctgggcgcggagttgatcgccaacgacaaaccgctggccgtgcacttcgacggcgactggtatttcccggcactcaagcgctacccggaaaccgcctttggcggcgaatttccgctggaggccaactacaagagcccgtatatccaggaactgctcaaggccaaggacgcctggacgctgtgggcgccgatcccgttcagctaccagagcatcaactacgacctcaaagtacccgccccggcaccgccttcgagcgtcaacctgctgggcaccgatgaccagggccgcgatgtattggcgcgggtgatctacggcttccgtgtgtcggtgctgttcgccctgaccctcaccgtgctcagctcgatcatcggcgtgatcgccggtgcgctgcagggcttttatggcggctgggtcgacctcgccgggcagcgtttcctggaaatctggtcgggcttgccggtgttgtacctgctgatcatcctcgccagttttgtgcagcccaacttctggtggctgctggggatcatgctgctgttttcgtggatgagcctggtcgacgtggtgcgcgccgagttcctgcgcgggcgcaacctcgaatacgtgcgcgcggcccgtgcgctgggcatgcagaacggcgcaatcatgttccggcacatcctgcccaatgccatggtctcgaccatgaccttcatgccgttcattctcaccggcgccatcggcaccctcaccgccctggattttctcggcttcggcttgccggccggctcaccgtcgctcggtgaactggtggcccagggcaaatccaacctgcaagcgccgtggctgggcatgagtgcctttgccgtgttggcaatcatgttgagtttgctggtgtttatcggcgagtccgctcgcgatgccttcgacccgaggaaatgagatgaatcaggacaatctgatcgaagtccgcgacctctgcgtcgagttcgtcaccggccagcaccaccaccgcgtggtcaacaacgtcagcttcgacatcaagcgcggcgaaaccctggccctggtcggcgaaagcggctcgggtaaatccgtcaccgcccactcgatcctgcgcctgctgccttacccgctggcacgccacccggcgggcaccatcagctatgccgggcaagacctgctgacccttaaagaaaaaaccctccggcatattcgcggcaaccgcattgcgatgatcttccaggagccgatgacctcgctgaacccgctgcacaccatcgaaaagcagatcaacgaagtactcggcctgcacaaagggctgaccggcaaggtcgcgacccggcgcaccctggaactactcgaactggtcggtattcccgagccgcacaaacgcctcaaggccttgccccacgaactctccggcggccagcgccagcgggtgatgatcgccatggccctggccaacgagccggaactgttgatcgcggatgagccgaccacggccctcgacgtcacggtgcagttgaagattctggaattgctcaaggagttgcaggcgcggctgggcatggcgctgctgctgatcagccatgacttgaacctggtgcggcgcatcgcccatcgcgtgtgcgtgatgcagaagggttgcatcgtcgaacaggcagcgtgcgagacgctgttccaggcgccgcagcatccttatacccaggagctgctggcggcggaacccagcggcgggccggcgagcaacgaggtggggccgccgttgctggaagtcgatgatttgaaggtgtggtttccgatcaagaaaggctttttgcgtaacaccgtggattacgtcaaagcggtggatggcattaatttcagcctgccccaggggcagacgctgggcatcgttggtgagagtggctcgggtaaatcgacgctgggcctggcgattttgcgcttgattgccagcaagggcgggattcgttttgagggccagcagctggaccggatgacccagcagcaggtgcggccgttgcggcgggaaatgcaggtggtgtttcaggacccgtttggcagcttgagcccgcggatgagtgtcagcgagattgttggcgaggggttgcggattcacaagatgggcacgcctgttgagcaggaggccgcgattattgcggcgctgcgtgaagtggggctggatccggagtcgcggcatcgttacccgcatgagttttccggggggcagcggcagcggatcgccatcgcccgggcgttggtgctcaagccacgtttgattttgctcgatgagccgacatcggcgctggaccgtacggtgcagcggcaggtggtggagttgttgcgcagtttgcaggccaagtacaacctgacctatttgtttatcagccatgatttggcggtggtgaaggcgttgagtcaccagttgatggtggtcaagcatgggcaggtggtggaacagggggaggcttcggcgatttttgctgagccgcggcatgcttatacgcggcagttgttggaggcggcgtttttggtgcctgcggttgtttgaccgtgtacatatccgtttttgcggtaacggcttctaatggttccgcccttacggcgggtcacttttggaaaagagccccaaaagtaaccaaaagggctcttgccccaccactcggcacctcgcctaggctcggtgtgccctcactccggcttgaatccgtggg

SEQ ID NO: 37 - DNA, 131796 bp, Pseudomonas poae FL10F
tttttctccgctttcgaccgagaagatcgaaacgttaatagagccaaacaacaccgctctaccaactccttctgggcctcgatgaactgaagcaactcgccgtcgaattctgcgtaactctttgtttaccaaggagttttccgtttcgactgcgccggaagtggggcgaattatagacctcctgattctgccgtcaacaccttttttcacatttctgtcatatcggtcaaaaagccctcagaaacgcaaaagccggccccaaggggccggctttcaactacagcgccttacaaactaggaaaggcaaactgcgacgcttcatgactggcccgctgcggccagcgctgggtaatcgccttgcgacgcgtatagaaacgcaccccatccggcccataggcatgcaggtcgccaaacagcgagcgcttccagccgccaaagctgtgatacgccaccggcaccggcagtggcacgttcacaccgaccatgcccacttcaatttcgtcacagaacaggcgcgcagcttcaccgtcacgggtaaagatgcaggtgccgttgccatattcatggtcgttgatcagttgcatcgccgcttccaggctgttcacccgaaccacacacagcaccggcccaaagatctcttctttatagatacgcatcttgggggtcacgcgatcaaacaggctgccacccaggaaaaagccttcttcatggcccgcaatactcaacccgcgaccatccaccaccagctcagcgcccgaagccacaccgtcttctatatagccactgaccttgtcccgcgcctggcccgtcaccaacggccccatatccaggccacacgaagttcctgcgccgatcttcagcgccttgacctgcggcaccagcttggcaatcaacgcatccgccacctgatcgcccacgcacaccgctaccgagatggccatgcaacgctcaccacacgaaccatacgccgcgcccatcaatgcactcaccgcattgtccaggtctgcatccggcatcagcaccgcgtggttcttcgccccgcccagtgcctgcacgcgtttgccgcgtttggtcgcttcggaatagatgtactcggcaatcggcgtcgagcccacaaagctcagcgccttgacttccggcgcttcgatcagcgcatccaccgcgcccttgtcgccgtgtaccacgctcaacacgcctttaggcagcccggcttcctgcagcaattgcgcaatcagcagcgtagaacttggatcacgctccgaaggtttcaggatgaaacagttaccgcagacaatcgccagcgggtacatccacagcggcaccatcgccgggaaattgaacggggtaatacccgccaccacgcccaacggctgaaagtccgaccaggcatcaatattcggccccacgttacggctgtactcgcccttgagaatctccggcgccgagcacgcgtactcgacgttctcgataccgcgtttcaattcgcccgcagcgtcttccaaggtcttgccgtgctcttcgctgatcaactgcgagatccgtgcttcgttctgctccagcaattgcttgaaacgaaacatcacctgggcacgcttggccggtggggtattacgccaggccgggaacgccgccttggccgcgtcgatcgcctgttgaatggtttcacggctggccaacggcacctggtgaatcacctggccggtagacgggttatacacgtcggcgctacggccgctgtcattgaccaactcaccgttgatcaagtgctggataaggctcatgcagggctcctgaaaagttgttctatatagaaggagaaatcagtcgattttgttcagcacttcgccgaccgcgtcgaacagacgatccaggtcctgcggcttgctgttgaaggttggcccgaactgcagggtgtcgccgccaaagcgcacgtagaaaccggctttccacaaggccatgccggcctcgaatggacgcacaatggcatcaccgtcacgcggggcaatctggatcgcaccggccaggccgtagttacgaatatcgattacgtttttgctgcctttcaagccatgcagcgcattctcaaagtgcggggcgacttcggccacgctctgcaccaggttttctttctgcaacaggtccaatgccgccaagcccgccgcgcaagccaccgggtgcgccgagtaggtgtagccgtgggggaattccaccgcgtactccggcgtcgcctggttcatgaaggtctgatagatctcgctgctggcaatcaccgcgcccatcgggatcgcgccgttggtgacttgcttggcgatgcacatcaggtccggggtcacgccgaagctgtcggcaccgaacatcgagccggtacggccaaagccggtaatcacttcgtcgaacaccagcaggatgttgtgctggtcgcagatttcacgcagacgcttgagataaccctgtggcggcaccagcacgccagcggagccggccatcggctcgacaaacaccgcagcgatgttcgacgcgtcgtgcagctcgatcaacttgagcagctcgtcggccaaggcgataccgccctgctccggcataccacgggagaatgcattgctggccagcaaggtgtgcggcagatggtcaacatccatcaagccctgaccaaacagcttacggttaccgttcacgccgcccaggctggtgccggcgatgttcacgccatgataaccacgggcgcggccgatcattttggtcttggtggcctggcccttcaggcgccagtaggcacgcaccatcttcaccgccgtgtcggcgcactcggagccggagtcggtgaagaacacgtggttcaagttgcctggggtcaggtcggtaatcttttccgccagttggaacgacaacggatgaccgtattggaagcctggggagtagtccaaagtgcccagttgtttggacactgcttcctgaatttccttgcgcgtgtgcccggcgccacaggtccacaggcccgacaacgagtcatacaccttgcggcccttgtcatcggtcaaccagctgccttcggcggccacgatcaggcgcgggtcacgctggaagttacggttggcggtgtagggcatccagtgggcatccaacttcagttggctggccagggacgaaggggcgttttcgggcatgttcatcagcaaaacctcgcggggcaaaaggcagcgtcgggattgaaaagcgttgttgcagctaaattgccacggggataaagtcggtgaaattcaactcttctaaccttcagtcaggccttcactaaactatgagcagccgtcgacccgacccactggcccaagtcagcgacttcgatattcgcctgttgcgcatctttcgcagcgtggtggaatgcggcggtttctcggccgcagaaaccgtactcggcatcggccgctcagccatcagccagcaaatgagcgacctggagcagcgcctcggcttaaggctgtgccaacgcgggcgcgccggcttctcgctgaccgaagaaggccgcgaggtctaccaatcggcgttgcaactattaagtgccctggaaagctttcgcactgaggtcaacggcctgcaccagcatttgcgcggcgagctgatcatcggcctcaccgacaacctcgtcaccctgccgcacatgcgcattacccacgccttggcgcagttgaaggaacgcgggccggacgtgcagatacaaatccgcatgatcgcccccaacgaagtcgagcaaggcgtactcgacgggcgcctgcacgtcggcgtagtgccccaggccagtgccttgtccggcctggaataccagccgttgtacagcgagcgctcgctgctctattgcgcggtcggccacccgttgttttatgccgacgacaaacaactcgacgacacccgcgtcgacagccaggacgccatcgcccccaccttccgcctgcccgccgagatccaggcgcattaccaggcactcaattgcaccgccagcgcctcggaccgcgaaggcatggcgttcctgatcctcaccggtcgttacattggttacctgcccgatcactacgccagcctgtgggtgcaacaaggccgactgcgcgcgctgaaaccgactacacgtttttacgatttaagcctcgcatcggtcacgcgcaagggccgccgccctcatttggtgctggaaagctttctcgagagtttggcagcaacccgctaactcgggcctctcgtcaaaagctgagcaactggacagctttttgcaaggaagccaggaccttgaaccgtccgccccgagtttgcccaccatgccaccagaaaacgccagccccagcgacctgatctacggcctcaacgaccgcccgaaacccattcccgcactactggccgccttgcaacatgtgctggcagcttttgtcggcatcatcaccccgccactgattatcggctccaccctgggcctcaccgcccatttgccctacttgatcagcatggcgttgatggtttccggcgtcggcactttcattcaggcacgtaggccatttggcatcggcgccgggatgatctgcctgcaaggcaccagctttgcgtttctcggcgcagtgttgtcggcgggctttctggtgaagcagcgcggcggcagcccggaagacatcatggcgatgatctttggtgtgtgctttttcggcgcggcggtgcagatcgtgctgagccgctttatcggccagctacgtcgagtgatcacgccattagttacagggatcgtcatcacactgatcggcatcagcctgatcaaagtcggtatcaccgacctcggcggcgggttcaacgcgccggactttggtgcgcccatcaacctggcactgggcgtgttcgtggtgctgaccatcatcctgctcaaccgctccaacacgccgtgggtacgtctttcggcgatcatcatcggcttggccctcggcagtttggccgcgtggttcagcggcaagctggtgccccaagccctgcctgatttgccgttgatcagcatgcccatgccgtttcgcttcggtttcaactttgactggagcgccttcctgcctatcgcgctgatttatctgatcagcagtatcgaaacggtcggcgacctcaccgccaattgcatgatcgcgcgccagccaatcagcggcccttcttatataagccgactcaaaggcggtgtattgggcgatggcgtgagttgcatgatcgccgccaccttcagcgcctttcccaacaccaccttcgcgcagaacaacggcgtgattcaactcaccggcgtggccagtcgttacgtcgggctgtacatcggcgtgctgctgttttgcctcggtttgtttccgctgatcggtgcggtgctgcagcaaattcccaagccggtattgggcggcgcaaccctggtgatgttcggcagtgtggccgctgctggcgtgcgcatcctggcccaggcgccgctggaccggcgcagcatgctgatcatcgccacctcgttcggcgtcggcctgggcattgccgcccaaccggacctgctgcacttgatgccctcgctggtgcaaaacctgttcgactcagccatcaccagcggcggcctgactgcgattgtgctgtgtcttttgttaccggaagccaaagcggcctccactgccgcaaaccacgcactggaaagcgacactctggaaccgctttgacgcttttattgcatcgggacttgtctggggcttgagggtgggttatctgtgcacacgtcgtctctctcgatcagcacggaaacctccatgagcctcgaagttcctgcccacagcaaccacgccggtaaacccgccagccgtattcggcaaaaaaatgaacaagcgattctgcaggctgctgaagacgagttcgcgcgccatggctacaaaggcaccagcatgaacaccattgcctcaagtgccgggctgcccaaagccaacttgcattactacttcaccaacaaacttggcctgtacatcgcggtgctgagcaacatcctcgaactctgggacagtaccttcaacgcactgaccgccgaggatgacccggccgtggctctcacccgctacatccgcaccaagatggagttttcccggcgccacccgcaggcctcgcggatcttcgccatggaaatcatcagtggcggcgaatgcctcaccgaatatttcagccaggactaccgcgcctggttcagcggccgcgccgccgtgttccaggcctggatcgacgccggcaagatggaccccatcgaccccgtgcacctgatcttcctgctgtggggcagcacccagcactacgccgactttgccacccagatctgccgcgtcaccggtcgcaccaagctgaccaagcaagacatggaagacgccggcaccaacctgatccacatcattctcaaaggctgtggcatcaagccagcccaataatcgaagcgacttatgcctttcacgctcaccggcctttgcgaatttcgtgaagaaatacgcaaaagccgcttcatcaccctcgcggcgccgattaccagcgcgcaagacgcccaggcgtttttcgagcaacacagcgacctcaacgccacccacaactgctgggcctggaaactcgccgaccagtaccgcagcaacgacgacggtgaacccggcggcaccgccgggcgaccgatcctggccgccatcgaagcccaagggtttgatcaagtcgcggtgctggtgattcgctggtacggcggcatccaactgggcaccggcggcctggcccgtgcctacggcggcggcgcgaacaaatgcctgcaaaccgccgagcgcatcgagctgatcagccgtgtgccactgagttgcgcctgcgggttttccgaattgaatctggtcaaactgcgcgtcgccgaactgggcgggttagttgtggaagaaaccttcaccgccaatggcgtggagttgcaactggcgctgggcgaagcgcacatcgacaccctgcaaacccagctcgccgacctgagccgtgggcgcatcctgctgcaacgctgaaattgcccacatctactgtgcacctgcctgtggataacctgagcacatccagccgtaacccttctgtcataagggcttgcgggcgctgtttgttttttaaccagcaacactggcccctatttgcccaaggctggagtaatgttgtcagccgaactcactgaaccgcgacgctaaaggaagccttcatgtctacgccaaaaaccgcactgattatcggcgcctcccgcgggctgggccttggcctggtcaagcaattgctccaggacggctgggatgtgactgccaccgtgcgtgacccgagcaaggccgatgcgctgaaagccgtgggcccggtacacatcgagaagctggacatggacgatcagcaagccgtgatcgccctgagccagcgcctcaaggaccgcaccttagacctgctgttcgtcaacgccggcgtcaagggcccggccaaccaggagcctggccacgccaccctggcggaagtcggccagctgtttttcaccaacgcggtcgcgccgatcaacctggcgcagcgttttgtcgggcagattcgcaaagacagcggcgtgctggccttcatgagttcggtactcggcagcgtgaccatccccgacggttccgacctggcgctgtacaaggccagcaaggccgcactcaactccatgaccaacagcttcattacgcaactgggtgaccacaaactcaccgtgttgtcgctgcacccaggctgggtgaaaaccgacatgggcggcgagaacgcgcacatcgatgtggacaccagcgtgcgtggcctggtggatcaagtgaatgcctacaccggcaagggcggccatcactttatcgactacaaaggcgacaccatcgcctggtaataccacggatcaaactgtgggagggcttgctccctcccacattgagcaatgtagacccaacctccaacaacacgtaatctaccgacctagccctcaccggcgaccctggatcagcagacagggcaacactgagctggcaaacctgaacccatcattcagaggagccggccaatgcctgcgacccgtatctggttaaaaaaccccctcgcgattttcactgccaatggcctcgacgcccgtggcggcctggtgctgcaagacggtgtaatcaccgaagtgctcggctggggacgcgagcctgccgtgccttgcgggcaagtgttcgatgctcgcgaacacgtgatcctgcctgggctgatcaacacccatcaccacttctaccaaaccctgacccgcgcctgggcgccggtggttaaccagcccttgttcccatggttgaaaaccctgtacccagtctgggcccggctgaccccggaaaaactcgcgctggcgtccaaagtcgccttggctgaattgctgctctcgggctgcaccaccgcggcggaccatcactacctgttccccgacggtctggaaaatgccatcgacgtacaggtcgaaagcgtgcgcgaactgggcatgcgcgccatgctcactcgcggttccatgagcctgggcgaagccgacggcggcctgccgccgcaacagaccgtgcaacaaggccaagtgattctcgaagacagccagcgcctgatccgcacctaccaccaacgcggcgacggcgcgcagatccagattgccctggcgccctgctcgcctttttcggtcacgccggaaatcatggaagccagcgccgaactcgccaacagcctcgacgtgcgcctgcacacgcacctggcggaaaccctcgacgaagaagacttctgcctgcagcgtttcggcctgcgcaccgtcgactacctcgacagcgtcggctggctcggcccgcgcacgtggctggcccatggcattcacttcaacccggatgaaatcgcgcgcctcggcgctgccggcactggcatctgccattgcccaagctcgaacatgcgcctggcgtccggcatctgtccgaccctggacctgcttgccgccggcgcgccgattggtcttggcgtggatggctccgcctccaacgatgcatcaaacatgatccttgaagcgcgccaggccttgtatatccagcgcctgcgttacggcgcagaaaagatcacccccgaaggcgtgctgggctgggccaccaagggctccgcgcagttgctggggcgtacggatattggtgagttggccgtaggtaaacaggctgacctggcactgttcaagctcgatgagctgcgcttctccggcagccacgatccgatttcggcgctgctgctgtgcggtgcggaccgagcggatcgggtgatggttggcggcaagtggcgggtgattgatggacaggttgaaggcctggatctcaagggcctgatcgccgatcacagccaggcggcgcgggaactgatcaaccggacttaactgaaaaaacaccttcaaaaatgtgggagcgggcctctgtgggagctggcttgcctgcgatagcatcatctcggtgcaactgaaaaaccgaggtgtctgcatcgcaggcaagccagctcccacacaacccagttcccacattgggttctgtggtgtttacaggcccaacaacgacagcatgataaacgtcgcaaacaacacaaaatgggtcatcccttcgatggcgttggtttcgccatcgttgaggttgatcgcgctgaccaccagcgtgatcaacaccatcacggtctgcaccggcgtcatcgccatctggaacggctggcccgtgtaaagcgccatggcctccatcaccggcacggtgaggatcaccgtcgacaaagacgcacccagtgcgatgttcaccaccgactgcatgcgattggccaacgccgcgcgcaatgccgtcagaatctccggcgccgccgaaatggccgcaaccacaatcgccgtgatcaccggcggtgcgcccgtgccttccaggcccaggtcgagggtcttggacatcacctcggccagtgcgccgatcacaaccacaccaaacaccaaggtgccaatggagaaagccaaactgatcggcggctcctgctgttcttccggctgtttcttgcggcgtttttccgggtagctgtagctgaagaaataactgtgcggccccacctgcatgcgcaggaacagggtgtagagcagcaccatcgcgccgatggtgaaggccgagtaaattttccagtccgcctcggggataaattccggcaccaccatcgacacgcccatggcggtgaggatcatcacgctgtagctgcgcgccgagtcatcgttgtaggactgttcgccatgcttgatgccgcccatcagcgcggccaggccgaggatgccgttgatgtcgagcatcaccgccgagtaaatggtgtcgcgcaccagggtgggcgaaggctcgttgctcatcatgatcgccaggatcaccacttccaccagcacggcggcaagggtcaggatcatggtgccgtaagggtcgccgaccttttccgcgagttgctcggcatggtgggcgactcgcatcgaggccacgacgataaacacgatcagcgccaccccgctgagcagcgccacgatttgcccgctgtgcagcatccagtgctccaaagggtaggcggcgatggcggcaatcagtgccagtagcatgtatttttcttgcttgagggatgtgagcattccgggccttttcgtgcagcaaatcagtcattgatggggtacagactgcaccacgccgctaacgtttcgttacaccttagttcacgcgctccttgcgtgaacaaaagcaatactctcctgctggtcaggttttgccgattatttcagccatggcctgtagaatgccgccattgcacctgatgagaatttagaaaatgtacgattggctcaacgccctgcccaaggctgaattgcacctgcacctggaaggctcgctggagcctgagctgctgttcgccctggctgaacgcaacaagattgccctgccgtggaacgacgtcgaaaccctgcgcaaggcctacgccttcaacaacctgcaagagtttctcgacctgtattaccagggcgccgatgtgctgcgcacctcccaggatttctacgacctgacctgggcctacctgctacgctgcaaagcacagaacgtgatccacaccgaacccttcttcgacccgcaaacccacaccgaccgtggcgtgccgttcgaagtggtgctcaacggcatcgccgctgcgctcaaagatggcgagcagcaactgggtatcaccagcggtttgatcttgagcttcctgcgccacttgagcgaagccgaagccgaaaaaaccctcgaccaggccctgccgttccgtgacgcgtttgtggccgtcggcctggacagctcggaaatggggcacccgccaagcaagttccagcgcgtgttcgaccgtgcccgtcacgaaggcttcctcaccgtggcccacgccggcgaagaaggcccgccggagtacatctgggaagccatcgacctgctgaaaatccagcgcatcgaccacggcgtacgcgccatcgaagacgagcgtttgatgcagcgcatcatcgacgagcagatcccgctgaccgtgtgcccgctgtccaacaccaagctgtgcgtgtttgatgacatggcccaacacaacattctcgacatgctcgagcgtggtgtgaaggtgacagtcaactcggatgacccggcgtacttcggcggttacgtcaccgagaacttccacgctctgtacaccagcctgggcatgacccaggaccaggccaaacgcctggcgcagaacagcctggatgcgcggctcgtaaagccttaagcaacaacggctgacacagcaaaaatcaatgtgggagccgggcttgcccgcgatgccggtgtatcaggcaccctatggcggactgatacaccgccatcgcaggcaagccagctcccacattgacctcatctgtctcaagcctgggtaagttcttccagggtcttccccttcgtctccatcccaaacacccacaccaccagcgccgccaccgcaaaacacagtgcgcccaaggcaaacaccccgccctgcccggtaatcggaaacaccagcccggtcactaacggccccaacaatgacccaacccggccaatcgccgaggcaaacccggaaccggtagcccgcgccgatgtgggatacagctccggcgtgtaggtgtacagcaccgcccacatgccaaacagaaagaactgcatcaacagccccgacgtaatcaacagccccacgttgccgccaaacaccgcgctctgcccatacagaaacgccatcaccccgccgcccagcaacgtcaccacacacaccggtttacgcccccagcgctccaccagccaggccgccatcaggaagccgggaattccgcccagggaaatgatcaccgtgtaatacaccgactgagtcacggcaaaacccgactgctgcaacaacgcgctcagccaagaggtcagcccgtaaaagccaagcaaggcaaagaaccacacgctccagatcatcatcgtgcgttggcgatactgcgccgaccacagttgttgaaacgccgaaaaaaacgtccccggcacgctctccacccgtggcaacgcgatgggctccggcaagtcggcacgccccaacgagtcgcgcactttttgctcaatgccctgcaacaccttgtctgccgcttcgttccgtcctgcctgttcaagccagcgcggcgactcggggataaaaaaccgaatcgccaggacaaacaccgccggcacggccaacaccaagaagatgtcgcgccagccaatcaccggcagcaggaagtaagacagcacgcccgccgccacaaaaccgagcggccagaagccatccatcaaggcgatatagcgcccgcgccctttggccgggatcagctccgaaagcatcgactgcgcaatcggaaactccatgcccatgccgatccccagcaggatgcgaaacagcgtcagcgtctccaccgtttgcgcggtggagcacaggtagctggcgactccccacaacacgatgctccactggaacaccggcttgcgcccaaaacgatccgccaacatcccggacaaagacgcaccgaccaccatgccgaaaaaactcgaactggccagcaacccggcctgggccgtgctcaggccaaactcggttttgatcgagcccaacagaaacgtcatcatcgccaggtccatggaatcgaagaaaaacgccagggcgatgatgatgaagatgattcggtggtaaccgctgatgggcaaccgttccagccgttccgctgcgctatagccttgcatacccatgccgccccccctgtgtgaagaaacccctcggcgagtgtgcggtaacgtttgcgccgctaattgctggatgcgacctgactgaaactctgaacgaccattgccctgctacaacgcggccagccggttgatttctgcaaacccgaggtcggtgaccagcaacgcgtgggactcgttgaccaggctgatccagccggactgcataaacagtttcagcagcccggcccccaacgcaccgcccaggtgcggttgctgctggctccagtcaaaacagtcgcacgccaagggcgcgcccagtgcctgggtaaaaatgcccatggccgccagctgccgcacgcccaccagggtcacgtcggtacgctgttcataacggtcgatccagccagcctccaacatccgcctataaagccccgccgccaattcgccgcccaggtggccgtggcataagcgtgcgcgccgcaaaggtgccggcgccagcaatgccggcggcaatacatccggcgtactgcgcgcggcactggccatggtggtactggccaacgcgtcgatggcaacgcagacatcggcggccgccatacgaaacaggcgcttgccgcgccgggcctccacccgcagcaatccacccccggtcagccgcgacaaatgggcgatggccgaggccgatgacaacccggcgagcgtcgccaactcttctgaagactttgccgacccgtccatcaaggcccagagcatggcggtgcgcttgggctcgcaaagcaagctggcgatgtgactgatgcaaggtgccgcttccatgtattcactccttgttaatcatttgtctgctgcggttggaaccgaagtataggggcgcaaaccgcccattccgcggcgtctgacgccgcggatagggacagggtctgagtgaaatttcctgctttgatggaggctattgcgcgatgcttaatcgctccggccattgcgccgtcaacgtcgcacagcgggccacgagcatttcccgcagcaggttgatgggtttgctcaattgcgcacgatgggcgcacagcaggttgagcggcgtgcgctcgccgcgcagctccggcaggatcacgcgcaagcgcccggccagcacgtcgctgctcacatccagccaggacttataggcaatgccgacacccgccacggcccagcggcgcaccacatcggcgtcgtcactgaaacggtcaccgctcaccgtcaggctgacttcgcgcttgccgtcgtgaaaactccagtggtcgtgaacgcggctgctcagcatgtacagcaggcaattgtgctgggccagttgttccaggttgcgcggctcgccatgccttgcgaggtagctgggcgcggcgcacagcacgcgcacattgtccggggcgatgggcagcgcaatcaggctggagtcttcgggctcgccgtagcgcagggcgatgtccacgggctggcgaaacaggtcggcaatccggtcgcccaacagcaggcggatgctcagttgcgggtattcaagctggaactcatccagccacggcaacagctgattacgcccgaagtccgacggcgccgacagttgcagcacgccgctgacatggtcctggccgctggccagtaagcgccgcccttcgtccaatgagcccagcgcggcgcgggcgtattccagaaaaccttcgccctcggcggtcagccgcaagctgcgggtggagcgcgccagcaaccgcgcgcccagttgctgctcaatgcgcttcaacgcagcgctggccaccgcgggcgacaggtccatgacccgcgcagcagcagacaggctgccgaggtccgccgcgcgcacaaacaattgcaaatcatcaaaacgcagcatgcatttccgccgattatcaatatttcattgaaacagactgctgttttagcggcttttatcttcctgggaaatagccaatcatctgcccatcccgttcatcacgtgccaggagttgaatatgtccacagcctttaacgtcatcgccacgctgatcgccaaacccggccaacacgccgcattggaaaccttgctgcgcgacatcctggagccgacccgcctggaagccggttgcgagcagtacgacctgcaccaggacctgcaacaccccgagaccttctacatgctcgaacgctggagcgacgacgcagcgctggccgaccacgaccagagcgcgcatatccagaatttccgcgccaaggccgctgacgtgatcgagcacttcgaactcaagcgcctgaaattcattgcctgatcaccgccctttttccggagcccacatgaaagccattgcctactacgcctcactgccgatcaccgacacacacgccctgcaagacatagagctgcccgagccggtcgccggcccgcgtgacctgctggtggaagtcaaagccatctcggtcaacccggtggacaccaaagtgcgccagaacgtcgccccggaaaacggcgccgccaaggtgctgggttgggacgtggctggcgtggtcaaggcggtcggcagcgacgtgacgctgttcaaagccggggacaaggtgttttacgccggctccctggtacgcccgggcggcaacagcgaactacacaccgtggatgagcgcatcgtcggccgcatgcccaagagcctggggtttgccgaagccgccgcgctgccgctgaccgccatcaccgcctgggaattgctgttcgagcgcctgcaagtgcgcgaaggcaaggatgacgaaggccagagcctgctgatcgtcggcgccgccggcggtgtgggttcgatcctgacccaactggccagccagctcaccgcgctgaaagtcatcggcaccgcctcgcgcccggaaacccaggaatgggccaaggccctcggcgccgacctggtgatcgaccacagccagccgctgagcgaagcgctgaaaaacgccggccacccgcaagtgacccacgtcgccagcctgacccagactgatcatcacctggaccaattggtggaagccctggaaccgcaaggcaagctggcgctgattgacgaccccaaggcgctggatgtgagcaagctcaagcgcaagagcctgtcgttgcattgggagttcatgtacacgcgctcgatgttcgagacgccggacatgatcgaacagcacaacctgctcaaccgtgtggctgacctgatcgacgccggcaccttgaaaaccacggtgggtgagcacttcggtgtgatcaacgcagaaaacctgcgccgcgcccacgcgctgctggaaagcggcaaggccaagggcaagatagtgctggaagggttctaaaaatcgtctgtcagtgtcgtcctttattcctgtgagtaatggacgacaccgctagtcagagagttgacctttgtcatatttgtgagcgcattcgggtttatattggccgcctttgccacgattcttttacgtgaggaagtcagcaatgaagatcctgataagagcgttagcaaaatcccccggcaacaaatggcaggtcagcctcgacggtgatgcgttcaccttccgcagtgaggccgaggcccgtgcctttgccgacaccctgcaagcccgcattcaagcgccccaccgcattcccctcagccagcaacgctccgccgctggctgatccgcacttcagacctgcgcttgcacggccctcgcccgttgcaggcgctgggtcgacacggcaatcgtcactgccaatacaccgcacaagctgatgaccatcgccatcggcatggccgtgccgtcgtgcaacacgccgaccagcgacgccgcgcccgccgccacaccgaactgtatgcagcccagcaacgccgaggcgctcccggcacgtgcgccctgcccgctcatggcgcacgccgaggtgttgggcaaaatgcagcccaggctggcgatgcagataaacaggggcaccaacaacggccacagcgcttcagtgcgcaacgcggcaatgcccaacagcgacaacgccgccgcgacgtagacccagaccgtgcgcgagagcaaaaacgccggaccgcgcttggccagcaagcgtgcattgagctgcgccaccaggataaagccggcggcgttggagccgaacagccagccgtaatgctcggcaggcacgccgtagagtttgataaatacgaagggggaaccggcgatgtaggcaaacatcccggcaatcgagataccgccggtcaaggcgtagccgaggtaaacccggtcggacaacagcgcgccatagcggcgcagcgagccggacaacggctggcgcggctgatgcgccggaaaggtttccggcaggccgaccgcgactgcgatggccgccataacgctgaacatcgacagcgccaggaagatcgactgccagccccacaccccaaccatcacgccacccgccaacggcgcgaggatcggcgccaggccggtcaccagcatcagttgcgaatacaccttggcggagcccacggcatcacacttgtcgctgaccaccgcacgggaaatcaccatgccggcgcaaccgccgagcgcttgtacaaagcgcgcgccgatcagccagtccagcgacggcgcgtaggcacaggcaaaggacgcgagggtaaacagggttacgccactgagcagcggcacgcgccggccaaagcgatccgccagcgggccgtagatcaattggccgatggccaggccagcgaaatacaccgccagggtcagctggatatgtttttcgtcagtcgcaaaggccgtggccatcgccgggaagcccggcagataaaagtcgatcgccaacggcgcgaaggcgctcaaggcgcccagaatcaggattatgcggaggttcatcagacacccaagtgagtcggcagcccgacagtctagccgcgcttgggtgtgatgaacattacgttagctcgctaactatcggaaaacttacgcgagcttggcgctgtagccttcttcggtgatcagctcgatgacttgctcggctgacaagcgactttccacaccgacttccttggccgccaggttgacgttcacgctcgccgccgggtcctggttccgcaccgcgtcggtcaccgcccgaacgcaatggccgcaggtcattccttcaacactgaatacttgcatgacatgactcctttgatgaggttggggccagtcttgaccttgccacgatggcaaggtcaagcgcctaaaatgtcggccgggctagtattcaggcgccgcctcggccaagcttgatccatcttagatatgaaccacggagcattcgccatgcgctggtcgttttttggccttgttggcctgttgagcctgtctgccgttgcgcccatggccagtgcagatgaagactatgcggtgctgattatttcccgcgagcgcctggaagtgccgaccaattgcgagataggcctttacctcaatgaccagctcgcaggccgtctattccaggaacaagcgacctcattcaacctgccggccggcaatgtgtcgctgcgcctgaagttgctgccgggccaatccccgggttgcctgcctgggctgttggcgccacctgcgcaaaacatgacgttgaaggccggtgacgtccgcaaggtacgtatcgctcaaggcccggacggcatgtacctcaagaacgctgcattaggttattgatcgttcccacgctccgcgtgggaatgccgcctgtgacgctctgcgtcaaacccttaagagcggacgcggagcgtccctagcagcattcccacgcaggagcgtgggaacgatcgcttatggggttattaaagccccttgaccttccccacaggtcaaggttgatcctaggggcaatgtctctttggagggctgccccatgaatggaactaccacgtttgacctgcccatcagcggcatgacctgtgccagctgcgcaggccgtgtcgagcgcgcgctgggcaaagtgccgggggtgcaaagtgtcagcgtcaacctggccaatgaacgcgcacatgtccaagtgcagggccagatggaccccggcatcttgatcgccgccgtcgacaaggccggctacaccgccacactgccgcaaagtgaaaccgtcaccgacgccaatcaagcccagcgcctgcaccgcgagcgctggtcattgctgctggcgattgcgctggcgctgccattggtgctgccgatgttggtggaacccttcggcctgcactggatgctgccggcctgggtgcagttcgccctggccacgccggtgcagttcatctttggcgcgcgcttctatatcgccgcgtggaaagccgtgcgcgccggcgccggcaacatggacctgctggtagccattggcaccagcgccggttacggcctgagtatttatgaatggctcaccgcccctgcgggcagcatgccgcacctgtatttcgaagcctcggccgtggtgatcgccctcgtgctgctgggtaaatacctggaaagccgcgccaaacgccagaccgccagcgccatccgcgccctggaagccttgcgcccggagcgggcaatccgcgtgctggatggccgcgaagaagacgtcgccatcagcgcgctcaagctcaatgacctggtgctggtcaaacccggcgagcgcttcccggtggacggcgaagtggtcgacggccaaagccatgccgacgaggcacttatcagcggcgaaagcctgcccgtgccgaaacagccgggcgacaaggtcaccggcggcgccatcaacggtgaaggccgcttgctggtgcgcacccaggcgctgggcgccgagagcgtgctggcgcgcatcatccgcctggtggaagacgcccaggccgccaaagcgccgatccagaaactggtggataaagtcagccaggtgtttgtgcccgccgtgctggtgctggcgctgatcacgttggtgggctggtggctgtacggcgcgtcgctggaaaccgcgatcatcaacgccgtcgccgtgctggtgattgcttgcccatgtgccttgggcctggccacaccgaccgcaatcatggccggcaccggcgtcgccgcgcgctacggcattctgatcaaggacgccgaagccctggagcgcgcccatgaagtcagcgccgtggtcttcgacaaaaccggcacactcacctccggcgcgccgaaaattgcgcacttggcggcagtggatggcaatgaagcgcaactgctgcaacaggccggggcactgcaacgcggcagcgaacacccgctggccaaggctgtgttggacgcctgcagcgaacaagggctgaacgtggccgacgtgactgccagccagtccctgaccgggcgcggcattgccggcacgctcgacggccggccactcgcgctgggcaaccgccgcatgctggaagaaaacggcttgaacgagggcgacctcgccactgccgccaaggcctgggaggccgaaggcaggaccttgtcctggctgatcgaacaaggcgcacaaccgcgcgtgctggggttgttcgcctttggtgacacactcaagcccggcgcactgcaagccgtggagcaactcaaggcgcagcacatcagcagccacttgctcaccggcgacaatcgcggcagcgcccgcgtggtggccgaggcgctgggcatcgacgatgtccacgccgaagtcctcccggccgacaaagcggccaccgtcgccgaactgaagaaaaccggcgtggtggcgatggtcggcgacggcatcaacgacgccccggccctggcggccgccgatatcggcattgccatgggcggcggcaccgacgtggccatgcacgcggcgggcatcacgttgatgcgcggcgacccgcgcctggtgccggcggcgctggagatcagccgcaagacctacgccaaaattcgccagaacctgttctgggcctttgtgtataacttgatcggcattccactggctgcgttcggcctgctcaacccggtattggcgggcgcggcgatggccttgtccagcgtcagtgtggtgagcaatgcgttactgttgaagacttggaaacccaaggatctggaggatcaacgcccatgaacatcggccaagccgcccgccagagcgggctgagcgcgaagatgattcgctactacgaatccatcggcctgctcaaagccgcgcaccgcaccgacagcggctaccgcgtgtacggcagcgatgacttgcacactctggcgtttatcaagcgttcgcgggatctggggttttcgctggaggaagtcggcaagttgctgacgttgtggcaagaccgacaacgcgccagcgccgacgtaaaagccttggcacgccagcatattgatgaactgaatcagaagattctggagcttgggcaactgcgcgatacgttgcaggacctggtggaacactgccagggcgatcatcggccggattgtccgattctcaaggagttggcgtcaggcagttgctgcgcctgacgatcgttcccacgctctgcgtgggaacgcagccaaggacgctccgcgtcccaaagcgtgacgcggagcgtcacaagaagcatccccacgcggagcgtgggaacgatcagctaccggaagatcactgcatccaaggcggcggcggttcctctgccgtcttggtcggtggcgcatcatccgccgcccgaatcgcttgcttacgctcttcatccaaccgcgccgcttcaatctcgcggatcacaccgccaacatccgccaactcttccggctcgtcgaactcgccagtcaatacgctggccgggtgcaaggtgccggcttcatacagcgcccacatttccttggcgtacttggtcttcttcaactccggggcaaagcgcccgaagtaggaagccatgttgcccacatcccgttccagcatgttgaacgcgtggttgttgcccgccgcatccaccgcctgaggcaggtcgatgatcaccggaccggtcggcgtgagcagtacgttgaactcggacaagtcaccgtgcaccaggccggtacacagcatcagcacgatctgggaaatcaggaaggcgtgatattcgcgtgcctggtccggctccagcgtgacgtcattcagacgtggcgccgcgtcgccgtattcgtcggccaccagctccatcaacaacacgccttcgaggaagtcgtacggcttgggcacgcgaacgcccgcaccggccagacggaacaacgccgctacttcggcgttctgccaggcatcttcggtttctttcttgccgaattttgagcccttggccatggcccgggcttgccggctgttacggaccttacggccttcctggtattcggacgcctgacgaaaacttcgtttattcgcctccttgtaaaccttggcgcaacgcaattcgttgccgcagcgcaccacataaacagctgcttctttaccactcatgagtgggcgcagcacttcgtcgaccagaccgtcttcgatcaggggttcaatgcgtttaggagtcttcatcagcttttattgtgggtcctttattaccaaacacgcgtatggcactcgttatacggcaatcggcccgccgcggggagaggctaccgacctttggcactcaagaatgcatccaatatgccaatttaactgcacaattcagcgttcgataatcgccgttacaccttgaccacccgccgcacagattgaaatcagcccacggcccttcccggcggcgtccaacagcttggccaggttggccacaatccgcccgcccgtcgccgcaaacggatgcccggccgccaatgaactgcctttgacattgagtcggctgcggtcgatggagcccagcggtgcgtccagccccaaacgggttttgcagtattccggatcttcccaggccttcagcgtgcacaaaacctgggcagcgaaggcttcgtgaatctcgtagtaatcgaagtcctgcagcgtcagaccattcctcgccagtaaacgcggcaccgcgtacaccggcgccatcagcaggccttcggcgccgttgacgaaatccaccgccgccgcttcgccatcgcgcaggtaagcgaggatcggcaagccgcgctccctggcccaggcctcactgcccagcaataccagggaagcgccgtcagtcagcggcgtggagttgccggcggtaagcgtgcctttttcgctgcgctcgaacaccggttttaggctggcgagtttttccagggtcaggtccgggcgcaggttgttgtctcgggtcaggccgagaaacggcgtgagcaaatcgttgtgccagccttcggcgtaggacgcggccattttctggtggctttccagcgccaactgatcctgttccgcgcggggaatctgccaggtctgcgccatcaactcacagtgttggcccatcgacagacctgtgcgcggctcgccgttgcgcggcagctccggcttgaggtggtggggacgaagttgtaacaggacttttagtttgtctgccatggacttgctgcggttggcttgcaacaggatcttgcgcaggccttcattcacgccgatgggcgcgtcggaggtggtgtcgacgcccccggcaatcccgctttctatctggcccagggcgattttattagccaccagcaacgccgcttccaaccccgtgccgcaggcctgttgaatatcgtaggccggggtttgcggcgacaggcgcgaacccagcacgcattcacgggtgaggttgaagtcgcgcgaatgcttgagcaccgcaccggcagcgacctcgccgatgcgcaggccgtgcaggttgtagcgttcgatcaggccttccagggccgcggtcaacatcgcctggttactcgccgtggcatacgggccgttggatcgggcgaaggggatgcgattaccgccaatgatcgctacacggcgcaattgagtcatggaaagctccctgatagttgtgggtggaatcatccagcctagcctaggctgatcgaacgactaccgcaccggggtggtcaaccctttgaaccccagccttcggagagcgttccatgtctgaccgttatatcgacttcgccaactcaagcctcggccatcgtttggtcgccgccattggcctgccgtcaccggtacgcctggaacgctggcaggccgggcgcctgcgcccggtagaaggcgcattgctgctaggcggcggtgcgctggcggccaacgtgctgccctttgccaacaagctcaccgacgcgatttacagctatggcgccgagccgttgggcgcgcccgcatggattcccgggcatggtcccaaactcaaggcagtggtcttcgatgccagcgacttgcagcacaccgaccaactcaagcaactgcgcgaattctttcaaccgctgctgaaaaatctcgaccacagcgcgcacctagtgattctggggcgcgcgccggaaagcctcagcgacccgttcgccgccagtgcccagcgcgccctggaaggtttcagtcgctccttggccaaggagctgcgcagtggcggcgtcctacaactgctgtatgtcggtgcaggcgccgaagaccagttggaaggcgccttgcggtttttcctctcgccgaaaagcgcctacatctcgggccaggtgattcgtctgcaagcctgcgcaacgccggtcgaggattggactcgcccgctggccgggcgcaaggcgctggtcaccggtgccgcccgtggcattggcgcctccatcgccgaaaccctggcgcgcgatggcgctgaggtcatcgtgctggatgtgccccaggccaaggctgatctcgaagccctggctgcacgcctgggtgcacgcagtgtgttgctggatatttgcgccgaagacgcggccacgcagttgatcgaacacctgccggacggcatcgatatcgtggtgcacaacgctggcatcacgcgcgacaaaaccctggccaatatgaccccggaatactgggacgcggtgctggccgtcaacctcaatgccccacaagtgctgaccaaggcgctgctcgacagcggcaccttgcacgacaatggccgcgtggtattgctggcttccatcagtggcatcgccggtaaccgcgggcaaaccaactatgccgcgagcaaggccgggctgatcggcctggcccaagcctgggcgccgttactgggcgagcgcgggatcagcattaacgccgtggcacctggctttattgaaacccagatgaccgcgcacattccgttcgccctgcgcgaagccgggcgacgcatgagctcgctgggccagggcggtttgccgcaggacgtcgccgaagcggtggcctggctcggccagccgggttccggcgccgtcagcggccaggcgttgcgggtgtgtgggcaaagcctgctgggagcataagcatggaatggcagaccttaggcactaccccgtttctgccgccgctgtattggcgcgcggccctcaagcgcaagatcaccggcagcacgttgcccgagcgcgggttgcgttgccgcgtgagtgtcaacgccaaggcggtggcggcctatcgcaacgtctgcggctttgccgacagccccatcctgccggccacttatccgcatatcctggcgttcggcctgcagatgcaattgctcaccgcaaaagattttccgttcccattgctggggttgattcacctgagtaaccgtatccgcattcaccggccgctgggcgcggtgaacgagttaacggtggcggtgcacgcgcaaaacctcaagccgcacgccaagggtgcaacctttgaggtgatcacaacggtcgaggattccctcggcctgctgtgggaagctgaaagccagatgctctgccggggcgtgaagctcgagggcgagccgacggataacgcgttgcccagccccacgcaggtcactgaactgactcgctggaaagcccccgccgatatcggccgccgctatgcccgggtgtccggcgattacaacccgatccatttgagcgccctcaccgccaaactattcggcttcccccaagccattgctcatgggttgtggaacaaggcgcacaccctcgccgcactgggcgaacacttgcccgccgccaacattgaaatcgtggtcgagtttaaaaaaccggtgcgcctgcccagtgaagttattttgctggcaagtgcacccggctccagcggcgagttgctgttaaagggcgccggcgatattgaaaatatgcgcggaaaatggcagcccattgcctgaaacacactgattaattgtatatatacacccaaagttatagcggaccttatcaggtccgcttttttatttaagccgttgatataaaacacatatacatcttgatacatcctctctttatacccttggtattagtcgctaagcgctgtaagacgacctgtatataaatcgttaataccaagttgagcgttgcgagaaagagcacctgggtctgtgatagccacacggacaaacgcatcgctatccctagaagtaacgagcgtttgaaacaaccaaggttgtacaggtgcaagggaactcaatcatgaaaactcaaactcaagtagtgctatggaaagcaagtaccgcgctggccctgatcatggcgatgagcctcggtggctgcagcagcggtggtggcggacatcacagcagtgtggcggcctcttctcctgacgcaggagccggtggtggtactggcggtggcacaggcggtggcaccggtggcggtactgacggcggcacaggtggtggcactggtggtggcactggcggcggtactgacggcggcaccggaggaggcacaggcggtggaaccggtggtggcactggcggcggcacgggtggcggaaccggtggtggcacgggtggcggcacaggtggcggcaccggttcgaccactaccccgctggtcaccggccaaattgccggcaccctgggcacaaccgtgggtaacgtcggcgcagcggtgggtgatcttggctcgaccttgaccggcgtacctatcgtcggtgtaaccgcaggcggcctggtcactgcgactggcaatgccgtgaccagcatcggcaccggcgtgactgcgggcctgggctcgctgggcaccaacagcaattcactgggcattaccgtcgcaggtgtaggtgacggcgttgccgacttgggcaccggcgtatcgaacaccggcaaatccctgggcaccaccctcggcggtattcctgtcgtcggcgggctgaccggtggcgtgggtaatgcagcaggcggcgtcgtcgataaagtcggccaggccgtgaccatgctcggtgacaccctcagcaccgccagtaccactggcccgctgggctcggtgaccaacaccctcggcagtaaagtcctggtccccgtcgtgtcgctggtggaaaacaccaccggcaacctcggcgacaagactggcctggccaacccggtcggcggcctgctggataaagtcggcaccactctcaaaggtgcgggcacccaagtcgccggcgccggcggtgcgggcaaccctctgggcacaattgtgggcggcgtgttgaccggtaccggctcggcactcgataagtcgagcggctatatcaacccggcttcgactggcccaacttccggtctgcctgaactggtcggcggcctggtcgccaacgtgggcaacggcctgaatgtcggcaacaccaacggcaccatcagcgcagcgggtgtcactggtggggcactgggcagtacggtcgcctccctcggcaccattatcggcggcaacggcgtggccaacaccgccgccactgcaccggtagctggcctggccaccaacgtcggcgcagcgctcaaccctgtgacctcgggtgtcgccaacctgacgcaaaacatcggcaccaccaccggcatcggcgcaccggtcaacggtttggtgactcaagtcggcggcgcagtcagcggtatcggcgccaacctgaccgcagccaacgccaacccgatcaccaacgctgtaggcaccaccgtcaccgccgttggcaacaccgtgggctcggtgggtggtttggtcaccggtggcaccagcagcggtggcggcttgctcggtggcctcagcgtaggtgccaacgcgtcggccagtggcagtgcaagcaccggtacaagcggcggcctgggcggtttgttgaacggcctgaccggcaaaaaatagaattgcacctggccgattagacggcctcccctacagcgcctacgcttggttgagacgagagaccctataagtctctcgtcttttttatggggcttgtttcaaaaaacattgcttggctctcccgaaccgcgtcccagaacccggcgggccagaaacgctgctgcagtttgaccatggagtgtcctatgcgcgtgttgacgccgttgttactgctcaccctcagtgcctacgtccaggccgagacccttcccagcttcctcaacagcaacgacaccatccgcaccctgccggtgccgaacctgcccgccgatgcctatcgaccggtcacgccccagacccaggtgcccgaggcgccggccacccaaggccagccgttgctgatggacaccaaagtcaccatccgcaagctgcagatcgatggcggcaccatctacccgctggacgagaccgccaaggcctacgcgtcgctgattggccatgagaccaaccttgcgcaactgatcgaagccacccgcagcatcacgcgccgctaccaggatgacggctacctgttgtcctacgcattcctgccgcaacagaccttcgaaaacggcctggtgcgcgtggtactggtggagggttacatcaaggattaccagcaaagtggcgatatcggttcggtctcggcctacgtcgacaaactggcgaataaactgctcgccgaacgcccgttgacccgcaagaccttcgagcgctacaccacgctgatgggccgtattcccggcgtaaccttgcaggcccaagtgccaccgccgggcaccaccgatggcggcacgcacatgacgatccaggccagccgcaagcccttcactaccagcatgagcctggtcgacaaaaaccgtggcggcacgcaagcgttgctcaccgccaccagcaattcgcagacgtccatgggcgagcagctcaacatcagcggcctgttcccaccgggcgacgacaaagaacactactaccgtttgggctacagccagttcatcaatgccgagggcacccaactggcgctgggcgccgagcgttatcgtgccgaccccagaagcaacatccagctcgacggcggcttcgaactcaagccgcaccagtcgatcgaccgctacaccatcggcctcagccacccgctgattgcctcgcccaacgaatccttgaccctgggcacgcgcctgtacgcggtggaccaaaccacccgttatcaactggtcggctaccccaaccgtttcgacatcgaaaccaacttgcgcgcgctggcgttcgagggcgactggcgcaagtccgacacgcgccaattgcgcattctcagcgccggtttgtaccaaggcatcaacggcttgggcgccacgacgcgcagcgatctggagggcacaaaacctgacctggacttcttccgcctgcgcctgtccggcgtgcagagcgacaagtttttcgataactggcagggcgtgctctcgggtgcgttctattggagcgacaacaccttgcccgacagtgaacgcgcgaccttcggcgggcagaacttcggccgtggctacccggatgaccagggctctggcgacaagggctggggcgtggcgtatgaggtcaactacagcttcaaccgtgccggcaattgggtgcgggtgctgcaaccctatgtggtactcgaccgcgccaagacctggttcaacgagctgccggtcaaaggcaatgacatgtcatcggcggcggtaggcctgcgctttggcgacaacaagtactacaacattgccttggaagccgccaaacccatgtcggacatcgcgctcgacagtttcaaccggcgcccgcggtatacgctgagcttcagctatcaactgtgagtggtgggagtgacctgtggtggtgagcaggtttgttgtggcgagcaggcttcctgtggcaagcgggcttcctgtggcaagcgggcttcctgtggcgagcgggcttgccccgcgttgcgctgcgaagcggcgccaaaacctgccgatgagttctaactggagagatgcggcgtctgggtcagggccgcttcgcgccccaacgcggggcaagcccgctcgccacagcaagcccgctcgccacgacaagcccgctcgccacaagtaagccaaacgacgcctacaggtgagtctttctcagtgggaacaggctgttgagcgtatcaatcaaccgcaccaggtagatgggcttgcgaaacaggtccagcacctgcaggcgcagcatgtcgctcacatcatccatctcggcatgacccgacatcacgatcaccggcaagtgttggcgggcggtgtgttcacgcaggcgtttgatcagggagatgccgctttcctcgggcatgcgcaggtcagtgatgaccagcgcaatgtcggggttcagggtcagctcctgcagcgcgtaggtgacggaggtggcggtaaaacaaacgaagccctcgttctccagcgactccgccagttctacgagggcatcttcttcgtcgtccaccaacagaatttgttggcgaaaaggtgcggatgcagcattcatgggtactacctggccttgctaatcaatcacaaaagtactcacagaatgccgtctgcacgatcacgttggcgtaatagccgtggtgattctggtaaacaacgcactgatctgtggcgacagcgtagtccctgcagccagtatcaccagcgctacaattgccacgagaataaggtattcaatggccgttgcaccgtcttcgcgacgaaacagcaactgcagttgaacatgaagtttaatcagtagatcaaggatcatgacactgctcctctggcgactgcgcgcccgatcatcaatttgtcggtgtaatggcggtagtaattttggtaaagaaggcggtgatctgtggtttcagcgtagtaccagctgccagtatcaccaacgctacaatcgccacaagaatgagatattcaattgccgtcgcgccgtctttgcgctgaaaaagcaattgcagttggacgtgaagtctaatcaggaaatcaagaatcatcgtactgctccctgggcggccaggcgccctagctcggtgctgcacagtaatcgcgatgtgccatctgagcattgtcaacaaaccccgcactcacaactgtaagaacggattaatcacaaagtagtgggtgctttgctgacgccttaaatccgtgatttctaaggctgagcactgcccgtcaaagaaatctttctgtcagtaatggcatttcgtcctagctgaactaccttcaaatagcgaaatagttagtccactgttcatagcagccgggttgcggatttgacctgttcggatagacgggttgtggtgcaacaggaaaaggagagccgtcatgaacacgcgtctgagcatgatactggccggtgtgcttttggtcggcgcgctgtttgccggttactggggcttggttctcagccgtgagcccgctgctgcaccaccgccgccgccacaaaccgctcctgccgaaaaagccgtcgccgtggttgaagaccagacccgccaaccggtggtggtgctggcccatgatgtgccgccctttgttgccctgaatgccgctgaccttaccgtagaaaaactgcgcaccgtgcccgccggcagcatgaccagtgttgaccaggccatcggccgcaccccgtggcgtgcgctgcaggccggcacctggctcaacgaggaaagtttcacccccggcggcccgctggcacgcatgattcgcccggatgaacgcgccctggccgttgccgttgatgaagtgatcggcgccgccggccagttgagccccggcgactatgtggacgtgctgctgtacctgcgccaagacaccgccaacctcgaacaatcggcccaagtggtcgtccccgccatgcgcctgctcagcgtcggcgaccaactgggcctgaccaacgacggcacccctgcgtccccgcccgccatgaccgccgaagaaaaagcccaacgccgcgcgccctcccgcaccgtggtgctggcggtgcccgagcaactgctgagccggttgatgctcgcctcccaggccggcaccttgcgcttggccgtgcgcagcagcgacgaacgcctgttgagccactactgggccggcgaaagcgatacgccggccaagctgcaaagcgccaaccgcgacctctaccaattcacccaactggccttcgcccaagccccgaaaaaagtcgcccagagcgcaccgcgccgctccggtgtcgaggtgatacgcggcaaccaagcaacccaaacaacgcccgactgaacaaggatgctgtgcatgacccgacgtttcgcaccggtgttcacgctgaaaatcgcctgtgccctgctgctgtcgaacctggccgtgggcctggcggtggccgccacgggcaactgcgccaacctcggccaattgcccgccgcgctgtcggtcggcgagggcttgcaacaagacctgcagtcgccggtggcgatcacgcgcctggcgattggcgacccgaaaatcgccgacgtccacctcaatggcgatcgcggttttctgctcaccggcatcgcttccggcaccaccagcctgatggtctggaccgcctgctcgaccacaccgcgccagagcatggtgttcgtcaagggcaaggccaccgccgccttgaccagcttgtcactggcgccagcggatgacccttctctccccagccaggtgcagaccgatatccgctttgtcgaagtcagccgcaccaagctcaaggaagccagcaccaagatcctgggcatgggcaagaactttttcctcggcagccccaacctgctgtttcccactcccagcaccttcaagctgccggtgagcgctgaccaattcaatatcggcttcggcggcgggcgcgtctcggcgatgatcaacgccctggaaagcagcggctttgcctacaccctggcgcgcccaagcctggtggccatgagtgggcaaagcgcgacctttttggccggtggcgagataccgatcccggtgcccagcagtggcagcgacaccatttccatcgagtacaaagagttcggcattcgcctgaccctgacccccaccgtgatcgaccgcaaccggatttccctcaaggtggcgccggaagtcagcgaactggattacaccaacgccttggtgattcagagcatccaggtgccggccctgaccatccgccgtacagacaccaccgtgtccctggccgatggcgaaagtttcgtgatcagtggcctgatcagcagcaataacaccaccaatatcagcaagtttcctggcctgggtgacatcccgatcctgggtgcgttctttcgcgattcttccgtcaaccgccaggacaaagaactgctgatgatcgtcactccgcacctggtgcagccgctggccgcgaacgcgcagctgccgtccttgcccggcgagaacctgcgcaactacgacccgaattggtaccgcctgtacttcctcgaaaacggtaatttcgaccgtaacaatgggttatctcaatgagcgatagcctgagccagaccttcctggcaatcacccgtaataccaccgacctggaatggctgcagggcgcgctggcgccgcttggccaagtggtcagcgccggcagtggcaccctcgacgagctgctggcactggtcgacgtgaccttcgccaatctggtgtttgtcggcctcgaccgcgagcacgtggtggcccaaagcgcgctgatcgaaggcgcgctggaagccaagccgatgctggccatcgtcgccctcggtgacggcatggacaaccagttggtgctcaatgcaatgcgtgccggcgcacgggattttgtcgcctacggttcacgctccagcgaagtcgccgggctggtgcgccgcctgagcaaacgcctgccgccggtgaccaccaacacgcaactgggcggcctcaccgtgctgtacggcacccaaagcaatgccgacggcgcgctgctcgccagccacttggcgctggtcgtccaaaagagcggccagcaaaccctgctgctcgacctgggcctgccccgcggtgacagcctggcgctgctgggcctggaaagctcgttcaatttcggcgatgccctgcgccacctgcggcggctggacgcgacgttgatcaacagcgcgtttacctccgctgaagacggcctgcgcatcctcgcctacgcctccaacgacgagccgctggagcagaccagcgccgccgagctgtacatgctgctcagcgccttgcgccaacacttccagcacattgtggtgaaccttgccggccagccggacagcgaagcgctgcgcacctttgtcagccactgcgacaagctgctctggtgcaccgaccaaagcgtgctggactgccgtcgcaacctcgcggtgctgaaccagtggcgcgaaaaaggcatgaaactggagcacgccaagctgttggtggatcgctatatcaaaaactgcgcgcccgacgccgacgccctgagcaagagctatgggttggaggtaatcgccatattgcccctgagcccggaggtgcgcctgaacgcgaaaaaccaggggcaaaccttgttcgccctggccccgcgagaacccctgacccacggcctgaaaaccctcggcgaccgcctggcaaaacgttcggaaggcatgaaaaagccgtcacacaattggtttgaacgcctgctcggatccggcaaatgaacggcgaaaaactcttcggcgcacccgctcgcggcgtcggcggcaacaccgaccacgatgggctgaaactggtgctgcatcgctacatcatcgacgccatcgaagagtcggggaagaatttgcttgagggttcgcgcccgctgctggcgcaatttgtcatcgacaaagtcgccgaatacatcaaccgcatgcacctggcgatatcccgctacgagatggagcgcctggccgaagaaatcgttgatgagctgaccggtttcggcccgctggaagtgctgctgcgcgacccgtcggtgaccgagattctggtcaacggcccgcaccgggtgtttatcgaacgtgacggtttgctgcaccagagcgacctgcgatttatcgacgcgcaccacgtggagcgcgtgatgcagcgcattctggcgccgctgggtcggcgcctggatgagtcgtcgccgatggtcgatgcgcgcctgcccgacggcagccgggttaacgcgatcatcccgccgattgccctggacggtccttgcctgtcgattcgtaagtttcgcaaggacatgctcaaaagcagcgacctggtcgcgatgcagaccatcgaccagaacatcttcgatttcttccaggaggcggtgggcaagcgctgcaacatcctcatcagcggcggcaccggcacgggtaaaaccacgctgctgaatatcctcagccagttgatcaacccgcatgaacgtctggtgaccatcgaagacgtcgccgagctgcaactgggccacccacacgtggtgcgcctggaaacccgcccgccgaatgccgagggccacggcgaggtcaaggccagcgacctgatccgcaacgccctgcggatgcgccccgaccgcatcatcctcggtgaaatccgcggcgtggaagtactcgacgtactcaccgcgatgaacaccggccacgacggttccatgagtaccgtgcacgccaacaacgccgccgatgcgctgctgcgcctggaaacgctggtgggtttgaccggccgcgtggtggcggaaaaaaccctgcggcagatgatctgcgcggcgctggatgtggtgatccaactgacccgcctgccggatggccgtcgttgcgtcagtgaagtggtcgaggtggtgggcatccgtgaagacgtgtacgtgaccaacaccctgttccgccatgaccggcgcaccggcttcggcttcctgcgcgaggcggtcaacccggccggcgaaaaattgcgccgcgaaccgatactgccttgaaggggacgcaaccatgaccggggccatcctgctgctcatctgcctgatcctgatcggcctgtcgattcgctccttccagaacggtttgcgccgcgcccagaccgaacgcgtactcggccgccttgccgaaggccagccgcagctggtcgaagaaaacagccagtggagcggcgtagaacgcatgttcctgcgcgccggcctgggcaagcccagtgacaacctcggcctgtggctggccgtgtggggcctgggcgtggtgctggggttactggtggccggttgggtcggcctgctggtgatgctggtgctgccgcccttgctgctgcgcgtgtacatcgcctggcgctatcaacggcgcatcaagcgcatgatcgaacagctgccgcaattgctcgaccacaccgtgcgcagtctcaaggccgggcgcaccctggctgacgcggtgctgggcggtatcgagatcactgaagacccgctgcaacaagccatgggccgcatccgccgcaacgtgcagctgggcgtgagcctgccggaatcggcccacgactttgccgaattttatgagcgtgatgagttccgcctgtttgccctgggcttgaaggtcaaccaccgctatggcggcaacgccagcgaactgttggaaaacctgatcaagatgatccgcgagcgcgagcaagccgcccgccagctgcgcgccctgaccggcgaaacgcgggtgaccgcgtatgtgctcaccgccctgccgatttcaatgatcggctacttcctggcggtgaaccccgcgtacctgatgaccatgtgggacgacggcaccgggcgcatcctgttgttcgtggccttgatcatgcagctgctggggtgcttcaccttgtggcgcatgttgcggagcgtatgagatggcgattgcactgctgatcagcgctgtactgtttatcgccgccctgctgctggtgctggccaacctgctcaaacaccggcgcggccagcgcctggttgcccaacgcttgcagggccagatggcgcgcgaacaccggttcggcacgctgatgcggcaactgggcagcagcccgctcgcgcaacgctcggtgagcctggacaacgaaacccaggtgctgctcaaccgcgtcggctggcgtaaagccaaccagcgctcgatgttcgccgccttccaggtcggcacgccgttgctgctgttggtggttaccttagtgggccagcagttgctgtttcctaacgtggcctcaccgtggctggcgccgctgctggccctgggcatcggctacctgctgcccaaacgcatcctggccagggcagccaaagcgcggcagcagcggatctcccgcgaggtgtcgaccttcattccgctgctgcgcatcctgttcgaatccggcatggcggttgaacaagcgctgcgcgtattgagtaccgaagcgcaacgcctgttgccggcgctgacctttgaactgcgcctgatcctcactcgggtcgactccggcctggagctgagcgaggagctgggcaagaccgcccgcctgctggccgtggatgaattcaccgacacctgcaccatcctccagcaactggttcagcaaggcggcggcgcgatgaaatcgttgctgtcgctcaagcaattgctcgatgaccgacgccttacacgcatccaggaattcgtctcgaagatgtcggcaaaaatgtcggtggtgatgatggtgtttttgtttcccgccttgctgatcgtgctcggggggccggcctttatcggcatcacccgagccttgagtaacttatgaggagcgcccgatgagagccttgatagccggttgtagcctgttgctgctgggcggttgcgccagcaacggccaagccccgtgggacgcgttgttggccaccggcagttgccccaagcccagctccgagcaggaactgtcgttgaacctggccgatgaaatggccggcgacggcaagctgcacgccagcctcgccaacttgcaaagcctgccggcgaatctgccccaggtacgcctgcgccaggccaaggcttatcgcctgctcgggcgcagcgaagccgagccgttgtaccgcagcctgatcggcacctgcatggccgccgaaggcgaacacggcctggggcaaatcgcttcggccaagggcgataacgggcaagccatggcccacttgcaacgcgcggcccggctggcgcccaccgacgagaaaatccgcaatgacctgggcgtggtctacctcaaccaactgcgcctggaagacgcgcgctttgaattcatgaccgccatggagctcaagcagagcgacccgctggcagcggtcaacctggtgactctgctgatctatcaggacaactggaaacaggccgcgcaactggtcagccagatgggcttgagccccgaacaagtcaccgaagcccaggcccgcgccgaaaaactaaaaggctcacgcgcacctgtggccaaggccaaggatcaagtcgccgccgtcagtgacgccgcaagcaacccgaggaattgatgatgaacatgccttatctcgccagcctggccgtgctcgcgttgcccatgagcgtcatggccatagaacccggcccgtcgtcaccgcagcaggcgctcaccgagcaatggttgacgttgcagtccacgggtagcgccgcgtcgcagaagccgcaaaaagcctcggcggacgaacgcgacagagccaaccagcggtttctggacagttacaagtatccgattccggagtatttcgagcagaaggtgggcgggaaaaccgaagggagtaattgagtaagtttctgccaggccactctctaaatgtgggagcgggcttgctgtggcgagcaagcttgcttgcgctggggtgcgaagcgcccccaaaaagccggctccagctgcgctgtcgaacgggagcaagctccctcgccacagcaagcccgctcccacatttgttgcaaaatcagtgtgcagttacccgctgacgcaacgccgagttgttaggcgacaacgccaacgccaattgcgtacggttatgcatgtgcgtcaagcgcagcacctgggacacatacaacttcacggtgttttcagtaatgcccaattcgcaggcaatctgatagttggtctgccctttccccaccagccgcgcgacgtccaattggcgcggcgacaactggttgaaaatcgccggaatttccaccgcccccacgtcctcggccgagagttcttcgctgtccaatccaggccggctgctgcgcactttgtcgaggtcctggtacaggtcgttgatcgactcggaaaggaactgcagcttctggttcaagttgcccagttgcaggtccttcttgcgctcttgcaacgccgcttcctggcgctgcaagccttcgagcaattcatcgagattaatcggtttttggtaatagtccgcgatccccgcacgcagggctttgatcacatcctgcttgtcggcgcgaccggtcaacatgatcgcctcgaaggcccgttgtttaccggcaaccttttgcagggcctggaccagctcgatgccgtccatgtccggcatgtgcaggtcgcagagcaccaggccgatctcggcgtcttcgctgaaacgcttcaaggcctgttggctggactcacacgggacacagcggaaaccgctgctttcaagaaattcacagagctcttccacgatcagcggttgatcatcgacaacgagcacttttaccgcagaggtaagcttgttcacgcgctactccatgcctagcaagccaaatgtttgactgatccttgacgacacatattcccgtacatctatgtattaaacgtagacgtactttccgactatgtacatagcgttaatacccgctggcgactaatggatccaaaaccaggcggcggcaaaacccaccaatagaaacggcgcaaagggcagtttttttgacggttccgcaaccagataacccatacccttcttaagcccatgactcataagcgggattagttttggcgcgcttaaaatccacagcccattggccaccgtagcccctacaaacgaccacagcaggtactcggcatccgacgccagcgccaatgccgcgagcagcttcacatcgcccgcgcccaggcggccgagggcgtaacccggcaaggtcagcagcagcgccagtaaaaacgccaaaaaaccttgcccggctggcgcacccagccaggtgctgtccgtccacagcgcatagatcaacgccaacagcactgcgcccagcgtcaggcgattggcgagcaatcgctgccgaacatcctgcgccgcacacagcaccaaccacaccaacaccactgcgccatggatcacgtaaaaaacatccctttttgccgattgattctatgctgatatcaagtagtagccgtcagggtagacgcggtgatgagaacaagcctcccgaagaagcaaaaaggcgcggcagcaatcgagttcattgctgtgttcgtgatttttttcgccgtgttctacggcatggtcagctatagcctgccgctgctgctgttgcagtcgttcaaccaggcgaccgccgaggccgtgcgcctgagcgtggcgctggaccccaccatgaccggctatcaggccgccgtccaaagcaccgccaaagccgccgtcatcaaccgcttggtgtggattccctcagcgtacaaatttaacgccaaccaagtcaccaccaccttcgtcggcggcttgctgtcagtgcaaatcaactaccccacggccaacctgcaggcggtgatgccctttattgtcctgcccggcatcggcaccgtgccgcagttgccggcgacgctgcaggccacctcgagcctgcagttttgacttcgggggacaaactcttcgggcgcctgctcggtcgcagcagcgcgctggccgtcgacacaccggtaccggtgtctgccgggctgcaggtgtatttggacgcgcaaggccgtgtgctcgacatcagcggcacgctgcgccaacagttggcgccgtacgccgactcgccgtacctgcagaacctgctgtgcccccacagcgcgctgacggttgaaggcgtgcccgccgattggcagcgccacagcctcgatctggatttccagggcgtcgccgggcaaatcctgcagacccgcggcacgattgaagcccacgacagcggctggttgctgcatgccatggacattggcgacttgctcaatggccgccacctggccgagcagcgtgaacagaatcagcaactggccagcctggtgagtgagcacctgcgcgtgtgcagcctcagccgattgcctgaggtgttcaacgaacaactggccagcgtggcacagcgctggcgcatcccgtgtgtggccctcgcgctgctcgatcaggaagaccagggctggatcatctacagccagtacgccaaccatgacgcgccgatgttctggcacaacgggcagcgcctcggtacgtgcctggacagcctcaacggcaccacgccgctgagcttgcaggcgccttatgggcgtggcgagcacccgcgcttgcacagcgtgttcggcaatgccgatggctttctggtgccgtatcgcgatggccaaggcgtggccgcgtggctgctgtgcggggcctacagcggccagccgcagatgcgcgaccgcgactggctgaacctcgccgccgccctcgccgcgccgctgctcagccgtctgcgcgaacaacgccatcatcaacaactggagcgcctggaagccctgcaaggcttgctgggcactggctggttcgagttgttgccggccagcggcgagatccaactcgccccccaattgatgcgcaacctcggcccggaacaagccccgacgcgccagcccctggacgcctggctggaactcatccaccccgccgaccgccaggaactgcacagccgcctgcgtgacctgcaaacccttggcaagcccttgctcgccagcgtgcgcctccaccgtggcaacagcgcccagccgccgacctggtatcgcgtgcagggccaagtgctgggccagggtgatcagcggcgctgggtcgggttcatgctcgacatcagcgacatcaagaaccagcaggtgcaagctgatgccgcccacgcgcgcctggacaacctgattgccagctcgccggcggtgatctacgtgcaacgttatgtaaacggtgcgctgctgccggtgtttttcagtgacagcctgctgccgttgttgggccgcaccctcgccgagtgcagcctcgacaacctggtgcaatgggtgcaccccgacgaccgcgacctgtacttccagcgcacccgccaactgctgcgcgaaggcagtgtgcgcagtcgttatcgggtgcaggataaacacggcgattaccactggctgctcgacgaagccaaactgctgcgcgatgacttgggtgtgccggtggaagcgattggcctgtggctggacgtcaccgacgcgactttggccgcgcaacaggtcaaggacagcgaagagcgttaccgcatcctggtggaagattccccggcgatgatctgccgctaccgcccggacctgaccctgaccttcggcaacacaccgctggccaactacctggaatgccggcccgctcagttgcgcgggctgaacctgggcgactggctgtcggccgaacagcgcgaagcatttgtgcagcgcattcagcaactgacgctggagtttccggtgagcaccgccgaaatcagcctgcaactgcccgggcgcgaacatgcctggtgggtgtggtcggaccgtggtgtgtttgacgagcacggcgccttggtcgaggtgcaggcggtgggccgcgacaacaccgaggtgcgccgctcccaacagcaactcacgcaaagcgcgaaaatggccacccttggcgaaatggccacgggcctggcccatgagatcaaccagccgctgaacgtgatgcgcatggccatcgtcaatgtgctcaagcgcctgagcaatggcgatgcgcagatcgattacctgaccgaaaaactccagcgcatcgatgcccaggtgcagcgggcggcgcgggtggtcgaccatatgcgcgtgtttgggcgccgctcggaagtcgaacagcaacccttcgacccggcgcaggcggtcgagggcaccttgtcgctgctcagcgaaggcctgcgcggcaaaggcgtggacgtgcgcctgacccaggcggacattcccgtgcaggtcaaaggctatgtcgaccagcttgaacaggtgctgatcaacctgatggtcaacgcccgcgacgccctgctgggccaacgcgagaaaaacccggagttgcgcccgtggatcgccgtgcacaccgaacacgacagccgccatgtgcgcatctgggtcgaggacaacggcggcggcatcgacccgcgcttgctcgagcggattttcgaaccgttcttcaccaccaagccgattggcgtgggcaccgggctgggcctgtcggtgagctacggcattgtggaaaacatgggcgggcgcttgagcgtcagcaacggcgaatacggcgcgcgcttttgtgtggaactgcccagggccaccgaggcttaaatcaccaggtaggcttcgccggtctggccgcaggtcaggttggcgccgacggttacgttcgccaggctgatgcccagcatattcagcaggttgttgaggattgggtccagcagcgggccgagcaggttatccaccaccggcgtgacaatggcgctgacgccgccgataagcgaggcgacggtcggcgccaatatacccaatgggttcccccctgaaggctggaaagccgtaatgctcacaccgttaagtgcagtggaaacgccgcttaccagattggttgccgaggcagctgcctgataggtcggcgggagccccacattcggtggcgtggcgaacggcgtggtgctggaatacgtcaagtcctggatgctgttgctcccagcgattttgctttgtacctggatcgcaagaccacctgcgccaaacggtacgcgggggtcacaagagccaatacccagaatcttatggcaggtcttggtgccaatatcgaccagtgccataggcgccactgacatcggctgcgtggacgaaaaggcattggtaatgttgcccacattcagcgaagcgagcgaggtggaggtgtgggctgtcacacttttagtgcccgcgttgccagtcgggcagctgtaggcggtgacataactgctggcgcccccggcatccagcacaatagtgagcggcaagttgcctggtaacaccagcagatccaactgctggcagccggcgcccagcaaacacaaggtcgagttgatcgtggtcaccaggttcaagctcaacaggccgctgagtaccggagtcagcgggcctaccaagtcattcacggccgtggtcagccccgacaaactgcccagcaccggcaagctgacggttacttgcgcgcgcaacacggcagtacgcacgtaaatcgcattcgggcctgtggggttggccaccgccagcgccggatcgccgatggccgacaactgcggcggttcgatcactttgatctgagtggtgatgttggccagcccgagcaggctcacaggcagagtcgccgacgccgcgctttggttgctggacaactgcaccacgccttgaatcagctggaacacctgcagattggcattcagcgccgcagacgtggtgccggtttgcaattgcaggattttcccgagggtcagcggtgccgagctgatcgcggcaactttcagactacccaaggcagtcaatacatccgccgttgcaccattttttgtcagcaccgtgatcgccgcctggaccagctgcgaggccgtgacgctggtgctgagcaattgagtgtagttaccggcggtcacgcccaggttgatcgccagttgatcgaggtagttgagcaggctgatattggtattgagcaagccgttccagccagcgacggtcaggttgacgttaccgcccaagagcccgctgaacaggctgttcaataggctggcactggcggtatcgacgctggccagggtgcttttgatgctcagttgggccacggttggcgtgggcttggccgccaccgccgtagcgctcaataccgtattgaggctgaccgagttgcccgaaaacagtgaccagatcccgccggccacactggtcgttacggttttgctggcaaccacctggatagccgacgacaacgccgggttggcgctgaacgtgcgctggcccgaggcggcagtggtgacggcgccacaactggtcaccagggtattgccgttgcccaccacgaaatggttgcgcgccacgctttgcccggcataagccgccgcactgaggcccgccaggcaggtgccattgcggctgacggcttccagcgccgcggtgtctgccacgccctgcaacttgcgtttctccaggtacaggcggccgctgtcgaccaccagcaaggtaaaagccaataccaccgccaatacgccgacggccattaagccgatggcgccgcgctgcttgcactgaaatcggggagacatcgagcactcctgtgccggcgagtcgccgagcgcttactctcctggggtgtagttgagtgtagacaaggcctgaggagtgcgctgattcaaggctgctggagatcaaatgtgggagcgggcttgctcgcgaaagcgtagtgtcagtcactgcatcacttactgacccaccgcaatcgcgggcaagtcgaatcgtcgcaccgccgctcccacaggggagctgatcgttcccacgctctgcgtgggaatgccgccccggacgctccgcgtcctgacgtttaagccttgcgagatatgacgcggagcgtccccggatgcgttcccacgcggagcgtgggaacgatcattggggggttagtgcggtgggtagttggagaggattttggtgacggtggtgcggatagcgttgctgcgatcctccgggttcggcgagctggccatcatctgttcgtcactgccgcgccacaccagtttgccgtccttgccgtccagcaagtcgatctgaacggttgccactttgtaggtgatgttgcgcgtttcgttgtacatcggcgcgccccagtagccattccacgggccgccccacgcgccgccgtagttggtggtgacttgttgctggcggtcttcgacgatcaggtaggcctgtacgttcaggtctgccttggtgcccgccgctgccgggcgcaggccgcgttggtcaagttgttcgcccaccgcctggcggatgcgttgctcggtgaggtcactcttgatgcgtggatcatccgggcgatattgcagggccgggtctttccaggcccagttgcggtaggcgccgaagtcgcggctggcgtcaaagtcgtggttgacctgattggtctggcagccgcccagcactacaacaacagcaagtgcagcaatgcgacgaagcatggtttttctccagaagacaaactgagcctgcgatgagaatagcggctaactcggcggataagcggccatggctttctgcatagcctcgcgcagggcatccgcccgttcgctgaggctgccctggctggcggtttcggcgctggtgctccacacaggctgacgggtgcgggcgtcgaacaagctgatgcgcgccaccgcgactgtcacttcataggtgcgcaccaccggcaccgtgttgtacatgccgtagccgttgccgtagcggttatagccgccgtaaccgtagccatagtcgtcctgaacctgacgcaggcgtttttccaggcgcacgtcggcgctgaccagcaggtcgggcgcccggttgtcatgcaaggggcgcaagccacgctggtcaagggcgccgctgaccgcttcggcaatctgcgccgaatcggcccacgccgtgcccgccggtagctggccgttgagccaggcccagttgcggtaggcgccatagtcgcgcaccggcgccgggtaggcgctggcatcaaaggtgttggccgcctgcgccggcgccggtggcatgggcgccgaggtggccacgtaaggattggggctggagcaggcgctcaagcccaccgataacaggatcaaacagagacgacgcatttcgacctccgcagactgggccgcttaaaccggacggcagatccagtgcaaataacgcccaagtccggcaaagcttgggtgacgacggtgagcgagttccatctccaacaagtcctgtaaatcggcgcgggcctggaattccaccggcatatagtcgtggaacacccgcacgccactttggctttcgacctgccaaagcccctctagttgcgccgccaactcacgcgggtcgagcggctgttgcggggtcaggctctgcttctcgccagccatgtcgttcttgcgcattttgcggaagtggcctttgagcaggttgcgataaatcagcgcatcgcggttgtagaacgccagcgacagccagccacccggcaccgtgagctggtgcagcaccggcaggatcgcatggggttcggccagccattccagcacggcgtggcagagcaccaggtcgtaaggctcggtgagttggccgagcaggtcttgccagggcgcatggataaaggttgcggtctgcccggcgtcggcaaagcgctggcgcgcgccttcgagcatcggctcggcgggttcggccagggtgacttggtggccgcgctcggccagccacaacgacatatgcccaaggcccgcgccgatatccagcacccgcagcgggcggtcgggcagcgcttcgatcaggtcggcctggagcaccgccaggcgaatcgcgcctttggcgccgccgtagattttctcggcgaagcgcgtggccagttggtcgaaatgacggtcactcatgggcaaaccgccgttcgctgtcggccaatttggcgcgcaccacctcgttcatgtccaggcccaactcactgcacagcaacagcaggtacagcacgatatcgccgacttcctgcccggcatgggcgagtttttcggcgggcagctggcgcgattggtcttcggtcagccattggaagatttccaccagctcggacatttccacactggcggccatggccaggtttttcgggctgtggaactgcttccagtcgttgttatcgcggatgcggtgcaggcgttcggtgaggtgttcgaggttcatgcgggggctcctgaaggtgtatagcttcggggggatcagggatgaaggcaagtgaatcccggtggtgggcttgagggcgccatcgcaggcaagccagctcacacattttaaatgtgttcacaattcaatttgtgggagctggctttcctgcgatggcggtttaatcgacgacgctgaactcgaggcgggcggtttggccggcttcgtcgaggacgctgagctggtagcggccgaggtgttcaaagctggcgttgatgctgtcctggttggcgctgtcgcccagcggcgcgccgttgaggaaccaccagcgtcggccgctaccgcccagggcggagattttcaggcgcagcgcttgctggctggcggcgggcaggcgcaactggtcgccttcgcgaacaccgacaatcgacaacggcgacgccgccgccaacgccggaggcgggcaatcggggtcggcagccgggatacgcgcttcacggcgttcgacccttggcagccacggctccagcggcgccggccacaaggcgatgtctttggccacagcacctgggcaatgggcatcgacccgcaaacccttggcgttaacccacaccgtttccttcaagcccacacttaatggctggtccaacgcctgcaaggtgggcggcgtggtgttgtccagtgtccaggcaaagcgctggcgacggcaattcgggtcgctgcgactcatcggctggcccagcggccaacagatggccgcgacgccgacattggccggcaccggtctgacaggcgcgctgatcccgcgctggctgtcgcggttggtcagcacgtcatgcacctgcaacatcaacggcgccgccgacgccaggccgaactggcccggcaccggcgtgccatccggtcggccgatccacacgccgatcaagtagcgcggccccacaccaatcgcccaggcatcgcgaaagccgtagctggtgccggtcttccaggccagcaccgggcgctgcaccagctcggcacgcgggtcgcggtcaggtcgcgcctgaccgctgaggatacgccgcacaatccaggcggcccctggcgacaataaaggccgctccttaagcgcatcgtccggctgcaagcggatagccgcactcttgccgtcgcgggcgaaggcgctgtagccgctgaccaagtcttccagtcggctgcctgcaccgcccagaatcaacgccaggtttggctcggccagcgccggcagcgccaagggcacgccgccgatgcgcatttcggcagcaaagcgcttcggcccgtaggcctccagcagttgcaccgccggcagattcagcgaactggacagtgccgtactcgccggcaccgcgccgctgaagcccatggagaagttgcccggccggtaatcgccatagcgccgcggcacgtcctgcagcagcgattcggagtgaatcagcccatcgtccagcgccatgccgtacagaaatggtttcaaggtggaaccgggcgagcgcagcgcgctgatcatgtccacgtggccgaagcgtttggcgtcattgatgtccaccgaaccgaggtaggcgcgcacggccatgctttcttcttccaccaccagaatggcagcggaggtgtgttccggcagccgcgcgcgccagcccagcagcaggtcttcaaggcggcgttgcagcgtggcgtccagagtggtgcggatcagcggcgggctgtcggggcggttcaggcggcgggcgagcaagggcgccaggctcggctccaggcgcggggcgagcagcagcggttcttccagggcttcatcgaccgccgattgcggccacacctggaactcggcgagacgccgcagcactttgtcgcgggcttgctgggcgcgttgcggatggcggtccgggcgcaggcggcttggcgcctggggtaatacggcgagcaaggccgcttcggcgtgggtcagttgtgccggggacttgcccaaatacgcccaactggccgccgccacgccttgcaacgtaccgccaaacggcgcgcggttcaggtacaggttgagaatctcgtccttggacaaatgccattccaactgcgcagtgcgccacagctggcgcagcttgccgtggaacgtccgcgaatgcgggtcaagcagccgcgccacttgcatcgacaaggtgctgccgcccgacaccacccgcgcgccggtcaagttctgccaggtcgcccgcaccagcgccaacgggttcacgccggggtgttcataaaaccagcggtcttcgtaggtgagcagcgcatccaggtaatacggcgacacctcacgggtttgcaccggataacgccacacaccgttggcatcagcaaaccgccacaacggcgtgccatcctcggccagcaccacccgcgccaagtcatccttggacaacggcaacggccaaatccgatccgccagccacaacagggcaatgactgccaacacacatccaaatgcccagcccagtaaatgtgggagcgggcttgctcgcgaaagcgatttgtcagtcaactcactcacaactgcttcaccacgcccacaactaatcgcaaattcaaccccgcaaacctctatgcttcatggaactagccgcgacccatcgcgaacaaaggctcagtgctggcaatttcgtccacttattcatcgagacacacctatgcaagtagactttttcggatggttgggtaacaccgttggcttgatcatccactacatcgtcgagttcttcagtgggctgttcaacatgctgtccaatgctggcggcaacttcgtcgagggcatgtcccgctcactgggcatggacacctcgatcatcagcatcatcacgctgatcatcggcctgctgttcctgtactcggccgtacgcgccttcatgcgcgcctcgatcatcattggcgtgatctggctgatgctcggcctgtggctgctgagttgggttgtgcactaaaccccaagcacttccccaattccctgtgggagctggcttgcctgcgatagcggtaggtcagccaccacattgtttgcctgatgttccgtcatcgcaagcaagccagctcccacatttgaaccccgcaggcctcagcggcccttgatcaccagatccgccggcgtctcccccaccgcctgccagtttggccggtacatcgactccacctgcggtggcggcacgcggtacgtgcccggcgtcaccgcccgcgccaggtacaacaggtgcgtggtgccatagccgtccaggttcatcgccgccacatagcggtcatcgcggaactcctgatgcttgagcgacgcgttctgcatcgactcgcgccattccttcacctggctgctggcgttctccaggctggccgcgctttgcgccaggttctggttttccagctccaggcctgccggcaaaaggtcgaccaccaaggcgtccggcacccgctgcttggcactcaccgccaggtgcaccagcaccaaatcaccactgtttacgttacgcaggttcaacggctggccgttcatgcccaggtactcgcgacggatgctcaggttgtcgccacccgctgccggtggcacttgcgggtaacccgaaatcgtcagttgctggtacaccggcgcctcgccctgattgctcaaggccaagtcactggacagcagtttgccgtccagctccaatgtcgactgttgattgttcagctcatgcacaccgccgctgccggtcagcgacacctgccagttcggctccggctgcgagaacccaaggcgcccggccaggaacagcgaattacgctcctgggtcgagaggtacgggctggcggccaactggtccgacagcgtgaacaaacgctcctcgcgcttgcccttggccaagtcgttctcttcgagcagtgccaggatcatcgcttgatcgcgcagcgggctgccgtagtcggccagccactcattggcgttgcgttgcgccgccaaaccggcgagcaaggcttgatcggcacgcggctggtcgcccattttttgcagggcgatggacaactgcaccaacggcaagccggagcgcgcatcgctacggcgttcgaaaatactgcgcaacgcgcccaatggcgcctgctgactgcgcgccaacaccatgccggcgtaggcctgcacggcaaagcgggtgtggtcggcgttgtcgctgtaactcacctcaatcaggttgcgctcctgcacataccgcagcaggcgctcgctggcttttttcagtgcttcaggcggcacggcgaagccctggtcgcgggcgcgcagcaggaagtcggtgacgtaggcggtcagccaatattcctcttcgccatcggcgccccacaaaccgaagctgccgttgtagcgctgcatgcccagcagccgctcgatgcccagttcgatcttgcgcttgcgctcgctgtccgcctcgcccttgacgcccaggcgcttaagcaacgcagcgtcggcatacagcgacggatacaaaccgctggcagtctgctccaggcatccataagggtaggccttgagcgcgcggatctgcgcaccgaggttcagcggtggccgactcgacaggctcagcagcgcttcacgccccgaggtatcgaactggtccaaagtcccgacaggcaggctccacggctgatccttgagcactgcgcggtaatgcttgagcaatgccgggtaggccgggcgtacgccaagagtccattcgcggctgaacggcggcaggttttcacccggcaggtccaggccattcaccgtgacgctgaccttgccctgccccaagccgccccaggctttcaccgggatacgcaaagtggtgcgctggccttgcttgagttccaccgtctgcgcagcgctgttgaccaactccaactgcccttcggccctcagttgcacgtcgagcttctgcgctttgcccgacaggttggacaggtccagcgccaacgtcgtctggtcaccaccggccaggaagcgcggcgccgacagctcggcaatcagcggcgcggcaatcaccgtcttgccttcggccatgccataacggtcatcgctccaggcctgggccatcaggcgcaactcgccgttaaagtcagggatattaacgctgacttcaccttcgccctgctcgttcaaggtcaccggcgcgctttgcaacgcgacgatggtcacgctggtgtccgggcgtttgccgcccttggccagcgccgcgtcaccaccaaacgccaggctggccaaacggccctggccggcttcgatcaactggccgtagatatcgaactggtccacgccataagccttgcgaccaaacaggctggagtacgggtccggcgtcgggtattcggtgatattgaggatgcccacgtccacagccgccagcagcacatgcacctgcttcggcacgctgccatcggcgttcttggcggcgatcttcaccgtcagcgcttgtttggggcgcattttttccggtgcggtgagggtcaggcccagtttgcgctgggtgcgatccagcggcaggtgtagcaggccgacggcacgtttgggggtgatattggccttgcgctcacccgggcgaatcaccaacgcgctgacgtacaggtcatggcgcgaccatttcgggtcgagtttcacggcgaagcttttgccctcggccggcacatcgatttcctgccaccacagcggcccttcgctggactctaccagcaagtagcccttgccggccgccggtggcgtgacggtgacagtggcggtatcgccatcgccgtacgcgggtttatccagtgccaacttgacttggtccgggcgcacggcgccgccttcggtgttgtcctgggcctggtagccggcccagaaacgcaggctgctgaccaagccggtttgcgggtcttcgacttcaacgcggtaggggccccactccacctggaagctgaccttggcggtgtcgccggccttgatgttcagggtctgctcgtcgaggttgaggaatttctcgttgaagtgataactccagccgtcactttccgagtagttccagtagtagtcgcggcgctcgcgcaccaggcgcaccttgaggttctgcgcggcgagtttttgcccgtcctggttagccaccaatacttcgaattccgctgggccgtcgccattggtttccttgccgtcgaacaaccctcgcaaaccgggcaattgctcggccggccagatcggttgcaccaggcgccgggtgattggccgacctcccgactcttgcaggctggcttgcacaatcagttgcagcggcgacttggcctcggcccatttgctttccagggtcagctcttcctggcccttggcatcgagtacgctttcgtccagctcgaaatcctggctcagctcttcttcagtgacggagccaaactgataacccggcagcgacttgaccgcttcgcgcagggggcgcacatacacttgcccgctgacgcgattgcccgacgccggtgcgccgtagaggtagcggccattgacgtgaatcaccgggttatccgccgggctcaaggccgtgtcgctgcccttgagttccagcgccaggcgctcgggcaggaagtcttcgacgaggaattcatacagctgcggcttgccgtcgccgaggtcgaacaccagttgccagcgcccggtcggcgcctcaccggccaattgcagttgatattgatagaggcctgacgcatcggcatcccacacgaatttgcggctgacctgctcatccgggcggcgcacttcgacgctcaccggttgcggcttgaccgcattgccatccttgtcgcgcagcagcgcattgagcagcacggtttcgccggggcgatacagatcacgcgggccgaatacgaagaattgcagcgggtgtgccggttggccaccgatgtcgaactcggccaaatccagcgcggcactgtccaggcgcagcatgctggtttgttcgccctgcttggccagtaacacctgggcttttttcggcagcggcaattcagcgtggccgcccttctcggttttgccctggccgagcacgcggccttcggcatccagcacttcgagatcaacgccgtccagcgccttgccgccttccagtgcctgggtaaacacatccaggcgattggcatagcggtgcaccgacaggccgatatcactcaaggtgaacagcgtggccggttgcgaatagttgtaggtgcccgaggcgcgcatcaccgccaggtacacgcccggctgttgcagctgcttgaggccggcaattggcaacaacagggtttcgcgggtattgcgcgccgggttcaggtcgaagcggccgccgtagaccaggtcggccatcggcagcagctcgcgggactcataactttgcaggctggtattgcgcccccactgcgccaggaatgacggcagggattcgggcttgatgcggaagaattcgacgtcgatcttgtcgacattcagcgcgatcaccggcaagccttcagccagacgagtcggcagcaaggtgccgcgactggcgaagccgaccgtggcttgcaggtcacgggtttccaggcgcgcgctgtactcggcggcgagcgtgttgtcgttgaccgccctgaccccggcatccacggtcagcaccagtttgcgctgcggctccaagtgacgcaggcgcaactccatcaagttatcggacagctcccacgcgccgtcgaccttgccggacttgctgtcgaccagatgcagtttgtcggcgaacttttgatcgggatccaacggaatggaaaaactcaccgacaaggtgctggccccgtccagctggacttcggacacatccaccacactcaactcacgcccggcgtaacgctgcttgagcgctgccacatcaaccgcggccttgaccggtttcggcgctgtggtggtcgccgccgctggagcagacgggccagccggtttgtcggaggaatcgcaggcgctcagtagggccagcgcgcaggccaggaacaatcctttgttaagcatggggcactcgtagtgagaggggtccgaggggtgaactatatatcagcctgggtggggccgatggggtgctggtcacattgaccgacggagggtggtttggttcttgttcctcttgtaaccaagccaaatcccactgccactgaagatcaaaatgtgggagctgttgtgttgttgagggccagttacaatgccgctccccaaaggagcctccatgacttccctgctcaccgactggcgccaccgccccacccaccgccgcgtctgggcgctggccgcgccgatgattctgtccaacatctcggtgccgctggtagcgctggtggacagcatggtcatcggccacctgccccacgctcatcagttgggcgccgtggccgtcggcgccagcctgtataccttcctcgcctgggccatgggctttctgcgcatgggctccaccggctttgccgcccaggccgccgggcgcaatgatggcgcggccctgcggcaaatcctgctgcaaggcttgctgctggcactgggtttggcgatgttgctgggcaccgtgggcattccgctgagccatctggccctggagtggatgcagccctcagccgaactgaatcaactgacccgcgagtttttccacacgcgcctgttcggcctgcccgccgcgctggccagctatgccttggtcggctggttcctcggcacgcaaaacgcccgcgcgccgttggcgattctattgaccaccaacctggtcaatatcgccttgaacctgtggttcgtcctcggcctggagtggggcgtggtcggctccgcgcgggcgtcggtcatcgctgaatggaccggcgccctgctcggcctggccctgacgcaaaaagccctgcgcgcctaccccggccatatcgcctgggccgcgctgaaagtctgggaaagttggcgcccgttgctggcggtgaaccgcgatatctttatccgcagcctggcgttgcagtcggtgtttttcatgatcacggtacaaggcgcgcgcctcggcgatgccacggtcgcggccaacgcgctgctgctcaatggcctgctgctgactgcccacgccctggatggtttggcccacgcggtggaagcgctgtgcgggcatgccattggcgcccatgatcgccaggcgttgcgccgctcattggtggtcgcctgtggctggtcattgatcgccagcgtcgggtttgcgttgctgttcacgttcgccggccacctgtttatcgccatgcaaaccgacatccccagcgtgcgcgaaaccgctgacatctacctgccttatctggccgtgctgccgttgattgcggtgtggagttacttgctggacggcctgttcatcggcgccacccgcgcgcgggaaatgcgcaacggcatgctgctcactgtggtgattctgctgcccttcgcctgggcgctgcagtcgtacggcaaccacgggctgtggataaccttcctgctgttcatggcgttgcgcagccttactttgtgggcgattgcctggcgcttgaatcggcagaatcagtggcttggataaacgctgtgacgcggtccagcactggggccagccagcgtaagggcttggcaatcgatgccactaaggtcgcgtggctggtcctggtgaagtaaaacgcctccaccggcacgcctgcttcgcgcagtttcttcgccagcccgccggtattgcgcgttgggttgaccagcgtgtcgctcaccgaggcgatcaacaggctcggtggtgcgtcacggctgacgtgattgatcggctgagaatccggcggtgaatcggggaagaaaaacacgggccgtacgtcgcggttttcaatcggcaggaagtcatatggcccggccaggccgatccagccctttagcatcgacggcgacatattcacttcgccaagccagcgcgcatccagcgccaacatcgacgcgttgtaggcaccggagctgtggcccatgaggtaaagctgcttggggtcggcgccgtagtcggcgatgtgctgataagtccaggcgacggtctgggcgttgtcctgcagaaacaatgggtaacgcacttgcgggtagagccggtaatccgcaatcaccaccacgatgccgcgtgaggccagggcttcgccgacaaaaccgtaatcgtccttggcgccgctgttccagctgccgccgtagaagaacaccacgactggggcattgggcgctgccttgattggacggtagacatcgagtgtttggcgcgggtcggcaccgtaggcaattgaggatgttttggtgaaggtgctggagggcgtgagtgcgttgagcactttgatcggggagcaggccgccaggaatgcggcgaatgccagggtgaaggcttgcaggagtttgctcgacatcgttcaggcctcacacagaaggtactaccaaacgaaaatccatgtgggagccgggcttgcccgcgatgcaggcaccgcgatcaacccagcagtccgcggtgatgctatcgcaggcaagccagctcccacacaaacccggctccacattcagagccgggtcacttcagttacgacgacaggtacgaagaacgcgtcaggcccagacgcaacgcgtcgaggaactgcgtgcgctcactggcactgatcttcgcacttgcacacttgtcacggtaatgcgtcatcagttcttccggcgacaagtgcacatagcgcagcatgtcttcgatggtgtcgtgggtttcgatcccggcgctgtacaccgaaccgtcttcgcgctggtaaatgttcaccgagtcggtgtcaccgaacaggttgtgcatatcaccgagaatttcctggtaagcgccgaccaggaagatgcccagcaagtagtcttcaccttctttcaaggcgtgcaccggcaggctggtctcgatgctctgctcgtcgacgtattgcttgatcttgccgtcggagtcgcaggtcaaatcctgcagcacggcgcggcgcagcggctcttcgtcgagacggtgcagcggcaggatcggcagcacctggccgatcgcccaggtgtccggcaggctctggaacaccgagaagttgcagatgtacttgtcggccagcttgtcgttgagctcatccagcacttggcggtgcgagcgttgacgcgctttcaacgagtcgtgcaggcgacggcatacggcgaagtagcactgctcggcgagggctttttcggccagggtgatcttgccgtcggcgtactgggtggccacgtcgctcatgtagtgcgtagcgcgccagtaggtttcagttaccatttcaatgtcggtcgggcccagcaggtcgaccagccactgcacggtttccggcaggctttccttgttttcgatcagcgggatttcgtcgttgtgcttctcgacgtcggtgacttgcaccaccagcatggcgtggtgagcagtcagcgagcggccgctttcggagaagatatgcgggtgcggcaggctctgcgcgtcgcagaattccttgagcatgcccaccaccacgccggcgtagtcgtccatgtcgtagttgatcgagctggcgttacgcgagtgcgtgccgtcgtagtccacacccaggccgccgccaacgtcgatgtgatcgactggcaggccgaggttgcgcagttcgccgtagtaacgaatggcttccttgaacccgtgctggtagtcggccaggttggcaatctgcgaacccatgtggaagtgcagcaggcggatgccctggtccaggccggccgcgcggaagcgctcgaccaccgacagcaactgcgccgccgacaaaccgaatttggacttctcaccaccggtgtccgcccacttgctcgacgccagggacgacaagcgcacgcgcaggccgacctgtggcttgaccttgaggttggccgcctcttcgatcaccagcgccacttcggattctttctcgatcacgatgaacacgttgtggccgagcttctggcccatcagcgcgaggcggatgaactcacggtctttgtaaccgttgcagacaatggtaccgcccttcggcgccagggccagcacggccagcagctcaggcttggagccggcttccaggccgatggacacgtcctgggtagcaatgatgttctcgatcaccgcttcctgctggttcaccttgatcgggtacagcgcggtgtacttgctctggtattccaggcgttcgatgttcgcatcgaaagcaccggtcagctggcgcacgcggtcttgcaggatatcggggaagcgcaccagcagcggcaaggacaagccgcttttgcgcagctcgtcgacttgctcgtacaggtcgacaggcgtgctgttcgggccgttcggacggacttcaacgcgaccggcttcattgatcgcgaaatacccggccccccaatggcgaatcccgtaaacactgcggctgtccgcaactgtccattggctgccatcgtctttgcgtgtgcgtcgtacggacatcgaagtcccctataaatgaaggcgaaggcgccgccccgggtttgaggctggcgcagtctaaagaatgaaaatgacgatttgcctgtaagggaggtagacctcactcgcaggacagagtttagacacaggttgggaagaggctttcagccgccggacttcttggccttgtacccgagcttgatcagctcggccaacagcaattcgacgtgatcgccctgaatctcgatgaccccgtctttcaacgcgccaccggtgccacagcgctttttcagcgtggtagccagttccttcagggcctcttcggccagcggtacgccggtgatggtggtcaccgtcttgccgccacggcctttgctctcgcgtcgcacgcgagcaatgccgtcaccttcagggatcagggtctgtttgcaggtgcacgaatccacgggctgacgacagtccgggcagtgtcgacctgcgtcggtggaaaataccaggccaccaagggcggcgaaggatgcggcttttttggccaccggcaatcctctcgggaggacaaagactgatcggtgctcgcaacgagcatcaccgaccgcgaagccccactcaggcaggggcagcgctaccgaaccgcaaaggtggttcgggtgaaaagtcgcgcagtgtaacggcaaaaagccgacttgctaagagccaaatagcgccaatttatgcaactttagcgacgcgaggccagatagcgccgcaagccttcttgagcatccgggcagtaaggcttttgttcagcttcctgcaggacagtttcaatgggtaaaaagcgcgcttccatgacctcttcgggctgcaggcgcaaaggcccatcccagaccgccgagtaggacgtgcaccacagccggctgtcgtcctcttcaaagtagaaatggtcatgcttgaccaattcaacgccggcaacaccaagctcttcttccagttcacgggcggccgaagcggcgtagctctcaccctccgcgaccatgccacccgccgccgtgtcccagaaaccgggatacaaggctttgctcagggtgcgccgatgcacacacagctcaccggccgaattgaacaggaagataaaagtgcatcggccgatcaggccgcgctggcgaaggtcggacctgacgaggtggccgagcaggttgtcctgctcgtcgacccagcagatcagttcagcatcggaggccgcacggtgtgcggcctccttttgagtagcgtccatcaatcacccctggttgaggagctgacgcaaatctataactgcagcgtttgcccgggaaatatagttggccatgaccaacgagtggttggcgaggatgccaaagccactgccgttaagaatcataggactccaaaccggttcttgcgaggcttccagctcacgaatgatctggcgcacgctgacggtggcgtttttcttggccagcacgtcggcaaagtcgacttcgatggcgcgcagcaggtgggacagcgcccacgcctgaccacgggcttcgtagaacacgttgtcgatctgcatccatggggtttccaccacttcttcgtcgacctgcggcacttcacccggcgccagggcttcggttttcagtgcggtgttcagcttgacccggcccacgctggccgacaggcgttgcgacaacgagcccaaacgggtggcgacatcgcccagccagttgttcaggttatcggcacgcgcataaaacagcgcgccgcgctggttagggtccgacaagcgcgcttcgtaacggctcagggaattgatgccttcctggtattccgactcgctggacggcagcacccagctcttgttgtcgaagttgaaacgcggctcggccttggccaagtcagcgtcttcagccgactgcgactgggagcgcgcgaagtctttacgcagggcgcgggtcaggtcgcgcacctgcaccagcacgccatattcccagctcggcatgttgtccatccacaggcctggcgggaaacggtcattggagatgtagccaccgggcttgttcagcaaggtgccgaccacggtcttgagggtttcgacggtggtatagcccaccaccatctgcttgccttccttctcggcggcaagctgggcattttgctggaccgggaacagcgccggctcttcgctccagtaccagcccagcgcgccggtgaccaacaggtacaaccccagcacgctgagcacggctcggctcatcaccaggttgcgaaagtagctacggttggccgacttgggctcaggggcagggcctttggcactgcctgcgcggtttttccagtccagcatggcgatatcctttcaatcacttgagttcatgcacgtcatttgtccgggtgcgttcaaacactccgaccacaaccctaccccatcgtgcccatcggtgcggggcttttaacagaagtggcgcgccagagatgttcgactataaatgatgcacgctttttacgcagtgcgaccacaaggtcaaaaactgaatacggcagacgtgtacttaattgacgtatgacactcatgtagaagaaaagaggtgctagcatagagccatcagtcgacctcagcatgcaccctaactagtagtcaggatatgaccgagccagaagaccccagccgtgagcgtctcaagcaccattttgcccagcgggtaattcatcaggcacgtcaaattcttgagatctggcaacgcctgcaacgcagcgaatggtcgaacaccgatttgtccgaactcagcgaagccaacctgcgcctgctgcgctttgccgagcgtttcgaacagccggagcacggccagctggcgcggcacattggcgaatcgctcaaggcagtcgacgaaaatcgcgggcgcctgagcagccaggtgatcaccgaactcaaccgcctgatgcagcgcctgtcccgcaccggcctgcgccagggcgatcagctggaacaaaccttcctgccgccgatgcgcaagccgatctacgtgatgctggcggaccacgaccgcgccgagcgcctggccaagcagctggagttctttggcatgagcgcccagccgctggacagcgtggcggcatttcgcgcctcgctggccgagcgcctgccgtcagcgattgtgatggacgtggatttctgcggcccaggcttaggcctcaagctcgcggccgaggcccaggaaggcctggagcaaaagctgccgctgttgtttttcagcctgcatgaaaccgacacaccgacgcgcctggccgccgtgcgtgccggcggccaggaatttctcaccggcaccctcgaagcctcgagcttgctggaaaagatcgaagtgctgacctgcgtcgcgcagtacgagccttacaaagtactgatcatcgacgactcgcgcgcccaggccctgcacaccgagcgcctgctcaacagcgccggcattgtcacgcgcaccttgatcgagccgatccaggcgatggccgagctggcggatttccagccggacctgatcatcctcgacatgtacatgcccgcctgcaccggcaccgaactggccaaggtgattcgccacaatgaccgttacgtcagcgtgccgatcatttacctgtcggccgaagacgatctggataagcaactggacgccatgagcgaaggcggtgacgacttcctcaccaaaccgatcaagccgcgccacctgatcaccaccgtgcgcaaccgcgccgcccgcgcgcgcaacctcaaggcgcggatggttcgcgacagcctgaccgggttgtacaaccacacgcacatcctgcaattgctcgaagactgcagctttcgcgcgcgccgcgagaacaagccgctgagcttcgccatgctggatatcgaccacttcaaacgggtcaatgacagccacggccacccgatgggcgaccgtgtgatcaagagcctggcgctgtttctcaagcagcgtttgcgcaagaccgactacatcggccgctacggcggtgaagaattcgccatcgtgatgcccgacaccgatctggaatcggcctgcaaagtgctggacgaaatccgcgggcgctttgccgaaatccattacccggcccaaccgcaggatttgtggtgcaccttcagcgccgggctggtggagctgtgcgacggctccgacagcctgatgatggctgcccaggcggatgaggcgctgtaccgcgccaaggacgccgggcgtaatcgcgtacacgctgcgcgtacgtcaaagcaaagtgccaccttttcaccggaattcactgattccgtcataactttgtaacggaaacgcaataacttcaggcacttatcttttgctgtcggttgaaaccacgcatgcgcctgaagctgctgaccaatctgaacacccttcttctggtggccgtgtgcctggcccttggggccacgttgtggtggtcgcaacgggcactggaacgcccgtatttgctgatggaacgctacctcggcctgtcgcagacctttcagaaccaggccgcgcgcaacattgacgactacctcgccagcggcgacgccttgcgcttgagcagtgccggccagagcctggaagcgctgttgcagcaggttgatgaactgccggcggacctcgcgcaaaccctgcgccccagcctggtggacctggacaccttcagcaaaaccgacctgctcgcggccggcaaattggcgggcgacccgcaagcgctgttgttgcaagccgaacgtgaactgggtgcgaacctggagcaattgagccagtacgccatgggcgtcaactcgccggaggccacgcgttacttgccgccactgctggccgccgcccaacacttgggcaaactgtccctggcccgggacaaactggtaagcagcgggcgcgcggaattggccgatgaggtggagcgcgaagtcgccagcatccgtgcccaggccgacctgttggcgcaactgccgttgctgggcgtaaaggccagtaccgagtccagcaccgacgacttttccgccatgatgggcctggaaaacagcgaaaaagccgaagtgcaggacactggcgtcgacctcaagcgtgaactcaacagcttgctgacccgctaccccgccgaactcaagcgcacccgtgaccaaatccagacacgcaccgcgctggccgacagcacccacgtgaaaatcgccgccgtgcagcatgccatcgccggcctggagccggtggtgcgcgcgcagcacggcaagatccagggcgaagtgcgcctgatgcagggcgtgatgatcggcctgatcctgttgattgcgctgctcatcgacaccctgcaacggcgcctggcgcgcgtattgaccaacctggccccggccttgtcgacctgggccgaaggcgacttcagccagccgattgcgctgggcaagaccaaccgcgaactgcacgatatcgaagcctcgcttaaccgcttgcgcgcttacctggtcgacctggtcggcaccattcgcggcaacgccgaagaagtcgccggcagcagccgcgccctcgcggagctaagcagtggcctgcacgacggcgccgagcgccaggctggcgatacggcgcagatccgtgattcgctgggtgaactggaagcgaccatccagcaagtggccggtgatgccagccaggccgccggtgccagccgcagtgcgggccaggccgtggaacagggccagcgcgtgatcggcctgagcctgaccgggctgcatgccttggtgggtgaagtgcagcaaaacgcccagatgatcgaaaaactcgccgaggagtccgccaccatcggcggcgtgctgacggtgattcgcgcaattgccgaccagaccaacctgctcgcgctgaacgccgccatcgaagccgcacgtgccggtgaagccgggcgcgggtttgcagtggtcgccgatgaggtgcgttcgctggcccaacgcaccgccggcgcaaccgccgaaatccagagcctgatcgccggcctgcaaaccgccgcccaccaatcggtgcaaggcatgcgcgcgcaggtcgagcacgccgaagctaccgcccagcaagcccaggcggccgacggtgccctggatgaaatcgtcggcgcgatccagacgatttccgacacggcggtgcgcatcgccgatgtgaccgcgcagcagagtggcgccgtcagtgagattcgcgacaacagcgagcggattcaccagttgggtgaggataatttgctgcgcattggccaggggcgtcgccagggtgaacacttgttggtgctgggtgggcagcttaatacggcggtgcaggcgttccgggtttgacctactctccagccatgtggcgttcaaaatgtgggagctggcttgcctgcgatagcggtggatcagctggcccgtcttgcacaggcatagcgctgtcgcaggcaagccagctcccacattagatccgcgccgatttcgtaccgtgccaccaatgaccggaatccgagccccagtcacaaattttgcgcaatcctcgctaatcgtgctgcctactgcatagaactggacagtcacaaaggctttgcggcatagtcgccgggttctgccgtacccacatcaataacaaggaacagccgatggcgaccttactggttcttcacggacccaacctgaacctgctcggcacccgtgaaccgggcgtctacggggcagtcaccctcgatcagatcaacctcgatctggaacgacgggcacgtgaagccggccaccatttgctctacctgcaaagtaatgccgagtacgaattgattgatcgcatccatgccgcgcgcagcgaaggcgtggactttattctgatcaatcccgccgcttttacgcacacgagtgttgcattacgtgacgcgctgctggcggtgagcatcccatttatcgaagtgcatttgtcgaacgtgcacaaacgcgaacctttccgccatcactcttacttctccgacgtagcggtaggagtgatctgcggccttggcgccagcggttaccgactggccctggaggccgccctggaacagcttgaacaaccggccaagcgcccctgaccgacccttgggagttgatgattcatggatatccgtaaagttaagaaactgatcgaactgctggaagaatccggtatcgacgagctggaaatcaaggaaggcgaagagtccgtacggatcagccgtcacagcaaaaccccagcccaacagttctacgcaccgcaaatgcaagcaccggctccagccgctgctgctccggccgccgcacctgctgctgccgcagcgcctgcagcaccggctgcgcctgcactgaacggcttcgtggtcaagtcgccaatggtcggtacgttctaccgcaccccggcaccgacctcgccagccttcgttgaagtcggcaagactgtgaaagtgggcgacaccatctgcatcgttgaagcgatgaagatgatgaaccacatcaccgctgaaaaagccggcgtcatcgaatccatcctggtagaaaacggtcagccggttgagtacgaccagccgctgttcaccatcgtttgaaccgcggagcgccttcgatgttgaaacctgcgaagaaactgcaaaaagtcctgatcgccaaccgcggcgagatcgcgctgcgtatcctgcgcgcctgtaaggaagagggcatcaagaccgtcgctgtttactcgacggccgacaccgaattgatgcacgtgaaactggcggacgaaagcatctgcatcggcccgccattggcgaccaattcgtacctgaaagtctccaacatcatcgcggccgctgaagtgaccggcgctgatggcattcacccaggctacggcttccttgcggaaaacgccgatttcgccgaacaggtggaaaagtccgggttcgccttcatcggcccgaaagccgaaaccattcgcctgatgggcgacaaggtatcggccaaggacgcgatgatcgcagccggcgtgccaaccgttccaggttctgacggcccgctgcctgaagacgaggaaaccgctctgcgcattggtcgcgaagtcggctacccggtgatcatcaaggccgccggtggcggtggtggtcgcggcatgcgtgtggtgcacaaggaagaagagctgatcgaagccgccaagcagacccgctccgaagcggctgcctggttcggcaacccgatggtctacctggagaagtacctgaccaacccacgtcacgtggaagtgcaggtgctgtccgacggccagggccacgccatccacctgggcgaccgcgattgctcgctgcaacgtcgtcaccagaaggtactggaagaagcaccggcaccgggcctggatgaaaccgcgcgccaggaagtgctggctcgctgcgtcaaggcgtgcatcgacatcaactaccgtggcgccggtacgttcgagttcctctacgagaacggccgtttctacttcatcgagatgaacactcgcgtgcaagtggagcacccggtttcggagatggttaccggtatcgacatcgtcaaggagatgctcagcatcgccgccggcaatgtgctgtccttcacccaggacgacgtgaagctccacggccactccctggagtgccggatcaacgccgaagacccgaaaacctttatcccaagccctggcctggtcaagcatttccacgcgcccggcggcaacggcgtacgtgtggattcgcacctgtacagcggctacaaggttccgtccaactacgactcgctgatcggcaagctgatcacctggggcgccacccgcgacgaggccatggcccgtatgcgtaacgccctggacgaaatcgtggttgacggcatcaagaccaacatcccactgcaccgggatctggttcgcgatgaaggcttctgcgaaggtggtgtgaacattcactacctggaacacaagctggccaaccagtaagtgctccacccaacaaagccgccttcgggcggctttgttgtttctggcctccggttttaggcggatgtacacaaatcaaaatgtgggagcgggcttgctcgcgaatgcggtgtgtcagtcaatgcatctttaactgatctaccgctttcgcgagcaagcccgctcccacatttggaccgagtacggtcagtggtgtcgtcttcttccccacgctcgcgtaaacttgcgccctttcgcagcccctccccgctgcacactcatttttttcaaaggtgcccgccatgccttggctgcaagtccgtctcgccatcagcccagaacaagccgaaacctacgaagacgctttccttgaagtgggcgctgtctcggtgacattcatggacgccgaagaccaaccgatcttcgaacccgaactcaacaccaccccgctgtggtcccacacccacctgctggccctgttcgaagacggcaccgatgccgccgccgtgctggcccatatggagctgctcaccggcagcccgctgcccgagcaccacagcgaagtgatcgaagaccaggactgggaacgcagctggatggacaacttccagccgatgcgtttcggccagcgcctgtggatcgtgccaagctggcacgcggcgcctgagccggatgccgtcaacctgctgctcgacccgggcctggcgttcggcaccggcacccaccccaccaccgcactgtgcctggaatggctggacggccaggacctgaccgactgcaacgtgctggacttcggctgcggctcggggattctggcaattgccgccctgctgctgggcgccaaggaagccgtcggcaccgacatcgacgtgcaagcgctggaagcctcccgcgataacgccgggcgcaacaacattcctgaaggcaaattcccactgtacctgccggagcaattgccccaggtgcaggccgatgtgctggttgccaatatcctcgccgggccgctggtttctttggcgccgcaactgtcgagcctggtcaagccgggcggccgcctggcgctgtcgggcatcctcgccgagcaaggtgaagacgtggcggcggcctacgccaaggatttcgagctggacccgatcgccaaccgtgatggctgggtacgcatcagtggtcgtcggcgctagaatgagcgcttgcctgaatcggatggccgcatgaccgacagtttcgtcacccagtgcccacattgccaagcgcgctttcgcgtcagccacgctcaattgaacgtggcccgtggcgttgtgcgctgcggctcatgcctgcaggtgttcaacgcggtgcgccaactgctggagcagcgcgccaacgcatcggcgccagctgcgcaaacgccggcctccgctgaagaagcaattgaacccattgttgaggcgccacgcgcgatcagccagaaacagtggaccgccgaagagctggacctggacaacctggacctggacgaagagctggccaagcttgagcgccgcgagattcagcacactcagccgatgagcgcggagcgccgccaggcgaacgctgaccgtcggcaaccggaggacgcccttagtgccagtcgcgtcagcgtcaaggccgaggaagaaaaatgggccgccagcctgttcagcgaaccgcctgaggaacgcgcccaagcagcgcaagacgaacctgaaccgcccaaggcgcctgcgaccaagcagcgcaccgagccgtccatgtcgtttcacaccggcgatatcgacgaagagccacccctgcgctcagcccctgacgatgacgacgacgatctcgacccgccgctcacgcccgtgaccgagcccctggacgagcccgaaccgcaagccccccctaaaccccgtcgcaaacgcccgcgccccgaagccagcattcacgatgatgtgctccaggacctggaagacgacccgctgcatctttacgcgcaaaaacgcccgccaagctggggccgccgccttatctggataatcctggtcttattggccgctgccggcctcgcaggccagtacatcgcctaccaattcgacgacctggcccgccaggacgcctatcgaccgtggttccagcagctgtgcccaaccctgggctgcaccgtgccatcacgggtcgatatcgcccacatcaagagcagcaatctggtggtacgcagcaacccggagttcgccggggcgctggtggtggacgcgatcatttataaccgtgcaacgttcacccagccatttccgctgcttgagctgcgctttgccgacttgaacggcagcctgattgccagtcgtcgcttcaaaccggccgaatacctcagcggtgagctggcgggggtgagcgaaatgccttcgcagacaccgatccatatctccctggacatcctcgacccaggtagcaaagccgtgaattacagcctgagctttcactcgcccgagtgaaacaacacgcgcgtcgaggtttgacggcagattattgacttgatgctgcgcaaccaaaccggcggcgataaagaaataactgttcagattttatccaattcagcctttatccagtcatcgagagcgggtatcatgccaaccctttttcgaactctaatgatccggccccacaacagggaagtcctatgtcggcggtacgcatcggcccatacacattgcaaaacggcttgatcctcgccccgatggcgggcgtcaccgaccagccctttcgtcagctgtgcaagcgtttgggcgcgggtctagtagtctctgaaatggtcaccagcgacatgagcttgtggaacacccgcaaatcgcggatgcgcatgatccacgaaggtgatcccgagccccgctcggtacagatcgccggtggtgatgcacaaatgctggcggatgcggcccgggccaacgtggagttgggcgcacagatcatcgacatcaacatgggctgcccggccaagaaggtctgcaacaaggccgccggttccgcgctgttgaaagatgagcaattggtagccgagatcctgcaggccgttgtcgccgcagtcgatgtgccggtcaccctgaagattcgtaccggctgggaccgggacaacaagaacggcctgacggtggcgaagatcgccgaacaggcaggaattacagcgctggcggtgcatggccgcacccgcgccgacctttacaccggtgaagccgagtacgacaccattgccgcgatcaagcaggcggtgtcgatgccggtctttgccaatggcgacatcgactcagccgagaaagcccggcgcgtgctgcacgcaaccggcgccgatggcttgttgattggccgggccgctcaagggcgaccgtggatttttcgtgagatcgagcattttctgcgtaccggcgaagtcttgccggcaccggagctgatcgaggtggaacgtattctgctagagcatctggccgccctgcacgccttctatggggacgtgatgggagtacgcattgctcgcaagcatgtcggctggtatctcgcaaccttgccgggcgccagggagtttcgcgcccacttcaatcgtttggatgaaacggaagcacagtgcgccaacgttcgtgagtttttcagcgagcgttacaagagcctggggacaggggacggagagggggtggccgcatgacgatgatgaccgagactttagtgagtggaacaacacccgtgagcgacaacgtcaatttgaaacagcacctcaacacgccgagcgaagaaggccagacccttcgcgggagtgtcgagaaggcgctgcacaattatttcgcccaccttgagggcgcttccgtcacggacgtgtacaacctggtgctctccgaagtcgaggcgcccttgctcgaaagcgtgatgaactacgtcaagggcaaccagaccaaagccagtgagctgctgggcctcaaccgtggcaccttgcgcaaaaagctcaagcagtacgatttgctgtaagcattcaatcaaaccagaaaggcgcccgcgtaaaaacggtcgccttttttgctgactcctttgcttttgatggaaattgaaatgaccgaccagaccacccgcctgccgatccgccgcgccttgatcagtgtctccgacaagaccgggatcctcgaatttgcccgggagctggaagcccttggcgtggaaatcctctccacaggcgggaccttcaaactgctgcaggacaacggcgtggccgcagtagaagtcgcggactacaccggtttcgcagaaatgatggacggtcgggtcaagaccctgcacccgaaaatccacggcggcatcctcggccgtcgcggtatcgacgacgccatcatgagcgagcacggcatcaagccgatcgacctggtggccgttaacctctacccgttcgaagccaccatcaacaagccaggctgcgacctgccgaccgccatcgaaaacatcgatatcggcggcccgaccatggttcgctcggcagccaaaaaccacaaagacgtggccatcgtggtgaacgccagcgactacgccaacgtgcttgaaagcctgaaagccggcggcctgacctacgcccagcgcttcgacctgatgctcaaggcgttcgaacacactgccgcctatgacggcatgatcgccaactacatgggcaccgtgaaccaggccgctgaaaccctctcgacctccgaccgcagccagttcccgcgcaccttcaacagccagttcatcaaggcccaggaaatgcgctacggcgagaacccgcaccagagcgcggcgttctacgtggaagccaaaccggccgaagtcggcatcgccaccgcgacccagctgcaaggcaaagagctgtcctacaacaacgtggccgacaccgacgccgcgctggaatgcgtgaagagcttcgtcaagccggcctgcgtgatcgtcaagcacgccaacccgtgcggcgtggccgtgagcccggacgctgaaggcggcatccgccaggcgtacgaactggcctacgccaccgacaccgaatccgcattcggcggcatcatcgccttcaaccgtgaactggacgccgagaccgccaaggcgatcgttgagcgtcagttcgtcgaagtgatcatcgccccaagcgtgagtgaagaagcccgcgccatcgtggctgccaaagccaacgtgcgcctgctggcctgcggcgagtggtcggctgaccgcgcagctgcctgggactacaagcgcgtcaacggcggcctgctggtacagagccgcgacatcggcatgatcggcagtgaagacctcaaagtcgtgaccaagcgcgcgccgaccgagcaggaaatcaacgacctgatcttcgcctggaaagtcgccaagtacgttaaatccaacgccatcgtctacgccaagaaccgccagaccatcggtgtcggcgccggccagatgagccgcgtgaactcggcacgtatcgccgcgatcaaggcggaacacgccgggttgcaggtcgccggctcggtgatggcgtccgatgcgttcttcccgttccgtgacggcctggacaatgccgcgaaagccggtgtgaccgccgtgatccaaccgggcggttcgatgcgtgatgctgaagtgatcgcggcagccgacgaagccggcattgccatggtcttcaccggcatgcgccacttccgccactgattgatcgttcccacgctccgcgtgggaacgcagcccgggacgctccgcgtccctgggacgcagagcgtccgtagaggcattcccacgcagagcgtgggaacgatcatccacacgaggttttgaaatgaatgttttgatcattggcagcggtggccgtgaacacgccctggcctggaaagtagcccaggacccacgcgtccagaaagtattcgtggctcccggcaacgccggcaccgccattgaagccaagtgcgaaaacgtcgccatcgacgtgctggccctggaacagttggccgacttcgctgagaagaatgtgtccctgaccatcgtcggtccggaagtaccgttggttgccggcgtcgtggacctgttccgcagccgtggcctggactgcttcggcccgaccgccggcgctgcccagctggaaggctccaaggcgttcaccaaggatttcctggcacgccacaagattccgaccgccgactaccagaacttcaccgagatcgagccggccctggcttacctgcgtgaaaaaggtgcaccgatcgtgatcaaggccgatggcctggccgccggtaaaggcgtgatcgttgcgatgaccctgcaggaagccgaagacgccgtgcgcgacatgctcgccggcaatgcatttggcgacgccggttcgcgcgtggtcatcgaggaattcctcgatggcgaagaagccagcttcatcgtgatggtcgacggcaagaacgtcctgccgatggccaccagccaagaccacaaacgcgtcggcgacgccgacactggcccgaacaccggcggcatgggtgcttactcccctgccccggttgtcaccgctgaagtgcacaagcgcgtcatggacctggtgatctggccgaccgtgcgcggcatggccgacgaaggcaatgtgtacaccggcttcctctacgccggcctgatgatcgacaaagccggtaacccgaaagtcatcgagttcaactgccgctttggcgatccggaaacccaaccagtgatgctgcgcctgcaatcgagcctggtgctgctggtggaagctgccctggcccaagcgctggacaaggttgaagcccagtgggatccgcgcccgagcgtcggcattgtgctggcggccggcggctaccctgccgactacgccaagggcgatgtcattgaaggcctcgacgcagctgctacgctggaaggcaaggtgttccatgcgggcaccgcgctcaaggatggcaaagttgtaaccgcaggtggccgtgtattgtgcgccactgcaatgggtgccagtgtcgacgctgcgcaacaacaggcgtacaaactggccgcgaagatcgactggaaaggctgcttctaccgcacagacatcggctaccgcgccattgcccgtgaacgtggcgagaaccagtaaatagctacccacccgtagctatccattcggttaggcaagggcctctggcccttgccgtacacatgtcaccccgcgcatagttaacccgtgcatcaacctacgaagggatttcgccgtgcgctggctcaggatcgccataggcttcacagtcagtctactgaccctgctctgcttgttcccggcccaggccgccgcgcaaggcagtggttgggcagtattgcttgatgaacaggccgacctgcaactgagcgacatccgttccgcccgctacaccaatcaattcagccccatcgaactggaccggatcactgctgctgacccgagcggtgcgttgtgggttcgcttcaaactgcaacccggcaagcacgagcaagtgctgcgggtattcgccccggacctgtcccacctgagcctctatgtactggacggcgacaccctggtggaacaacaaagcaccggcacccgccagccccaggcggaacgcccgttgcccagcagcgacttcatgctgccgatgccccagagccagaagccgctcgaggtttacctgcgcctggtctcggagcacgagctgcgcccctatatcaccctggagccggccgtactggccgccgccgaccagacccagacgctgatctacggcctgctgttcggcgtgctgttgatgctgatcctgcacaacctcacacgcttcgcttatcaccgttcgcgcagcagcctgtggctggccgcctgcgaagtactgttgatgctcagcctggcgctgttgctcaacctggtggggccatggctgccgaactggcacgctgtccaaaccccgggcgcttacctcgccctgctgctgaccgcgccgtgcgggctgatgtttgcctaccgtttcttcatgccgctgggcccgcacccgctgaacaagctgttgatggccgatatcctgtttatcgtgctctgcggcctgttgctgttgttcgtcaacaccttgccgctgaacatcatcacctacgccctggtggccctggccggcttgagcatgttgtttgtctcggcctaccactggcaaaaaggctatcggccggcccgcttgttcgtagcggcaatggtggtgttcaacatcggcacactggtcatcctgcctgccctgctcggcctgacgctggtggcgccgcaaggcttgatcgtgactctgctcggtttcatctgcctcagtggcttgctgatgagcctggccctgggcgaacgccagcgtgcgattgtcgaggcgcgcttcagcctcagccgcgacctggcagccagcaacgccgaaatcgccgccaaggccgagttcctggccaagatcagccacgagatccgcacgcccatgaacggcgtgctgggcatgaccgagctgctgctcggcacaccgctgtcagtgaagcagcgtgactacgtgcagaccatccacagtgccggtaatgaactgctgacgctgatcaacgagatcctcgatatctccaagctcgagtccgggcagatcgaactggacgacgtgcagttcgacctcaatgcgctgatcgaagactgcctgagtatcttccgcgccaaggccgagcagcagaacgtcgagctgatcagtttcatccagccccaggtgccgcgcgtcatcagtggcgacccgacgcgtctgcgccaggcactgctgagcctgctggaaaacgccctgcaaaaaaccgacgaaggtgaagtgctgatcgtcgtcgccctcgacgagcgcagcaccaagccacgcttgcgcatcgctgtgcaagacagcggcctgccaatggaagccgccgagcgcgatgcgttgctgcacagcgaattgcacagcaagaacttcctctcggccacccgcttgagcggccacctgggcctggtgatcgcccgccaactgatcctgttgatgaacggcgagttcggcatcaagagtggcagccaccagggcagcaccctgtggctgaccctgccgctggacccggagcgcctggaacatccgacctccgacctcgacggcccactcaagggcgcacgggtgttggtggtggacgataacgacacctgccgcaaagtgctggtgcagcaatgcacggcctggggcctgaatgtcagcgccgtgccgtccggtaaagaagccctggcgttgctgcgcaccaaggcgcacctgcgcgactacttcgacgtggtgctgctggaccagaacatgcctggcatgaccggcatgcaactggcggcgaagatcaaggaagacccgagcctgaaccacgacatcctgttgatcatgctcaccggcatcagcaacgcgccgagcaagatcatcgcgcgcaactgcgggatcaagcgcatcctcgccaagccggtggccggctatacgctgaagaccaccctggccgacgaactgacccagcgcagtaaaggcgtggtgcagccgcgcccggccctcagcgcaccggcggccgtgaccgtgcccgccgacttccgcatcctggtggccgaagacaacagcatctccaccaaagtcattcgcggcatgctcggcaagctcaacctcaacccggataccgccagcaatggcgaagaagcgctcgaggccatgaaggcccagcgttacgacctggtgttgatggactgtgaaatgccgatcctcgatggcttctccgccactcagcaactacgcgcatgggaagtcagccaccagcgcattcgcacaccggtggttgcgctgactgcgcatatcctctcggaacataaagagcgtgcgcgtcaggccgggatggacggacatatggccaagccggtggaattgtcgcagttgcgcgaactggtggagttctgggtggcgcagcgccagcagcgcccggaacacgccccttcctgacctgaaatacaatcaacatgtcggagcgggcttgtgtaggagctggcttgtgtgggagctggcttgcctgcgatgcagacacctcggtgagtcagtcactccacggtgatgctttcgcaggcaagccagctcccacatagccagctcaacatagccagctccccatagccagctcccacatggcccgctcccacatttgatctgcgccgcctgttagactcagcccatctttctacccgcgagccgccctcatgctccacgtgttattcagcgtttacctgaagatgctcgtgctctacagcccattcttcgtgctctcctgctttatcagcctgacccgtggctattccagcaaagagcgtcggcgcctggcctggaaagtggcactggcgacgctggtgtcgagcgtgttgctctacttgttcggccgggtgattttcagtgtcttcggcatcaccgtagacgccttccgcatcggcgccggcagcgtgctgtttatctctgcactgggcatggcccaaggcaaatccgccgtacagaccgacaacgtgcagcaggacgtgaccatcgtgccgctgaccattccgctcacggttggccccggcaccattggtgcgctgctggtaatgggcgtcagccaaccgcactgggatgacaagatcaccgccattctcagcatcgccctggccagcctgacggtgggcgtggtgttgtacctgtccaaccgtatcgaacgtattctgggtgaccagggcttgcagattgtcagccggttgatggggttgttcgtatgcgccctcgccgcacaaatcatctttaccggcgtgcgcggctacctggtgccttaaattcggtatttggcgatcgccaattgcactttatcgcccgcgctttcacgcatcagttgaatcgtgttttcgttgaccaccgaggtattcagcaccaggcaggtctgcccgctgaaggcctcgaacgaggcgctgtcccactccagaaacggcaaccccagctgtttgctcacgccatgggagctgtaagtcaccagcaccatcgtcacttcaccctcggcttcggcacaggacgccaggccgaaatccccgccctggtgcaccgtgctgttgcgcatgaatagctcgaatgaagccggttgtcgcttcagcgcttcgagtgcatcagccgccaacttgggcagtaccgcgagcaatggcccggccagtgctgtcgaggccaacatcgcggcaatcatattcagcgccgccagctgcacggtcaggcccttgccggtgtgtgagacccgttcgaaacggctgcgcaccggcagccagccgaggctgaccatcaccttgataaattcgtcgtaccaggcctctgtgccacgctgtaccttcaacacatcgctgacatagctgctcgcaagcaagtagctcttgcgcacgtactcgcggttgagggcggacataccctcgataaacgagatcaccccgttgttcaccacggccgcattgcactcatcgtcagtctccaccggcccggcaggctgtgttgcaggcgcccctggcaacttgtaggcggcaatcaatttgcgccttttcgcgctgatgatccttttgtgatgtcgctccatttttcagttctccacaagcaccccacatggggtttgcctccacactagacgagtgcccggcgggctatccagacgacaaacatcgcttggctcgccctccgaaaaaggctgacccagcaattacaaggcgtacctcacggccttgcgtatttcatcgatgaaaaaagaaaaagctccgagcagcgccaggctttcacccagcattactcggagctttcttacttgcggcaggctgttttcaggaggcgggcttgttgccataccaacgtggcgtgtacacccactcaccgccaccggcgcgcgggaatacacaggtggtggatgagccgatcagcaccatggtgcgcatgtcgacctgctcgggtgtcaattgcccaagcgtggtgacgcgcagggtctggcctggacgaccaatatcgcgacccagcaccaccggcgtttcaggcgtgcggtgcagcgcgacgatttccagcgcgcgccccagttgccatggccgcgaacgcgagatcgggttgtagaacgccagcgccaggtcggcctgggacgccaggtccaggcgtttttcgataatcgaccacggcttgagattgtccgacagcgacatcacgcagaagtcatggcccagcggtgcacccgcctgggcggcggtggccagcgaagccgaaacgcccggcagaatctccaggtcgacctgatgccaggccgggtcactcgactcatgcaaagcctcgatcaccgcagcagccatggcgaagacgcccgggtctccggacgacaccaccaccacggaacggccctgcgcggccagctcgaacgcatgccgcgcgcgctgcatctcttcgcggttatccgtgcaatgttgcacctgatcgtcgcggaacggcccggccatgcgcacataggtttcatagcccagcacatcggtacagcgcgccagctcggccttgacggccggcaccatcaattccgccgcgccagggcccaggccgatcaccgccaggcggccacgcgggcgcccgacgtgcgccaggtccagcggttgctcggcaacactgataacgatgtccgcatcttgggtgacgccagagaaacgcaacggcacgcctaattccaatgcagcttcatgcagcgaagtgtcggccatctgcgtatcgctggccaacaggcaggccagggattgcagtgcaatgcccgcgtcgtgcaatgccgcccgcacacgtccagccaaatgcgcgccgggcttgcaggtgacgcacacgttcttggggtaaatcagcaactcattggccacgggcgcacgctcggcgctgcccacatgaatcgccaggcgtgcctgctgatcctgcggcaaattcgcctcgtccagccagggcgctgcgccttcgatacgcacactttcgccggccagcaggtccgagacaaagcgcttgcccagttccagatccgccaattggtaacccgcaggcgggttgagcaggcaggtgccgaaacgcagctcgccgctggtggtgatcgcagcagacacgtccagtgcagcggcgatgtccctcgccatcacgttcacaccgccaaggccaccgagcaacggcaccacggcgctgccgtcttccgccacggccagcacggcgggttcttcgcccttttccagcagcagcggcgccagggtgcggatcacaatgccggctgcacacaacgcaatcagcggcgtgccgtgttgatacaactgacgcagggtcgcgccgaactcggtgtaggtctggtcggcgccttcaacgcgcccggccaggccatggatcagcgcgccggggtaaacctgcgcaatcttgcgcgccgtggccaggctgccctggcccagaatgacaatcgccgggcgcatcaaccttgccacctttcacccggcacgatgatcagcgagaaatacggcgaagacgccgggtcaacctgatccagcggcacgattttctggttggccatggtcgcgcgctccacatacagcgcgcgctcggccaggccgagttcttccagcacctgacgcaccttggggaagttgcgaccgagcttcatgatcaccgccgcatcggcgtccgccaggcgacgcttgaggtcgtcatggggcagcacgcccgagagcaccgacaggctctgattgcgatacaccaacggcgcgccgagcaccgaggcgccgccgagcatcgagcacacgccagggatgacctgggcttcatagcgctcggccaggcggtcgtgcaggtacatgtaggaaccgtagaagaacgggtcgccttcgcagatcaccgccacatcgcgcccggcgtccaggtgcgccgctacatccaggctggccgtgtcgtaaaagtcgctgatgacttgctcgtaggacagcggcgccggcagtacttcggtggtcaccgggtacaccagcggcatcaaggtctgttgcgccaccaagtggtcttcgatgatgccgaaggcgttgcccttcttgcccttggccacgaagtacgccaccaccggcgactcacgcagcaggcgcagggccttgagggtgatcagttccgggtcgccggggccgacgcccaggccaatcaaacgtccacgtgcctgcattactcgacctccgtggccaaggcgttgaccgcagcggcggccatcgcactgccgccgaggcggccttgcatgatcacgaacggcacgccacggctgtcagccgcgagcatggccttggattcggcggcgccgacaaagccgaccgggaagccgaggatcagcgccggcttcggtgcgccggcgtcgagcatttccagcaggtagaacaatgcggtcggcgcgttgccgatcaccaccacgctgccttccaggtgcgggcgccacagctccagcgcagcggcggagcgggtgttgcccaattcacgcgccagctccggcacgctgtcatcacgcaaggtgcagatcacttcattgttggccggcaggcgcgcgcgggtcacaccttcggaaaccatccgcgcatcacacagaatcggcgcaccagcggccagcgcatcgcgcccggccttgccggcgccttcggagaactgcaggccgtcaatcgcctcgaccatgccgcaggcatgaatcacccgcaccgcgagtttttccaaatcagccgggatgcgctctaacttggcttccgcgcgaataatggcgaaggagttgcgatagatctcctgaccgtcgcggatgtaatcaatcatcggtgttgctccgtgagcgtgcgcgtaacagggcgcccgccgcttcaatggaaagagtgcgtgcgtgcagccggccgaaaccgggctcggctgcctcgcgaaaatagacgtcgtagtggccggggcttaccgccagcaaagtgaccggcgcggtgtgcgcggcggcgcaggaacgcgggcagccggacaagtgcacctcagtgccaggttgcagcgcagccaattgcagggcgtcggccttggtatcggccaggcctttgccgcagccgctggaaccggtgcaggcgatcaagcgcgccaggggttggtcgaccgagcagagaaagcccaaccgctgcaaaccttcagtcacggcggcagggtttttaacgttgggcagcagtacgccttgccagggcgtgaagcgcaacgtgccgtcgccgaatgcgctggccaactgcgcgacgcctttgagcatggttgaatccagacgccccaacggcgcaacggcgcccacgtagaacagatctttttgacgctgtggataagtgcccaggtgcaacccggccccgctgaccgggcgtttgaagccatccaccggcagcagcggcaggttcagacggctcaataagttatccacagccagatgacgcatgcgcgtttgcgtcggggtcgccaggtcgagaaacagctccagcaccgcgacgaccaaggcatgaccttgctccagaggcaccgccgcgcagggcgcatccaaccccgggcaaccggccaggccgaaggccaacaacgtctcgccatcgcgctcaaacgccgacagccacacatcatggtgatgctcaagcatcgccagggcctcacagccatccagttgcacagcgaacttggctgacagctcatgaaaacgcggatggttttgcagcgtcgccaggatctgctcggccagcgggcgcgtgtcgaacagcatttgcgggtcgatgccggcgctggggctgagcatcaggttgcgcacatcatcgccgccggcgttgttcgggccaaggtcggcagccagcagcagggcgatcaaggcgtcctgctcggtgccgatcccgcgaatctgcaggttggcgcggttggtggcctcgatcaccccgcccgcgtaggcctgggccgcgtccgccaccgcaattgcctgggccgcagtgatcgagccaccggccaatttgatccgacaaatgccgccatccaacgcctggacaatacgcagcaaccccggacaagccgaggggcgcaaggtattcacagcgggcgttgggttcacggggctaccggttgacgggtaaaggcgcggtattatgcctgctttgtccggcggcatgaaaagcctgcccgtcggatgtcgttcaaggaattcatatgtcgccctggctgacggttgtaggcatcggtgaagacggcttcaaggggctgggcagaaacgcccggcatgccctgctgcgcgccactcgtattataggtggccaacgccagttggacttgttgccggtgtgtattcgaggcgagcgcgagctgtggccaagcccgttttccctggagccggtactggcgaagcgcggcgagcctgtgtgcgtgctggccagcggcgacccgatgttctatggcgtgggcgccagcctggcgcggcaggtggcggctgaagaattgctgattttgccggcgccgtcgtctgtttccctggcagcggcgcggttgggttggccgttgcaggaagtggtgacgttatccgtggtggctcggccattggcggcacttaacgcgcatctggccagcggcgtgcgcgtgctggtgttgagcaatgatgggcgcagccctgcagcgattgcctcgctattggttgagtccgggtttgggccaagccggttgagcgtgtttgaacatttgggcggcgcagatgagctgcgtatcgacgcactggcacagtcatgggcgcacgcctcggtcgccgacttgaacgtggtcgccatcgactgcctcgccgacgccaatacaccgcgcctgtcgcgcctcgccggtctgcccgactcagccttcaaacatgacggccaactgaccaagcgcgacgtgcgcgccatgaccctcgcccgcctcgcgcccatgcccggcgaattgctctgggacgtgggcgcaggcagcggctccatcggcatcgaatggatgcgcgcccacccgagctgccgcgcgctggcgattgaagccgatgcaggccgccagggcttgatcgaacacaaccgcgacgcccttggcgtgcccggtttgcaattgattcgtggaaaggcgccggacgtgctgcagggcctggaagccccggacgccatcttcatcggcggcggcgtcacccgcgacggcgtactcgacacctgctggcagcagctgcgccccggcggccgtttggtcgcgaatgccgtgaccctgcaaagcgaaatgaccttgatggcctggcgcgcccaacacggcggcgagctgacgcgcattcatgtggcacaggcccagccgttgggcgagttcgacacctggcgccaggcgctgccgatcacgctgctggacgtggtcaagccgttatgaaacgcatcctgctgctgggcggcgtaacggaagcgctggccatcgcccgcactctggggccggaacatctctacagtttggccggtgtgggccgtgtgcctaccgatctcacctgccaagtgcgtgtcggtggttatggcggggctgaaggcctcgcccagtttgttcgcgatgaaaatatcagcttgatcctcgacgccacacatccctatgcggctcagatcagccggaatgccgccctggctgcgcagtcgtgcgacattccgtgctgggccttgcggcgaccagcgtggcaaccgcaagccggggatgactggcgtgaggtcagtgattgggccgagttgattgaagcgttgaaacccttcaagcgcccgttgttcacactggggcgcgagccattgcaacacctcgatgaaatccccgccgatcagttctggacgctccgcgcgctggacgtgtacccggggaatgcgcgctgtgaagtcatcggtgcgcgtgggccgtttctgatcgaagacgagcgcgcgctgtttgagcggcgtgggattgatgtgctgatcagtaagaacagcggcagtgcggccaccgagccgaagctggaagtggcgcgggagctgggaattccggtgcttgtcttgaagcggccggtgttggctgcagtagatcgagaattcaccaccgtggcggcggtgctacaggcagtcgacacgctctaaacaccacctttccaatgtgggagcgggcttgctcgcgaatgcagtgggtcagccaataaatcactggctgacccaccgttatcgcgggcaagcccggctcccacatttggtttgtggcgggcacaaaattttggtcagacaaaaacaagtgtgggagctagcttgcctgcgatggcggtgggtcagtcagcctggccgttactgatacaccgccttcgcgagcaagcccgctcccacatttggattgtggcaggcgcaaaaatttggtcaggcaaaaataagtgtgggagctggcttgcctgcgaaggcggtgggtcagtgagcctggccgttactgatacaccgccttcgcgagcaagcccgctcccacatttggagtgtggcgggcgcaaaactttggtcaggcaacaataagtgtgggagctggcttgcctgcgatggcggtggatcagtcagcctggccgttactgatacaccgccttcgcggacaagcccggctcccacatttggattgtggcgggcgcaaaattttggtcaggcaacaataagtgtgggagctggcttgcctgcgatggcggtgggtcagtgagcctggccgttactgatacaccgtcttcgcgagcaagcccgctcccacatttggcttgtggcgggcgcaaaattttggtcaggcacaaataactgtgggagctggcttgcctgcgatggcggtgggtcagtgagcctggccgttactgatacaccgccttcgcgagcaagcccgctcccacatttggcttgtggcgggcgcaaagttttggtcaggcaaaaataactgtgggagctggcttgcctgcgatgcgggcgactcggtcttccagccaggccaaggtgatgccatcgcaggcaagccagctcccacagggttaagattggcaatctgtggttcccgactatcatgaaggcaaccactgcgacaccaaaccacaccgccgctttttacttatccccagcgatcaggctaaatacccacctgatcgcttaaccctacggattgtccgccatggcccgtcaacgctttgcaattgtgtggatcgcctgctttgcagtgctgttcaacgcctttgccatgccgatggccagtgcgatgcagcagtcccaagaccctgttcagcaattactgtggggcagcttctgttcgtccaatggtgccagcctgaagacgattgccctgggcaagctggagattccggcgccgcaacaggacgaccactccaccatgcagcattgctggtgttgctcgggctcaccgccgttggtggcgttgccagggcatgtgccgcagttgtacgtgacgcggtttgcggcggtgcagagcctgccgccgccttcgttgcaagcccccacgccgcgccagcaatggccgagccttaacccgcgcgcctctccaacggtttgatttcttcgcaagtgaactgcgtttagaaccgttctggagaactgccatgctcaaatcttccctgcttctggctgcgttgctgctgccggtgttcagtgctgccaatgccgaagactacaaggccggcgacctgcgggtcagcgatccctggtcccaggagttgccgccgaatgcgccgactgtcgcggcgtactttgtgattcataacaccggtgaaacgccggaccgcctgctcagcgtcgagacgccggtggcggacaaggccgagttgcatgaacacgtcatgcaaggcgacttaatgaagatgcagcaggtggaaaccgtcgccgtgccggccaagggtgatctaaccttcgcgccgatggcctatcacgtgatgctgctgggcctcaaggaccgcagcctgttggccgatggcaagcacttcccgctgatcctgaccttcgaaaacgccggcacggttgaagtggaagtctcggtccagaaaacgccgccaatggccggccacgagcataaacacgcgcaataggccaacgtaaatgggcgcccctcgcgccaggttatccgcacaccgccgccagcccatgagcctgatgcgcggcagttggatcagcctgttcgccatgctgatgatctttatcggtccgctgatttcccaagcgatgccgatggatcatcacgccggtatatcgatgcaaatgtcgatgcaaatgcccgcgggcatggacatgcccggcggccacggcgaacacaagcaggcgtctgacgaacaccacgcactctgggaaaagtgcggctattgcagcctgcttttcagttgcccggccctgcccggcagcgtgtcctgcgtcagcctcggcactccgccgccggacaacgccattaccgccgccacccgcctgggccatgcccggcaaagcatcttccccggcgcgcgcagccgcgcaccgcccatcactgcgtaagcacttcaactccttacttcacaccggccgactttagacagacagccgcaggctgctggccgtgttgtttacgcttgattgatggaatttgtcatgtccaggttttctgctgacacccgtttgggacgtacccccgttttcgctgttttgtgtggcgcgctgttggtgccacaggcacacgcggatgatcacgagttgagtcccacggtgatcaccgcgattgcccccagctcgccgctgaccgtgattaccaacccgaaagacccacgccaaccggtgcccgccagcgatggcggcgactacctcaagaccatccccggcttcgccctggtacgcaacggcggcaccaacggcgacccggtgttgcgcggcatgttcggctcgcgcctgaacatcctcaccaacggcggcatgatgctcggcgcctgcccaggccgcatggacgcgccgacctcgtatatttcgccggaaacctacgacaaactcacggtgatcaaaggcccgcaaaccgtgctgtgggggccaggcgcgtcggccggcaccatcctcttcgaccgcgaacccgagcagttcggcgagttgggcacacgggtcaatgccagcgtgctggccggttccaacgggcgcttcgacaaggtcatcgatgccgccgccggtgggccgctgggctacgtgcgcgtgatcggcaaccaggcgcatgccgatgactacaaggacggcaacaaccacacagtcgcctcgcgctacgacaaatggaacggcgacgtcgccgtcggtttcacccccgacgccgacaccctgctggaactcaccgctgggcgtggcgatggcgaagcgcgctacgccgggcgcggcatggacggttcgcagttcctgcgcgaaagcctcgggctgcgttttgaaaaatccaacatcggcgaagtgctggataaggtcgaggcccaggtctactacaactacgccgaccacgtgatggacaactacagcctgcgcacgccgtcgggcaccggcatgatggccgggcccatggcctccaatgtcgaccgccgcaccctcggcgcgcggatcaaggcgacctggcgttgggctgatgtgcagctgatcagcggcctggatgcgcagaccaacgagcaccgccagcgcagcagcatgggcatcgacacctacaaggacctgccgcgcaacaaggacgccaacttccacaactatggcgtgttcagcgaactcacctggtacgccgccgagcgtgatcgcctgatcactggcgcacgcctggaccgcgcctcggccaaggattttcgccagaccaccggctcgggaatgatgtcgcgccccaacccgactgccgacgacacccgcgccgagacgctgccgtcgggctttgtgcgctatgaacacgacctggccgacacacccactaccgtctatgccgggctgggccacgccgaacgcttcccggattactgggagctgttttccccgaacaccggcgcggtcggatcagtaaatgccttcgatggcgtgaagccggagaaaaccacccagctcgacttcggcgcgcaatacaaaaccgccgacctcgaagcctgggcctcgggttacatcggccgggtccaggacttcattctgttcgactacaggcccggcatgatgggcaccacctcccaggcgcgtaacgtcgacgcgcgcatcatgggcggggaagtgggcgcggcctacaagctgacgcgcaactggaaagccgacgccagcctcgcctacgcctggggcaagaacaccagcgacggcaaggcactgccgcagatgccgccgctggacgcgcgcttcggcctgacctacagcgaagacgattggagcgccggtgccttgtggcgcgtggttgcagcgcaaaaccgcatcgaccagaacaagggcaacgtggtcggcaaggacttcgacaagagtggcggctttggcgtgttctcgctgaacgcggcgtaccgcatcaataaaaacttcaaggtcagcactggcgtcgacaacctgttcggcaaggcttacgccgaacacttgaacctggccggtaacgcaggcttcggctacccggccaacgacccgcaagccatcaaggagccggggcgcacgctctggaccaaggtggacatgagcttctaaaagcatcgcaagcaagccagctcccacagtcgaaatgcattcccctgtgggagcgggcttgcccgcgatggcggcacaacggacccaaaaaaattaaagccttgcggagcccaatgatgaccactcaaaagatttccttctacaacctggcctggcgctggcacttctacgccgggctcttcgtcgcgccgttcatggtgctgctggccctgaccggcatcatctacctgttcaaaccccagctcgacccgctgatgtatggcgacctgctcaaggtgcaagccgccgagcacgcactgagtgccgacgaacaattgcaacgcgcccaggcggcatatccccaaggcaaaatcagcaaatacctgccgcccgccgacgccaccagcagcgcgcaattggtgatgcataacaacggccgcgaagtgaccgtattcgtggacccgtatcgcggcaccgtactcggcgaacaagactccaaatacaacctgcaagccatcgcccgcgcgcttcacggcgagctgatgatcggcaccgtcggcgaccgcctggtggaactcgcggcgggttggggcgtgatgctggtggtgtccggcgtgtacctgtggtggccgcgcggcaagtcgtcggccggggtgttatggccgaggttcaacacgcgtggccgagtgttctggcgcgacatgcacgcggtcgccgggttctggggcgcggcgtttttgctggtgatgctgctcagcggcatgacctggaccggcttctggggcaagcaatatgccgagctgtggaatcgctttccggcggcgatgtggaacaacgtgccgcagtctgatcagcaggcacgcgtgctcaataccgccagccaacagaccgtgccctgggccatggaaaacacgccgatgccgatgtccggcgaccacgccgaacacatgaaccacggcgccatgcactccggcccggcggcgcccacgattcgcctgcaacaagtggtcgacctggccaacgcgcgcaaggtcgagcccggctacagcatcaccttccccaccaccgccgaaggcgtgttcaccattgcggtattcgccaacgacccgcgcaatgacgccaccctgcatgtggaccaatacaccggcaaggtgctcgcggatgtgcgctgggcgcactacaacaccgtcgcccgcgccaccgaaaccggggtgatgctgcatgagggcaagatgttcggctgggtaaaccagctgatcgtgctgctgatctgcctgatgattttgctcagcgccgtcagcggcgtggtgatctggtggaagcgtcggcctgcgggtgggctgggtgtgccgcctctgcgtcatgacctgccgaagtggaaaaccgcgatggtgatcatgctggggctggcgatcattttcccgttggtgggggcttcgttgatcgtggtgtgggcattggatcgcctggtgttggcgcgtttttttggccaacgtgaatctgcctcaggttctgcatgaagccggcgagatgcccataacagagcccttctgtagccttgcgcgacttttgtctcgcagccgataagtgttaacttataacactttctgcgttatcgttgctcgccgcgccctgcggcgagcaccttccaagaagcgattgatcgaccgatgaacaagtaccttgcgtccggcctgtgcctgctcgccctgcacaacagcgcccaggccctgactctgcccgccagccccgtgaccgcgcccgccatggatgacgaacgcgtcgacctgaacaccccgaccaccgccggctcgcgcctgaacctcacggccctgcaaacccccggcagtgtcgagagccagaccggcgagaacattcgcgaacgcggcgacgccagtgtgcaggacgctatctcccgcgccaccggcatcagccgcaccggcacgcccggcgacggcggcacctcgttgcaggcgcgcgggtttaccggacagagttcggtgctgcagctgtacgacggccagcgcatgttcgacggcgcgggcacgtccaccttcccggtggacacctggtcggtcgagcgcgtcgacgtattgcgcggcccagcctcggtgatgtacggccagggcgccaccggcgcggtgatcaacacccttgcgaagaagccgtttgaaggcgagatcgaaaaccacatccgcctcggctacggttcctatgatcgccagcagcaagccctggacagcggcggctcgctgactgatacgctgagctatcgcctgaacgtcaaccgcctgcgcagcaacggtttcatcgcgcgtggcgactccgccagcgacttcgtcagcgctgccctgcgttggcaaccggccgagaacctgagcttcaccctggctcacgactacggcgaccagagcccacagaatgactacggcacgccgctgatcaacggccagttgcacaaaagcctgcgtgacaagaactacaacgtcagcgacgacaaacagcactacaacgaccagtggacgcgcctgaccagcgagtggcagctcaacgacaacgtcactgccaccaacgagctgtcgtacctgaaaaaccagcgccgctggcagaacgccgagagctacaactttgtcgacggcgggctcgtacgccagagctacctgggcatcaagcacgatcaggaacaggtcggcgatcgccagacctttaccttcaagcacacgctgttcggcctcgacagccagacggtgacgggcgtcgagtacaaccgaattcgcttccgcctggccagcaacgcgccgttcatcgatgcaacggagcaaggccagccggtggatatcaaccacccagtgccgcagccgtttgaaagcgccagcccgtttattgcgcagtctgtgactaccactaaacaactggccgcgtttgccgaaaaccgcctgcaactgactgacaaactgtcgctgatcaccggcgcgcgccgtgactatctgcacatcgacagcaacgacctgaccaccgcgaaccaggacaccgacagaaccctcaccggcaacaactggaaagccggcctggtctacgcgatcaccccggacacctcggtctacggccaatacgcgaccagcaccgacggcgtcggcagcctgatcagcttgagcccaagccagcagcagtttggcctgtccaccgcgaagcaggccgaagtcggcatcaagcaggcgttctgggattcacgcggcgagtggacgctggcggcctatcacatcgttaaaaagaagctgctgacagacatccccggcaccacgctgcaacaacaagtcgggcagcaatcttcgaccggcctggaagccagcctcgacctgcagctgccgaacgcttggcagttgcaagcgaacgccgccattgtgcgggcgaagtacgacgactttttcgaaacggtgaatgaccaggccgtgtcccgcgccggcaaccgcccggtggacgtgcccaaccgcaccgccaacctgtggctgagcaaggccgtgagcgacaatgtgcgcgccggcgccggcgtgcgttacgtcagcgcgcggtatgccgacaccgccaacaccagcgaagtaccgagctacaccgtggccgatgcgagcgtgtcgtggaaggccatgcgcaacaccacgctggggctggaactgaacaacctgttcaaccgcacttacgccgtcagccagtacaacaacggccaacagtggattttgggtgagccgcgctcgttcttcgtgacggcggattacaccttttaacggaatgtcacacactccaatgtgggagctggcttgcctgcgataacggtggttcaggcagtgcatctgggccagacataccgctatcgcaggcaagccagctcccacagttgaactgtgttgaaccagggaataacgatgacttcactcaccctcacccagcttggctggaccccaccgggtcacgaccactgcaaccaccgcttccagctgcgtgaggccagcctgcaggtcgctgtgggggagtttgtcgggctgatcggccccaatggcagtggcaagaccagcctgttgcgctgcgcgtatcgcttcagcaaaccggagcacggcgacgtgctgctcgaccaccagaacgtgtggaagcaaagcgccaagtggtgcgcgcaacgcatcgccgtggtgctgcaggagttccctgacgccttcggtttgcgcgtggatgaagtggtcgccatgggccgcacgccgcacaagggtttgttcgatggcgacacgctgcacgaccagcaactgatccaggaggcattggcgtcggtgggcatgcagggcttcgaagaccatgccttcgccaccctctccggcggtgaaaaacagcgggtgattctcgcccgcgccttggcccagcaaccgcatttgctgattctcgacgagccgaccaatcacctcgacccacgttatcagctggaactgttgcggctggtcaaacgcttgaacatcggcaccctggcgagcatccacgacctgaacctggccgccgccttttgtgatcgcctgtacgtgatcaaccacgggcgcatcgtcgccagcggcacaccacaccaggtactgactaccgaattactgcgcgacgtgtttggcgtcgaagccctgatcgacactcaccccttgtccggctacccccgaatcacctggataacccaaccatgatcctgcgcgccctgctgtctctcgccctgtcgttcggcaccgctcaagcctttgccggcgcgacccattacccgctgaccatcaaaagctgcaaccgcgacgtgaccttccaggaagcgccgcaacacgcggtcagccacgacatcaacatgacccagatgatgctcgccctgggcctcaagtcgcacatggccggctacagcggtgtgaccggctggaagtcagtcaccccgcaaatggcccacctgctcgacggcctgccggaactggccagcaaatacccgtcagtggaaaccttgctcaatgccagcgtggatttcttcttcgccggctgggactacggcatgcgcgtgggcggcgacctgacgccgcaaaccctgcaacccttgggcatcaatgtgtacgagctgaccgagtcgtgtgcgtttgtgatgaagcgcccggccgcgacgcttgaagacacctataacgacctgcgcaacctgggcaagatcttcgacgtgcaggaccgcgccaatgccttgatcgcgcagatgcaggcgcaagttgccgaggtgcaaaaggacctgcccgtcgacaagccgcgcgtgtttctctacgacagcggtgaagaccgcgccatgacctccggccgcctgggcatgccgcaggcgctgatcgacgcggccggtgggcgcaatatcctcgatgacatcgacgccagctggacccgcgtcaactgggagaccgtggtggagcgcaacccgcaggtgatcgtgatcgtcgactacagcgaagtcaccgccgagcaaaaacaacagttcctgctcaacaacccggcgctgcaatcggtggacgccatcaagaaccagcggtttatcgtgatcccgtatgtgcaggccacgccgggcatcgacaacgtgctggcggtggaaaccctggccaaggggtttcacggcgaatgattacccggcgctacgccttgttgctggccgcgcttggcgcgttgttgctggtctcttgcgtgatctccctggggttcggctcggcgcgggtgccggtggatgtggtgtggcggattttgctgaacaaggcgttcggtatcggtgaggtgaattggagcaccggccaggaacatatcgtgtggctgatccgcgtgccgcgcatgttgctcggcgcgctggtgggcgccgggctggcgttgatcggcgcagtattgcaggcggtgacgcgcaacccgctggccgacccgcacctgctcggggtgacctccggcgccacgcttggcgcggtgatcgtggtgttgcatgtgggtgaaatcatcggcctgctgacgctgcccatcgctgcgtttatcggcgcgctgctgagcatgctggtggtgctggccgtggccagtcgcaacggtcgcctggaaagtgatcgcctgctgctgtgcggcgtggcggtgtcctttgtgatgatggcggtggccaatttgctgctgttcatgggcgaccaccgcgccgcgtcggcggtgatgttctggatgctcggcggcctgggtctcgcccgctgggagctgctggcgatccccgccgcgaccgtgctgctggggctgctgttgctgctgggcatggcgcggccgctgaatgcgttgatggccggcgagcagaccgccgtgaccctgggcctgaacgcgcgcaacgtgcggctcaaggtgttccttgtcgcatccttgatgaccggcgtgctggtgtcgatcagcggctccatcggctttgtcgggttgatggtgccgcacattgcccggcgtttggtcggagccgagcatcgacgattgctgcccgtgtgcgtgctgctgggcagtgtgttcctggtgtgggtcgacgtcgccgcacgtaccctgatcgcccccgaagacctgcccattggcgtggcgacggcggcgattggcgggttgttttttatcggcctgatgcgcaagcgctgaggtcagagttcatcttttgcccgtgcgtaccagaactcgtcggcttccggttctgcctgtaactcactgacgctccactcttcagccagcaagcccggacgcgaccagaaggcgtcggggacctgcaccgacaaactgccctggctgcgcaatcgactgaccaacacactcgggtccggcgcgccccccgcctccagcagctccgtttcagctgcggtaaacgccggcacatacttgagcattgccccgccccggcaggacaggtaacaactcttggcatcgggcgcattccttttgatcagcgccaggtagtcgcgcagatcatccttggagacgaagttttccagcagatccttatcaatctgcgcatagctggacgtcgactggatcgccttgtagaacgcctgcacggcggcaattttgtaggtgctcaacacgttgcccggcggcacgtcgaggcctggatgatcaactcggaacaaccgctccaggctgcgtgcagcgccggtgccctgatcttccaccggttcgatcgccacataccccggcgtttgccccggaaccagtaccgcgcccacatactgcttggtcttgtagggcgccaccagccgttgggcatagcgggctgcgtcatcggggtaataaaacaccggcccgcagtaggaatgaacatacgggtcgtcggcaaacgggcggggcgttcttttcggcacccaatcggccgtgacccgctccttcctgccccaaacttcactggtgccgcgaatatccagttcacccgccccggcgaggcggcgcacatagtcttggaccttcagcgagccttcgagtaattgcaggcggtagtccgcgctcgtccatgggtagagtggcgaagtcttgggaaacacgtacttgagcaacgcgccgtcgccgcacaacaaatacagcggcagcacaccaccgttgcgcgcatacagagtgaattgcagggccttggcgatgtagtgaggcgggaaaaaactgtatgccatttcatcatcggccggggcgacggccgccgtcgaagcacacagatacaggccatcgagcacatacccctggggcaactggccgtcgagaaaaacctgcttgaagtcggccaggttttctctgaccagcgccagcgtcgtcatgtacagcggcttgttcactgacttgagtacataaccgaacgccacatcggtttgcggcgcgcactggcgttgggcataacgaacggcgtcatacgcctgggtgaagatcgggccgcagggcgcgtcggcgaatacctggcgaatatccccaggctggggtcgcgtttgatacggcacaaaacccggggttatcttcctgggttcgccccatacgctgtcgccctttaccacacgcagttcaccggccttcgccgtctcatcgatgaacgcctgtggcgagagcgccccgctgcgcagttgctcttcgacagggttgtcgctgaagtccaacttgaccgggctcagtggcgtcaggcgctgcttgagcagcacctcctcggcagagtccgacagttggtagctgaggatcgaacccgtggcgccgaacacatactcctgtttgatcgggtcctggcggtgcaacaggctcgacaataccgcgctcggcagcatggttttgtacaaggctttctgctcggcggacagcagcaacgggacctcctggtccaacaacgaccggtagcgcgccacaatcgcactgcctccggggtacagccctaccgcaaccgcctggtccgggtaaatccagttcagcgcaaacccctgcatcggaagtgccagcggctcagttgcggcgaacaacccggtgggtaaccgcagaatgaccccgccatacccccgctgccagccgttgctgatcatggcggcggcatagcgggccgcgtcatcgaggttggcgaaagccgggcttaaccggcgcggagacaacgtcgcataactgttccagttgttgtcgaccaacccgtttttgtcccagcactggctggtgcgaaccacgtgcagcccgcccttcacggcccactcccgaacaaactccgcaggggctttctgaccggagttcaactgctcctgcgcctgaatcagcgacctgtcggccaggcccgcacttctcacgtccatcggcgcaggcacataccgcagcagcgcgccatccagggttgagaagtaaatcgacaggttgttcatgccctgccgattagccgcgtagagggctgcgtacaacacatccggcgtgacaaaaaacagcgtcagccaagcgttcgaggcattcagcccggtcggcgaccattgctgcgaacggaacagcccatacaacacaaacccgtcaggcaggcggtagctgtcatcggcggtgcgctcaaacaggctgttgagattgaacaacttttgctgccccgccacgcccacgacttcgctggcaatgtactgctcctggtccttgtgcttgagaatgaaggcaaagcaggcctgctcggcaaagtttcgcccatgcacgcgcccgtgcaggttacgcgcagccgcatcggcactgttgaacacggcgccgtaggtggcgtagtcgggcgggccggaccgtggcgcgtagctgtagctgggcgtccagtcttcgtaaatcaccgagcgcggcccccacaatgggttgccctggatgatcttgaaatccccggcttcggccacgcgccggacccagtcggcgggccggatctgcccgttttcaaggcgcttggccaggctgctgctgccgacttccgggccgatattacccagcagcacctcttcatgggacgaatggtttggggtgtattccaacaggcaattctgcgcacccgacaggtacgccacccggccagccgtgatgatcgagtacatttcagcgtcggaaaacccttgctggatgatctgcgcctcatcccgcgtccagccacgctgtgcaacccaggccgggtcggccatcgacagggcggtgtgggagccgtagcgcccgtgcaacacatagggttccggcgggatcagcggcccctggttgtcgaacggaaagaacagtgtgaaggcaaacgggttggccacactggcgatgggttcggtgatgacaaaacgaccgtctgcgtccttgaggatataaccgccgtagctgcgggctcgccagttgccaatttgctcgtgggcatacacggccgcatcccgtgcagagagaaacgaacggctcaaggtggccttgtaaaacgacatcagcaggttggtgcggttatccaacatgcccaccgtgcgccataagcctccggcctgaaccaccgacagatcggtctgggcaatgaccctgcgcacataatcccgagggctcagcgtgccgtcgaccatggccgcctgtgcgccgttatcgtcaagttcacccgcgcttttttgcctgaccagctcagtcgtggccgtggcctcgggcactttgaaggccaacagggcgccgtctgaggcgtgcatgtacaggcgcaacccgcgcgccgggtcctgaatgcccagggttgcctgcgcctgacgggtggcggccaccacctgtgccggagtaaagaaggtgcttgccaaccaggtttcccgcgccgcgacttcgttcttctcgtaccagctattgaagtaaatagcctccaatcggaagttggaaggcaatcgaagtttgccgtcggcgcgttttggaaacacgtcgtttggcgaaaacagcggctcacgcttgggcactgccagcgtcgccacaaaggcgtcttcacgggtgtgcttgaggacaaagcccatggcgcctgcagtgagcgagccagcagccgaaagcgcccccaaaacggccgtatccgcggttgggaacaccgaggtgaaaaagggttgttgtgcagtactgctgctggtcacaggcgtgttgattcgccagcctgttttcacccggccgcgcacgccgccccacaccttatttgcaatcagcacccacagctcaccaatctgcgccaggttccagatcgggttctcgaaatcacttttggcctcaagcgtgccatcgcgcacttgctgggcgaaggtattttccgccaccgagccactgctgacatatttgagcagcacgttatcgggcccggagaaatagtgggtcttggcgaatgctctgtttctgaagctgaagagctggtccggcatggagtagaaattgttgaacaccacgacttggtcggtcgtgaagtagggaaacatcctttggatctgtgccgcatccgccggatgggagtggtagaacgcctcggcgctgtagccatcgggggtgatgaagttgccttcactgtccacggccaacaggatccggtgatcgaaactattgcgctggtccggcaccgggtgggtggcgtagtagcgatgggcgcgcttgagaataacgccaccgtactcgacatcgcgccgtgtaccgatggcctcgtgtgcccaatgcgcggcgtcgtcggcgctgataaaggccgggctcagggcaggtaacttggcaaggtcatgtgaggggtgggcttgagtaatgtccataagtgtctcgctgacaagagggtcgcgggcgcgttcgttgcgcctcacgtagggcctcatgctgaaacatccttgccgaccacttgcgctgcatatctacgcctgcgccctttttcagggcttggcgtgcacacgacgctcatcgcagcgccaagttggtgcgcatctcccccgtcggtatcggccggcccccgccattacgcgtgttaagtcgcgcaggcacagcctttgcaaagtcctgtgcatctgccccacaaaaaaatcggtttacggagatcgcaccatgcagcgtcgtagcttgatcaaggcttttactttgtcggcatccattctcgccatggggttgacctggaccgtgcaggccgccgagaccatcaaggtcggcatcctgcactcgctgtccgggaccatggcgatctccgagacctcgctcaaagacatggcgttgatgaccattgacgagatcaacgccaaaggcggtgtgaacggcaagatgctcgaaccggtggtggtcgacccggcgtcaaactggccgctgttcgcggaaaaaggccgccagttgctgacccaggacaaggtcgccgtggtgttcggctgctggacttcggtgtcgcgtaaatcggtgttgccggtgtttgaagaactcaacggcttgctgttctacccggtgcagtacgaaggcgaagaaatgtcgccgaacgtgttctataccggtgcggcgccgaaccagcaggcgatcccggcggtggaatacctgatgagcgaagaaggcggcggcgccaagcgcttcttcctgctcggcaccgactatgtgtacccgcgcaccaccaacaagatcctgcgttcgttcctgcactccaaaggcgtagccgataaagacatcgaagaggtctacaccccgttcggccacgccgactaccagaccattgtggccaacatcaaaaaattctcggccggcggcaagaccgcggtgatctccaccgtaaacggcgactccaacgtgccgttctacaaagagctggccaaccagggcttgaaagccaccgacgtgccggtggtggcgttctccgtgggtgaagaagagctgcgcggcatcgacaccaaaccgctggtgggcaacctcgcggcctggaactacttccagtcggtggagaacccggtgaacaagaaattcgtcgccgactggaaggcctacgccaaggcccacaacctgccgggcgcggataaagccgtgaccaacgacccgatggaagccacctacgtgggcatccatatgtgggcgcaggcggttgagaaagccaagtccaccgatgtcgacaaagtgcgtgaagccatggccggccagaccttcgccgcgccgtcgggcttcaccctgaccatggacaagaccaaccaccacctgcacaagccggtgatgattggtgagatccaatcggacgggcagttctcggtggtgtggcagaccgaaaaaccgatccgcgcccagccgtggagcccgtacattccgggcaatgacaagaagccggattacgccgtgaagagcaactaatccaaggggtgtcggcagctgagagctgacacaaaccctgtgggagctggcttgcctgcgatgctgacactcgatatgtctgatgcaccgctatcgcaggcaagccagctcccacatttgttcgagcaaggcccaagaatatgcccactgccctttaccgcttcatcctcgccgccctgctgttgctgccttttgcagcacatgccagcgacgccgacgacttcctcgctgccaacccgatgcaacaagccaagctgctccaggattgggccgcacagcccgaccccgcacgcatcgagctggtggacgcgctgcaacaaggccagatcacggccaatggcgaaaccaagaccgtacgcctgaacaaccgcctgcgtggcctgatcgacaacgttcaagccagccagcaactgctcgccgccgaccccaaggtgcgcctggcagcggcacaaaccctgcaaaaaagcgctgtacctgcccaactcaaattcctcgaccagcaagtcgccgccgagaccaacgaggacgtgcacaccgccctcagcctggccctggccaacctgcaactggtcgacagcgaccccgtggtgcgcctcgccgccgtgcgtttgctcggcggcaccggcgacccgctggcgcgcacgcgcctcgaagcgttgctcgcgcccggcgtcgaaaccgacgccgccgtgcacaccgccgccgagaccagcctggcccaggtcaaacgcaaattgatggtcggcgaaatcctcggccaggccttcagcggcatgtccctgggctcgatcctgctgctcgcggccttgggtttggcgatcaccttcggcctgctcggcgtgatcaatatggcccacggcgagatgctgatgctcggcgcctattccacctacgtagtgcagttgatgatgcagcgctacgtgcccgcggccatcgagttctacccattggttgcgctgcccgtcgcgttttttgtcaccgccgccatcggcatggccctggaacgcacggtgattcgtcacctctacggccgcccgctggaaaccctgctggcgacgtggggcatcagcttgatgctgatccaactggtgcgcctggtgttcggtgcgcagaacgtcgaagtgtccaaccccgagtggctgtccggtggcattcaagtgctgcccaacctggtgctgccgtacaaccgcatcgtgatcatcgccttcgcgctgtgcgtggtggtgctgacctggctgctgctgaacaagacccgcctgggcctcaacgtgcgcgccgtcacccagaaccgcaacatggccgcctgctgcggcgtgccgaccgggcgcgtggacatgctcgcgtttggcttgggctccggcatcgccggtctcggtggcgtggcgctgagccagatcggcaacgtcggcccggacctgggccagagctacatcatcgaatcgttcctggtggtggtgctcggcggtgtcggccagttggccggtagcgtgatggccgccttcgggctgggcatcgccaacaaaattctcgaaccgcagatcggcgccgtgctcggcaagatcctgatcctcgcgctgatcattctgtttatccagaaacgcccgcaaggactcttcgcactgaaaggacgggtgatcgactgatgaaccagccattgatgcttacggccacacaaaaggccggccccaaggtgacgatagcggtcggcgcggtgatcctgatcctgctgctggcgctgccgctgtgctcgctgctgtcgccggaaaacccgctgcatgtgtcggcctacaccctgacactggtgggcaagatcctctgctacgccatcgtcgccctcgcgctggacctggtgtggggttatgcgggcatgttgtccctgggccacggtttgttctttgccctgggcggttatgcgatgggcatgtacttgatgcgccaggcctccggggatgagctgccggcgttcatgaccttcttgtcgtggaccgagttgccctggtattgggtcggcaccgaacatttcctctgggccatgtgcctggtggtgctggcgccgggtttgctcgcgctggtgttcggttttttcgcctttcgttcgcggatcaagggcgtgtatttctcgatcatgacccaggcgctgacgttcgccgggatgctgctgttcttccgcaacgagaccgggttcggcggcaataacggcttcaccaacttccgcagcatcctgggttttggcattaccgagccgggcacgcgggcggtgttgttttttgccaccgtggtgttactggtggcaagtttgtacaccggctggcgcctggcgcagagcaagttcggccgcgtgctgacagcattgcgcgatgccgaaaatcgcctgatgttctgtggctacgacccgcgcggtttcaagctgtttgtgtgggtgttgagcgcggtgatgtgtggcttggctggcgcgttgtacgtgccgcaagtgggcattatcaaccccagcgagatgtcgccgaccaactccatcgaagccgccgtgtgggtggccttgggtgggcgcggcacgctgatcggcccgctgctcggcgctggtgtggtgaacggcatgaagagctggttcaccgtggcgttcccggaatactggctgttcttcctcggggcgctgttcatcatcgtcaccctgtatttgcccaagggcgttatcggcttgctgaagaaatgaggaatgtcatgctcgaacctattttcgatgcgggcagcagccgcgatgccatcggccttggccaggccgccggcaagggcctcaacacccgccacggcaccatcctgaccctggaagacatcagcgtcagcttcgatggtttcaaggcgctcaatgacttgaacctgtacatcggcgtcggcgaattgcgctgcatcatcggccccaacggcgcgggcaagaccacgctgatggacgtgatcaccggcaagacccgccccagccacggcaaggcctggttcggtgaaaccctggacctgaccagcatgagcgaagtgcagatcgcccaggccggcattgggcgcaagttccagaaacccacggtgttcgaagccctcagcgtgttcgaaaacctggagctggcgcagaagaccgacaagtccgtgtgggccagcctgcgcgcgcgcctgagcggcgagcagaaagaccgcatcgatgaagtgctcgacaccatccgcctgaccgcctcggtgcagcgccctgccgggctgctgtcccacgggcaaaagcagttcctggaaatcggcatgctgctgatgcaagacccgcagttgttgctgttggacgagccggtggcaggcatgaccgacgccgaaaccgaattcaccgccgaactgttcaagcgcctggcgggcaagcactcgctgatggtggtggaacatgacatgggctttgtcggctcgattgccgaccacgtcaccgtgttgcaccagggcagcgtgctggccgaagggtcgctggagcaggtgcaggaaaacgagcgggtgattgaggtttatttgggccgctgatcgttcccacgctctgcgtgggaatgccgccctggacgctctgcgtcggctgtgtgacgcggagcgtcacggtatgcattcccacgcagagcgtgggaacgatcaagcgtgggaacgatcattgaggagaatttgaacatgctgcaagtcgacaagctgcaccagtactacggcggtagtcacatcctgcgcgggctgtcttttgatgtgaagatcggcgaagtcacttgcctgctcggccgtaacggcgtgggcaaaaccaccttgctcaagtgcctgatgggtttgctgccggccaaagaaggcgcggtgaactgggaaggcaaggccatcaccggcctcaagccgcaccagcgcgtgcacgccggtatcgcctatgtgcctcagggccgcgagatttttggccgactcacagtggaagagaacctgttgatgggcctttcgcgttttccaggctccgaagccaaggaagtgccggcgtttatctacgaactgttcccggtcttgcagcagatgaaacatcggcgcggcggcgacttgtccggtggccagcagcaacagctggcgatcggtcgcgccctggccagccgcccgcgcctgttgattctcgatgaacccaccgaaggcatccagccgtcggtgatcaaggaaatcggcatggtgatcaagaaactcgcggcgcgtggcgatatggcgatcctgctggtggagcagttctacgacttcgccgccgaactggcggaccagtatttggtgatgtcccgtggtgaaatcgtgcagcaaggccgaggtgaaaatatgcaaagtgagggtgtacgcgggctggtaaccatctaatctgtagcgtcctaacgataagcacaaaaacatgaacttgcccgttacccccgccctgttcactcccagctggcacgccgagctggaactcggctacgcgcgtttcggcgataccacgcggccggtgatgcgccgccacctcggcccgctgcgggtgcaaaagcacctgtacgccgaaggcccagaagtgtgccagcacatcatcgtgcacccgcccggcggaatagccggcggtgatcgcctggacatcagtgcccatgttggcgccggtgcctgggcgcaattgaccagccccggcgcggccaagtggtatcgcgccagcggcccggcgtatcaacagctggagttgaccgtgcaagccggcgccaccctggaatggctgccccaggaaaccatcgtgttcagtgcggcccaggccgaactcaccacgcgcattgagctgcaaggcgatgcgcggctgttctactgggacgtggtcgccctcggccgcccggccagtggcgagcgttttgacctcggccactttcaatcgcacctggatattcgccgcgacggccagttgctctggcatgagcgccagcgcattgtaggcgccgatggcttgctcgactcgcccatcgggctggacggtcaaccggtgtttgccacgttgttgctcacggctgatatcgaacctgaattattggaaacctgccgcgccttgccgcatgcggtgcgcggtgatctgacccaactgccgggcttgctggtcgcccgctgcctggccagtgaagcgctgctggcgcggggttggttgattgatttatggaaactgttgcgcccggcagtccttgggcgccaggcggtttcaccccgaatctggagcacatgaagatctgaagtggagcaagcccctgtgggagctggcttgcctgcgatgcagacaactcggtattgctgatgtactgaggtgatgccatcgcaggcaagccagctcccacacaagcccgctcccacatttgatctctattgcagttaagaatgctttttacgaaggaccttgaaccatggatttgaccccacgggaaaaagacaaactgctgatcttcaccgcaggcctggtcgccgaacgccgcctggcacgtggcgtgaagctcaactacccggaaaccatcgcctacatttccgccgccttgatggaaggcgcccgcgatggccgcaccgtcgccgagctgatgcacttcggcaccaccctgctcagccgtgaacaagtgatggaaggcatcccggaaatgatcccggatatccaggtggaagccaccttccccgacggcaccaagctggtcaccgtccaccagcctatcgcgtgagaaccgaccatgattcgtgatgccaccgagcaagacctgccggccattcgagacatctacaacgacgcggtgttgaacaccacggcgatctggaacgaacaacccgtggacctggccaaccgccaggcctggttcagtgcgcgccaggcccaggcgtatccgatattggtgagcgtcgaaaacgatgaagtcaccggctacgcctcgttcggcgactggcgacccttcgagggtttccgctacagcgtcgagcactcggtgtacgtgcgcaatgaccaacgcggcaaaggcctgggccctcgcctgatgcacgcattgatcgaacgcgccggcacctgcggcaaacacgtgatggtcgcggccatcgaaagcggcaaccaggcgtctattcgcctgcatgaacgcctggggttcatcaccaccgggcagatgccgcaagtgggcatcaagttcggccgctggctggaccttacctttatgcaactgacattgaatccgggcgccgaaccgcccaaggagtgagatcgatgagcgctgcacaactgcgtcgagtcaatgctgaaagttttgcccattaccgcctgggtttgattgagctattgctcgacgcggtgcagcacggcgcctcggttggcttcatggccgacttcgatgaagcccaggcccgcgactacctcaagggcgtgcaagccagtgttgaagacgccagcctgctgctgtgggtggtggtgcgcgacgagcaggtgatcgccagcgtgcaattggcgctgtgtcagaaagccaatggcctcaaccgcgccgaagtgcaaaagttgctggtgcacagcagcgcccgccgccatggcctgggccagcaattgatgaacaccctggaactcgccgcgcgccagcacaagcgcggcctgctgtacctggacaccgaggccggctcgggcgccgaagccttttatcagtcgctgcactacaccaagatcggtgagctgcccgactactgccaaagcccggacgggcgctacagcccgaccgccatctacttcaagaccctggggcaacctgcatgattcctggtgaatatcagatccagcctggcgacatcgaactcaacgtgggccggcgcaccgtcaccctcagcgtggccaacagcggcgaccggccgattcaggtgggctcgcattaccattttttcgagaccaatgacgcactgacgtttgatcgcgccgccagccgtggcatgcgcctgaatattccggccggcacggcggttcggtttgagccggggcagagccgcgacgtggagttggtggatttgagcggtgggcgccgggtgttcgggtttgccggacgcatcatgggcgacctgtagttttgatcgtccccacgcgcagcaaagggatgccgccatggacgctccgcgtccgctcttaacgtcgtgacgcagagcgtcacaggatgcactcccacgcagagcgtgggagcgatcgaggacacacacatgaagatttccagacaagcctacgccgacatgtacggccccaccgtcggtgacaaggtccgcctggccgacaccgatctgttcgtcgaagtcgagcaggacttcaccgtttatggcgaagaagtgaaattcggcggcggcaaggtgatccgcgatggccagggccagagccaattgctcgcccatgaggtagtggacaccttgatcaccaatgcgttgatcatcgaccactggggcatcgtcaaggccgacgtcggcttgaagaacggccgcattcacgcaatcggcaaagccggcaacccggacatccagcccggcgtgaccatggccatcggcgccagcaccgaagtgatcgccggtgaaggcatgatcctcaccgccggcggcatcgactcccacgtgcatttcatctgcccgcagcagatcgaagaggcgctgaccagcggcgtcaccaccatgatcggcggcggcaccggcccggccaccggcaccaacgccaccacctgcacctccgggccgtggcacctggcgcgcatgctgcaagccagcgactcgttcccgatgaacattggttttaccggcaagggcaacgccagtttgccggagccgttgatcgagcaggtcaaggccggcgccatcggtttgaagctgcatgaagactggggcaccacgcccgcgagcattgataactgcctgaacgtcgccgaccaatatgacgtgcaggtggcgatccacagcgacaccctcaacgagtccggttttgtcgaaaccactctggccgcgctgaagggccgcaccattcacacctatcacaccgaaggtgccggtggcggccacgcgccggacatcatcaaggcctgcggctttgcgaacgtactgcccagctcgaccaacccgacccggccgttcacgcgcaacaccatcgatgagcatctggacatgttgatggtctgccatcacctggacccgagtatcgccgaagacgtggccttcgccgaaagccgcatccgccgtgagaccatcgccgccgaagacatcctgcatgacctcggcgcgttctcgatgatcagctccgacagccaggccatgggccgcgtcggcgaagtgatcacgcgcacctggcagaccgccgacaagatgaaaaaacagcgcggcgcgctgcctggcgacgggcctggcaatgacaacttccgcgccaagcgttacatcgccaagtacaccatcaacccggcaattacccacggcgtcagccatattgtcggctccatcgaggtgggcaagtgggccgacctggtgctgtggcgcccggcgttttttggcatcaagccgaccctgattctcaagggcggcgcgattgcttcaagcctgatgggcgacgccaacgcctcgattccaacgccacagccggtgcactaccgccccatgttcgccagcttcggcagctcgctgcacgccaccagcctgacctttatcagccaggccgcggccgacgcggggttgcccgaagcattggggttgaagaagcaaatcgccgtggtcaaaggctgccgcaacgtgcagaaaaccgacctgatccacaacgattacctgccggatatcgaggtggacccgcagacctaccaggtcaaggccgacggcgtgttgctgtggtgtgagccggcggatgtgctgccgatggcgcagcggtactttttgttttagcgcagacgactgcgccccgaagacgcttgtgggtcctcggggcgcagtcgcagtgttgcttacgcaaattgtgtttcgatcatgccctcgctgtagtcgtaattcatgcgcagctcagcgcccgccggaatgtcttcggtcgcaaacaccgccgtcaggatgaaatccgtcctggtggtttttgcgccccacacttcatccgcttcgatgtcgaaccctacaccttcaacgttgtaaccgcctgcggcctgacgcaccggtttgccattggcgtcatattcaaagttggtatttatcctggagataatgttgtcccccgatatttcgatcggctcccttccaagccttcctgatgccggccgggagcctgccagcaggatgtaagtctgcccaccggggctggcgacttgagagggcaggacggtcccgccataaacaccgactatttcccctttggcgattcgccggttggcaaccaccatggactggccgatcagcgacttctccccaggcgccttcatatcctgcgcagtgaacacacgctgctgcagcttcgcttcataaagagccccaacgtcctcatacccttcaaacttgatgtaaggcttgatctgctccgaggtgtattcaacaccggacgccgaccgaacctttctctgcagtttacgaattcgtatcggtttgccctgtaaatccctgagcggatatcgggcgttgttcacgcggctgtaactgcccggcgtgttgcgcagctgtgtgaagtgagtttgccggcgcatggcaatgagttcgtccgcggtgtagggctgcatcggcatagactccgaggcatcttcgaacacctcctgggaaactcccggccgtatcccgcccgtcgagcctctgcgcttccagaccccggcgacatcgggcttggcgataatcgcgctactgaccaaggcaaatggattatccggcgcctgcacccacaacacgtagtgctcaccatcgcctgcatcgggcatgctcgcaatgaagtacggcttgccgccgaactcaatggcttgcgcctgggcaagttgtaacccagacaccgggttctccagcacttcaagggttccccgtggcagcaaggcttgggcgatttcttgacgggtcagggtgttgagcagtgccgcgttcttaatcgcccactgcgcctgcaggtcatcggcctgttgccggtacagggcctcggccaacgtctgcgcctcaaagcgacgggtgagatcggccatttgcgcatgatagggttggcgctgggctgcaaattgcgcctggtatttgttggcgagatagtcctgccagaaggctcttgccagcaatgcctggaactctttgggtgagtgatccagggccacgacttcgttatacgcagcctccagcatcgccggggtaacgtgggcaatgtcggcgaactgcattttctgcggctgacccggtagttgcaggcggtccttgaggccgacacgataggccagccttatctcgacctcttcactcaggcgcagggtgtgggggagtttgtcagccaggcttaccgccggatcattcacgatcgcctggctgcgggcgatatcggccgaggcgatccggtccagcgcgtccaggcgaaacagcccccgtgccaatgtccgcaactgcgggccttgcgtcaggtcgccggccgttacgcgagccttggcaaccatcaccgcgagttccatattgctgaaggtaaacaccgcacggtcacagcatttcgcctccccgcccaactcgaaaacttccgcgcgcagccgttcggattcaggcgtattcaggctgatcgcatcgatcagttcccatacccgccgctgctgatcggcatggctcgcgggcgttgtctccaatcgttcaagctgattgaaaaaaccatcggccttctgcgcgccacgcaatgcaaaccactgggccctcttgcttgccacctcatcagtgggcatcccttcggcccagcgcagaaacgcattttgtgggcccgcgtcgatcacttcgacgccgcgtacgttcagcgcacgcaccgcaaacacatttgacgagttcgtggtctccagcccctctcgatgaagccgctcagcgtaatcccgcacgttctgctgagtcgcaggtaacagtgggttgttgctggcattggttaaatcgttgatgcgctttgccgttgccaacaactcgtctgtcggtgcaatgatcgcgtcagggatcgtcgtgatctcgttactcctcaggtccacatcctccagcgcttgcagttcaagcagcccatttggccaggcgtcaatgcctgtactgtgcaggctgaggacgcgcaaatccgtcatcgcgctgaaagtcgggatcatgccgagcgggttgttgcccaggcgtaacgcttgaagggcagtgcgtgcggacaggatcgcggacgtctgcggggtcaacctgattcggttggaattaaggtacaggctggtcagtgcattcatgttgcccacagcaacgggcacttcccggagctcgttgaatgccatgtccagatgccgcacattcgggaagcgggagagaaaaccttcgggcgaagtactgagattcatgaacctcaatttgagcgagacagcctgactaaagtccacgccgaggtccggcaagctcggcaaattcaagtgggacaggtcgagtgtataacccgggcccatatcgtcactggccagcaccggctccgtttcccgtctccagcactcaataatccgatctttggccgtagatcgatcagccatgttcggcggcagaggcctgcgccggaagccccccccgagtggtgggggcagatcgccttgctcgtaaacccaatcggacaacctgccgcttaacgcaaagagttcgtcctcaagcctctgcagttccgcgtcggcacctgcccccaggtttctgagaaactcccgggcttgttgacgcgtccttgcggggtacacgctctgataccgttcaatgctggggccgccaacgtcgaacgcaccgggcagcgtgccttccaacagatcaggccgttcccggctcaggcgcagccagtagctatcaaatttttgccagtaatcggcaggaaacttgtttctatcaagcagggtgacacgattgatccgggcaatcacttcaagcagatcaggcggcgggtccagattgatcgcaggcacctcactgagcccgttaccctccaggttgacgtaatccaaccctgtatcagcccgcagccccactggccactggttgatcccggtactactgaggctcacctttttcaaccgggacatcgcactgaaatcgggagacatacccaggggattgttgttgagcatgagcgtctcaaggttgctgagggcacttagtttggccgcgctttgcgaggtcaaacggatatcgttgaaacccaggctcaactcagtcaggttattcatgccgccgatcacatcaggcaatgacgtaagcccgatggaggtactgatgctcaaacgtttcagacggggaaagttctggaaaaacgtatcggcattgttgggccactttattttgaacagctcgagtgactcgacatggctgaaatcggccttcaatgctggcagatccatccccactaacgaaagcgcgtgagccctgccctctcgacgccagcagctcaagatattcttgacgttgatcgccggtgcgtctgcgttcgggtcatacgccgagaactccctgggctgagcttgctcccaaaccttcaaggctttcttcaggcctcgatactcggcctccaaccggtataaaccgccgctgacgtcatcgcctaaccgctcgataatggccgtgatctctggctcactgagcgtggggtatagttttcgagcgcgggcctgggcagcgctgaaggtgccgcgcgcccattgtcgaacgccgcccccaccgcccagcaggcgcactgtcgggtcaacgttcggcttgagcagcggatgctccagcaataccgtgcgcagcgacgcacgcgggaggggcgtttgctggatcgcggccttcatttgcgacgcgtcggtaaaccccaggccctggcgctcggtggcggacaacaggtcccaggtcgccgagtagaagtccctgggcgtgggcgcctgaaactggccgttgttcatcaccaccagcgtcctgcttaccgatgcgtccggcggaccgacagcatccagcagtggccccgtggccgagtactgacgcagttccacccgcgttccgctcggccagccgggcaaggtttcgagggtacgcaaggccaggcgctggctctcaacatccgccagggtgtccaggtgcaagccttcgtaggcgcgagaaacgcgggtttcctgttcacaccatttggcctgttcggcctgctgcttgggcagcatcccggtgcggcgcaacgcctgcaattgctcgttgttcaggcgcttgagcaaatgctcggccgccgctgtcggcaacttgggataactgagctgtaccatttgcacatcgggatcagccgacaaagtggacgccttgtagcgctcctccgccagcgggcctttgaacgtctcaacggtgtcgccgaggtactggcgtagcttgccggcgcgcacctccagcgagtcgtcggcgctgccggggatttccttgagcgtggggtcaacgccctgcaaggtgttcaagacttccttgagcaactcgccacgtgccatttggctgtcagagacaaccaccacgcgcctggacgccgtaaccggtgcatcgttctcccaaagcaggcggccgtcgccgcgcatgacgcgaaggggcgtatcggcgggcagcattccacgacgctgcagcatgttcagttgcagcaccggatcagcctggctgtacaccgccgggtcgctgctgtgcatgtgctcaacgaacgtcgtcagcgcctggtgggccttgaaatgctggatcgaatcttccagcagcaagggcaccggctcgtgctcgacaaaggtctggcgcaaggcgtcttcttcgacaccactggccatgcgggcctgttccagcgtttgggtatcgagcccgcgctgatccagccccaggcgtcgtatcagggtcggcgagtcccaggtcaggggctcttcgacttcatggctccaggcacccgcgtggttatgttccagttgcggttcgtacgcgccagggcggctggggtgctgaatgcggtactgcccggtgtcgggttcctgccggactcgatagtagtcaccttcatggtgcaacaccgcctgcccgtggtgctggtacaggcccagggcgtccggtttggcacccgccggcaattcgacaggcactttatagggcgtcagatcagggttccacagcagctgcttgcctgatggcagggtcaccggccggaggttgtcgaccaggctcgccagcttgatttcaggcaacaccttggccccggtgcccagcattgctgcattcagcgccacactggaaaagtgcgcccacatcgtcttcaggtcgccttggttagcgacttcaatgccttcatacacttcagtgcacacctgcgccgcgcccaccaccagcatgatcggccccagcccgggcaccacgaacgcgaggaggttgaacgcgctgttcactgcggcggcatagcttgccagccgatccatgcgcgccttgcggtcttcatcgccagtgggcacagccacggcgcgggcgtcggccaatagcttgctcacctgcgccttgcgcagttgctcccacaaattgccgttgatgcgcagctcatccagaggcaatttcgacggttttggcgccagcggatagtcgcccgccgcaccattgccgttggcgggtttgtacaaccgattgaactgctgaaaaaaccggccctgctcacgctggggtatgaagcggctgaaaaaccgccggtacgaagcactgtgcaagcgagtgcgcaggtcggccataaagacgccgctgtcggcatattccttgagcggctgttgtggatcattggggatgaacaccagcaggcgctcggcgctgtcactgtctttacgcaccggcccgatcagcaacggccccaccaagacacagccaaacaccttcagcgcggcaaatgtcaccggcttgccatcaagggtggcggtggcggggtcagtgatgacctgtttgatcatccggtaagcgtccgcgctgatgccccactctgcctgatgcgaggcgacctcggcgctcagtgccagcagttggcgctggtgttcttgcagttgttgctccagcgccgagcgctgggtttcgtcctcgggctggacgatggcctggaggtgctgctggtacaaattgcccagatccagggtgcggcacatctgcgcaaactcatgggcgggaatggccaaggcctgggagttgaccgcatgaggcgtcgcgatgacctcaccgtcatacgcgctccaggtggtaatcacctgacaatcgttacaaaggctggcgcgttcttcgtccggcgtgaagttggccagggcagcttcgagcaacgaaacaccgcggtactcgtagctcagtgacggatccggggcctggtcgaagaccagcacaccgaacagatcgtcacggcttttaaacccatacttgcgcgcgaaatagacgttccgcacgtccagttccaggctgaagcgttgcttgatcgcgtctttaagcggctgctcggcaaatgccagcacatcctggatatcgcccaggctgttctccacctggttcaaggtctcgcgataacgggtgtggctgtcggccaggtcagccttctgctgcgccgtagcggtcaagtaccagctgggcagctccatttcgtggttggcgagttcttcctggcgctgggtcgagccttggctgaaccacgcaggcacgcggtctttgaggaagtcgtaatgcacgccccgaaggtcaacgttaaagctgccttcgggggtagttgtaacgggttgttctggcatatcgggccatccatgacgggctgtaaaaccaccaacctatcgaatagccctgccggaaaagcactaggtatttatcgcggctcagaaatgctcacgcgggttgaacgcggctttttgcgccagctcttgccacaacgccttgacctcctcgtcgctgcttttaggcatcacagcctttagctgcacaaacagatagccgcgctgcccggccttgttcagcaagccatggcccttggcgcgcatgcgctggccgttctggctgccggcaggcactttgaggttgatcttgccggtgagggtcggcactgccacttccgcgcccaacgccagttcccacggcgccaaaggcaggttgatgatcaggttttcgccatccacttcgaatttggcgtgcggcgcaaacttgatgatcaggtacaggtcgccattcgctccgccaccaatgcccggcgcgccctggcccttgaggcggatgcgctcgccgtcggccacgccggcgggaatcttcacgttcaggctcttggtggtgttgctgacgtggcgacccgagccgtcgtattgcggcacctggaagctgatctgcttggactcggtggacagcgtgtcctccagcgacaccgacagctgcatctccacgtcctggcccttgcgcccggtcgggcggcgctggccgccaccgaaggcgtcgccacggttgccgaagatcgagctgaagaagtcggagaagtcttcagtgcctgcgccaccgccaaaaccgccacggctctgccagcccggcgggccctggaacggctggccatgctggccgtatttgcgcagttcgtcgtattccgcgcgcttatccgcgcttttaagcgcttcataggcttcggacgcgtccttgaatttttcttcggcgtctttttccttgctcacgtccgggtgatatttgcgcgcgagcttgcgatacgcggccttgatttccttgtcatcggccgtcggctcgacacccagaatcttgtagtagtctttgaaatccatcggcggttcaccatccttaatcgagatcgcacagcccggggcacaacgtgcgctgctttgcacttgttgagggttgtggcccgggggtgcgtcaaagtgttatcggcgctagccgtatgcaacagatgtgggggcaaatcccgtactttcaagcacaatttaacggatggctggcctacgcatccgccttcgactggcatacactgcgcggccgtttttcaaccggaacctgatagacatgaaaaacccatccccagcccgtgcctgcggtatcgacttcggcacgtccaactccaccgtcggctggatccgccccggcgaggagacgcttattgcgctggaggacgacaagatcacgttgccgtcggtggtgttcttcaacttcgaggagcgtcgcccggtgtacggtcgcctggccctgcacgaatacctggaaaactacgaaggccggctgatgcgctcgctcaagagcctgctgggttccaagctgatcaagcacgacaccagcgtactcggcacggccatgccgttcaccgacctgctggcgctgtttatcggccagctcaagagccgcgccgaagccaatgccggccgcgagttcgaagaagtggtgctgggccgcccggtgtttttcgtcgatgacgacccgatggccgaccaggaagccgagaacaccctggtcgacgtggcgcgcaaaatcggcttcaaggatatttcgttccagtacgagccgattgcggccgcgttcgactacgagtccaccatcgaaaaagaagagctggtactgatcgtcgacatcggcggtggtacgtctgacttttccctggtgcgcctgtcaccggaccgccgccacaacgacaaccgccagagcgacatcctcgccaccggcggcgtgcacatcggcggtaccgacttcgacaaacagctcagcctgcaaggcatgatgccgctgttcggctacggcagccgcatgaaaagcggcgcctacatgcccaccagccaccacatgaacctggccacctggcacaccatcaactcggtgtactcgcaaaaatcccagctggccctgggcagcatgcgctacgacatcgaagacaccggcggcatcgaccgcctgttcaagctgatcgaacagcgcgccgggcactggctggcgatggaagtggaagaaaccaagatccagctgacccacgccgacagccgccacgtgccgctcgaccgggttgaaccgggcctgagcgttgagctgagccgcgcgctgttcgagtcggcgattgatggcttgctggagcgcgtgcgcaacagcgtcacgcaattgctcaacgatgcctcggtggaagtggcgcaagtggacacggtgttcttcaccggcggttccagcggcatcccggcactgcgccacagcatctcggcgatgttgccgaatgcgcggcatgtggaaggcaatatcttcggcagtatcggcagcggtttggcgattgaggccagcaagcgttacggcagctgaccctcaccgatttcaccatcacagcaaatccaatgtgggagcgggcttgcccgcgatagcagagcgtcagtcgatgtatgtatctactgacccagcgccatcgcgggcaagcccgctcccacattttttttgaacggtgaataccgcctagtggtgatagaccgcccacaccccaagcaacgtcaggcaccacatcaccgcgccgggcacgatcaccaggtagttccacaggttaaaacgcgcgttgctctgcccctccgggtcacctgccgcgaaattgaccaggccttgggcgtgttgaaggatgtaggcacacagcggaacggccaggagcatcaggggcttataggcaaaccagggctgaaaacggtcagcggccatttcgaaaagcctggcacctaccgtaaccacgacgaataccgtcgcccactgctcaaagtcaaaatcgaattttcgaccgctgcgggccacgcgatcagcggcccggcgataaagctggtggataaagaaaataaagaaaatggcccgcgcccacggccagatatccagttgattggctttcttgtacaagctccagtttttatacgaccagatataggtgtacagcccaaagctgagcaagctcaacaccagcagcttggttttggaaatgacgtaaaactctgaagatgtgtttaccgtctcggtcagctccgccgttggcggagcgtagatattgtcgctcactgcttgtttccccttaattccctttaaagttcacgtcagtgcgttaaaccattccggcgagcttcagctcactcttcaggtacgcatagtaaatcggccccgccaccacacccggcagcccgaatgcggcttcgaacaccagcattgccagcagcaattcccacgatttggcactgatctgcccgccgacgatgcgcgcgttgagaaagtattcaaccttgtggatcacgatcaaataccccaacgccgccaccgccacccaaatcgacagcgacagcgcgacgatggtgatcagcgtattggacatgaggttgccgatcaccggcagcaggccgagcaggaacgtcagcacgatcagggttttggtcagcggcaggtgaatcccgcacagcggcaggaccaccgcgaggaagatcgcggtgaacatggtgttgagcgcggcgatcttgatttgggcgaagacgatattgcgaaaggcctggaccagcaggtgcaggcggtcgaacaacgcggcggccagcggtttgcgcttggtcaggtcgggcacgcgctgcagcgcgataatcgcgccgagcaccatgccgatcagcaaggtgacgaacatgtgcgcggcgtctttgccgaccagttgcagttcgctcaggtgtttgctcagccaatcgccaatggccacgcgaaattcggcggcgctggcaggcaggtaagcgtcgaggaacggcggcaactggccgcgcgcacggtcgactacgcccatgaatttgtcgagggaagccccgggattttccgcttcgtggagcaggaagctgatggcgccggcgaagatcaacgtcagtacgctgacaatcaaggtgccgagcaacgccacagccagccaacgcgcgcgccggccttcgatcagccgctgtaactgcggggtgagcatgttgaccagttcataaaccagcaggccggccaacaggctgggcagcagtttgagcggcaggaccagcagtaatccaccgaaaatgatgatgcaactgaccagcaacaacacgtgacgctgagaaaacgttggcatacagcctcaaaacgaacggcgttaaaggatgggcagtctgccagccttgagggaatcaagcgagaggccagggtgtgaatgcgatcaactgtgggagccgggcttgctgtggcgagggagcttgctcccgttcgacagcgcagctggagccggctttttgggggcgcttcgcaccccagcgcaagcaagcttgctcgccacacaagcccgctcccacaggggattcgcctgatcagctacctttgaggcaagtgctcataaaggtcttgcgtgcatcgccggtcaacgtcttggttttcgccgtggcgttgcagtctttcatcttctgctgctggggcgtcagggtcttggcgtcgttggctgccggagcggccttgaggcaggtgctcataaatgttttgcgctcgtcgccagtcttgcctttggcttcggcgttgcacgtggtcattttttgttgctgggcggtctgtgcagcggtggcggcaaacccttgggaacacagcagcaggcccatcatcaacagcggaatacgcagcatcttcatggagttttctccctgttaccgtgccggggggcacggcctacgcaggagtgtagtcaaagcctgttacatcttcaccggctgcgaatatttgttcggcgatattgctccggcgtacagccggcgtggcgctggaacatggcgataaacgccgaggcggtgctgtaacccaggtcaaacgccacgtgttgcacgctgtggtcgctgtccaaggcctcgatggccgccagatagcgcaggcgctggcgccattcgccaaagctcatgcccagctcgcgcacaaactggcgcgccaaggtgcgctcgctgacgtgcacttgctcagcccactgcgccagcgggcggttatcgcccggttcagcctgcatgccttcgagcacgccgagcagcccggggtggcgcgcatagggcaggaagcaatcgtgaatcggggcttgcttgagttggtccaccagcacctgggccaaacggatgtcggcttcggtctgcgcaatattgacgtcacgctgggcaaagtcactgaggatggccttgagaatctcgctaatcgccagggtgcacggcgccttcggcaattgctcgcagagttccggggccaaaccgaccgagcgatagactatcgcctgggcgttgtaggagctgtgctcggtgttcggcgggatccacaccgcgtactgcggcggcgacataaagcggctgccggcgacctccatgcgcatcacgccgttggccgaatagtccagcgaaccccagaaatgccggtgcggggtgcactcggtgtcgggggcaaaatccgaataacgaaagtagaccgggctcggcaggctgtggaaatccgcgaggcgtacggtatgtctggccatattgtctggatacaaaggtcgtttgtctggatcgcagtataggcttcgatccagacaagggataatcctgcctcatcaacacacctggtttctttcgatgcaatacgcctatcccctgctggccatttttatctgggccggtaacaccgtggtcaacaaattggccgtgggcacgatcttccccgcagaaatcggcttttaccgctggttgctggcggcgctgctgtttaccccgttcatgctcaagccggtgattgccaactgggcgctgatccgcccgaacctgggcaaggtcttcatccttggcgtgctgggcatggcggtgtaccaaagcctggcttactacgccgcgacactgaccagcgccaccaacatgggcatcatcctctcgctgatgccgttgatgtcattgaccgccgccattatcagtctcggccagcgcctgaccttcggcgcgctgaccggcgcggtgctgtcgttcgcaggcgtggtggtggtggtctcggccggcaacctcggcgcactgctgcaacacgggctcaacctgggcgacggcatgatgctgatcgccacgctggcctacgcggtctacagcaccctgctgaaaaaatggcagctgcgcctgccgccgttggtgttgctgtacctgcaggtgctggtggcggtggtggtgttgttcccgttgttcctgttctcgaccaaggcgggcctgggctgggcgaatattccgctggtgttgtacgcctgcttgctggcgtcgatgctcgcgccgctggcgtggatgcactcggtgaaaaccctggggccaagccgcaccacgctgtttttcaacctgttgccgttgattaccgcgttgattgcggcggtggtgctgaaggaagagttggcgctgtaccacttggtgggcggcttgctgacgttgggcggagtgattttgtcggagcgttggacgacgccggtgcgcagtgaggtcagtgtggcctgatacaccgctatcgcaggcaagccagctcccacattcgcccccattccaaggttggaacacggtcaactgtgggagctggcttgcctgcgatgaacgataacgcggtccacctgctaaacccccgccgctttcagccttcgcgcatgctcaacaaacaaccgaatcggctccgcgcccttgcccaccagccccaacgactggttaacgatatcaaaatggtccagcgcatagtcatcgccgatcaccacgcccaggtgtgagctgtagcgcccaaccatgccgtcgcactggcccttctcgcgcacaaaactgcgggcgaataaccggcaactgcggttcgtgccgtccagcaggttacgcccgcgatcagtcttgcccggctgcaaggtgccggaccacgagtaataacgcacgccgttgaccacctcggcgccctgcccgccccaggtttccggcagcccttggggatactcgcggttaaaccgggccacgccttcgcacgtcaaggactggtgcgacgcctgcaaatccgccttgaagcggggcccgcgatagccggtttccagcaggcccatcacccaggcaaccagatgaaacaccgcgctcacgacccggcctttccagctgtccggcggatagtgggtgtggaaatggtccgccaattccgaaccgtggttgggcccggccaccgacgtcaccgacgccacccattccgggcgcttggccgcggcataacgggcggtgagcgagccttggctatggccgatcaggttgaccttgtcggcgccggtctcgcggcggatccgctcgatctgcaccagcaactgctcgccgcgcacttcgctggaatccagcggcgccacctgcacggcaaacacctgcgcgccacccgcccgcagtgccgggacaatgccgtaccagtaaggaaacagcaccaggcgcacaaaacccagcatgccgggcaccagcacgagcgggtaacgcgtggcgagggattcgggcatgcggcgggcatcctgattgggggcgataatgtcatcctagaccactcgacatgaccgccccatgaccgccagcgctttagaaatgcccggccaggtcgtgcaactggcgctcggcttcgtcacaggcgcgcaggaatacggacttgtccgactcttcaccttcagcggcgatcacccgaatgtcatcgatgccgatatagcccagcaccgtgcgcaagtgtgggtcagcgtggttcatcccctcattttcgccgcctgggtcaaacccgttgccgccacggctggtgatgatcaacgcgcgtttgccgttcagcaacggccggtattgcgcaatgccctgggcgtcttggctgatgtcgaaggtgaggcccatgcgtacgatttgatcgatccaggccttgaggccgctgggcacgccgaagttgtacaacggcatggaaatcaccagcaactcatgctcgatcagctcgccgaccagttcgtcactcagttgcaagtcggccttcatcaccttcggcagggattgcggctcggggtagaagttcgcagcgacaaacgcttcggtaacgtgcggaataaaggcccggccgacttcacgacgggtgatccgggcatcggggttggcggcctgccaagcatcgagaaacgactctgccaagcgccgggaatgagaacgttcgccacgtgggctggcgtgaattactagcatttttttcatctgtatagaccttgacggagtagactcaagcgacctggatggccgcctttcttgcccgcaaatctagagctgagcgccagcctcgacaaatgagcaatagttaacccggatgaatccatttcatccatggagcctgaatgtttgcctcgctgccccttaccgcgttgcgcacctttgagtcagcctcacgcctgctgagcttcaaagccgcggccgaggaattgtcggtgacgcctaccgcggtatcgcatcagattcgcgcgctggaaacctggctgggcgtgccgttattcgaacgcctgccgcgccgggtgcgtcttaccgaaggcggcgagcggctgtttcacagcctgcacggcgccttgctggacgtggcgcaaagcgtcgatacattgcgcccgcaacgcagtgccgggcacctcaccgtgtccacgacgccagcctttgcggcgctatggctggtgccacggctggggcgcttctacgccgcccacccggacatcaacctgcgcttggatacccagtgcgaggtgctcgatctgcagcaggacgccagcgtcgacctggtgattcgctatagcatcggcgactacccgaacctgtacggccaatgcctgttcgatgaatgttttgcggtgtatggctcgcccgagcaggttgcgcgggccagcagtcaagtgccgacgctgatcagcgtgcgctggcacaactccgagctttacgccttggggtggcaagcctggtgccacaaggccgcggaaacatggctggatcacaggctgccgttgcgcgaatacgacgaggagcattacgcgctgcaagcggcgattgccggccagggcctggtgctggcgagcaatattctggtgtcggaaagcgttgccagcggcttgctggtgccctatcggccgcaggtcagtgtcggcggcgcgggttacagcgcgctttgtgtgccggggcgtgaacgccatccgccagtacgggcgtttttccagtgggtgcaggaggaagccaggctgtccggccaggcggtgtgaaatccgataaaactttttgcgttgcccgggactcacaactgggagcgatcacgccggcagagcgtggcgtaaaaccggattagcaccaggagattgagatgactgaagcacatttgactgacgttgcgaccctgcgctcacgcgcccgtcagaacgtcgaaaacggcgccgtgaccgaaggctacgacgccgatcgcgaagaaatcatccgcctgctcaacgcctcgctggccactgaactggtctgcgtgttgcgctacaagcgtcactacttcatggccaccggcctgaaagccagcgtcgccgccgatgaatttctcgagcacgctacccaggaagccgagcacgccgacaaactggccgagcgcatcgtgcaattgggcggcgagccggagttcaaccccgacctgctgtcgaagaactcccacgcccaatacgtagccggcaataacctgaaagaaatggtctacgaagacttggtggccgagcgcattgcggtggacagctatcgcgaaatcatccagtacatcggcgataaagacccgaccacacgtcgcatcttcgaagagatcctggcccaggaagaagaacacgccgacgacatggccgacattctgcaagacctataacccgcaacaccgctgaacccctgtgggagcgggcttgcccgcgatagcaatcgaacagtcagctcatttgtcgactcttacaccgctatcgcaggcaagccagctcccacatttgcattcgggttttgtcagttgcttccacgttttcaatgctttacaggcaaaccgctgatctctgtgggagcgggcttgcccgcgatagcaatcgaacagtcagctcatttgtcgactgttacaccgctatcgcaggcaagccagctcccacatttgcattcgggttttgtcagtgaagtcgccgctgtc

SEQ ID NO: 38 - DNA, 127968 bp, Pseudomonas poae FL10F
gtatagcgcagtccggtagcgcgcctgctttgggagcaggatgtcaggagttcgaatccccttaccccgaccatattaaaaatcctcgtatcgaaagatacggggattttttttgtctttttttgctgtatttgtgcaatttccaaacaggcattgtgttcattggtgcgttggagtggtgggcgcggcctcctagactaggcttcgtcactccaaccagcccaaaggaattcgcatcatgacacttgccattaccgctcaacccacgcgctcgttgcctgccttgctcaagtccacgctggtggggctcggcatgctgatgggcctcggccactatgccgtcgccgcagaaactgccgcgaacaagcagccgaccattcgcgccatgctgggcgccaagccgaccgatcgactcgacccgaaaaccaccgccttgctggtgatcgacttccagaacgaatatttcaccggccgcatgccgatcccggacggcatgaaagccctggaaaacacccagcgcctgatccagtttgccgacaaagaaaaaatccaggtcattcatgtgcagcacatcgccccggacgatgcggcggtattcgccaagaacggcaaaaccgttgattttcacccgctgatgaagcctcgcccgcaagacatactcgtgcagaagaccaccgtcagtgtgtttgccagcaccgacctggatgcgcaattgaagaaagccggcgtcaaaacgctgattatcagtggcctgatgacccacgcgtgtgtcgcaggcgccgctcgggacgccgcgccgttgggttatgacgttgtggtagcatccgatgccactgccacccgggcgattacccgcgccgatggccgttcggtcaacaaggatgagttgcacaactcggcgctggctgaaatcgaagacaccttcggttccgtgctgaccaccacgcaaattatcgctttgccgcttaactgattcctcaaaccccactgggatcgcctgatttcatgaaccagctgtctgccatgcgcgcctttcggtgcatcgtcgaagccaaaggcttttctgccgcagcagagcgcctggacaccacgcactcgacgatttcccggcaattgcagcaactggagattgaactgggcgcccaactgatcaaccgcaatacgcggcgcttcagtctgaccacggccggggagcagtactacgcggcgtgtgtggatatcctcgatcgcatcgacgccgcatcccaggccatcgcgcatggtcaccaacgccccgccggcgtactgagagtcagtgtgccgttggtggtggggaccctggaccttgcgcactggctgccgggctttcagcgacgctaccccgatatcgagctgcagttgtgctgtgacgatcagttcgtcgacctggttgccgacgggtttgatgtcgcgatacgcatcgccagcgccctggcggacacctcattgatcgcccgcacgttgacggtttccagcctggtgctggtggcgtcagcagggtacatcggccgccatggtttgccgcgttcggcccaggagctcgacaagcatcgcctgctgacgtttatgggggcgtcttcggattgggcgttgagcgcagcacgtggcgcggtggtcaaggtcacgccatcggggcggttcagcaccaacaccatcagtgcgttgcacgcagccaccctggccggggcgggcattgcgtgtttcacccaggccaccgtgcacaatgatctggcgcagggccagttggtgcgcattctgcccaactacttattgggtgaacggcattattacgcgctctatccacagtctcggcaccgggcgcccaaagtgcgcgcatttgtcgactacatggccgagttctatcagcagagttaacccaactgaaaatccccctaatacgcctgatcaaaaccgtgcgccgatgaacgcgctccgaacataaggcgttgcgattaagaaaggcggccaggcgcgaagtcgccgaacgctttcgataaggagaggctagggaaacaaaccatctgtcggaactggtatttctcacaggtggaaaaggtaagggcgcgcgttacaagggatctcgagcagttcttattgactgatacgaggtaacgaatcatgaccgacaatacaccaaacctcccaggtccaagtgatccaaatcccgtgaggcagcccgacattacagaaccacctcagggagccacaatatcagcatccagcactatccgtgtaaaaggaagctcacatcccaactattgggttcgcatagttactccggggcaggacgatgcgttgagtaagcacggtaagatgggcgattcggggagtttcactctagaggtcgagggcaaagtccctaaaggtacattttgttttcaagtgatactctggaaagataaaggggttctagggcgctctccaacgcgctgtataaacgttgtttgagtagtgtgctctctagtatgaaaacgcttaatacgattacgctcttgctcactatggttgcactgggcgcccaagatgcggacgcctgtcgactctaggttcgagttttacgagcagcggtgaacgtgtcttcgacgtgcaataaaaaatccccctgtcgttggacaaggggatttttttgttgccattcagccgatcagtgcagtttgagcctcggctcggtcccgcgcccaatcttgctgcccagcatcagcattgccgtgcggaagaaaccgtacaacgccatctggtgcatgcggtacagcgacacatagaacatgcgcgccaaccaaccttcgagcatcacgctgccggtcaggttgcccatcaagttacccaccgccgagaaccgcgacagcgagatcagtgagccgtagtcggtgtacttgtaggacggcaggtccttgccttcgatgcgcagtttcagcgacttggccagcaacgacgcctgctggtgagccgcttgggcgcgcggcggtacgttgcggtcggtgcctggttgcgggcaggcggcgcagtcgccgaaggcgaagatattttcgtcgcgggtggtctgcagtgtcggcagcacttgaagctggttgatgcggttggtttccaggccatcgatgtccttgaggaagccaggcgcacgaataccggccgcccacaccttgaggctggccgggatgacctggccgctgctggtgatcagggcgtcggccgtcacttcgctgaccgccgagttggtcagcacggtgaccccgagtttttccagggttttatgcaccggcccgccaatgcgctccggcagcgcgggcaggacccgtgggccggcttcgatcaaggtgatgtgcatgttttccggtttgatccggtccaggccataggcggccagctcatgagcagcgttatgcagctcggcggccagctcgacgccggtggcgccggcgccgacgatggcgacgctgatctgttcaatggtatcggtctgcccggcatgggcgcgcaggtagtgattgagcagctgctggtggaaacgctcggcctgcttgcgcgtgtcgaggaacaggcagtgctgggccgcgccctcggtgccgaagtcattggtggtgctgccgaccgcgatcaccaggctgtcatagcccagcacgcgcgcaggcaccagttcgcggccctcttcatcgagggtggcggccagctggatcttcttctgttcacggtcgagcccgctcatgcgccccagttggaactcgaagtggttccatttggcctgggcgacatagttgagttcgtcttcggaagagttcagcgaaccggccgccacttcgtgcagcaacggcttccagatatgggtcaggttggcgtccaccagcgtgatgctggcggtgccgcgcttgcccagagtcttacccaggcgggtagccaactccaggccgccggcgccgccgccgacgataataatacgatgggtcatggggatatctcgcaaggctaaaagaaatcggagcagttacccccgcgagcgccaggcagctcatagcgtcaggtaactcaaaaggcggctcagcagaccaagcccgatcaccgccaccagcaccacaccaaggagcagccacggccggaaaggcttgcgctcgactcggttctgggagagttgcaggtactcttcgacatgctgttggtcatcggggttcaggcggctggacataaaggcctcgtcaggtagacgttgcgaaagggcgccacgttacagtcaggagattggcggcatcgccacaagcgtagcctgtgcccgcgtcacaggctgatgcccacgtcgaatactatgctgcgccccaggttgttgcgcaagaagtccggtgcatccggatgggcgaacagcacgcgggcaaaggtcggccctaccagcgacagcgagcgccagccctggcgcaggtattcggtgggcggtgggaaatggctgttgaggtccagcacctcgcgcttgaggctggtgaaggcgatgaggtccagctcgcccaggtccataccgcgctctttatagttgtgcgcttttttacgcagggtcggcgccaggcgcagcaggaactcatgggccgggatgcgccgcggcttggcctcgcgccgcaccaattggctcagggaaaacgcactgcgccttcgcagcaattcatcgcgccattcgtcgttcaggcggcgcccttcatccagcacgaaaaacacttcgaaactggcgtcgcgaaacagcacatccggcggctcttgaccggcggcatgaaactcctcggcccgatagggcacattcaagccttgcagcaggcgctggcagacccaacgctcacgctcccatttgcgggcattggacaggaacgcattggcttgttcggccgctacggtgagcaggcgcaggtaatctgagtcatccatatttgcagcttagcgtccaaatgatgaccgcaggaagtcttgctttaaaacgccggtgtagactggcgactcgactgtcatccgaaccaaggagtacgcggtgaagtgttttgtggtgctgtttttgagccttttgcccttgtgggcccaagccatcgaagtcggtgaacgcgtggcgccgtggaccttgctcgaccagttcgaccaagcctacaccctggatgaccaggcgcagattctattggttgcccgcagtatggacgccgccaagctgttagatgctgcgctgcaaggccagcctaatggctatctcgacgcgcggcacgccgtatttgtcgccgatatccagcgcatgccccggctaatcgccaagctgttcgccgtgccggccatgcaggcctacaactaccgagtcatgctcgaccgcgatgcgcgtatcgccccgcgttatccgggcgctgtggataaggtgctgtggctgcaactcgataacggcaagttggtcgcgcaacatgaatacagttcggctgccgagttgcgccaggcactggagcaggtgaagccgtgatcagcgccgccgtgctggcgccgcaaaccctcagcatcggctggctgctgtatgtgccgctggtgatgtgggcgatcctgcgctcgccgtgggtcgagctatttgccgaccgtcggcgtcagcatttgctgttcggcacggtattcgcgctgttcatgttgtggctggtacggcgcgatttcgataccggcgtgtcctaccactttatcggcatgactgccgtcacgctgctgctcgattggccattggcaatcgtcggcgggttggccgcgcagttcgggttggtgctgctggggcgtcaggatctggccgctgtcggcattaatggcttgctgctgatcgtgctgccggtgctggtgaccgaagcctgcgcggtgctggtcgagcgggcgcaaccacgcaatcccttcgtgtatatcttctgctccggcttttttgccgccgcgttgtcggcgctgctctgcctgttggtggctttggggctgctgtggttcgacggccgttttgcaatgccggaatggctggaagacttcgtcggctacctgtggctgattatcttccccgaagcctttatcaacggcatggtcatcagtgccctggtggtgttttgcccggaatggctggagacgttcaaccgcacgcgctatctctcggcgccctggaaggacgacgatacgcagcgttgatccaggtcaaatcccgggctgacgcgcacgcccatgctctgcgaaattcttctagaggcttgaatgatgagtgtgtacgagtgggcacggcaggagttgcgcagaagccaggacgcagcccaggaaatcggttttgacccaggccttaccctgcgcgcgatgctcagcgcggtggtgcagcagagcaaaggtgtgcgcagtttcgaagacctggccgacgagctgcaataccttgcagagaacctcgacgaccagcaggaatacgcctttatgcggccttagtggcgcggcggcaggtcttcggagaacagctcgtcctcggcatccgggctgaccggaatcttgtgctcttccgacgcccaggcgccgaggtcgatgagtttgcaacggtccgagcagaacggccggttcgggttggtcgctttccattccacgggtgcaccgcaggttgggcagtcaacggtcataggttggctcatgatcggcctccacgcaaagtaaggtaaaagtggtgcagtcgctcgacctcgctgtgcagccaggcgaggtcctggtcattgaccagcacgtcatcggcatggttcaggcggtcttcacggctggactgggccttcagaatcgcctgcacctgctgctcgctgatgccgtcgcgctgcagggtacgctgaatctgcagtgattgcggcacgtcgatcaccaggatgcgctgggtcatgttgtactggccggactcgatcagcagcggcgacaccagaatcgcgtaaggcgactgcgcgcgcgccagatggctgcgaatttcctcaccgatcagcgggtgcagcaaggcttccagccagcggcgctcttcgggcacgtcaaagatcagcttgcgcagcgcggcgcggtccagctggccgtcgggctgcaacacgcccgcaccaaaatgctcagcgatctgcgccagtgccggccggccgggctctaccacccagcgggcggcgtggtcggcgtcgatcaagtcgatgcccagctccataaagtgcttggccgccgcgcttttaccactgccgatgccgccagtgaggccaagaatccaaggtgttgcgacagaagtggtcatctgaaaccgacagactgcaaatagaagtcggttatttgaccaccccagagcaatgcaatccagccggcaatcgccaggcatggaccaaacggcatcggaatcgatgcctggggcttgcgcaagcgcaacagaatcagcccggcagctactcccagcagcgacgacatcagcagtgtcatcggcaaaatctgccagccgccccaggcgccgagcaaggccaataacttgaagtcgccataacccatgccgtccttgccggtaaccaccttgaacagccagaacaccgtccacaggctcaagtaaccaatgaccgcgccccatagcgcatcgggcagcgacgtcagcacgtcagcgctgttgaggatcaaccccagccataacagcggcagcaccagaacgtcgggcagcaactgatggtccacgtcgatcaggctcatcgccagcaagccccaactcagcaacatcaccgcgccggcttgccagccgaagccgaaatgccaggcaactgtcgccgagatcagtgcgcaggccaactcggtgaaagggtaacgggcactgatgggttcacggcaatgagcgcaacggcccttgagcagcaggtagctgagcagcggaatattttcccaggcgcgaatcggatggttgcactgcgggcagcacgacccgggatgcatcaagttatacgtggcgcccgcagggtcggcaggcaagccgagcacttcctgggcctgggcgcgccactcgcgctcgagcatcttcggcaggcgccacaccagcacattgaggaaactgccgacgatcagcccaagcagcagcgctatcgcgacaaagacccacggctcttcctgaagcaacaggctcaaaatgccgaccccatttggaataccggcaagtacatggcgatgaccaaggtgccgacaatgccacccagtaccaccatgatcagcggctccatcaggctggtgaggttgtcgaccaggttgtccacgtcggcctcgtagtgattggcgactttttccagcagggtgtccagggtgccggattcttcgccgatcgccgtcatctggatcgccatgccgggaaacaaccccttgctggccatggattgatgcaacggcatgcctgtggatacatcgtgacgcatatgctcgatcgcctgtttgaacaacccattacctaccgcgcctgccacggaatccaacgcctgcaccaagggcacgcccgcggcaaaggtggtcgagagtgtgcgggcatagcgggccacggcggtttttttcagcagtgtgcctgccagcggcgcgttcaacaaaccggtatccaaccagtgacgaaaacctggcgctgcgcggtaggcctggcgcaggccagccagggtggcggccacgccaagcgcaagcatccaccaggcgcgctggaggaattcggacagggcaatcaccgtcaacgtcaggccgggcagttggccgtcgaccccggcaaacaggttctggaactgcggcaccacatgaatcagcaggacgctgctgaccacgcaggcgaccacgatgacggcgatggggtaggtcatggccttcttgatgcgtgccttgagcaactggcttttttccaggtgcacggcgactcgttccagcagggtttccagcgcgccggcctgctcaccggcggccaccaggttgcaatacaggtcgtcgaagtgacgagggtgcttacgcagtgctgcggcgaggttgttgccggcggcgatctcctgtttcaaggccctgaccagctcgcgcatcgggcggctatcgaagccttcgcggataatgtcgaaggcttgcagcaaggggatgccagccttcagcaatgtcgccaactggcgcgtgaacaaggcaatatcggcgggttttatcggcggcgcgaagcgtggcacgcgtgtggtctttttgcgcacacggccggggcagattccttgctggcgcagctgcgccttgatcagcgccaggttctggccgacggtgtgcccggacactctgcgccctttgcggttgatgccttcccaggcgtagatcgttgcagtgtcattcatgtcacgtttccgcacgcagctcgttgaagatttatagcttagtcagctgcgggattcggacaggctggcggcgaggagtaaaatgtcagattgtgcgtcttacgcgcgattggccgctcgctcatgagtacactggcgccgctgcatactgcggggcgcaggacgcgccttgttatgagttctatatctggagagtgaaagtgatgcgtcagaaaggctttaccttgattgagttattgatcgtcgtggcaatcatcggcattttggccaccgtctgtttgcccctgtacaccaagcatcaggccaaggccaagttgacggcgggtttggccgaaatctcggcgctgaaggccggtttcgaagacaccctgaaccagggcaccgtgccgacccttgccttgatcggtggcatcagccccaccgccaattgcaagatcgacgtggccggtgatgtggcgaccggcgccggttccatcagctgtgaaatccttgatgcgcctgcgcccgtgctgggcaagaccatcaccttgacgcgcagcgccgccacgggctggaagtgcgctaccaacgccgacgcgcaatacgttgtaaagggttgcggcgccgacggagcctgattgccgctgggcggtgggcgagttagttgctgcatgcccaatgcggtgctagctttagcccaccgcccgtgtagctcagccggtagagcagcgcactcgtaacgcgaaggtcgcaggttcgattcctgtctcgggcacaaaggcaacactgcttcaaaggcaacgtttcaaaggcagcactgttttcagatgatcccagaatggttctgaaggccagacgagccggcattcgtgcccgctctttcgtatctgcgcaaccttgatgacccagatgcatccccattcctcgatctaagagaacaacatgaccacaccagaaatgacccaggaagagcggcacgaagcagccctcaaaaagtacgtcgcggagtcgccggaactgctggacgagatcaaggacctgagtgctgatgatcagcgcgatcagatccaatgggcatttgaggatgaggccgaggcccagggcctgcagccgtgggaattaaccctcaagtacacctcgactccggaagaattcgaagccgcacgcctggccttgcacagggaggccgccgaggtgctgggtgtcgactggaacgagtattgcgggatgaacaacctcgcgatctaagcaccaagtctgacgcgagcttgttgtggaaggcgcgcttggttggcgcgtgggcttgaacgggttagtgggtttgttgtggcgagcgggcttgccccgcgttgggctgcgaagcggccccaatacaggctccgcgtagttccagttaaaccctggcgtctggtttcagggccgcttcgcgccccaacgcggggcaagcccgctcgccacgacagccccgctcaccgcaacaagcagccgcacaattttcggtcatgtgcctcagagactgaggcgcatcgacaaatccaccgccttcacatccttggttatcgcgccgatggagatgtaatccaccccggtttcagcgatgggcagcagcgtggtttcgttgatcccgccgctggcttccaatttggctttgccggcgttcaggcgcaccgcctcacgcatgtcatccaggctcaactcgtcgagcatgatgatatcggcgcccgccgccagggcttcgcgcaactcatccagactttccacttcgatttcgaccggcttgcccggggcgatcttgtgggccgccgtaatcgcctgggcaatgccgccacaggccgcgatatggttttccttgatcaggaacgcgtcatacaggccgatgcggtggttatggcaaccgccgcatgtcaccgcgtatttctgcgccaggcgcaggcccggcagggtttttcgggtgtccagcagcttgacctgggtggttgcgacaaagtctgccagggactgcgcacgggtggcgacgcctgacaacagttgcagaaaattcagtgcacagcgttcaccgctcagcagtgagcgggccgggccttccagatggaacaacgcctggttggggctgacgcgctcaccgtcggccacctgccaatgcactgcaacccgcgggtcgagctggcggaagacggcgtccacccaggcggtgccggcaataacggccgcgtcgcgggtaatgatcgtggccttggccagccgttcggccgggatcagctgcgcagtgatgtcgccgctgccgatgtcttccagcagtgcgcggcgcacgttggcttcgatttcggcggtgaggtcggcaagacggagattcggcataacaggctccacaaacaaagtgcctcgattataggggcagtgcagcgatgaacacaggctcaccactcatttgcagcgtaacggcagagtttgctggcgcaactaccctcatttgcaagataatctcgcgccttgcaattggcgtcatagctttgacgtcctggtgataaacggttttttacagctccaattgggcctgtcgccggtatttccccaccccaacaccgccgtttcaggaggccaggatgcacattgacggaaaggtggtgccaatcaacaaggcacaggccacgccatcgccgctcgcgcgcttgccggtggtgttactgcaggtgcgtgacaaggctgcgcaacaactgcagcagggcttgcaggagttgttcgataacgccgacgacaccctgttcgaaatggccgacaaggctcgcagcaacgttgaccatcacattttctttgaagccatgcgcgacttgcgcctcaagcgcaagaatttcgaacgcgtgtttatggagcagctgttcgccgcgttcgccagcctggggcaagccgggcggggcgatccgcacttggtgccggtggtctcctttgacgcggcgcccggtacgtccagcgatgagctggaaaaagccgtggcgctggaggccatgcttggtcgggtgcggcatcgcgatggcctggcgctggggcaattgactgcgcgcttgagcgtgttgctcggcaagcccctggatgagcgcgacaacccactgggaccggcactgctgtgtgagttctttttgcgtgcgggacgcagcctgggggtggagatccgcgtcaagctgatcatgctcaagctgtttgaaaagtatgtgctcagtgacgctgaccagttgttcggcgaagccaaccagttactggttgccaccggggtgttgcctgagctcaaggcggtgccgtcacgtcgacccggcgggcgggcggcgcgcgaacaacagcatgagggcggctcgcccagcgtcgaccagccccttgatgaaaccggccaggaagccttcgccgccttgcagaaattgctggctgccgtgcgtggcagcgtagcgccgaccctggaagccagcgccgagccgcaacccattgccacgcgtgacctgttgcggttgctctcgcacctgcagcaatacgtgccggagcccgaggttgaggatgatttcgacctgcgcaaccagcttgggcagttgttgacccgggtcagcgtcaagagtggtaaatcccgcgtcgtggaagaagcagacgaggacgtgatcaacctgatcgccttgctgttcgagttcatccttaacgaccgtactgtgcctgcggccttcaagggcttgattgcgcgcctgcagatcccgatgttgaaagtcgcggtgctggacaagagtttcttcagccgtaccagccacccggcgcggcgactgctcaatgaaatcgcttcagccgccatgggctggagcccgcacgctgactaccagcatgacagcctgtacctgcagattgagcaggtggtgcagtgcctgttgaatgattttgtcgaagacccggcgattttttcccaactgctcgcgcagttcacggcgtttacttcggatgagcgtcgccgtagcgagctgcttgaacagcacacccgtgaggccgaagaagggcgcgtgcgcacgcaagccgcccgtgagcgtgtagccgacctgcttaaccggcgtttgctgggcaaggtattgccacaatcggtggtgcagtttctccagcaggcctggagccaggtgttgttgctggccagcctcaagcacgacgagcagtcggtgcaatggcaggcggcggtgcgcaccatggacgagttgatctggagtgtgggcctgcagaaagacacgcaagcaggccttcacctgctggagcaactgcctgggctgctcgcggcattgcgcaacggcttgaccagcgcggcattcgatcccttcagcacgcgtgaattttttgtgcggttacaggccatgcaccttcagtcttgcgaaggcgagggcatcgacacgttgatcaaggtgcgcgagcccttttcattcagtgccggtgggcccgaccccgtcgaagacctgccgagcgatgatccggacctgctcaaggcccaccaactgcgcatcggcggctggtttgagtatcggcaagacgcaggcacctgcttgcggtgcaagctgacggcgatcatggcaccggccaatagctatatttttgtcagccgtaccgggctcaaagtcctggagaaaagcgccggccaactggccatggcgttcaaacgcgacgcgctgtgcaccttggacgataaaccgctgttcgaccgcgcgctggcgtgcgtggtgggcaacctgcgtcaactcaatcgcggcaagtgatcgcaaccgcagggctgaacgcggcatactggtaacacctcgtctcattcaaggaacctgtatgcagttggaccccaccagcggttggtgccagggcattcgacattgcccttcgcccaacttcaacgagcgccctgcaggcgaaatctcactgttggtggtgcataacatcagtttgccaccggcgcagtttgccacgggcaaggtgcatgagtttttccagaatcgcctggatgtcacggagcatccttactttgaagggattagcgacttacgggtgtctgcgcattttctgattgaacgcgacggcgcggtgacgcaatttgtatcgtgcctggaccgcgcttggcatgcgggcgtgtccagtttcgcagggcgtgaagtctgcaatgatttttccttggggatcgagctggaagggacggacgagctaccgtttaccgatgctcaatatacgtcgctgatcgacctgacgcgtcagttgctggccgcctacccggacattacccagcaacgtatttgtggtcacagtgatatcgccccggggcgcaagaccgacccgggcccggcttttgattggttgcgctttcgcagcgccctgcaggatggaggacacgcacgatgagtttcctggtgttggtgctggcagtctggatcgagaaattctcggccctgcgtcggcgattgcagcgtgacggcggatggttgcgagagctggccaagctggagtcgagcccacgcctgggcaagcggccgtggttgattcttgtgctgctggtgttgttgccggtggccctgctggcgctgttactggtggtgctggaaccggtggcttatgggttgttggcgctgccggtgcacttgctggtggtgatttacagcctgggccgtggcgacttgttggccgagcttgggccgtttcgcgatgcctggcggcgcggtgatctgcaagccgccgagcacgtggccgaacgcgacctgaagattgcagccgacactggcgagcaattgctggagcgtgtgcaaggccatctgctctggcaggcgtaccaaagttttttcgcggtgattttctggtatttcttgctggggccggtcgcggcgctggcctatcgcctgttggcgttggccagcgagcatagccagaaccccttggtcgctgaacgtgccgggcagttgcgccatgcattcgactggttaccagtgcgcctgctggcggcgagttttgccctggtgggtaactttgtcgcggtcagccgagtgatgctgcatgaactgctgagctgggacatcagcgctgcacagctgatggaaaaagtcggtttggtggccgctgaaatcccaccgccggtggtgggggctgacggtatcaacagccttgatcgcctgtgggaactgctgctgcgtgcggcggtgctgtggtacgccgggtttgcgatctggacggtgttgccgtaaacggctgaacgcgtttaaaaatgtgggagcgggcttgctcgcgaatacggcagctcagtcacaaatttgttgactgatattccgccttcgcgggcaagcccgctcccacattggttttgtggtgcgcctaagctccgttaaccttacgttacaaaactccctttcaaattgagctatacagacagagcgccaaatagtggctatctgccgtatttccctgcgcctcaataaaaataatagaaagggagttcacctgtgaagagcttgctctatcccgccgtcgcgctgatgaaccgcctgagtttcggcatgaaattcagcctgatcagtgtgctgttcctgctgccgatgttggcgaccaactacttcctggtgcgcgactcctggtctgaattccagggcacgcggatcgaactgcaaagcctcgacctgctgggcagcagcctggcgctgcgccgcgacctggaaaccctcaataaccaggttcagatcaacgcggtgctcggtcaatccggcaaggccggtgagctggaaggcagcatcaccaccctggaacagagcgtactaagccgcctgcaaagccttgaagcaatggccggcgacccggaacgcgtcagcgcgtttaacggcaagcgcgacgagatgattgccgcgttcaagacccagcaacaggaaacctcgctgctgagcaaaagcgcgttaatcggcaaattgcttaaccaggcgcagatgctcagccagatcatcgccagccaagccgggttgagccgcgacgcccagagcgatgtgcggcaactcagcgagttggtcaccagcgtcaccccgcaggtcactcaaaccttgggtgaagggcgggcgatgggcgcgtattccctcggccagggctttctcaattcagcctccagcacgcgctttgacgagctgctgcaacagttggaaaaactccaggctgagtacgccttgaagttgcaggatgcactgggtgccagccaggccgcgcatgcggcgctcgacaacctggccaaagccagcagtgcgagcctcaaaaaaggcagtgaagtgtttgaagagcaggtcgtgatggtcgataccctcgacgcgccttggcagcccttttaccaagacgtcagcaagctgatggcccagacctatcagctcaacgaagccaccctgacgtttatccagcagcaactcgagcaacgcctggcgcaaaaccgcacgcacatgctggtgctggtctgtgccctggcggcggtgttttttctgatcttctatttgtatgccgggttctatgcctccacccgcaccaccttgcgccgcctgggggcgacgatggacaaggtcgcggccggcgacatgaccgtgacctttgttgcccacagccgcgatgaactcggggatttgggccaggtgttcaacgccaccgtggccaggattcacgacttgatcgaacgtgtcgggcataccgtcagccaggtagaacagcaggccggccaggtgcagacggtgtcggcgcacagcaatcaggcggtggccgggcagcgcagccagatcgaacaggtggcgacggcgatgaaccagatgtcatccacggcccaggaagtggcgcgcagcgcggcggcggcggtcagcagtgcccacagcgtgaatgatgaaaccgtcagcggccgtggcctggtgcagtcccagcagggcagcatcgcgcgcctggccaccgagattgatgagtcggtgcgcgtcatcaatcaattggcgatcgacagccagtcgatcagcagtgtgctggaagtgatcaagagcatcgccgaacagaccaacttgctggcgctgaatgctgcgattgaggcggcgcgcgcgggtgagcaaggccggggttttgcagtggtcgccgacgaggtgcgcaccctggcccggcgcacccagcattccaccgaagaaatcgaacagatgatcagccggcttcacagcggagtcggcgcggcggtgaaggccatgggcaccagccatgccatggcgaacggtacggttgggcagtcggaaaaggtccagcaggccctggaaaatatcctcggcgccgtcggcatgatcgtcgaccagaaccagcagattgccgcggccgtggagcagcagactgctgtggcccacgatatcgaccagaacatcgtcgcgatcaaccgcgcgggcgagcatgcagccgagggcgcgcatcagaccgaaaccgccagccgcctgctgtcgatgcaggtcatcgagttgaagcaattgatcggagcgtttcgcgtgtaggtcgggcacgtaggaatttaccctggcgtgatgtggtgcctgtcctgatttacctgtggatcttttctgggtgcgtgaatgggggagaatttgtttcaaccagtcacggacccggagaggcacggcgatgaccgctgttatcggcatcaaagggcactgcgcccattgcgacatcaccttttcactcaagccttggcagctaaacgccattgccatccatgagccctttggttgcacctactgtcagcgcatcttgcagttgagctgcccacgacagctgcgccaattcaagtcgctggaccactgggccatggtgcacccgagcatgatggtgctgaccagtgtggtgctgattgtggcgatggtggccgaatggcttgggctgctcagcgtgatagggcaactcaatgtgtcgctggtggtcctgctggtgcactttctggtgctgcgttatgcccggcatcggcagcgactcacgttggacttgcaggccgtcaacccactaccaattgaacaactcgcacgcattgcgtgtgctcgcctcagccaatagcaacgggctgatacccatgcgttcggccagggcggtgcagatgtccggcaagtgttgcgggctgttccgctggccggggtacatggcgggggccatgtccggcgaatcggtttccagcaccaccgcatcaaggggcaattgggcgagcaccttgtgcatgcgcagcgcctggggccaggtggccgcgccgcccaggcccagcttgaagccgagcttgatgtactcgcgagcctcttcaacgctgccggcgaacgcgtggatgatgccgccgcgcggcaggcggatgcgcttgagcgtggcgatcaccgctgcgtggctgcggcgcacgtgcagcagcgcggggagctggtagtccaccgccagtttcagttgggcctcaaacaggctttgctggcgctcgcggtccagatgttcaagaaagtagtccaggccgatctcacccacagcgcacagttgccggtgcccgtgcaggcgggtcagccagtcgcccaactcagtcaggtcggcggggcgatggtcatcgaggtacaccggatgcaggccgaaggcggcgaacaagccttcatcgtcttgcaccaggtcccacagccgttgccaattttgctgatacacgcccagcaccaccatgcgccgcacaccgagtcggcggctgttggcgaggacttcccggcgatcatcatcgaagtccgggaagtccaggtgggtgtgggtgtcgatcagctccacgctcaggcctcgtgaatacgccgcttgaaggtccggccaatggcatgcacgcccggttggtactgttcttcctcgatggcggccaaggccaggcgcagggcggtgtcggcaatcagctgatgttgctgggccatggcgttcaccggcagcggcaggaagtccagcaactgggtgtcgccaaaggtgcccaggcgcaacggccgggacttgagcgggaagtcatgcagcgcgtcaaacacgccctgcagcagcacgtaggatgtagtcaccagggcgtcaggcaaatgccccagttgctgtagaagttgctccatcagctgtcggccgcaatcacggctgaaggcttcaccctgttcaatgatgacgtcacccgtgaacccttgcagggcttcacggaaacccgccgcacgctcctggctgatgctcagctcaggccgggcgccgatcagcacgatctgcttgggcagcggctgcaacaggctgctggtcagttgctggcaggcttggcggtcatcgctgaccaccgagcagaattgcccaggctccatgacccggtcgatggcgatcaccggcaggcctttggcttgcagctcgcggtagctgtcatcgctggccggcaggcagctggcgacaaacaacgcatcgcagcgccgcgcgcgaaacagctgcagcaactggcgctcgctgtcggcctcgtcgtcggagctggcgatcagcaactgatagccgcgcgctcgtgcaccttgctccagcagcttggcgatgcgtgcatagctggggttttccaggtccggcaggatgaaacccaaggtacgcgtatgccggctgcgcagcccggctgcctgagggttgggcgtaaaaccatgggcttcgaccaccgcacgcacccgctcgacggtggcgttgctgatgcgttgctgttcggccttgccattgatgacgtagcttgcggtggtcacggacacaccggccagacgtgcgatatcactgagtttcaaaccgggatttccttgttttttagagcgtgccccgacattttgtccaatcgtaaccgattcctgcacacgactattgtctgagctcaagcgccgagtggttcttcaagcttgcataattagcgcgtaatctgccataaattctagattaaacgtttcagcaggcgtatttttgcgatgttcgccactgagtggctactgccaattgaccactcagtcagttatttttgaacaccgccacgctgatttattcaaaacaatacctagtgcgcacaccgcactaactaggagaacggcatgcttgagctcactgtagagcagatttccatgggccagagggctgtggataaatctgctgccttgcacctgctcgctgacaaattggtggccgatggcctggtcgccgagggttatctcagtggcttgcaagcccgtgaagcccaaggctcgacctttctcggccaaggtattgccatcccccacggcaccccggaaacccgcgaccaagtcttttctaccggcgtgcgtttgctgcagttccccgaaggcgtggactggggcgacggccagatcgtctacctggccatcggcattgccgccaaatccgatgaacacttgcgcctgctgcagttgctcacccgcgccctcggcgagaccgacctgggccaggccctgcgccgtgccggttccgccgaagccttgctgaaactgctgcaaggcgcgccgcaggaactggcgctggatgcgcagatgatcagcctcggcgtgtccgccgatgattttgaagagctggtctggcgtggcgcacgcctgttgcgccaggccgattgtgtgagcaacggctttgccgccgtgttgcagcaagtcgacgcgctgccgctgggcgatggcctgtggtggctgcacagcgagcagacggtgaagcgccccggcctggcttttgtaacgccggacaaacccatgcgttacctcggccagcccctcaacggtttgttctgcctggccagccttggcgaagcgcaccagaccctgctggagcgcctgtgcgccttgctgattgaaggacgtggccaggagctcggccgcgccaccagcagccgtgcggtgcttgaagtgctcggcggtgaactgccgccggactggccgagcgcgcgcatcaccctggccaacgctcatgggttacatgcgcggccggcgaagatccttgcgcaattggcgaaaagttttgacggcgatattcgcgtgcgcatcgtcgatggcccggtgggcgccgtgtcggtaaaaagcttgagcaagttgctgagtctcggcgcgcggcgtggccaggtgctggaattcgtcgctgagccgacgattgccggcgatgcattgccggccttactggcggcggtggaagaaggcctcggcgaagaggtcgagccgctgcccaccgtcagtgcccagccggcagccgtcgacatcgagccggtgatcagcgcccccgcgtccggcagccagatccaggccatcgccgccgcgccgggcattgccatcggcccggcgcatattcaggttcagcaagtcttcgattacccactgcgcggcgaatcctcaggcgttgagcgccagcgtctgcacgcagcactcagcgatgtacgcggggatatccaaggcctgatcgaacgcagtaaatccaaagccatccgcgagattttcatcacccaccaggaaatgctcgacgacccggaactgaccgacgaagtcgacacccgcctcaagcagggcgagagcgccgaagccgcgtggatgagcgtgatcgaagccgccgccaagcagcaggagtcgctgcaggacgccttgctcgccgagcgcgccgccgacctgcgcgacatcggccgccgggtgctggcgcaactgtgcggcgtcgacaccgccgaggaaccgagcgagccttacattctggtgatggacgaagttggcccttccgacgtcgcgcgcctggacccggcccgcgtcgccggcatcctcaccgcgcgtggcggcgccacggcccacagcgctattgtcgcgcgcgccctgggcattccggcgttggtgggcgcaggtgcggcagtgttgctgttggccgccggcacgccgttgttgctcgatggccagcgcggtcgcctgcacgtcgaccccgacgccgctaccttgcagcgcgccagcatcgagcgcgacacccgcgaacaacgcctgcaagccgcctcggcccagcgccacgagcccgccctgacccgtgacggtcacgccgtggaagtgttcgccaatatcggcgaaagcgccggtgttgccgcggcggtggagcagggcgccgaaggcatcggcctgctgcgcaccgagctgattttcatggcccacccgcaagcgccggatgaggccacccaggaagccgaataccgccgcgtgctcgatggcctcggcggccgtccgctggtggtgcgcacccttgacgtcggtggcgataaaccgctgccgtattggccgattgccgaggaagaaaaccccttccttggcgtgcgtggtatccgcctgaccttgcagcgtccgcagatcatggaagcgcaattgcgtgcgctgctgcgctcggcggataaccggccgctgcgcattatgtttcccatggtcggcagcgtcgatgaatggcgcgccgcccgcgatatgaccgagcgcctgcgcctggaaatcccggtggccgacttgcagctgggcatcatgatcgaagtgccgtccgctgccttgctcgcgccggtgctggccaaggaagtcgactttttcagcgtcggcaccaacgacctgacccagtacaccctggccatcgaccgtggccatccgaccttgtcggcccaggctgatggcctgcacccagccgtactgcaactgatcgacatcaccgtgcgcgccgcccatgcccatggcaaatgggtcggtgtgtgtggcgagctggcggcggacccgctggcggtgccggtgctggtcggcctgggtgtggatgagttgagtgtgtcggcccgcagcattcctgaagtgaaggcgcgggtgcgtgaattcagtctgagcgaggcccagggcctggcgcaaaaagcccttgcggtgggtacacccgcgcaagtgcgagccctagtggaggccgtgtaaatggcgaagattctgaccctgacgctgaacccggcgttggacctcaccgtacgtctggcgcacttggagccgggcgcggtgaaccgtagcgaaaccctgctgacccacgccgccggcaagggcgtgaacgtggcacaggtgttggccgatctcggccattacgtgagcgtgggcggttttctcggcggcgcaaaccccgaggcttttgaagcgttgatcgccagccgtgggtttggcgacgcgttcgtccgcgtgccgggcgaaacccgcagcaatatcaagattgccgaacaggacggccgggtcaccgacatcaacgcgccggggccgttggtgagcgagcaggcgcaaaaacaattgctgaagctggtggcggtgatcgcgcctgaatttgatgtggtggtggtcgccggcagtttgccgcgtggcgtcagcgtgcagtggttccaggcattgctggaggaactcaaatcgctcggtttgaaaatcgccctcgacaccagcggcgaagccttgcgtgcaggcctcaaggtgggcccgtggttgatcaaacccaacgctgaagaactcgccgaagccctggattgccccaccgattccatcgcacaacaggcgctggctgccgagcgcttgcacgctcaaggcgtggagcatgtggtgatctcccacggcgctgacggtgtgaactggttcagcccgggcacggcgctgcatgccacgccgcccaaggtcagcgtcgccagcaccgtgggcgcgggcgactcgttgctggccgggatgctccacggtttgctcagtgctgatctgccggaaaccaccctgcgccgcgccacggcgattgccgcgatggcggtcacgcaaattggcttcggcatcagcgatgacgcgcaattggcgcgtctcgaaagcggcgttcacgtgcgcgcgctgacagaacaataagagggtttgtgatgaagttagccattgttaccgcctgcccgaacggcatggtcaccagtgtgctgtgcgcccgcttgttggacgccgccgcgcaacgccaaggctggagcaccagcgtcgaagtggtggacgtgcagcgcccggaacgccagttgtcccaggccacgctcgatgacgccgaatgggtgttgctggtcagcagcacgccggtggacatgcagcggtttgtcggcaagcgcgtgttccagagcacgccggcccaggcgctggcggatgtcgacgcggtgctgcgcctgggcgctgaagaggctgcggtgtatgtagcgactgaacaggcggtgaaaaacgccccgcgaatcgtcgcgatcacggcctgcccgacgggcgtcgcccacaccttcatggccgccgaggccttgcagcaaactgccaagcgcctgggctatgacttgcaggtcgagacccaaggctcggtcggcgcacgcacgccgttgagcccgcaagcgattgccgaggccgacgtggtgttgctggcggccgacattgaagtcgccaccgagcgcttcgccggcaagaagatctaccgttgcggcaccggcattgcgctcaagcaatccgaagccacgctcaacaaggccctggccgaaggcgcggtagaaagcgcagccagtggtacgacggccagaaagtcggaaaaaaccggcgtgtacaagcacctgctcaccggtgtgtcgttcatgctgccgatggtggtggcgggcgggttgttgatcgctttgtcgtttgtgttcggcattcatgcgtttgaagaacagggcaccttggcggcggccctcaaaaccgtcggtgaccaggcctttatgctgatggtgccgctgctggcgggctacatcgcctactcgattgctgatcggcctgggctggcgcccggcatgatcggcgggttgttggcgggcacattgggggcgggttttatcggcggcatcctcgccggtttcctggcaggttactgcgtcaagctgatcactcgcgcggtgaaactgccgcagagcctggaagccctcaagccgatcctgatcattccgttgctggcgagtttgttcacgggcctggcgatgatctacctggtcggcccaccggttgcgcggttgctcaccagcctcaccgactttctcagcaccatgggcaccaccaacgcggtgctgctgggcattctgttgggcggcatgatgtgcgtggacttgggcgggccgatcaacaaagcggcgtacgcgttttcggtcggcttgctcgcggcttccagcggtgcgccgatggccgcgaccatggccgccggcatggtgccgccgattggcatgggcatcgccacgtttctggcgcgccgcaagtttgcgcagaccgagcgcgaagccggcaaggctgcgatgattctgggcctgtgctttatctccgaaggcgcgattccgtttgcggccaaagacccgctgcgcgtcatcccggccagcatcgccgggggtgcgctgaccggcgcattgtcgatgtacttcggctgcaaactcgccgcgccgcatggtggcttgtttgtgctggtgatcccgaatgcgatgaaccatgcgttgctgtacttgctggcgattgttgccggtagcctgttgacggggttggtgtatgcgctgatcaagcgtccggaagcggtggagttggcagtcacctctgccaaagcctgacacagggtaaaaaatgtgggagctggcttgcctgcgatagcatcacctcggtgtcactgatactccgaggtgtccgcatcgcaggcaagccagctcccacagttgatctccattgtcctttagatcagtgtcacatccgcttcatcccgccatgctttagttgcccttttgatcctcaagagggcacctgcatgagccacttcgatctcggccgtcgccgtgtgatgcaagccgtcggcgccgggctgttactgccgggcctggcgccggcggtgatcgcctcggtcaaggaccggccgcaactcaccgacggcgtgcagtccggcgacctgctgggcgaccgcgcgatgatctggagccgcagcgaccgcccggcaaaaatggtggtggagtgggacactcgcagcgtattcagcaacccgcgcaaattcatctcgcccctggccgacagccgcaccgactttaccgcccgcgtcgaactcaccgggctgccggtcgaccaggcgattttctaccgcgtgcatttcgaagatgcccagactggcgtcgccagcgagccgtggttcggccacttgcgcagcgtgccgcagcaacggcgtgacatccgttttgtgtggagcggcgacaccgtcggccagggcttcggcatcaacccggacatcggcggcatgcgcatctacgaagcgatgcgcctgcgcctgccggacttctttatccacagcggcgacaccatctacgccgacggcccggtgccggcgcagttgaccgttgaagacgggaggatttggcgcaacatcaccaccgaggccaagagcaaagtcgccgaaaccctggacgaatatcgcggcaattaccgctacaacctgctcgatgaaaacgtgcgccgctttaatgccgaagtgccgcagatctggcagtgggacgatcacgaggtggtgaataactggtcgccgagcaagcagcttgatgagcgttatcagaccaaagacatcaacaccctggtcggccgtgcgcgccaggcctggctggaatattcaccgatgcgccggcaaagcgccgacggcggcgggcggatttatcgcaagctcagctacgggccattgctggatgtgtttgtgttggatatgcgcagctatcgcggccccaacgatgacaacctgggcggcgaaaagccctttctcggccgtgagcaactggactggctcaagcgcgaactcaaggcctcccaggcgcaatggaaagtgatcgccgccgacatgcccatcggccttggcgtgcccgacggcgaggtcagccccggcgtgccgcgctgggaagccatcgccaacaatgacccaggcccggcgcaaggccgcgaattggaaattgccgagctgttgggctttttgcgtgcccagcaggtgcgcaaccatgtgtggctgacggcggatgtgcactactgcgcggcgcatcactaccacccggatcgggcggcgtttcaggatttcgagccgttctgggagtttgtggccgggccgttgaatgccggcagtttcgggcctaatccactggataagacgtttggccctgaagtggtgttcgagaaggcgccacctgcgcaaaacacttcaccgtttgccgggtttcagttttttggtgaggtgcagattgatgggcagacggcggagatgaccgtgatattgcgcgacttggatggggtgtcagtattcgagcaaaaactgcagcccgtctgacctgaaatgcattcaaacctgtgggagctggcttgcctgcgaatgcggtgtgagacgatcgttcccacgctctgcgtgggaacgccgctatggacgctctgcgtccgcttttaaagtcgtgacgcggagcgtcacaagatgcattcccacgcagagcgtgggaacgatcaatcagtagacgtcgcgacgataacgcccttgctcgatcaaccgctccaccgcctcgctgcccagcacctcgtgcaacacctgatccactccggtcgccatgccctgcaaactgccgcagacataaattgcggcgccttccgccagccatcggcgcagcacgtccgccgactcgcgcaggcgatcctgcacatagatcttctcttcctgatcccgcgaaaacgccaggtccagcagggccagatcgccgctggccagccagccttgcagttcgtcctggcacaagtagtcatgggcgatattgcgctcgccgaacagtaaccagttgcgctgctggccatcggcaatgcgcgccttgagcaagctgcgcaggccggcaaggccggtgccgttgcccagcaggatcagcggcatcggcgcgtccggcaaatggaagccgctgttgcggcgcaggcgcaggctgatgctggagccgagggcggcgtgttccgtcagccagcccgaacccaggcccagtctgccgtcggggtgccgttcctggcgcacgatcagctccagaatgccgtcgctggcaatcgaggcgatggagtattcgcgcatgccaaagggcaccaaggcgtccaccagcgcttgggcatgcaggcccaccaagtgcgcgcggttgtccggcagttggcgagtggccagggcttggttgagggtttgcgccaagccgtcgatcagcacgccatcgctgccgtccaggcccaggccttcgaggaagtgttcgatggcccaggagcaattacgcggcagcacttcgaccaggtcaccggccagccagctgtgcggcgagggcggggttaggccgagcaagtaaatacctgaaccgacgctgccacggttgagcaggcggcgccgggtcagggtccagttttcatactgggcgctctgccaagccgctgccggcgcgtgaccggtgagctggcccagttgctgttgccaggtgagcaaggcgtcggtgtcaccgctgtcgacttccaccggcgcgaacaacgggttaccgccttggtgagtcagccagaaatgcaggcgccgggcaaagccgcaaaagtgttggtattggcgatcacccagggccagtaccgagtagttcaggcctttgagcgacaggtcttggccgagcacactgcgctcaaacccacgggcgctgtcgggggcttcaccgtcgccgaacgtgctgaccacgaacagcgcgttttctgattggcgcaggtcgtcctggctgacagtgcccaagggctgcaccttcaccggcaagccggcggcctgtaattgccctgccgtctgccacgccaactgctcggcaaaaccactctggctggcaaagccgatcagccaggcaggggcgtcgccagggttggcgtcgaggcctttgcgcgcatcgcgtacctggcgttttttgcgccgacggtcgaggtacagcagccagccggtgataaaaaacagcggcatgcacagtgcgctgacggtgagaatgatgcgcccgatcaggccgaaataactgccggtgtgcagcgcgtaaatactggtcagccattgcgacttgagggtcttgctggcgtagcggtcgtggaagttgacctcgccggtggccgggtcgaggttgatctggttcagcgcgcggtcgtgaggcgaggttttgagcaggtaatagacaatcgccggttgcccggcgacggccggcatgcggatgttgtaagcgctcaagccggggccggcgttggcgtagatgctgctccagatggcgtcgtaattggccaccggcgcagggcctgcgggcggtgggccgcgtttgcgcatgcgctcgttgttcggggcgtcggacaacagcttggtcaggccctggttgtaccaatcgtaggaccacgacaaaccggtcagcgccgcgaacagatagaacagcaggcaccaggtgccgaacaccgagtgcaaatcccagttgaagctgcggccttttttgcgccagtccagggtcagccaggcgcgccagcttgccacttggcgcggccagcgcaggtacaggccggagaggcagaaaaacactaggatcagcgtgcaggcgccggtgatttgccggccggtgtcgcccatggccaggaagcggtgcagttgcagcacaaagccgaagaagtcctgacctacggcgtcgcccatgtaatcgccggtgtaagggtcgaagtagcgcatctggccacgacgctcgccgggcggtgcggtgaagaacacgcgcgcggcgttgccgctttcgctttccacccacagcatcgacacagtcttgccttcggtggcttccagcttgcgcaccaactccgcaggcggcagaaccccggcttcgcgtttttcgacatgcagtaccgtggggttgagtgcgcgcagaatttcatcctgaaacgagaccgtggccccggtgatccccatcaatgccaacaccagcccggcggtaatgccgaagaaccagtgcaactggaacagggttttcttcaacacgtcggacggcctcgctgagctggatagtaggtcacggcgcgcattatgccgtgggttaacgagaaatattctgttttacatataaatctctcgcgcatccgatgcgtgggtttgggccgggcgtttttgcgcgcgtctgtctgctgtgttttacacagcggataggaatcaataccattggcgcctctctgatgtcaggtgacgccccatgctgctgcacattcccggcctgttctctcgcgaggaggtgctgcgcattcgccaagccctggaaaccaccgagtgggccgacggtaaaatcaccgccgggcaccagtccgccaaagccaaacacaacctgcaattgcccgaaggccacccgttggccaaggaaatcggcgcggcgatgctcgaacggttgtggaaaaatcccttgttcatgtcagcggcgctgccgcacaaagtcttcccgccgctgcttaattgctacacggcgggcggcagtttcgacttccatatcgataacgccgtgcgccaggcgcgtggcagccatgagcgggtgcgcactgatctgtcgtccacattgtttttcagcgacccggatgaatacgacggcggcgagctggagatacaggacactttcggcctgcaacgggtaaaactgccggccggcgacatggtgctgtacccaggctccagcctgcacaaggtcaacgccgtaacccgcggtgcgcgctacgcgtcgttcttctggacccaaagcctggtgcgcgaagacagccagcgcaccttgctgttcgaaatggacggcgcgatccagcaactgacccgcgatgtgccggaccacccggcgctgatccagctaaccggcacgtaccacaacctgctgcgccgctgggttgaggtctgaatgggttttttattgcgccgtgaagaagtgctcaatgtcgaacaattgcagtccatgctcgacgactcgccggtgcgcgccgcccaggcgatcctgatggcggcgaaggaaggcgtgatcgacgcccaggccttgctcgggcaaatcctgctggaagggcgcggcattgcgcgtgatcaagcgctggcattgcgctggttcaagattgcggcccagggagggcatttaattgcgcgcaatatggcggggcgttgcctggaacatggctggggctgcgcggtggacgaagcggcagcggcgcgcgagtttcgcttggcggcagaggcggggctggattgggcgcaatacaactacgccaatttgctcgccactggtcgcggtgtcgctgaagaccgaccacaggcgctggcgctgtaccgcctggcggccgagcagggccacgccaagtcgatgaacctgctggggcgttaccttgacgacggtcagtattgcccgagggatctggacgcggctgtgcagtggtatcgacgttcagccgaaggcggggattttcgcgggcagttcagttatgcggcggtgctggccgataaagggcaggtcgacgatgcgctggagtggttgcgcaaagccctggcaggcgggaatttgaagtttttgcgaacggcgtatacggcgctggcggcggcggatgatccgcagattcgggcaatgggcgcggtgtaccagcagcgtgctaccgaactcgatcgttcccacgctctgcgtgggaatgccggtctggacgctctgcgtccgtacttgaaggcgtgacgcgcagcgtcaccggatgcgttcccacgcagagcgtgggaacgatcactctgcgttaaacgtagtaggacttcaacggcgggaagccattgaactcaaccgcgctgtagctggtggtgtaggcaccggtcgacaaccagtacaaacgatcaccaatcgccaggttcagcggcaggccgtacttgtagttttcgtacatgatatcggcgctgtcgcaggtcgggccggcgatgaccacttcttccatctcgcctttcttctcggtccagatcgggaacttgatggcttcgtccatggtttcgatcaggccggagaacttgcccacatcggtgtacacccaacgctcgacagcggtacgggatttacgcgcaaccaataccacttcactgaccaggatgccggcgttggcgatcaacgaacggcccggttccaggatgatttccggcaggtcgtcgccgaaatcttccttgaggaagcggatgatttcttcggcgtaggtttccaggctgttggtgcgggtgatgtagttggccgggaagccgccgcccatgttgatcagcttcagatgaatgccgtcttcttctttcaggcgttcgaagatcactttgaccttggcgatcgcggcgtcccacacgctgatatcacgctgctgcgagccgacgtggaaggagatgccgtacggcaccaggcccaggtcacgggcgaggatcagcaggtccatggccatgtcggtctggcagccgaatttgcgcgacaaaggccagtcagccgtggtcgagccttcggtgaggatacgcacgtagactttcgagcctggcgcagccttggcgatgttgcgcaggtcggcttcggagtcggtggagaacaggcgcacgcccttctcatagaagtagcggatgtccttggatttcttgatggtgttgccgtagctgatacggtcggggctcacgccgcgatccatgaccttgtccagctcgtagatcgaagcgatgtcgaagctcgaacccttgtctttcaacaggtcgatgatttcgacggccgggttggccttgaccgcgtaatagactttggcgaattcgaaaccggcgcgcaggtcatcgtaggcctggctgatcatcgcggtgtcgatcaccacgaacggggtttcttgcttgtcggcgaacgccttcattttgtcaaaagtggcgcgcgcgaaataatcttcgacgttgatcgacatgctgggaactcctaagggcaaactaatttgatcaatgggtgcaaatgaacgtcctccgtatccccactttggttcgcctacttcccaaggcatgtcgccgaaagcaaaaaggccatgggaatagacgcttcccttggccttgctgtctcgtcgtcagtacttgagccggatggatcgtttccagcatggacgttcggcgcgaactttaggacgtgaggggccatagatcaactaaaaatgtcgcgtttttgcacgcgttcgtcgcggagccgcgtgcagctacttatgtaaccgaccggtgtgacggattgatgttccccgggaggggcaaatcaggaggatttgtggtgccttcatcgcgggcaagcccggctcccacaggggaatgcattccaacaaatgaatgcaattcaatgtgtgagccgggcttgccacaggggaatgcattccaacagatgaatgcaattcaatgtgggagccgggcttgccacaggggaatgcattccaacaaatgaatgcaattcaatgtgggagccgggcttgcccgcgatagcggtctatcaggccagcgcggtttcggcaggcgaaacgatgctggtcttgccgccacgcgacttaccggagctcaggtactcggcaatcgactcctgggtcacttcacccaggaacacccgctcagcgtccatcaccggcaaccacgagcggttgaactcgtacatgcgcgacagcaggatgcgcaagtgctcgtcgtacgctgccgtggcgttgaattcgcgcaagtactggccgcaagtaccggtctgacggtgcaggtcgcggcgtcgtacataacccagcgccttgttctcggcgcaggtcaccaccacgtaacgacggtcggtttcgtccatcagctccagcgcctcggccaccggggtttccgggctcaccgacggggcgttgtctgcggcgtcttcggctttcaccagcagcaggcgcttgagggtgctgtcctggccgacgaaattgctcacaaattcatccgccgggtgcgccagcagcgtgtccgggtggtcaatctgcagcagtttgccggcgcggaagatggcgattttgtcgcccagcttgatggcttcgtcgatgtcgtggctgaccatgatcacggtcttgttcagcgcgcgttgcatctcgaagaactcgttctggatcatctcgcggttgatcgggtcgactgcgccgaacggttcgtccatcaacagcagcggcgcatccgctgccagcgcgcggatcacgccgatccgctgctgctggccacccgacagttcacgcgggtagcgatgcaggtattgcttgggctccagcttgatcatgctcatcaactcgcgggcgcggtcgtggcatttctgtttgtcccaaccgagcagcttgggcaccaccacgatgttttcttcgatggtcatgttcgggaacaggccgatctgctggatcacataaccgatgttgcgacgcagggtcacctcatccaggtcggtggtgtcttcgccgttgatcaggatcttgcccgaggtgggcttgatcaggcggttgatcattttcagcgtggtgctcttgccgcaacccgatgggccgaggaatacgcaaatctcgccttcgttgacggtcaggcttacgtcattcacggcggagacagttttgccgttgctttgaaaagtcttggtcaggttttgaagttcgatcatttgagcagtccttttggagtcagcgagcgttgcagccattgcagaagcaggtcggcgaagatggccagaagactgaccagcacggcgccaacgatcagcatcgacatgtcgctgcggctgatggaagccagaataagtacacccaggccaccggcgccgatggtggcggcgatggtcattacaccaatgttcatcaccacggcggtgcgcacaccggcgaggatcaccggtacggcaatcggcaattcaaccatgcgcaggcgctggccgaaggtcatgccgatgcctttggcagcttcgcgaatgcccggctccacgccggtgagggccaggtaggtgttacgcatgatcggcagcagggagtagaggaacacggcggtaatcgccggcatcggccccaggccctggccgaacttggaatagaacggcaacaacaggccgaaaagggcgatggacggcacggtcagcagcaccgtggcgctggcttgcaacgggccggcgagcgtcgggaagcgcgtcatcagcacgcccaggggcacaccgacgacgattgccaggatgactgcaataccgaccagggtgatgtgctgccaggtcaggtgcaggacttgtgcccaatcaagatgggaaaaggcgttcagaaattccatgtcttctcctcttatgggttgatcggatgttggcgcaggaaatctgcggccacggcggacgggctttcatggtcgacgtcgacccgcgcattcagctggcgcatggttgcatcgtcgaacagcgcggccagaggcttgaggtccgcttccagctgcgggtgagcatccagataaacctgacgcaccacgggcgcggcggtgtagtccgggaagtaatgcttgtcgtcttcgagcagcttcaatttgaaggcgttcaagcgaccgtcggtggtgtagaccaaaccggcaaacacttggccattacgcagcgcggtgtagaccaggccggcgtccatctgccgggtgtttttgcgtgtgaggttcatgtcgtacagcttgaccatgccagccatgccgtcggaacggttggcgaactcggtgtccagggccaccaggcgggtgcttttggttttttccgccagggcttgggtcaggtcgctgatgctgttgacctgcgggaattccctggccacgttctccggcaatgccagcgcataggtgttgctgaatttcgacggggagagccagaccaggccttttttcgcgtcgagttctttcactcgggcgtaggactgttcactgtcgagcttctcgtccacatggttgtaggccaccagcgacacaccggtgtattcccagatcaggtccagttgcccgctttcctgggcactgcgcgccaggttgctgcccaggccgccggtcacgcgggtgtcataacccttggcgcgcaagtactgggaagtgatttcggcgagcagggtctgttcggtgaacacccgggcgccgatgcggatgaccggtttttcggcggcttgcgcaatgcctgcaaacagcaggacgcagctcaatatcaacgtcagttttttcatgtgatttcctttgccaagccttaagacggacgcaacccgcgttccagccagaggcggctggccatggtcaccagaccgtcgagcagcaatgccagcaacgcggtgcacgcggcgccgagcagcaattgcggctgattgttcagggcgatgccggggaaaatcaggctgcccaggctgttggcgccaatcaggaacgccagcggtgcggtgccgacgttgatcgccagggccacgcgcacgccgccgatgatgatcggcacggcgttgggcaattccacgcgaaacagcacctggcgcggcgtcatgccgatgccggtggcggcttctttcagcgagccttggacgtttttgaggccttcgtaggtgttgcgcacgatgggcagcaacgaggcgaggaacaacgcgaagatggccgggccactgccgatgccgaggacgccgagggcgatggccagtacggccaggggagggacggtgttgccgatgttgaatatttgcatgaagcgttctgcgcgcccgaccatgttcggtcggctgagcaggataccggcggggatccctacaacaagggctgccagcatggagactagaacgaggatcaggtgtgcttgcaggtaaaacaacaaatcgtcgcggtacagttcgatcgtgttgatgccgatccagtggaccagcagggccaggagagcgacgacaaccgctcctcctatcagccctttgccatagcgaatagccacaggcggactcctttttttcttttgtcggcgaacacatttccgagcggcaatgccattcctggctgtcggcgaatgtggtcgcgaaatgcagcttgtcgataccggcaatgcggtatgcgatcaagccatgagcgcagcctcgtcaggctaacttgctgatttatcagcccctgttccgagtgcggtagcaggggagtggacgtctcgaccttttaaaaggttccacacttggcagcatttagccacccccaatcgggtgaacggtggtctggctccctgggtttgcgctatactcgccgcccttttttgactcacctgccaggcgatttcccatgacccaccaggccgccgaagtcgcgaaacgccgcactttcgccattatttcccaccccgatgccggtaaaaccaccatcaccgagaagctcctgctgatgggcaaggcaatcgctgtggccggcacggtgaaatcccgcaaatccgaccgccatgccacctccgactggatggaaatggaaaaacaacggggtatttccattaccacgtcggtcatgcagttcccgtatcgcgaccacatggtcaacctgctcgacaccccaggtcacgaggacttctccgaagatacctaccgcaccctgactgcggtggactcggccctgatggtcctcgacggcggtaaaggcgttgagccacgcaccatcgcgttgatggacgtgtgccgcctgcgcgacacgcccatcgtcagcttcatcaacaaactcgaccgcgatatccgcgaccccatcgagctgctggatgaaattgaagcggtcctgaagatcaaggctgcgccgatcacttggccaatcggttgctaccgcgacttcaagggcgtgtaccacctggccgacgactacatcattgtctacaccgccggtcacggccacgagcgtaccgacgtcaagatcatcgagaagctcgattccgacgaagcccgcgcccacctgggtgacgagtacgaccgcttcgtcgatcagctggagctggtgcagggcgcctgccatgagttcaaccagcaggaattcctcgacggccaactgaccccggtgttcttcggtactgcgctgggcaacttcggtgtcgaccacgtactcgacgccgtcgtgaactgggcgccgaagccgctggcccgcgtcgccaacgagcgtacggtggaaccggtcgaagagaaattcaccggtttcgtgttcaagatccaggcaaacatggaccctaaacaccgcgaccgtatcgccttcatgcgtatctgctcgggcaaatacgaaaaaggcatgaagatgcgccacgtgcgcaccggcaaggacgtgcgcatcggcgacgccctgacgttcttctcctccgagcgtgaacagctcgaagaagcctacgccggcgacatcatcggcctgcacaaccacggcaccatccagatcggtgacaccttcaccgaaggcgaagtgctgggctttaccggtatcccgcacttcgccccggaactgttccgccgcgtgcgcctgcgtgacccgctcaagtccaagcaactgcgccaaggcctgcagcaattggcggaagagggcgccacccaggtgttcttccccgagcgcagcaacgacatcatcctcggcgccgtcggtgtgctgcagttcgacgtagtcgccagccgcttgaaagaggaatacaaggtcgaatgctcctacgagccgatcaccgtgtactccgcgcgctggatcgattgcagcgataagaagaagttggaagagttctccaacaaggccgtggaaaacctcgcggtggacggcggcggtcacctgacctacctggcgccgacgcgggtcaacctggcattgatggaagagcgctggccggatgtgaaattccgcgcgacgcgcgagcaccattaaggtctgagcggtacaaaaagggcgaagctgtgatggcttcgcccttttttgtgggcgtataccgccgaccattgtgggagctggcttgcctgcgattgcggtgggccagtcactgataggttggctgacgggccgctatcgcaggcaagccagctcccacattttggtcttcatccgcctgggaaattggcgctaacccagcatccggtctagcgtttcgaatagttcaccctttcaccgacggaataggagaccaccgtgcgtataactcaacgtgccagccatttgctgctgggggcactggcgttgtccatcgccatggcgcatacgttggcgctggctgacaccggcacaccccaatggaaagacaccggtccggtcaccaaaaagaaacagaacgaggtcaactccggcagttggcaaccccaagcccaacccgcgcccaaggaggatgcggaaaacccctataacgaaggggaagacagtgaaacctatgacgacggtgacacctgaggcctggcgcaaacctggcattgggactagcttctaacctggcgacggtaaaccgctgtcgtgcaggattcatctactgactggacggaaatcgaccatgagtatttttcaacgtgtagtgctgttgataaaagtgctggtgctgttgtcgttggggatgtcgacggcctgggcgcataacccggtgcagggcagccaggtgggcttttctgcggtgcagacggcgcagggcaaagggttgcagttggccaagtctgaatccgaagcgggtgacgaagaccagggcggctccaaggatgatgacgaccagcaagccccgccggatgacgatgactcctctgaaggcgacagcgatacctgagtcgcgctaaaaaagcccctcccgtcagggcatgcgtcacctgatgggaagggcttttgaaaaccaaactcaccccacgcgtaaatcaaccgatttctttaaaataatcgtggctagtgatgtgctctatagaaagaccttgttctggtgtgtagctggtacttcgaacggtagagaaccctgttcccttatcacccaagctaatagtgcggtcttcccctgtttttgtgctgatggtgtaaaccgtgttgcgcatcgtcatatagctcgctgagtcattctttattttttcgagcaggctgtttatctgggctggcgtcagattgagtgttttttccaggccaacaccccagcgagccaagcatgtttcggcatagtgtcgaacgatctgccccggctcaggaagaattttcgaacccttgttaccattggcagccgcattacccaccagagttgcgtgtcgcccgggcagtgggtaaatatggattttagtgccgctggaaaacaggggcacaacgcagtcaaagccagctgatcgctcgtcgcgcgcataaaaacctacatattcttttacgttgctcccgagttcgactctgttcttttggaagttaaaagcgcccggtactgggtcaatcgcgaagatgttgacgggcacgccagaaagttcactgtcttcgagcatggcgttcgccaacatatggcaactaacccctccgcggctccaccctactaaattgacctgggttggaataatgccgtccgatcgaaaggtctttataatctgttcttgaagctgttgcggcgtaacctgacgtgtaccatattcatatttgcgccagaaccagcagcctgttgtattaacgtcttcgatggggatgccagcattctccagttgtttatagttttccgcagtcaatttttctcgctgccaggtgaacttgcctttcatcatattgacagcgtgtgcgacgttttccttccagccatctccgaatagcattcccttcgtttgataatagccgccaggctttgtgaacatttcgtctgcttgtaagtttccactgccaggcccgtccacgatgatccaactggcgaattcattgttttggcttcgagtgttctgagccagtgtggaaaccagttcgccattccagtaattattattgctgtcatcgaatttgttagagccagtgccgcaaaagtatacagtgaaggtggtcatatattttgccgataagtttatggaattgaatacttatggaatcctaaagtccgcgttcaggctactgtgagaactaacaggtattgatattttttgtgaatattgaattgattttttatgccgtttttcattcggtagcattggtatgggttttataaaaaaaagattttttttggggggagctcaggttatttgcaaggggcaacatttctttatcgggcatttttcctcggtaagctacctgtcagaattgacagtagacgctgggtgcagtggcgtttatacctatgagtccgcgggcgttgtacagccttcaggttgttagactaactattttgtgaggttgagatgagtgctggacaagaaaaaatcatatttacagccacggaagtggcgagcctgaagtcatatgtgtcaatggcacaagacctccccaccgaagtcgatgttattgaggggcgctacaacacaaaaaagcttaatgaaaagggcctgagcgcttctgatatgagtgagctgtttaagatcattcaaagaaatgcaaacggttggccttcaattcaaacagacttaatcgcattgatgggaaagttattagagtttgcggagttgtttaaaataagcggccagggaacaatcgatatattggaatcaatcccgggatataaagagttcaatgcacaagtttctgggttgtcgcaggagcaaataaacagtcttccattgaactcaatgagagaggggtatgatcctgacttaaacaaagttgaagatatctataatgatttggggattgaagtaaaaaagcgtcgggatgagattgaaggcatagaggctcgagtctcagcgtataagcgtgagttgagtgatgaggtgctggtcgctgtaacagccaagctgaatctcgtcggtagcgatccgcttgatagggaaattgcggagcttaataaagaaattgaaaaagaaaaccttgcggtcgccgagaatcagaagatcttagatcagatgcgaagtatgagtctttggccggagtttacacaaatttatattgtgaggcctgctgtgagttcggcgaaaaaaaagcgagatcaattgataattaagttgggcgagcggaatgaaattaaatcgattttagaaaacataaaaattttactaacaggaatggaggtaattattgctgctgcgctcgatgcggtgaggaagatagagagtatctggaccttgacgttagattttgccaggtcttccgtgttgaaaataacgaatgcaacaaagatgacaaaaataaattcattggtgagcatgcaaaaaggcgcgcttaacgattggcggattgttcaagattatatgcagtccctgaagactgcgtttgagagttgacgttgttgagtgctattcaaacgatgcatgatggaggctatgatgactaatacgacggctgcatcaattccagtggtaacgaagaacgatgtagaaagcattcggcgttacgttacgaagggtaagtctttaccgacagatattaatagcataaataatttattgaaagtttccactacaaatattccaggtcttgagccaagcgatatcagggtgttatatgaagatattagcgccagtgcctatgcttggaatagcgttgaagtcgctatgaaaaaagtggccggcgcgctgtcaacttttgcagaagatataaagctctatggagacgagctggtgagtacgattgtcaccatgcccggatatattgactatatgggcaaggtcgctgatatcagtgatgaggatatcagtgcccttcctccggtctatatgactgatggcgacgggcaaagggtcaccagtatccatgattttctggaatatttgaaaacctcaattgaggctaagcaattaaatacccagggtgttattaacatcattacggctttcagaaaacgactggaagagataaagcccaacgtgggggcggcgcttaagttagcatccaaagatgaattgaacgctgaaatcacagcgttgcaagcaaaaatcgatgatgtagagttgagaattgataataaaaaacaagaatatggttggggaggggtgtgggattatttaactcttgtgaatgtgtattcaattattggatatcaggttcagaaagcaaaggatcaagcgtctgagctggaaccgttacgcaacaataagcgggaacttatccggcagatggatgctagaaacgcgctaattgggccgcttcacgccgtgtccactgagctcaacacgctgtttgattatgtgttgagtgcacagaacacggtgtctcagcttgaaagtatctggcgcggattgattgagtatatcgagtcctctaagcaaagtatcaataaggtcagtcaatacactgtgttgcgcacctttgtcataaaaatccaatccacgattaaaagttgggaaaagattaaagaaagtgcaagtgtgctggtggtggctttgagttgaacttgattgatatttacacgacaggagacgtgtgtcatgaacacagatgaactgcaggtcctcgatctgggcgttgtgagaaaggctcgggttatcattcgcaatgaaacacttatcaactccagtaatgttttatacgaatccctccggcaggagttgaaacagcttaatgcatcaattgatgaagttgatctggttatcaataacgccttggctgccgtcccggtattactggacgtcgatgaactgcgagaatacgtcaatgggttggaggacatgggggctgattcggatcgccagccagcacgggatagctacttgcaagaaataggtaagctgcttgatagtttttcggtcagatttactaaagttcgtgaaggtgtaaatgcggcaatttttgttgccgaaacggctgttattagtggcaacgattacatgttgagtgctttgcaagcggaacggagcgtgctattaagtcaagtctcgcctgaggagaagcctctcattagaatgaaggagcagatggccgttatcgaccaggctatcaaagtatatacggataactcagatttggataaggcacttgttctggtagataatgcgaccagcgtgcttgataaggctgaggtgcctggtggtatgaaggcggcggcaatcaaggcaggtgctgaaaccgctaagctggttttaaaaactcttaatgaggcgattaagtttgagcacttgattgcagcgcgaaagtcgcttcaggaaagcattgatcgaagagcaaatcgaatgacaagtctcgagcaacagcttgatgctaatcaaaaaaaatcacagcagtttattgattcgcaaaatattgtggagcctcggagggcttatgtatatcaagttaagaaggttgcggatgcgttttcgaattttcacagtgcggtttttttaaaacctaaagacgtgcaagcgactgcgaaactactattggctgatgctgataccttaaaaaaatattgtcaaaatcttcagccctattggcttcgtgacgtttagcgtgatcaggcttgttgacgagtatcaatgcagtaattgattgcgttgcttggtcgggctacaccatttcaagtttattatttctgtataaattcagggtaatacacaaaaaaatccccctcaacagactgatgcgcaatctggtgagggggacggtgcaactcgatagagcgttgttgttgcagcttgtcagcgatgtccgggacgactgtgtcgccctacaaggctcaagccacaaactgctccgcgtagtggcaagccacctgacggttatccaacgcacgcaactgcggctcttcgctgctgcaccgcgcggtcgcgtaggggcagcgcttgtggaaagcgcagccaggcggcgggttcagcgggttgggcagctcgccgacgatcttgatcttcggcttgttcgggtccgggtgaatggtcggggtggccgacagcagcgcctgggtgtaggggtgcagcgggcgggcgtagatgtcgtccttgggaccgacttccaccggacgaccgaggtacatcaccatcacgtcatcggcgacgtgttgcaccaccgccaggttgtgggagatgaacacgtaggccgtgttgaattcctgctgcaggtccatgaacaggttgagcacctgagcctggatcgacacgtcgagtgcggaggtcggttcgtccgccaccagcactttgggttgcagcatcatcgcgcgggccagggcaatacgctggcgctgaccaccggagaacatgtgcgggtagcgctgataatgctcagggcgcaggcccacctgcttcatcattgcctgcactttctcgcggcgttcggcggcggacaggttggtgttgatcagcagcggctcgccgagttgatcaccgaccttctggcgcgggttcagcgaggcatacgggctctggaacaccatctgcacgtctttgcgcaattgcttgcgctgggccttgtcggcgccggcgacttcctgaccggcgattttcaaggagcccgaagacggttcttcaatcagcgtcagcgcgcgggccagggtggatttgccgcaacccgattcgccaaccacggcgagggttttgccggcttccagttcgaacgacacaccattaagcgcgcgtaccagcgcatggcccttgaacaggccacgggacacttcgtagtgacgggtgaggtcgcgggcggtaagaacgacggccattacgccacctcctggttcaaggggtagaagcagcgcgcgaggctgttggttttcgggtcaaggccggggcgctgggcacggcaggattcctgcacatacgggcaacgcggcgatagcaggcaaccctgcgggcggtcgtagcgaccgggcacgatgcccggcagcgtggccaggcgggtggcgcccagactgtgctccgggatcgccttgagcagcgcttcgctgtacgggtgcgccgggatgtcgaacaactgcggcacctggccgacttccacggcttgaccggcgtacatcacgcacacgcgctgggcggtttcggctaccacggccaggtcgtgggtgatcagcaccaggcccatgttctgctctttctgcagggccagcagcagttccatgatctgcgcctggatggtcacgtccaaggccgtggtcggttcgtcggcgatcagcagtttcggctcgccggcaatcgccatggcgattgcaacacgctggctcataccaccggacagttggtgcgggtaggcgtccatacggctggcagcgcctgggatttcaactttttcgagcagttcgatcgcacgtttacgcgcttgcttgccggacattttcaggtgcaggcgcagcacttcttcaatctggaagcccacggtgtagctggggttcagcgcggtcatcgggtcctggaacaccatcgccaggtctttgccgacgatttggcggcgctgacggttgctcagcttgagcatgtccttgccgtcgaagttcagcgcgtcggcggtcacgatgccggggtgctcgatcaggcccatcagcgccatcatggtcacggatttacccgagcccgactcgccaacgatggccagtacttcgcctttgtcgacggaaatgtcgaggccatcgaccaccggcacggcggtcttgtcgccgaagcggacgttgagattcttgatttctaacagtgacatgggaatctcctcaggcggcgttcttgagtttcgggtccagcgcgtcgcgcaggccgtcacccatcaagttgattgccagcacgctgagcaaaatggtcaaaccaggcaagctcaccacccaccaggcgcgttcgatgtagtcacgggccgaagccagcatggtgccccactcaggggttggcggttgtacgccaaggcccaggaagcccagggccgcggcatcgagaatcgccgacgagaagctcaaggtggcctgtacgatcagcggcgccatgcagttaggcagcacggtgatgaacatcagacgcggcaggccggcgccggcaaggcgggcggcggtcacgtagtcgcggttcagttcgcccatcaccgccgcgcgggtcaaacgcacataggacggcagggacacgatggcgattgcgatcacggtgttgatcaggccagggccgaggatcgcgacaatggctacagccagcagcaacgacggcagggccagcatgatatccatcagacgcatgatggttgggcccagcacgcgcgggaagaacccggcgaacaagccgagcaggatgcccggaatcagcgacatcaccaccgacgacaaaccgatcagcaaggacaggcgcgagccttggatcaggcgcgagagcaggtcacggccgagttcgtcggtgccgagcaggaattgcatctgcccaccttccagccaggctggcggggtgagcaggaagtcacggtattgctcgctggggttatgcggtgcaacccacggggcgaagatcgcgcagaacacgatcagcaacatgaacagcaggccggcaactgcgcctttgttcttggagaaggcttgccagaattctttgtacggggacggatacagcaggctttgatcgactgctaccgcttgagtaggtgtgctcatggtcatgatctcagcgctggtgacggatgcgtgggttggcgaagccgtagaggatatccaccacgaagttcaccaggatcaccaggcaggcgatcagcaggatgccgttttgcaccaccgggtagtcccgcgcgccaatggcttcgatcagccatttgccgatgccgggccacgagaagatggtttcggtcagtaccgcaccggccagcagggtgccgacttgcaggccgaccacggtgagtaccggaatcagcgcgttacgcaggccgtgtacgaagaccacgcgagccggcgacaggcctttggccttggcggtgcggatgtagtcttcgcgcagtacttcgagcatcgacgaacgggtcatccgcgcaatcaccgccagcgggatggtgccgagcacgatggccggcaggatcaggtggtgcagggcgtcgaagaaggcgtccggctcgtcagccagcagggtgtcgatcagcatgaagccggtgcgcggctcgatgtcgtagagcaggtcgatacgcccggaaaccggggtccagcccaagcttaccgagaagaacatgatcaggatcaggccccaccagaagatcggcatcgaatatcccgcgagggagatgcccatcaccccatggtcgaacagggatcctcgtttcagggccgcgatcaccccggccaacaggcccaggataccggcgaacaacagggcggccatggacagttccagggtcgcggggaagagggcggtgaattcggtccacacgctggtgcgcgtgcgcagggattcgccgaggtcgccgtgggcgagcttgcctacatagtcaaagtattgcgcgtacagcggcttgttaaggccgaggcgttccattgcctgtgcgtgcatctcggggtcgactcgtcgttcgcccatcatgacttcgacggggtcgccggggatcatgcgaatcaacgcaaacgtcagcaacgtgatgccgaaaaacgtggggatcaataaccccaatcggcgggcaataaaactaaacatcttgttgtgtacctcaatcagccggttaggcaggttcggcaccgtcaatgtcgacggtgccgagcgtcttctcttatttacttcacctgggtggtggcgaagttatttgtacccagagggctttgggtaaagccttctacgttcttgcgcattgcggtgaacaatttcgggtaagccatgggaagccatggttgatctttttcgaaaatgtcctgtgcttgttcatagagcgcagcgcgctggccgggttcagcgattgcgcgcgctttgtcgatcaagtcttgaaactctttgttacaccagcgggcgtagttttcgccgtttttcgctgcatcgcaactcaggtttggcgtgaggaagttatccgggtcgccgttatcaccgacccagccggccgaaaccatatcgtgctcgccgttttttgcacgtttgagcatctcgccccattccatcactttgatgttcactttcaggccgatctgcgccagatccgcctgcatgcgctgggcgccgagcatcgggttggggttggtcgggcctccaccgttacgggtgaacagggtgaactcggtgccttccggcacgccggcttccttgagcagggcgcgggccttttcaaggtcacggggcggattcttaagcttgtcactgaaacccagcaaggttggcggataagggcccgtgcccaccacggcattgcctttgccgaacagggcttcggtatagccggccttgtcgaatgcgatattgatcgcgtgacgcacccgtgcatcgctcatgtacttgtgggtggtgttcagtgcggtgtagctggtggtcatcgccgccagttcatcgactttcaggttcgggtctttcttgatgcttggaatgtcatccggcttggggaacaacgcgatctgacattcgttggccttgagcttctgcaggcgcacgttgttatccgtgctgatcgccaggatcagcgggtcgactgccggtttgccgcggaagtagtcggggttggccttgaaccgcgcctgggcgtctttctggtaacggatgaagacgaacgggccagtgccgatcggcttggcgttgaggtcttcggtcttgccggatttgagcaactggtcagcgtattccttcgagtggattgaagagaacgccatgcccaggtcggccaggaacggtgcttcaggacgggtcagggtaaagacgacggtgtgatcgtcggtcttctctacgctcttgagcagttccttgaagcccatgctttcgaaatacgggtagcccacgagggacttgttgtgccaagggtgattcgggtccagctggcgctgaaagctccaaagcacgtcatcggcattcatgttgcgcgtgggtttgaagtagtcggtggtgtggaacttgatgtcgtcacgcaggtggaacgtgtaggtcaacccatcggcgctgatttccggcaggtctttggccagtgcaggcacgacttcggtggtgccgggcttgaagtccaccaggcggttgaacatggtttcggcggcggcgtcagcagtgacggccgtggtgtacaggaccgggtcgaaaccctccgggctggcttcggtgcagaccaccagcggtttggccgaaacgccgatcgcgacgctcaacagcgcagcggcaatggcggcttgtagcgggagcattttcattcagagccctctgcaatcgattgaaccagacgagcgtagacggcgggctcgtgatgagcccgccatctacctggcgctaattaaagaatgttgaacgggatggtggtcaccaggcggaactcacggatgttgccgtcagcctggttggcgctggcgcggtgagtcacgtaggtaccacgaatggtggtggccttgagtgggccgctctgaagggcgtacgacgtgccgatgccgtattcctggtgggtttcgccgtccatcaggcgcaggtcactgcgtgccacgttagcttcgccgtaggcggtgccggtgtagtgagtaccgtcgatgccccagccgcgagccgagtacacgttgaacttcaggcctggcacgccgtattcggccatgttcaggccgtaggcgatctggaaggacttctcgttcggtccgttaaagtcggacgtcagggagttggccaggtagatgccgttggtttcatgcaggtagtcgaagtactcgttaccgttgatggcctggtaggagaaggtcaggctgtgggcttggtgagtcaggcccagagacaacgagtacgtatcgttgtcgattttgcccatcttcttgctaccggtgtcggtggttttgtagtagttcaggccggtggtcagtgccagggtctgagcatcacccaactcgtgggtcgcgccgacgtagtactggttccagaagtcttcgacgttagcggcgaatacgctggttttcaggctcttgaacggctggtagttgaagcccagggttttgaccttgtcggtggtctggccattaccgtattcggagcggaatttcgacaggctctgttcggtccgtggcgaaacacggtcgaagataccgccctggaacgacaggttgctgagttcttcgctgttgaagctcacaccttcaaagctcgacggcagggcacggttgccgatggtgtcgacgatgccgctgctgaagttctggcgaccggcggtcaaggtggtgttcgacacacggaacttcacgttggccaggcccagtttgctccactggcctactgcgtcaccgtcggagtcagccagggtacggttggaaccgcccttgatgtcacgcttgctgcggtccaagaccacggcgttgtaggctgccacttcagttgctacgcctacggtgccttgggtgaagcccgaggagtagttgaggatggtgccttgtacccagttggtacggttcgcgtcggtgcgcgtttgaccgtgcttctcgtaggagaagcgctgaccacggaatttcttctcggtggagtaccagttacgggtagtaccgcccaggctttggccgtcgataaagcctttggcttcgctttgggcgctggtgccggccaaggtggttggaacgaagtcctggctttgggtttcagcgaaggcggttgccgtgatgctgctgatggccaaggccagaagcgctttgctgctcagtttcatgggtggagctcctttggttctctttttaatgccggtctttttaggtgaaccggctattgggtgtgtaactcgttcaagcctttgcaaacgtttgccgtaggaaatttcccaacaaaaggctgcacgtttgccaggaagccgatttggctccctgcaatccggttatatttttatggggtgatactgacgcccgagaacacgttgcggccgaaggggctcactttgaaaccttcgactttggcgcttaacggctggttgaccgtcgagtgggcgactggcgtgatcggcacctgtgctttaagcagttgctgcgcctgtttgtacagaacagtcctttgttcgcggtcggtgacgaccttggcttgcttgatcagcttgtcgtacgccgggtcacaccacatggagtagttgttcccgccgatggcgtcgcagctataaagagtgcccagccagttgtccgggtcaccgttgtcgccggtccagccgatcaggctgatgtcgtgctcaccgttcttggtgcgcttgatgtactcgccccactcgtagctgacgatcttgaccttgaggccgatcttggcccagtcactttgcagcatctcggccatcagcttggcgttggggttgtacggccgttgcaccggcatcgcccacagggtgatctcggtgccttccttcacgccggccgccttgagcaactctttggctttttccgggttgtaggcggcgtccttgatggtgtcgtcgtaggaccactgggtcggcggcatggcgttgactgccagctggccggcgccctggtacacggcattcaggatgctttgcttgttcaccgccatgtccagcgcctggcgcacttcgagctggtcgaagggcttgtggcgcacgttgtaggcgatgtagccgaggttgaagcctggcttggtcagcagttgcaggttcgggtcggccttgagggcgtcgacgtcggccgggcgtgggtgcagggttatctggcactcgccggccttgagtttttgcacccgcaccgaggcgtcggtgttgatggcgaagatcagttggtccagcttgacccggctcgggtcccagtactgtttgttgcccacataacggatctgcgagtctttctggtagcgctggaacacaaacgggccagtgccgatgggcttctggttgatgtcgctgggtttgccttctttaagcagttgctcggcgtattcggccgacagaatcgaggcaaagctcatggcgatgttttgcacgaacgcggcgtcgaccgtgttcagggtgatcaccacggtgtgcgggtcggttttttcgaccttggcaatgttcttgttcaggctcatcccgttgaagtacggaaactcggtggggtaggccttgcgaaacggatggtcggggtcaagcatgcggttgaaggtgaacagcacgtcgtcggcgttgaagtcgcgggtcggcttgaactccttgttgctgtggaatttcaccccttcacgcaggtgaaaggtgtaggtcaggccgtcttcggaaatatcccacttggttgccagcccaggcaccacattggtcgcgcccttttcgaactcaaccagtcggttgtacagcggctcggccgcatcgttgtctgtggcggtggtgtattgcgcggtgtcaaaccctgccgggctgccttcagagcagaacaccaggctcttcttgtcggcggcttggcccatcgtggccacagccagcaggctggtgccaaaaattgcggatagaacggtggtatggcgcatgacgatcccgatccttgtttgtaattgtcatcagcgagcaatcacccaggcttttgcctgggagacatcactgatcccacacgcagcaagtgcctttccgtgattgatgcctctgctgtcctacgacgttatgggtcgcggacctcgcagtaaatgcgccaaaacggattgaccttgtaggtaacggagctgtacgtcgcggctcattgctgtaagacgcaatgagttaggtcgtggtctgtttcctacggtctgggcggatgcaataacggcgacgttgtgaaacgtcgccgttattaatccttacttgccgcttacgctcacgccgtagaaagagttcaagccaaacgggctgatcttgaagtcctgcacggtgttgcgcatgggttgatacaccgtcgagtgcgcgataggtgtcatcgggactgcatctttgaggatatgttgcgcctgcttgtacagctcggtgcgtttggcgacatccgatgtggccttggcttctttcacgatgccatcgaatttcttgtcgcaccatttggagaagttgttaccggccagcgagtcgcagccgaacagcacgttcagccagttgtccgggtcaccattgtcgccgctccagccaatgatcatggcctggttctcgccgcctttggagcgcttgatgtactcgccccactcgtagctgacgatgttgaccttcaggccgatctgtttccagtcgttctgcagcatctcagccatcagcttggcgttcgggttgtacggacgttgaaccggcatcgcccacagggtgatttcggtgccttccttgacgcctgcttccttgagcaaagccttggctttggtcacgtcgtgcggggcatccttgatggtggtgtcgtaggaccattgggtcggcggcatggcgttaacggccagttgaccggcgccttggtacacggagtcgatgatctgctgcttgttcaccgacatgtccagggcttcacgcacccggatgtccgacagcgggttagtcgcggtctggcctttgagtaccggcatgacgttgtaggcgatgtagcccaggttgaaaccggcctggtgcggcagtttcaggtccttgtcttcacccagcgccttgaggtcggccggacgtgggaacagagtgacctggcattcgtttttcttcagcttctggatacgcaccgacgggtcggtggtgatggcgaagatcaggttgtcgatcttcacgtcctcaggcttccagtaatccttgttgccggtgtaacggatgttggagtctttctggtagctcttgaacacgaacgggccagtgccgattggcttctggttgatgtcctgtgccttgccttctttcaacagttgggcggcgtattcagccgactggatcgaggcgaagctcatcgccaggttctggatgaacgctgcgtccacggtgccaagggtgaacttgacggtgtggtcatcgactttctcgatgttcttgatgttggtgtccatccccatgtccgtgaagtacgggaactcggtggggtaggctttgcggaacgggtcgtccttgttgatcatgcggttgaacgtgaacagcacgtcatcggcattgaaggtacgggtcggcttgaagtacgaggtggtgtggaacttgacgccgtcacgcaagtggaaggtgtacgtcaggccatccggggacacgtcccagctggtggccagcccaggaatcacagcggtgccgccgcgttcgaactgggtcagacggttgaacatggtttcggccgaagcatcgaagtctgttccggtggtgtactggcctgggtcaaaaccggccgggctcccttcggagcagaacaccaggttagtcgccgcttgggcgaaaggggctgcggccataaggccagcactaactaaaagcggaatgactgcgtgtttaagcatgttggcctcatgatttgttgtcatttttggtggtgagggcgacctcgtgagtcggcctgcggatacttatgcaggggccatacccattgcaagatgctgaacggttacgaacggaaaactgtggtacgaacgtacaggaatgtcgcatttatgaaagtttgtacataaatgcatatatatagaggtttttttcggtgcatggcgcgcaccaaaaatgcccaaccgagcggtctagcgcactcggttggggcgtagctgttacttatctagactgacaccataaaacggcgtcaggccaaaaggactgatcttgaagtcctttacttcctttcgcaggggctggaaaaccgtcgagtttgcaataggcgttataggtacttgttccttaagtattttctgcgcctgttgataccacttgatgcgctgctcacggtcactgctgaccttcgcctgctggacgagtttgtcgtaggccgggttacaccatttggcgtagttgctgcctttgaccgcggcacaactgtagagcacaccgagccagttatccgggtcgccattgtcgccggtccagccataaatcatcgcgtcatgctcgccatttttggcgcgcttgatgtactcgccccactcatagctgacgatgttggccttgataccgattttttcccaatcctgttggatcatttgcgccgacatccgcgcgttagggttggaagcgcgctgtacggtcatcgcccacaagttgatggtggtacctggtgcaacccctgcttcttttagtagcgcccgagccttggccgggtcgtacggcgcgtccttgatggtggggtcataagaccactgcgccggaggcagggcgttctgcgccaattgcccggcgctttggtacacggccttgataattgccggtttatcgatagccatgtccagcgcctgacgcaccttgagttgatccagcggcgggtgggtcacgttgtaggcgagaaagcccaggttgaagcccgcttgttgcaacacgcgcaggttcggatcctgtttcatcacctcgatatcggccgggcgcgggtaaccgctgacctggcattcgccggccttgagtttctgcaagcgcgaggcggcgtccggggtgatggcgaacaccaggttgtcgagcttcacatcctccggtttccaatactgctgattggccgcgtagcgaatctgcgagtctttctggtaacgcttgaacacaaacggcccggtgcccacgggtttctggttgatctcctcggccttgccttcttttaaaagctgggcggcgtattcggccgattgcaccgaggcgaagctcatcgccaggttctgcacgaacgaggcatcgacgttgttcaggttgaaacgcacggtgtgctcgtcgagtttttcgacgtttttgatcgtggtgttcaaacccatgtcggtgaagtacggcgactcggacgggtaagccttgcgaaacggactgtcggcatccagcaggcggttgaaggtgaacagcacgtcatccgcgttgaagtcgcgggtaggggtgaagtagtcggtggtgtgaaacttgacgccatcgcgcagatggaaggtgtaggtcaggccgtcattggatacatcccagcgcgtcgccaggccgggttcgacttcggtgccgccacgcttgaactgggtcaggcggttgaacacggtttcggcggaggcatcgaagtcggtgccgctggtgtactggctggggtcgaaaccggcggggctggcttcggagcagtagaccagggtgctggccgcttgggccattggcatgaacgccagcaggctcgcggccaggagtagcggtttgaaagcggttctttccatggaaactcctgaagtggcaggcctataaagccgcccaaacgaaaacggcggccaccgaggttaccgccgttcaggtttgtcaggtagcggtcactacatcagtacttcgatcacgccatcggcgctcatgttgacctggctggtgccggcttcgacttcaggcgtcggtgcggaatccgccatggccgctttcatcatcatgccggcaccgcgcgcgtaaggcatcgggtagccattggtgttgaagttcaggttgacgatcttgtaacccttgccgcccagcgcatcggtggccagttgggcgcgggccttgaatgcggtgacggcgtctttgagcaacgcgtcttcgctggacttgcgcgtgctgtcggcgatggcgaagtccatgttttccattttcagcgtgttcagcaggtcgccagtcagcttggacagggccgggaagtcggcactttccaggcgcagctcggcgcgctcacgccagccggtaatcttctggttcttgttgtcgtagatcgggtagctgttacggctgccctggcgcagggttacgcctttgacttcgcgcgcctcgcccagggccttgttcatcgtgttggtgatttcggcggcgagcttggccgggtcggtgttctgcgactcggtgtagagggtgacgatcatcttgtcgcgagccacttcctggctgacttcggcacgcagggaaatctggttgtagtgcagctcatcggcagccatcgccggaaggctggccagggcactggcgctgagggtcagaacggctgcactgcgagtgaaacgagacatggaagctccttggaatgttcgtgttcggtatgactgtagacggtgctatcgggttcttcgggtttacacattcgctacaagttgtggcgatgccgacgaacggttatttgccaggcctgcggcaaagagccacacgcgccgtgccagcaggtcggcttcgtttatactcgtgccgatccgcctgcagcgctcaccgggagagctcatgctcgccgccgtaaaactgacttccgccacccgccagaacctctggcgcctgacgtttatccgcaccctggtactggccgcacaggccggctccgtcgggctcgcgtattggttcgacctgctgccgttgccgtggctgcaactggccgtgaccctctgcttctccatcgtcttgtgtgtgttcacggccattcggctgcgcaccacgtggccggtgaccgagctggaatacgccctgcaactggcctgcgacctgtttatccacagcgtgttgctgtatttctccggtggttccaccaacccattcgtttcgtattacctagtgccactgaccatcgctgccgtgacgttgccatggcgctattcggtggtgctgtcgggtatcgcgctgaccctgtacaccttgctgttggcacagttctacccgttgcagacattccccatcgccagggaaaatctgcagatctacgggatgtggctgagtttcgccctgtctgccgctgtgatcaccttctttgctgcacgcatggccgaagagctgcgccgccaggaagaactgcgcgccattcgccgcgaagaaggcctgcgtgaccagcaattgctcgcggtcgccacccaggctgccggcgccgcccatgaattgggcacgccgctggcgaccatgagcgtgctgcttaatgaaatggtccaggaccatcacgacccggccctgcaagatgacttgagtgtgttgcaggaacaggtcaagcaatgcaagcagaccttgcagcaactggtgcgtgccgccgaagccaatcgccgcctggccgtcgagatgcaggacgtgacccagtggctcgacgaagccctgaaccgctggcacctgatgcgccccgaggccagctaccgcttcaacctgctgggccagggcacggtgccgcgcatggcgccgccgccggacctgacccaagccttgctcaacctgctgaacaacgccgccgacgcttgccccgaaggcctgggcgtgcagttggactgggacgcggaaaacgtgaccatcagcattcgtgaccacggcgcgggcgtgccgctggcgattgccgagcaaatcggcaaacccttctttaccaccaagggcaaaggcttcggcctcggcctgtttttgagcaaggccagcgtgacccgcgcgggcggctcagtgaagctctatagtcatgaggaaggcggcacgctcaccgagctgcgcctgccccgtgtcgcacgaggagatatcgatgagtgacgagatccaagtcgaaggcgaagaactgccgcacctgttgctggtagatgacgacgccacctttacccgcgtgatggctcgcgccatgagtcgccggggtttccgcgtcagcaccgcaggctcggccgaagaaggcctgaccatcgcccaggccgatctgccggactacgccgcgctcgacctgaaaatggacggcgactccggcctggtgctgctgcccaagctgctcgagcttgacccggaaatgcgcgtggtgatcctcaccggttactccagcatcgccaccgccgtcgaggcgatcaagcgcggcgcctgcaactacctgtgcaaaccggcggacgccgacgacgtgctggccgccttgctgtccgagcacgctgacctggacacgctggtaccggaaaacccgatgtcggtggaccgtctgcagtgggaacacatccagcgcgtgctgaccgaacacgaaggtaacatctccgccaccgcccgcgccctgggcatgcaccggcgcaccttgcagcgcaagttgcagaagcgcccggtacggcgctgaacaaagtctgaacaatccgcttcaggccgcacggagccctgaaccgatcgtctatgatcggttcaaacgcctgtcacattttcttacagagcctgaacgatgaatcagaacgctgagtattccgcggtcaacgacgcggtgcgtgggcaattcttccgtcgcacctgggcgctgatcgcgccctattggcgcagtgaagagaagggcaaggcctggttgttgctggccgcggtgattggtttgtcgctgttcagcgtggccttttccgtttggatcaaccattggtacaaggatttctacaacgcccttgagaagaaggacacggcggctttctggcaactgatcggctatttttgcgtgcttgccgccgtggccattgtgggtgcggtctaccgcttgtacctgacgcagatgctgaccattcgctggcgcgcctggctcaccgaaaagtattttgcgcgctggctcagccacaagaactactaccagctggaacagggcggctacaccgataacccggaccagcgcatttccgaagacctcaataacttcacctccacgacgttgagcctcagcctggggctgctgcgtaacgtggtcagcctggtgtcgttctccatcatcctgtggggcgtgtcgggcagcatcgaagtcttcggcatctccatccccggttacatgttctggtgtgcgctgctgtatgccgccgtcggcagttggctgacgcacctgatcggccgacgcttgatcggcttgagcaaccaacaacaacgtttcgaagcggacctgcgtttctccatgattcgggtgcgcgagaatgccgagagcatcgccctgtacaacggcgaatcaaacgaaaaccagcgcttgagcacgcggttcggcagggtctggcacaactactgggacattatgcgagtgtccaagcgcctgacgtttttcaccgccggttacgagcagatcgccatcgtttttgcgtttatcgtggcggcgccgcgctacttcgccggcaaaatcgagctcggcgagctgatgcaaatcaactcggcgttcggcaacgtgcagggcaacttcagttggtttatcaccgcttactccgacctggccagctggcgcgccaccagtgatcgtctgctgagtttccatcaagccatgagcgaaaacgagcagcgtgcgccagccattgatgtgcgcccggaaggcgagcgtttggtggtgagtgacttgggcatggacctggccgacggtcgtcacttgctcaccgatgccgacatgaccgtagagccgggccagcgtgtgatgctcagcgggcgttccggcagtggcaaaagtacgctgctgcgggcgatggggcacttgtggccggcgggtcatggcagcattcgtttgccggcggcgcgttacctgttcctgccgcaaaagccttatttgccgattggtacgttgaaggcggtgttgagttatccacaggatgacagcgtttacccggcagaacgttatgcacaggtcctggaaacctgccgcttgccgcatctggtcgcgcgtctggatgaagccaaccactggcaacgcttgctctcgccgggtgagcagcagcgcctggcgtttgcccgtgcgttgttgttcgcgccgcaatggctgtacatggacgaagccacctcggcgatggatgaagaggatgaggcgacgttgtatcaggcgttgatcgatgagttgccggggttgagcatcgtcagcgtcggccaccgcagcagcctcaagcgctttcatgggcggcatgtgcggattgagggtgggcggttgcaggaacagcagccgtcctaaggttacacgcagtcggtgtgggagctggcttgcctgcgatgcgagcacctcggtgtatcagtgagatacagtcgatgccatcgcaggcaagccagctcccacagaggatcttcaccagtcaagttattttcaagcactaaaaagcccggctgatcatcgatcagccgggctttttagtgcttgaaaataacttacttcttcaagccgtaatgctcatccagcatgcctggggcgtttggcgtttttggcgcgtagtcccgtggtggctcctggttttcccgcggcggggtcaagcgttcccgcggagcttgcggcgcatcggaatgcagcgcagccagcagacgctgacgggtgatgtcgtcgagggccaggcggttggcgccatcggcgaggtgatcctgtacttcctggtagctctgggtgagcttcttgaccagggtcgcggtgctgttgaagtgggtaacaacctcgttctgataactgtcaaaacgttcctgaatgtcatccagctgacgctgcgtgcggttaggcgcggcattcggcagcaggcgggcaaccaggaatccaatggcgacaccggcaaccaaggcgagagtcggcaacaaccaaactaagagcgagtgttccacgagtccttcctctataaacggctttgctttacgttaacggctcggacctgcgctgtataccgcgattaagctcgcaatcatgccaagcacagacttttagctagacgagtcgaccctttgagaggtcacggagttcattccttgctcatgcgtgaaacccccgttttgatcgatggcccggttggccaattggaagccctgtaccttgatcaccccgagccacgtggcctggcgctgatctgccacccgaacccggtgcagggcgggaccatgcttaataaagtcgtatcgaccctgcaacgcaccgcccgcgatgccggtttgattactttacgttttaactaccgtggcgtcggtgccagcgccggtactcacgacatggccaccggtgaagtggacgatgccgaagcggccgccacctggctgcgggaaaaacaccccgagttgccaatcactctgctcgggttttcattcggcggttacgtggccgccagcctcggtgggcgcctggaagccaagggcgaacagcttgcgcacctgttcatggtcgctgccgccgtgatgcgcctgcgcgataccgacgcgctgccccaaggctgcccattgaccctgatccagccggaaaccgacgaggtggtcgacccgcaagtggtctacgactggtctgcggccctcaaacgcccccatgagctgctgaaagtggcagaatgcggacacttttttcatggcaagctgaccgatctcaaggatctggtgctgccgcgcctctcgaattgatagcagtctgataagcgattacccatgacgactcgtacccgtatcctcaccggcatcaccaccaccggcacgccgcacctgggcaactacgccggcgcgatccgtccggcgatcctcgccagccaggacgcgaatgccgactccttctacttcctggccgactaccacgccctgatcaagtgcgatgacccgcagcgcatccagcgctcgcgcatggaaatcgccgcgacctggctggccggtggcctggatgtgaaccgagtgaccttctaccgccagtcggacatcccggaaatccccgagctgacctggctgctgacctgcgttgctgccaagggcctgcttaaccgcgcccacgcctacaaggcctcggtggacaagaacgtcgaaaccggcgaagacccggacgcgggtattaccatgggcttgtacagctacccggtgctgatggccgcggacatcctgatgttcaacgcgcacaaggtgccggtcggccgcgaccagatccagcacgtggaaatggcccgcgacattggccagcgtttcaaccatctgttcggcaacggtaaagaattcttcaccatgcccgaggcgttgatcgaagaaagcgtcgccaccttgccgggcctggatggccgcaagatgtcgaaaagctacgacaacaccatcccgttgttcaccagcgccaaggacatgaaggacgcgatctcgcggatcgttaccgactcccgcgcccctggcgaagccaaagacccggacaattcgcacctgttcaccctgttccaggcgtttgccagcaaggctcaggaagcagagttccgcgccgaattgctgcaaggcctgggttggggcgaggcgaagagccgtctgttccaactgctggacggccagttgggtgaggcgcgcgagcgttatcaccaactgatgtcgcgcccatccgacatggaagacttgctgctgatcggcgccaagaaagcccgtgcggtcgccgcgccgttcctggccgagctgcgtgaggctgttggcctgcgctcgttcgtcaaccaggccgccgcgccggtggctgccaagaagaaagccgccaaagctgcacgctttgtgagcttccgtgaagacgacggcagcttccgcttccgcctgctgtcggctgaaggcgagcaactgctgctgtcgcgcaactttgccgacggcaaagcggcgggcgcggtgaccaagcaactgcaaaacggtgacgcgctggatgtacgccctgaggctctgagcttcagcgtatggctggatggcgctgtggtagctgacagtgccgcgttcgccgacgaaacgtcgcgcgatgccgccatcggcgctctgcgcgtggcgttgacgccaatcgaggattaacccgaccaagggttgattgccattatccagggccgtcgttacagtggcggcccgtttttgttgccttgctaacgaaattatgacgcccctagaacgatatcaagctgatctgaaacgccctgaattcttccatgacgccgcccaggaaaacgccgtgcgtcatttgcagcgcctgtacgacgacctgatcgcggcctcgcacaacaagccagggatgttcagcaagctgtttggcaagaaagaccacacaccggtcaaaggcctgtacttctggggtggcgtgggccggggcaagacttacctggtcgacaccttcttcgaagcgctgccgttcaaggaaaaggtccgtacgcacttccaccgcttcatgaagcgcgtgcacgaagaaatgaagaccctgccgggcgagaaaaacccgctgaccatcattgccaagcgcttctccgaagaagcgcgggtgatctgcttcgatgaattcttcgtttccgacatcaccgacgccatgatcctcggcaccttgatggaagagctgttcaagaacggcgtgaccctggtcgccacctcgaacatcgtgcccgacggcctgtacaaggacggcctgcagcgcgcacgcttcctgcccgccatcgcgctgatcaagcagaacaccgagatcgtcaacgtcgacagcggcgtcgactaccgcctgcgtcaccttgagcaagccgagctgttccacttcccgctgaacgaagcggcgcatgaaagcctgaaaaagagcttccgcgcgctcacgccggaatgcacaaaggcggtggaaaacgacaagctgatgatcgagaaccgcgaaatcatcgcgctgcgcacgtgcgatgacgtggcttggttcgagttccgccaactgtgcgacggcccgcgcagccagaatgactacatcgaactgggcaagatcttccacgcggtgatcttgagcggtgtggagcagatgagcgtcaccaccgacgacatcgcgcggcgtttcatcaacatggtcgacgagttctacgaccgtaacgtgaagctgatcatctcggcggaagtcgaactgaaagacctctacaccggcggtcgcttgaacttcgaattccagcgtacgctgagccgcttgctggaaatgcagtcccacgagttcctgtcgcgcgggcataagccgtaagtgaagtgatcgaactgtaaaaggcccgcagtcattacgggtcttttatagggttggcgcaggttaaaaagtgatctggtcgtcgcgcggcggcggcggtgtcacggggatcgtgaggccgtctggggtaatcaaattaactgcgccgtctggctcgatctggagtttggcctccttcggttgatcctttgcacccttttttttcttgttcttctcttcgtcgttctgatcgttctgcagcgactcagcctgattcgcgtctggtttatcggcgctggatgtctggttcaactgaacagccgggttgaacgagctgcttgatatggatgacatgattgaatctccgctctggtttaagccaaatgaatttagaaaaagcctttcgcgagtctgaattcaatccgacagaaatagccgacttcttctagcgcttaacatgccagccgcattgggcgcaggggattcgtcttcgtcctgtactgctgtaggaaatggaggccttgcttgaggtgtaggtagggctcaacgggtttttagttcgaccctgcaccattgcggtatggcagggtcgcttgcatcgtcaggcggcggatctatgcggcttgctgaaattgctgccggtactggttcggcgacaactccgtgtgttgcctgaacaaccgcgcaaagaagctcgcatcgtcataacccacctcataactgatggtcttgatgctcttgcggctgcccgaaagcaagcccttggcggtctcgatgcgcaggcgttgcaggtaatgcagcggcttgtcgccggtggcggtctggaagcgtcgcatgaagttgcgaatgctcatgccgtgctcccgcgcgacgtcttcaaagcggaacttgtcggcaaaatgctcttcgagccagtgctggatctgcaggatgatcacgtcctggtgcagcttctgcccgccaaaaccgatgcgccccggcgcgtagctgcgctgcacttcgtaaagaatgtcgcgggccacagcctgggcgatgttggcgccgcagaaacgttcgatcaaatagatgtagaggtcgcaggccgaggttgtgccgccggcgcaatacaggttgtcggcgtcggtcaggtgcttgtcctggttgagctgcaccttggggaagcgttcgctgaaggccgtgaagaatcgccaataggtggtcgcctccttgccatccagcaagcccgcttcggccaaccagaacacgccggtggcttcgccgcagagcaccgcgccacgcgcatgttgggcgcgcaaccagggcagcacttgcgggtagcgtgtgcacagcgcgtcgaagtcgtcccagaaggccggcagcacgatgatgtcggcgtcttcgaggccgccgtccaccggcatgatcacatcactgaagctgcgcaccgattgcccgtcggggctgaccaggcgtgtttcaaacgctggggtcaggcccaggccttgttgtttgccataccgcaggctggcgagatggaagaaatccttggcttgcatgagggttgaagcgaatacccgatcaatggccaaaatgctgacgcgccgcaacggcgtggagatttggttagacataatttcatttattcttataggggaaagtggtcaccagacggctggatcgtcttattttttgtcgcatgtgtccagtgtcctgtgacgccttcgcggcataggctctggggtctggcttttgtccgacaatccacgcaggtgacccatgatccccagaaccttgttcagctcggagcacgaactcttccgcgagagcgtgcgcaccttcctcgaaaaacacgccgcgccgttccatgcgcaatgggagaaacagggctatatcgaccgtgggctgtggagcaaggcgggggaggcgggcatgttgtgttcgcatctgccggaggaatatggcggcctgggcgcggactttttgtacagcgcggtggtgatcgaagagatcagccgcttggggcttaccggcatcggtttctcgctgcattcggacatcgtcgcgccgtacatcctgcattacggcagtgaagcgctgaaacagaagtacctgcccaaattgatttcgggcgaaatggtcaccgccatcgccatgaccgaaccgggcgccggctccgatttgcagggcgtcaagaccacggcggtactggacggcgatgagtacgtgatcaacggctccaagaccttcatcaccaatggctttctcgccgagctggtgatcgtggtggccaagaccgaccccaaggccggcgcgaagggcaccagcctgtttttggtggaggcggatacgccgggcttcgataagggcaagcgcctggagaaggtcggcatgaaggcccaggacacctcggagctgttcttccaggacgtgcgcgtgcccaaggacaacctgctgggccaggcgggcatgggcttcgcgtatttgatgcaggagttgccgcaggagcgtttgaccgtggcgattggtgcgctctcatcggctgaagcggcattggcctggacgttggaatacacccgcgagcgcaaggcgttcggcaaggcgattgccgacttccagaacacccggttcaagctggcggagatggcgaccgagattcagattggtcgcgtgttcgtcgataaatgcatggcgttgcacctggaaggcaagctcgacgtgcctaccgcggcgatggccaagtactgggccacggacctgcaatgcaaggtgctcgatgagtgcgtgcagttgcacggcggctacggcttcatgtgggaatacccgattgcacgggcttgggcggatgctcgagtgcagcgaatttatgcggggaccaatgagatcatgaaggagattattgcgcgggcgctctgattttgtggtgtggctgagggccccatagcaggcaagccagctcccacatttgacggtgttcgcagttcaaaatgtgggagccgggcttgcccgcgatggcggtctacagatcaatcaaggcgctggattcggatgatccttctgaatcgcctcaatcccttccaacacttctttcgacagtttcaggtcagcgctggcaatgttgctgtccagctgctccagtgtcgtggcaccaataatgttgctggtcacaaacggctgttgcgtcacgaacgccagcgccatctgcgccgggtccaggccgtgctcgcgcgccagtgccacataacggctgcaggcggcttccgactgcgggttgaagtagcggctgaagcggctgtattcggtcaggcgtgcttttgctgggcgtgcgccgttctcgtacttgccgctgagcatgccgaatgccagcggcgaataggccagcagaccgcattgctcacgaatcgcaacttccgccaggcccacttcaaagctgcggttaagcaggttgtaggggttctggatcgacaccgcgcggggccagccacgggcttcggccagggccaggaacttcatggtgccccacggggtttcgttggacaggccgatgtggcggatcttgccggccttcacctgttcgtccagcgcttcgagggtttcttccagcggggtcaggtcgtcttcgtccttgtgcttgtagctcaactggccgaagaagttggtgctgcgctccggccagtgcaactggtagaggtcgatccagtcggtctgcaggcgtttgaggctggcatccagggcttcgacgatgtgcttgcggttgtggcgcaggtgaccatcacggatgtaatcgatggtgttgccggggccggcgatcttgctggcgacgatccagtcggcacggtcgccgcggcttttgaagtaattaccgatgtaacgctcggtggtggcataggtgtctgccttgggcggcaccgggtacatttcggcggtgtcgaggaagttgatccccgcggccttggcccgttcgatctgcgcgaaggcctctgcctcgctgttctgctcaccccaggtcatggtgcccaaggctatcgcgcttacgttcagatcggttcggcccagctgtcgataatccatcgggtactccttcggggaaaacaatcataaaagcaggttgaattttttttcgcaatctgcataattgcccacctctttctgcagtggaagtgatgcgccgcctgccgaagaatcttgccgttgaacggacgcgccgacccgagcccccgatagcgtctgtatccggctgcctttgacttgtcaaagtacgcactattcagtaagatccgccgtctaatttacagggcggcccctgaggctattaaagaatgacaacttttactgcaaaaccggaaacagttcagcgcgactggtttgtcgtcgacgccgctggtcagaccctgggtcgtctggccactgaagtcgccagccgtctgcgtggcaagcacaagcctgagtacacccctcacgttgacaccggtgactacatcgtgatcatcaacgctgagcaggtacgtgttaccggcaacaaagcgcaagacaaaatgtactaccgtcactccggtttcccaggcggtatcaagtcttcgaactttgaaggcctgatttccaagaagcctgaagccccgatcgaaatcgcggtcaaaggcatgctgccgaagggcccactgggtcgcgatatgtttcgcaagctgaaagtctatgcgggcgctgtacaccctcatgctgctcagcagccccaagaactgaagttttaacggaatagttcattatgtcggcgactcaaaattacggcactggccgtcgcaaaaccgcaaccgcacgcgttttcctgcgtccgggcactggtaacatctcgatcaacaaccgcactctggacaacttcttcggtcgcgaaactgcccgcatggtagttcgtcagccgctggaactgaccgagaccgttgaaaagttcgacatctacgtcaccgttatcggtggcggtgtaagtggtcaagctggcgcaatccgccacggtatcactcgcgctctgatgcagtacgacgaaaccctgcgtggcgctctgcgcaaagctggcttcgttactcgcgatgctcgtgaagttgaacgtaagaaagtcggtctgcgtaaagcgcgtaagcgtccgcagtactcgaagcgttaattcgctttacgttccacaaaaacgcccaactcctcacggagctgggcgttttttattgcctgcgatttatgcacatttttcgccgtgacaacttgccacatccgtagaccccctatactacaaggcctggaggggcagtcccgggcaattcccttgtcatacgtggggcttttcattaccatccgacaaaatttttataagtaaagattcaacacttagtagacgcctgatttaacaggccaaaaagctgatgggagaggactgaatgagcaatgacggcgtgaatgcaggccggcgtcgcttcttggtagcagccacatccgtggtgggtgctgcaggagcggtgggggctgcggtcccgttcgtggggtcatggtttcccagtgccaaggcgaaagccgcaggtgcaccggtgaaggtgaatgtcagcaagatcgacccaggccagcagatgattgctgagtggcgcggtcagccggtcttcatcgttcgtcgtactgaggaaatcctggggaatctgaagaaaatcgaaggtcagctgtctgatcccgattcgaagaattccgaacaacccgcctacgtcgataaggaaatccgttcgatcaagccagagatcctgctgctgatcggtatctgcacccacttgggttgctcgcctactttccgccctgaagttgctcctgccgacctgggcaaagactgggtcgggggttacttctgcccctgccacggctcccattacgacctggctggtcgcgtctacaagtcacaacccgcaccactgaacctgccagttccgccacatcactacgagactgacagtgtcattgtcattggcgtcgacgagggggagaaagcctgatgagcaagttcatggattgggtggatgcgcgtttccccgctaccaagatgtgggaagaccatctcagcaaatattacgcaccaaaaaacttcaacttcttctacttcttcggctcactggcactgttggtgctggtcaaccaactggtcacgggtgtgtggctgacgatgagttacacgccgtcagccgaagaggccttcgcttccgttgaggggatcatgcgcgacgtcgagtacggctcgattctgcgcttgctgcactccaccggtgcctcggcgttcttcatcgtggtctacatgcacatgttccgtggcttgctctacggttcgtaccagaaaccccgcgagctggtgtgggtgttcggcatgctgatctacctggcgctgatggcggaggccttcatgggctacctgctgccgtggggccagatgtcgtactggggcgcccaggtgatcatctcgctgttcggcgcaatcccggtcatcggcaacgacctgacccagtggattcgtggcgactacctgatctccggcatcaccctgaaccgcttcttcgccctgcacgtcgtggcgctgccgatcgtgattctgggcctggtggtgctgcacatcctggcgctgcacgaagtgggttcgaacaacccggatggcgtcgacatcaagaagcacaaagatgaaaacggcataccgctggacggcattccgttccacccgtactacaccgtgaaagacattgtcggcgtggtggtattcctgtttatcttctgctcgatcgtgttctttttcccggagatgggcgggtatttcctcgagaagcctaacttcgaacaggccaacgccttcaagacacctgaacacattgcaccggtctggtacttcacgccgttctacgcgatcttgcgggcgattccggacaagctcatgggcgttgttgccatgggggcgtcgattgcgctgctgttcgtgctgccgtggcttgaccgcagcccggtcaagtcgatgcgctacaagggatggttgagccggatctggctggtcgtgttctgcatcgcgttcatgctgctgggctggaccggcgtcaaggcaccgacgcctgcgctgacagtgctgtcgcaggtctgcaccttcctgtacttcgcctacttcattctgatgccgttctacacccggctcgagaagaccaaaccggttccggaaagggtgactggctgatgaaaaaattatttgttgcattgatgcttgcggcgctgccgctactgtccttcgccgccgagcatggcgcagagctggagagcgtcgacatcgacgtgtctgacaaggccgccatgcaggatggcgcgcgtacgttcgccaactactgcatgggctgtcacagcgccaagttccagcgttatgagcgtgtcgccgatgacctgggaataccccacgaactcatgatggagaaactggtgttcacgggcgccaagatcggcgaccacatgaacatcggcatgcagcctgccgacgccaaggcctggttcggtgctgcaccgcctgacctgaccctggtggcgcgcgtgcgcggcaccgattggctgtatggctacctcaaatccttctacgaggacccggcgcgcccttggggtgtgaacaataaagtcttcccgaacgtcggcatgcctaacgttctggtcggcctgcagggtcgccaagtggtaggatgcaagcaggttcaggtcgttgaagacggcaagaagcaatatgatccgttgaccggcacgcctttgactcatgaagcgtgcgatcaactgaccatcgtgcccaagaccggtacgctgaatgaagagcagttcgacgagaaggtcaagaatctggtgaccttcctggcctactcggccaacccggtcaaattgcaacatcagcgcatcggcacctatgtattgctgtacctggctttcttcttcgtgttcgcctatctgcttaaacgcgaatactggaaggatgtgcattgatccaaccgtaagcaattgctgttaatcttgcgcgcccagcggcatctctgaacatgtagcggtctggttgaaccaggcactacagagatgctctctgggcgcgctcgtttttgagctttcgataatttcaacaagcgaggaggaccgccatgggcgtgaccaatcggttggcctgttactccgaccccgccgaccactattcccaccgagtacgcatcgtgctcgcagagaagggtgtcagcgccgagatcatcagtgtggaggtggggcgtcatccaccaaaactgatcgaagtgaacccttacggcagcttgcccaccctggtcgatcgtgacctggcgttgtgggagtcaaccgtggtgatggaatacctggatgagcgttaccctcatccgcctttgctgccggtgtacccggtggcgcgtgccaacagccgcctgctgatccatcggatccagcgtgactggtgcgggctggtggatgtgattctggattcacgtacaaaagaagccgttcgagtgcaggcacgcaaggaattgcgtgagagcctgaccggtgtttcgccgctgttcgccgacaaaccttttttcctcagcgaggaacaaagtttggtggattgctgcctattacccatactctggcgcttgccgattctcggtattgaactgccgcggccggccaagccgttgcttgattacatggagcgccagtttgcgcgtgaggctttccaggcgagtctgtctggtgtcgaacgcgatatgcgctaaggcttaaggagccgctgatgaactccagtcgaccctatttggtccgcgcgctctatgagtggattgtggacaacgattgcaccccgcacatgctggtcaactctgaatttccgaaagttgacgtaccgcagggttttgccagtgatgggcaaattgtgctgaacgtatcgccgagtgccgtgcgccacctgcacatggacaacgaagcggtgagctttgaagggcgttttggcggcgtgccgcatacgctgttcgtgccgattggcgcgattctcgggatctatgcccgtgagaatggccaaggcatggtgttcgatctggagtcgcctttcgaggacgacgaatcgatcgaaggcgaagacggtgatgatgtgccaccacccgattccgagccaccgcgtccaagcggtcggccaagcttgaaagtggtgaagtaagcggctttcaccctcgggtgagccggaaaaatgcctcgacatgtgtcggggcatttttttgcgcgaaggatgtggatgaaagtcgcgacagaacggtgatcgtacaaccgccatgggctatgatgcgggctcaagttcgccgagaaagatggttcatcatggaaaacgccaacaccgcacctcgtcttccccgcaagcgccgcagccttgcccaggaattggtcacggtgttgtccgagcagatccgcgacggccaactcaagcgtggcgataagttgcccaccgagtcggccatcatggaagcccatggcgtcagccgcaccgtggtgcgtgaagccatctcgcgcttacaggcggcggggcaggtggaaacccgccacggtatcggcacctttgtgctggacacgccaagccccagcggtttccgcattgacccggccacggtggtgacattgcgtgatgtgctggcgattctggaactgcgtatcagcctggaagtggagtcggcaggccttgccgcgttgcgtcgcagcgacgagcaactggccgccatgcgtgccgccctcgacgccctgaatgaaagcgcggcgcacgccggcgatgcagtggcctcagacttcgcgttccacctggaaattgcgctgtccaccggcaaccgctacttcaccgacatcatgacccacctgggcaccagcatcattccgcgtactcgcttgaattcggcgcgcctggcccatgacgaccagcagcactacatgggccgactgagccgcgaacacgaagagatttatgaggcgattgcccgccaggattcggatgcggcgcgggcagccatgcgcttgcatttaaccaacagccgcgagcggctgcgccatgcccatgaagaggcagaagcgcagcgcgtttaaccgggcaaccgagttgtgccgggtgtaaattgatccaagtgtgggagcgggcttgctcgcgaatgcggtgtgtcagtctgcacatgcatcaactgaaagaacgccttcgcgagcaagcccgctcccacatttgatctccttggccttgaggtttgcgtctattcagttcgccggctggttaggcttgtaagactgaagcagcaagtaagtactccacccccaccaatcattggtccagtgtttgtcgttgaggtcatttacgtccttgcgacgcagcaccttgtctccctccatcttgaacagcggcgagaagttgttcgccgggttctgcgcggcattcaggtccggcacgtacagcggcgccttgaagttggccggggagggcgcgacaccgctgataaaggtctcgaagatctcatcagccgaggcctgcaccgcgcgtttgaccattgcccgattgtccgcgtcgatggcgtcgaagtagcgtttatccccataggcatgccattgatcacccttggcattgcgcaccttgagcccgaacttgctgtcttcatcgtgcatgaagcggctgatcagcgagcccagttcgcccggcgtcaccaccgccgccagttgtttacgcggtacgcgcagatggccggcggaaaacaggtcggtcaaaaagtgatcagcaaagctgttcattgcataggccagttccagtgcctggtcggtgccggtttgatgggccacgactgcttgttgcaacgccgccgtatgcccggccaggtaggccgacagcgcccattcgccgaagtggtcggcgttgtccgcagccagcttcaaatagcgccccagcggaatcaaggctgaaacagcactgccaccgccggtgatgcggttccattcttcagacaacgtatcgcccagcgcgtcataggcttcatggggttgtttgccgtccttgatcgcctgcttgaccgcgttgatctccttttgcatcaccgcgaggatcttcccggcttcttcccgcgaggcgggcagcactgccagcgaattgaacgcggcgccaaagcgttgcacgcgctcggcaggcgaggcgccatcgctgatgggttggccagggatgccatagaagtcaccgcccaaggcgatcacttggccgtaggtgagcgccagcccgttgggcaggtgcagctcgacttggtgggcgggaatcgccggggcatctttgacgaaacgcaacagcgtttcatcgccgatagccgtgtgttcgccgccttcgaaacgcagagtcggtgggtttttttcgggtgctgcgagttcaagacctgacatgttagctccttgctatgtcgtaggaatcttccttaataactgtatgtatatacagttatctggagcatagaggaataatttcctacgtcaagaagtcaggtttaaacgctcggccgcggatgaagcccgatgaattgcagttgacgaatctttttatagttgtacgatgacgtacgacatcaccaaaaccaacaacaacctttcgacagaaagtcttcgcccagggtgttcgaataatgaatccacaagaactgaagtccatcctctcccacggtctgctgtctttccccgtgaccgatttcaacgcgcagggtgacttccaccaggcgggttacatcaagcgtctggaatggctggccccgtacggcgccactgccttgttcgccgccggcggcaccggtgagtttttctccctggccgccagcgaatactcccaagtggtgaagaccgctgttgatacctgcgccaccagcgtgccaatcctcgccggtgtcggtggttcgacgcgccaggccatcgagtacgcccaggaagccgaacgcctgggtgccaaaggcctgctgttgctgccgcattacctgaccgaagccagccaggacggcgttgccgcccacgtggaagcggtgtgcaagtcggtcaagatcggcgtggtggtctacaaccgcaacgtctgccgcctgaccgcgccactgctggaacgcctggccgaacgctgcccgaacctgatcggctacaaagacggcctgggagacatcgagttgatggtgtcgatccgccgtcgcctgggtgaccgtttcagctacctcggcggcctgccgactgcagaggtttacgctgctgcctacaaggccctgggcgtgccggtgtactcctcggcggtgttcaacttcatcccgaaaaccgcgatggacttctaccacgcgattgcccaggacgatcacgccaccgtcggcaagatcatcgacaacttcttcctgccttacctcgacatccgtaaccgcaaagccggttatgccgtgagcatcgtcaaggccggtgcaaaaatcgccggctacgacgcaggcccggtccgcacgccgctgactgatctgctgccggaagaatacgaagccctggccgcgctgatcgacaagcaaggtccgcagtaactcatcaacaaggccgctgagagatcagcggccttttgcgtcaggagaagatttgtgtcccaagccaaacgttttgagaactacatcaacggcgagtgggtggccggtgccgactactgcaacaatatcaacccgtcggagttgtccgatgtcatcggcgaatacgccaaggctgacgtagcccaagtcaacgccgccatcgacgccgcccgcgctgctttcccagcctggtcgacctccggcatccaggctcgtcacgatgccctggataaagtcggcagtgaaatcctcgcgcgccgcgaagaactcggcaccctgctggcccgggaagagggcaagaccctgcccgaagccatcggcgaagtgacccgcgccggtaacattttcaagttcttcgccggtgaatgcctgcgcttgtccggtgactacgtgccgtcggtgcgcccgggcgtcaatgttgaagtcacccgcgaagccctgggtgtggtcggcttgatcacgccgtggaacttcccgattgcgatccctgcctggaaaatcgccccggccctggcctacggcaactgcgtggtgatcaaaccggccgaattggtgccaggttgcgcctgggccctggccgaaatcatctcccgcgccggcttccctgccggtgtgttcaacctggtgatgggcagcggccgtgtggtcggcgacgtgttggtcaacagcccgaaagtcgacggcatcagctttaccggctcggtcggcgttggtcgtcagatcgccgtcagctgcgtgtcgcgccaggccaaagtgcagttggaaatgggcggcaagaacccgcagatcattctcgacgacgccgacctcaagcaggctgtcgagctgtcggtacagagcgcgttctactccaccggccagcgttgcaccgcctccagccgcctgatcgtcaccgccggtattcacgaccagttcgtcgcggccatggccgagcgcatgaagtcgatcaaagtcggccacgcgctgaaaagcggcaccgacattggcccggtggtttcccaggcgcagctggatcaggacctgaaatacatcgacatcggccaaagcgaaggcgcgcggctggtcagcggtggcggcctggtcacctgtgacaccgaaggttactacctggcgccaacgctgtttgccgacagcgaagccgccatgcgcatcagccgtgaagaaatcttcggcccagtggccaacgtggtgcgcgtagcggactacgaggcggcgctggccatggccaacgacaccgagttcggcctctcggcgggtattgccaccacctcgctgaagtacgccaaccatttcaaacgccactcccaggccgggatggtgatggtcaacctgccgaccgccggtgtggattatcacgtgccgttcggtgggcgtaagggctcgtcttatggttcgcgtgagcaaggtcgctacgcgcaagagttctacaccgtggtgaaaaccagctacatcgggtcgtaacacgtaacacccgtgggaactggcttgtgtgggagctggcttgcctgcgatagcggtacatcagtcacagagaggttgactgatacaccgctatcgcaggcaagccagctcccacagcaagcggctcctgcacttaaaacagaaatgcttacccgcaaaaaaaataattagtgggagtacatcttcatgcaagcgaccaagccgacccacgtccgctatttgatcctgctcatgctgtttctggtgaccacgatcaactacgccgaccgggctactatcgctatcgccggctccagcctgcaaaaagacctcggcatcagcgcggtcaccctcggttatatcttctccgcattcggttgggcctacgtggccgggcaaatccccggcggctggctgctggaccggttcggctcgaaaaaagtctatgccctgagcatcttcacctggtcgctgttcaccatcctgcaaggctatgtcggcgagtttggtgtctccactgccatcgtcgcgctgtttatgctgcgctttctggtgggcttggccgaagcgccgtcgttccccggtaatgcgcgcatcgtggccggctggttccccaccgccgaacgcggtacggcctcggcgatcttcaactcggcgcaatacttcgccacggtgctgttcgcgccgctgatgggctggatcgtctacaccttcggctggcagcatgtgtttatcgtgatgggtggtattggcgtactgttctcgctgatctggctgaaaattatccacagcccgcgccagcacccgatgatcaacgacgccgaactcaagtacatctccgagaacggtgcgatggtcgacatggaccaggaaaaagccaagggccagaaaaccgacggacccaagtgggattacatccgccaactgctgaccaaccgcatgatgctcggcgtgtacctgggccagtactgcatcaatggcatcacctatttcttcctgacctggttcccggtgtacctggtgcaggaacgcggcatgaccattctcaaggctggcttcattgcgtcgctgccggcgatctgcgggtttatcggcggcgtattgggcgggttgatttccgattacctgctgcgcaagggccactcgctgaccttcgcgcgcaaggcgccgatcattggcggcttgctggtgtcgtgcagcatcgtcgcgtgcaattacgtggatatcgaatggatggtggtgggcttcatggccttggccttcttcggtaaaggcgttggcgcactgggttgggcggtggtgtccgacacttcgccgaaacaaatcgccgggctcagtggcggcctgttcaatatgtttggcaacctggcgtccatcagcacgccgattgtgattggctacatcatcgccaccaccggctcgttcaagtgggccttggtgtttgtcggcgccaacgcgctgctggcggtgttcagctacctggtgatcgttggcccgatcaagcgtgtggtgctcaaagagccgcccagcaaagggcccgagctgacccaatttacccaagcgcattcctgaggggcgatgtaatgcagttgattgaacatgccgactcgccgcgctcgatccgtttgcacgagcgcgacaacgtggtgatcgtggtcaacgaccagggcgtaccggccgggaccgagttcccggacggcctggtgaccgtggatttcatcccgcaaagccataaggtgaccctggaagacatccccgaaggcggtcagattattcgctacggccagaccatcggttacgccctggcgccgattccacgtggcagttgggtgcaggaagaccaactgcgcatgcccaccgcgccgccgttggacagcctgccgctgtccaccgaagtgcctgaaacccaggcgccgctggaaggctttaccttcgagggttatcgcaacgccgacggcaccgtgggcacgcgcaatatcctcggcatcaccaccacggtgcagtgcgtcaccggcgtgctggaccatgcggtcaagcgcatcaaggacgagttgctgcccaagtatccacatgtcgatgacgtggtggcgctgacccacagctacggctgcggcgtggcgatcaccgcgacggatgcttacatcccgatccgcaccgtgcgcaacctggcgcgcaacccgaacctgggcggcgaagcgctggtgatcagcctgggctgcgagaagctgcaggccgggcaggtgatgcacgacaacgacagctccgtcgacctgagcgagccgtggctgtatcggctgcaggattccagccatggctttaccgagatgatcgagcagatcatggctctggccgaggtgcgcttgaagaaactcgaccagcgccgccgcgaaaccgtgccggcgtcggagctgatcctgggcatgcagtgcggcggcagtgatgcgttttccggcatcaccgccaacccggcgctcggctatgcctcggacctgctgctgcgggctggggcaacggtgatgttttccgaagtcactgaagtgcgtgacgccatttacctgctgacttcccgtgccgagagcaaagaagttgcccaggccctggtcagggaaatggactggtatgaccgctacctggccaaaggcgaggcggaccgtagcgcgaacaccacgccgggcaacaagaaaggcgggttgtcgaatatcgtcgagaagtccctgggctcgatcgtcaaatccggcagcagcgcgatcaacggcgtgctcggcccgggcgagcgcttcaaaggcaaaggcctgatcttttgcgcgacgccggccagtgactttgtctgcggcaccttgcagctggcggccgggatgaacctgcacgtgttcaccaccgggcgtggcacgccttatgggttggcgatggcgccggtggtgaaggtctcgacgcgtacggaattggcgcaacgctggccggacctgatcgatatcgatgccggacgcatcgccaccgggcgtgcgagcattgaggaattgggctgggagttgttccatttctacctggacgtggccagcggcaagaaacagacgtgggcggagcggcataagctgcataacgacatcaccctgttcaacccggcaccgatcacctgaaaccgcgtcgaacccagtgggagctggcttgcctgcgatagcggagtgtcagcaaccaatgtgctgactgacacactgcaatcgcaggcaagccagctcccatattttgatttgtgaacacagtcaaatgtgggcgcgggcttgctcgcgaaggcggcctaccagacgccacagggccgcatggcttatcattagccacctgacgacacccacccaaggttctccccggcatgctggctatcttcctcaccaccctcaccatcaccgcgccggtgtttgccatgctgtttctcggtgtgctgctcaagcgcatcaactggatcaacgacaactttatccacaccgcctcgtccctggtgttcaacgtcaccatgccggcgctgctgtttctcggcatcctgcatgccgacctgcacgcggcgctcaagccgggtttgctgatttactttgccgtcgccacgctgctgagctttgccctggcctggggctgggcgattttccgctgcccacccgaagaccgtggcatctacacccagggcgcgtttcgcggcaataacggcgtgatcggcctggcgctggcggccagcatgtacggcgactacggcatttccctcggcgcgattctcgccgccctggtgatcctgttctacaacaccctgtcgaccatcgtgctggcggtgtacagcccggtgatcaagtccgacccgtggagcatcttcaaaagtgtggtggccaacccgctgatcatcagcgtgattgcggcggcgccgttcgcgattttcaagatcggcctgccgggctggctggagtcgtccgggcagtacctggcggacatgaccttgccgctggcgttgatctgtatcggtggcaccttgtcgttggcggccttgcgcaaaagcgggagcatggcgttgagtgccagcctggtgaagatggtcggcctgccggtgttcgcgacgctgggcgcgtggttgctgggtttccgtgggccggaactggggattctgtttttgtacttcggcgcaccgacggcggcggcgagttttgtcatggcgcgggcggccgagggcaatcatgaactggcggcggcgattattgtgatcactaccttgatggcggcggtgaccactaatatcgggattttcgtgctgcaggcgggtggttggatctgagttttgcggtgtgtttgagggccaatcgcaggcaagccagctcccacatttgaaggtattcacagttcaaaatgtgggagctggcttgcctgcgatagctatctacaagtcactgccgatctgcctgatacgcctcaatcacttcctgcgccgcccgaaacgcatcaatcgccgccggcacgcctgcgtacaccgcgcaatgcagcagcgcctcgcgaatctcctccaccgtgcacccgttgttcagggcgccacgcacgtggcccttgagttcctgcgggcacttgagcgcagtgagggcggcgagggtgatcaggctgcgcgtcttcagcggcaggccttcacggttccacacgctgccccatgcgtgttcgttgacgaaatcctgcagcggctgggtgaactcggtggcattacccaaggcgcggtcgacaaacacatcgcccatcacctggcgacgcatttcaaccccgggctttttctgatcggtcattgcgattccctcttgtgttggcggcgccaggcttgcagcgagctgaacaacaggaacgccaccagcgccggcaggacgtaatacagcatcaattgttcaagtttggtcgccagcggcatgccaaaggtgaacgacaccacatgcagcccatacaccaggtacaggcccaggaacaccaggccttcggcgcgggtgacacggtagccggtataaaacaccggcaggcacagcacaatcacgccgagcatcaccggcaaatcaaaatccagcgcattgggcgacacggacagcggcgacggcgccacgagggcggtaaacccgagcaccccaagcaggttgaacaggttgctgccgatcacgttgcccacggcaatctcgcgctcgccgcgcagcgcggcaatcagtgacgtcgccaagcacggcagcgaggtgccgacacccatcagcgtgaggccgatgatgcgctcggacaagcccaagtcgctcgccacgtccactgccgcgcccagcagcaaatgcccggccagcaccaggatcaacagcccgctcagcatcagcgatgcgctgctcagccaaggcgccctggccacggtgtccagtgtgcgcgggcggcgggagtggcgggtctggtagtgcaaaacacccaggtaggccgccagtgcaatcagcaggaacaggccatcgagcggggtcagttcttcgttggcggccagggtaaacaccagcaggccggcacaaatcatcaccgggatatccaggcgcaccaactgccgggacactcgcaatgggatgatcagcgcggcgaggcccagagtgaccagcgtgttgaagatactgctgccgatcacgctgcccacggcgatatcggtattaccggccagggtggcctgcaggctcacggtcatctgtggcgcgctgctgccgaaggcgacgatgctcaggccgatgatcagtggccgcaccttgaggctggccgccaggcgcacggcggcgcgcaccaggatttcagcgccgacgatcagcaacaccaggccgctgaccagttcgatcaggctccaggacgagagggcggttagtgcggaaatggccaaggctcccttggttagttgctcatggcttgcacgcgaacccgtgcagtgccgctgcccagcataccgagttgttcggcggccctgcgtgaaacgtcgatcaggcgcccacgggtatgtgggccgcgatcattgatgcgcagtaccacggatctgttgttgtcgaggttggttaccttgacctgcgtgccgaagggcaggcgccgatgggcggcggtcagggcattctggttgaagggttcaccgctggcggttttgttgccatggtgcttggcgccgtaatacgaggcggtgccggtttcgtcgtagccgttggggtcgatgaggccgctggcacaaccggccaacagagagaacagggccagcaggccgagtagacgcttcattatcaaggatgcccccgtatcaaatgcaggccccggctcatgtgggagcaggcttgcctgcgatggcatcaccgcggtcgatttgaaggaccgaggtgcctgcatcgcgggcaagcccggctcccacataggccggttcctgctctcacagtgttgcgaatcagccttcgagcttgctctttagcagttcgttcacttgttgcgggttggccttgcctttggacgctttcattgcctgcccgacgaagaagccgaacatcttgccgcgcttggcttcatcggcggcgcggtattgttcgacctgttcggcgttggccgccagcatttcatcgagtacggccgaaatcgcgccgctgtcggtgacttgcttgaggccgcgcttctcgatgatgtcgtcggcattgccttcaccgctggccatggcttcaaacacggtcttggcgattttgccggagatggtgttgtccttgatgcgcagcagcatgccgcccagttgctcggcggtgactggggcttcgtcgatttccaggccctgtttgttcaacaggctgcccagctcaaccatcacccagttggccgccaacttggcgtcgccggcaatgctcacgactttttcgaagtagttggcttgctcacggctggaagccagcacgctggcatcgtagaccgacaggccgaactgcgcctggaagcgctcgcgtttctgctgcggcaattccggcagggtggcgcggatgtcattgaggaacgaatcttcaaggacgaccggcaacaggtccgggtcggggaagtaacggtagtcgttggcttcctctttgctgcgcatggcgcgggtttcgtctttgttcgggtcgtacaggcgcgtttgctggatcaccttgccgccgtcttcgatcagctcgatctggcgacgcacttcgctgttgatcgccttttcgataaagcggaacgagttgacgttcttgatctcgcagcgggtgccgaactcgacctggccttttggacggatcgacacgttgcagtcgcaacgcagcgaaccttcggccatgttgccgtcgcaaatgcccaggtaacgcaccagcgcgtggatcgtcttgacgtaggccacggcttccttggcgctgcgcatgtccggctcggacacgatttccagcaacggcgtgccggcacggttcaggtcgatgccggtagcgcccgggaattcttcgtgcaggctcttgccggcgtcttcttccaggtgcgcgcgggtcacgccgacacgtttgatggtgccgtcttccagcgggatgtccaggtagcccttgccgacaatcggcagttccatctggctgatctggtagcccttgggcaggtccgggtagaagtagttcttgcgcgcgaatacgttgtgctggccgatctcggcgtcaatcgccaggccgaacatcaccgccatgcgcaccgcttcctggttcagcactggcagtacgccgggcatgcccaggtctaccaggctggcctgggtattcggctcggagccgaaggtggtggcgctaccggagaaaatcttcgattgggtggcgagctgggtatgaatctccagcccgatcacaacttcccattgcatagtgttctcctcagaagccggtaggggtgcgcgtgtgccagtcggtgttcaactggtactggtgcgccacattgagcaggcggccttcctggaaatacggggcgagcaattgcacgccgaccggcaggccatcgacgaaaccggcgggcatggacaagcccggcaagcccgcgaggttggcggtgatggtgtacaggtcttccaggtactcggcgatcgggtcgccggtcttggcgccgagcttccaggccgggttcggcgtggttgggccgaggatcacgtcgacttcttcgaaggcggccatgaagtcgtttttcaccagacgacggattttttgcgccttgaggtagtacgcgtcgtaatagccagccgacagggcgtaggcaccgaccatgatccggcgttgtacttcggcaccgaagccttcgccgcgggagcgtttgtacaggtcggtgaggtctttcgggttttcacagcgatagccgaagcgcacgccgtcgaaacgcgacaggttggaagaggcttctgccggcgcgatcacgtagtacgcaggaatcgcgtgctgattgttcggcaggctgatttccttgatcacggcgccgagcttttccagctccttgacgctgttgtgcacgagttcagcgatacgcgggtcgaggccggcgctgaaatactctttcggcacgccgatgcgcaggcctttgatcgaggtattgaggctggcgctgtagtccggcaccggctcatcgatgctggtggagtcctgtgtgtcgaacccggccataccttgtaacaaaatcgcgcagtcttcagcagtgcgcgccagagggccgccctgatccaggctggacgcataggcgatcatgccccaacgggaaacgcgaccgtaggtcggcttcaagccggtgaggttggtgaaggctgctggctggcggatcgagccaccggtgtcggtggctgtagcggcgggcaggaagcgcgcggcaacggcggccgccgaaccgccggacgaaccgccgggcacgtgttccaggttccacgggttttttaccgcgccgtagtagctggattcgttggccgaacccatggcgaactcgtccatgttggtcttgcccagggtcacggccccggcggcggccagcttggagaccacggtggcgtcgtacggcgccttgaagttgtcgagcatcttcgagccgcagctggtgcgaatgccctgggtgcagaacaagtctttgtgggcgatgggtgcgcccagcagtgcgccattctcaccgttggcgcgacgaacgtcggcggccttggcctggctcagggccagctcttcggtgaggctgatgaagctgttgaccttggggtcgtgctcggcaatgcgcgcaagcagggtcttggtcagctcttcggaagaaaactttttgtcggcgagaccgcgggcgatctcggccagagtcatgtgatgcatgaaaggctctttccctttagtcgatgactttcggaaccaggtacaggccgttttcgaccgctggcgcgatggactggtaagcctcgcgattatttcgctcggtcacaacgtctgcgcgcaggcgctggctggcttccagcgggtgagccaggggctcgatgccgtcggtattgacggcctgcatttggtcaaccagcccgagaatgctgttcagggctgcggtggtctgtggaagatcggcttcattcaggccaagcgaggccagatgagcgattttttccacgtcggagcgttcaagcgccatgggattctccagtggaaaacagaacggagggcgtccgtgtgttagattgtcggaacactaccgcatttctacggtcatatggccgcgattgtgggggttggtgcacagaaagtcggccaatttagcacattggcgccttgcccaaaatccctgtcgttgttagagtttgccgcacttttttacccacgcgttgcctagggtcctttccccatgttcaagaaactgcgtggcatgttttccagcgatctttccattgacctgggcactgccaacacccttatttacgtgcgcgagcgcggaatcgttctgaatgagccatcggttgtggccattcggacccatggtaatcagaaaagtgtcgttgccgttggcaccgaggccaagcgcatgctcggccgaacaccaggcaatattgctgccattcgtccgatgaaagacggcgtgatcgccgacttcagtgtctgcgagaagatgctgcagtatttcatcaacaaggttcacgaaaacagtttcctgcagcccagccctcgtgtgctgatctgcgttccgtgcaagtccacccaggttgagcgtcgtgccatccgtgaatcggcccttggcgccggtgcacgtgaagtgttcctgatcgaagagccaatggctgctgcgatcggtgccggcctgccggttgaagaagcacgcggttcgatggtggtggatatcggtggtggtactaccgaaatcgccctgatttccctgaacggtgtggtgtatgccgaatccgtacgcgttggcggcgaccgcttcgacgaagcgatcatcacctatgtgcgccgtaactacggcagcctgatcggcgaatccaccgccgagcgcatcaagcaggaaatcggcaccgcctacccaggcggcgaagtgcgcgaagttgatgttcgcggtcgcaacctggccgaaggcgttccacgtgccttcaccctgaactccaatgaagtgctggaggctctgcaagagtccctggccaccatcgttcaggccgtgaaaagcgccctggagcaatcgcctccggaactggcttccgatatcgccgagcgtggcctggtgctgaccggtggtggcgccttgctgcgtgacctcgacaagctgctggcccaggaaaccggtctgccggtgatcgtcgccgaagacccgctgacctgcgtcgcccgtggcggtggccgtgcactggaaatgatggataaacacaccatggacctgctctccagcgaataagattgcttggatggttcatgcttcgtccgcaggcagcactttgcagtgctgcctgttggcgtttatcttcttcaatctgcatccaggccggtttgatgccgtatgaataaagagaacatttgcctgggaggagcggcttattaaaccgcttttcgccaaaggcccctcattgggcgtgcgcttattggtgctggtcgtgctttcggtcgcgctgatggtggtcgatgcccgctttgcactgctcaagcccgtgcgtagccagatgtcgctggtgttgatgcagacctactggatcaccgacctgccgcaacgtctctaccagggcgtggccagccaattcggcagccgcactgagctggtcgccgagaacgaaaaactcaagactgaaaacctgctattgcaggggcgcatgcaaaagctggcggccctcaccgagcagaacgttcggctgcgcgagttgctcaattcttccgcactggtcaacgagaaggtcgaagtggccgagttgatcggcatggacccgaatccgtttacccatcgcatcatcatcaacaagggtgagcgcgacggtgtggtccttggccagccggtgctcgatgcccgtggcctgatgggccaggtggtcgagttgatgccctacacctcgcgggtattgctgctgacggacaccacccacagcatcccggtgcaggtgaatcgcaacggcttgcgcgcgattgccagcggcaccggtaacccggagcgccttgagttgcgccatgttgccgataccgccgacatcaaggaaggcgacctgttggtcagttccggtctgggccagcgcttcccggcgggttacccggtggcgacggtgaaggaagtgatccacgattccggccagccgttcgccatcgtgcgtgcagtgccgacggctgccttgaaccgtagccgttacttgctgctggtgttcagcgacaaccgcacccccgaagagcgtgccaatgacgccgcccaggcgcaggaagcggaagacaagcagaacggcgccgtaacaaccattcctgccacggtgccgaaaccggctttcgtcgggccgcccgcaccgtcggcaaccccagcagcgcccgttgcgacgcctgtcaaacctgctgctcacagcacgcgtgcggccaaaccaccggcgtctacacctgctgccaccgcgccagcggctaaaccgcctgctgccacgccggcaacccggccagcagccacggccccggcaaccacgcggcagagggaggaataatggccggtactcattcgcgaaatggctggatcgtctggctgacgttcgccatcggtttgctgctcagcgtttcgccgctgccgcaattcatggaaatcctgcgtcctttatggctggccttgctgctggctttctggtcgctgaccttgccgcataaagtcgggatggtcaccgcgatgtgcctgggcttggcggaagatgtgctctatggcaccttgctgggccagaacgcgttgatcctcaccctgatcaccttcctggtgctgtcgttgcaacaacgcttgcgcatgttcccgatgtggcagcagtgcctggtgatcctggtgattttcggcctggcgcagttggtgcaactgtggctcagcgccttgaccggtaaccgccagccgaccctggcgttggtgctgccggcgctggtcagtgcgttgctgtggccatgggtcagtttcggtctgcgtggattacgtcgtcgctataaaatcaattgaatggattgcgaggctctgcctggttatcgaaccctacagggagagtctggaatgaattcgctttatctggcctcgggctccccaaggcggcgtgaactgctgacccagatcggtgtgcccttcaccgtggtcagcgccgctattgatgaaactcctcttacaaacgaacctgctgtggcctacgtcgagcgccttgcgcgcggcaaggctacggcgggttttgctgcgcttgaacacagcgcgggcatctgcgtgctgggtgctgacacggccgtgatcgttgatgggaaaatcctcggcaagccagtggatcaggccgacgccctggcgatgttgatggccttggccgggcgtgagcacgaggtgctgaccgccattgccgtcaccgatggttcgcgctgcgaaacacgctgtgtaagcagtcgcgtacggtttcgcggtatttctgtcgaggaggctacaacctactggcacagtggcgaacctcaggacaaggcaggcggctatgctatccaggggcttggttcggtgtttgtcgccgggctcaatggcagctattccgccgtggtaggcctgccggtgtgcgaaaccgcgcaactgctcgaccaattcggcataccctgttggcaaaaccttaccgcgcgctgaacgccttacttgcgcgccaagccttaagcgatcggtcactattgtgaaaacgcctgaacgagacccagccatgagtgaagagattctgatcaatatcacgccgatggaatcgcgcgtggcggtggtagagaacggtgttctgcaagaagtgcacgtcgagcgcacccagaagcgcggcattgtcggcaatatctataaaggcaaagtggtacgcgtgttgcccgggatgcaggctgctttcgtcgatatcggcctggaccgcgcggcgtttatccatgcctcggaaatctccttgcgcgaaggcccggcggtcgaaagcatcagtgcgctggtgcatgaaggccagagcctggtggtgcaagtcaccaaggaccctatcggctcaaaaggcgcgcggctgacgactcagctgtcgattccttcgcgttacctggtgtacatgccgcgcaccgcccacgtcggcatttccttgaagatcgaagatgaagccgagcgcgagcgcctgaaaaaggtggtcagcgactgcgtggctgccgaaggcatcaaggaagcgggtggctttatcctgcgcaccgccgcagaaggcgccggtgccgatgaaatcctcatggacatccgctacctgcggcgtttgtgggaccagatcggcgcgcagatcaaaaccatcggcgcaccaagcgtcatctatgaagacctcggcctggccctgcgcaccctgcgcgatctggtcagcccgaagatcgagaagattcgcatcgactcgcgggaaactttccagcgcaccacgcaatttgtcgccgaattgatgccggaaattgccgaccgcctggagcactaccctggcgaacggccgattttcgacttgtatggcgttgaagacgagatccagaaagctctggagcgcaaggtgccgctcaagtccggcggctatctggtggtcgacccggcggaagccatgaccaccatcgacgtcaataccggcgcgttcgttggccaccgcaacctcgaagagactatcttcaagaccaatctcgaggcggccaccgctattgcccgtcagatgcgcctgcgcaacatgggcggcatcatcatcattgacttcatcgacatggaagacgaagaacatcagcgccaggtgctgcgcacgctcgagaagcagctggaacgcgatcacgccaagaccaatatcatcggcatcaccgagcttggcctggtgcagatgacccgcaagcgtacccgcgaaagccttgagcaagtgctctgcgagccttgcagcagttgccagggacgcggcaagttgaagaccccggaaacggtttgctacgagattttccgcgaaatcttacgggaggcacgcgcctatcaagccgaaggttatagagtgctcgccaaccagaaagtggttgatcggttgctggatgaggagtccggtaacgtcgctgaactggaggtttttatcgggcgcacgattcgcttccaggtcgaaaccatgtattcccaggaacaatacgacgtggtgctgctctgatccccaatcgctttctttcttcgagaccggcagaccttgatctgccgtccgctaactgccttgagggtcgcctgacatggagcgtctgaaacgcttttttgccgctttgacccgttggggcctgggctcgtgcgccttgctgctggtgttggcagcggtgtacgtgagcctgggtcgtgaattgaccccactggtggctgaataccgcgccgaaatcgaagccaaggcccaggccgcggtggatatgcccgtgcacatcggcagcctggaagggcgttggagcggcttcgcgccggtgctgctggcccacgacgtgatggtcggcgagggcagcagtgccttgcgccttgaccaggttgaagtggtgccggatctgtgggccagcctgatggcgcgcgaagtgcgcattgcccacctggaagtcagtggcctgcaattgagcgtcaaggaagacaaggatggccgttgggcgctgcaaggcttgccggtgcaggatgaccagccgctcgacccggagcaattgctcacgcgtatgcaaatggtcaagcgtgtgtcgctgctcgacagccaagtcaccttgcaacccttcgaccagtcgccgctgaccctgacttacgtaggcctgagcctgcacaccggcgccacccgccaacgcctcgatgcccgcctgaccttgcctgatggccagcctcttgccctgagcctgcgcagccgaattcgcgccagccaatggaaagacggccaagtcgaagcctacctgagcctgccccaaagcgattgggcaaaatggattccggccaagctgacccagcagtggaagctcacccaattcaaagcgggtggcgagttctggctgacctgggcaaagggcactgtgcaaagcgcagcggtacgcctcaattcacctcaggtgaagggcagctacgccgagcgcaagccggtgcatattgaaaaccttgccctgacagcttacctgcaacgcagcgatacaggcctcaaggtgctgtttgattcgctggcgatgaacatcggtgagacgcgctgggagtcacgcctgcaattgcagcagagcctggctaccgacaaggacctggaagtctggaagctgcaggctgatcgcctcgacctgacgcccatcacgccgctgctgaatgccttggcacccttgcctgaaggctttgccaaaaccatagaacacctcaaagccaccgggttgctgcgcaatgtgctggtggatttccgcccccaggacaccagcgaccagaaggtcagctttgccgcaaacctggagcgcattggctttgatgcatattttggcgcaccggccgcgcggaacgtgtccggcagcatcagcggcgacctgggccacggcgaactgcgcatggacagcaaggacttttccttgcacctgttcccgatcttcgccaagccttggcagtacatccaggccaacgcgcgcctgacgtggaagctggataaggaaggcttcaccctgatcgctccgtacatcaaagtgctgggcgaggagggcaaggttgctgcggacttcctgattcgtctgcattttgaccacagccaggaagactacatggacctgcgggtcggcatggtcgatggcgatggccgtttcacgcccaagtacctgccagcggtgttgagcccgtcactggatgaatggctgcgcacggcgattctcaagggcgcggttgaccagggtttcttccagtaccaaggctcgctgaaccacgatgcactgccggctgcacgcaatatcagcctgttcttcaaggtgcatgacgctgaactggcattccagccgggctggccccatgtgagcaaggtcaatggcgaagtgttcgtcgaggagagcggcgtacgcatcctggcaagcaagggccagttgctcgacactaaggtcaaggacgtctacgtcaacattcctcacgcaccggccggtaaggacagtcacctgctgatcaccggtgggtttgccggtggtttgggcgatggcttgaaaatcctccaggatgcgccgataggcaccggctcgacttttgccgggtggaaaggcgagggtgacctgcaaggctcgctggacctggacattccattggccaagggcgctgagccgaagattgtggtggacttccagaccgacaagtcccgcctgcaattggccgagccgaccctggacctgactcagctcaaaggtaatttccgcttcgacagtgccaagggcttgagtggccagaatatctcggcgcaagcgtttgaccgaccgatcaccgcgcaaatctttgctgatggcaagccgggcaatatcagtacgcgcgttaccgccaagggccaagtcacggttaaacgcctgacggactggttaaaaatcagccagccaatgccggtgtccggcgatattccctatcaactgcaactgaccctggatggcgccgatagccagctgatggtcagctccagcatgaagggcgtagcggtcgatttgccggcaccgtttggcatgcctgccagccagggtcgcgacagcgtgttccgcatgactttgcagggccccgagcgccgctactggttcgactacggcgagctggcgagctttacctttgcctcgccacccgacaaattcaatgacggccgcggggagttgttcctgggggatggagacgccgtgctgccagcggccaaaggcctgcgcattcgcggtgtgttgtctgagctggacatcgacccttggaaaaaactggtaaaccgctacgccggcaatgatccaggcggcagtgccaagcaactgctcagtggcgcagatttcaaggtcggcaagctgaccggttttggcacgcagtttgatcaggtcaatctgcaactggatcgcaaaccggctgcctggggtttgcagttcgacagccagcaggccaaaggcgctgtgaacctgccggatgccaagggggcacctattgcgatcaacttgcagtacgtgaagttgccggcggtggacccgacggcgcaggcggatgagaatgcgccggacccattggctgatattgatccaaaagacatccctgcactggatatcgccatcaatcagttgttccaggggccggacctggtgggggcctggtcgctgaagatccggccaaccgccaaagggctggccttcaacagcctggacctgggcctcaaaggcatgcaacttaagggtgccggtggctgggaaggtgcgccgggcgccagcagcagttggtacaaaggccgcctggatggcaagaacatcgccgatgtactcaagggctggggctttgcgccaacggtgaccagcgaggacttccacctcgacgtggacggtcgctggccgggttcgccggcctgggttgggcccaagcgtttctccggcagcctggatgctgcgttccgcaaaggccagttcgttgaggttgaaggtggtgcccaggccctgcgggtgtttggtttgctgaacttcaactctattgggcgccgtttgcgactggacttctcggacttgttgggcaaaggcttgagttatgaccgggtcaaaggtttgctggccgccagtaatggcgtgttcgtgacccgtgagcccatcaccatgactgggccatccactaaccttgagctaaatggcacgttggacctggtcgctgaccgggtcgatgccaagctgctggttacattgccggtgaccaataacctgccgattgccgcgttgatcgtgggggcgccggccattggtggcgcgctgttcctgatcgacaagttgatcggtgaccgtgtgtcgcgcttcgccagcgtgcaatacaaggtgcaaggcccttggaaggatccaaaaatcaccttcgacaagccatttgaaaaaccaaactgagagcctgtggagtagcatggccgcatgccctttacggagtgtcggcctatgtcctttgcggtaattcaaatggtcagccagagcgatgtcctggccaacctggcccaggcccggcgcttgctggagcaagcggcggcaggcggtgcgaagctggcagtgctgccggaaaacttcgccgccatgggccgccgtgacgtagccgctatcggtcgcgccgaagcattaggcgaaggcccgatcctgccatggttgaaacagaccgcccgcgacctcaccttatggatagtggccggcacattgccgttgccgcccaaggaccaacccaacgccaaatccaacgcctgctcgctgctgatcgacgatcagggcgaaatagttgcccgttacgacaagctgcacctgttcgatgtcgacgtggcggatgctcgaggtcgttatcgtgaatccgacgactatgctttcggtggcaatgtggtggtggcggacacgccggtggggcgtttgggcttgtcggtgtgctacgacttgcgcttccccgagctgtacagcgagttgcgcgcggcgggggctgaattgattaccgcgccctcggcctttacagcggtaaccggtgctgcgcattgggatgtactgattcgtgcgcgtgccatcgaaacccagtgctatctgctggcggccgctcaaggcggcgtacatccaggcccgcgtgaaacctacggccacgcggcgattgtcgacccttgggggcgcgtgctgacacaacaggatcaaggcgaagcggtgttactggccgaacgcgacagcagtgaacaggcgtcgatacgggcgcgcatgccggtggtcaaccatcggcgctttttctcgcagggcgcgcagcggcctgcctcggaacgatgaatttaaggccaaacctatgagcgagttgttgtcctcagtcagtgaacatctcctggcacccggtggcgtgaccatcgaaagtttgcaaaccgtgctcggcgatctggccgggccaggcatcgacgcagccgacctgtatttccaggggcagatttccgagtcctgggccctggaagacggcatcgtcaaggaaggcagcttcaaccttgaccaaggtgtgggcgtgcgcgcgcaatccggtgaaaagaccggttttgcctacagcaacgcaatcacccctgaagccctgggcctggcggcgcgtgcggcgcgctcgatttcccgcgccggccagaacggtacggtgcaggcgttcagcactcaggacgtggcgcagttgtatgcgccggacaatccccttgaagtgatcagccgcgcggaaaaagttgatttgctcaagcgtatcgacgccgctacccgcgcgctcgacccgcgcatccagcaagtcacggtgagcatggccggcgtttgggaacgcattctggtggcgtccactgacggtggcctggcagcggatgtgcggccgctggtgcggtttaacgtcagtgtgatcgtcgagcagaacggtcgccgcgagcgcggtggccatggcggcggcgggcgtaccgactaccgttatttcctcgctgaagaccgcgccatgggttacgcccgtgaagcgctgcgccaggcgctggtcaacctggaggccattccggcgccggcgggtacgctgccggtggtattgggctcgggttggtccggggttctgctccacgaagcggtgggccatggccttgaaggcgacttcaaccgcaagggcagttccgcctacagcgggcgcatgggcgaaatggtcgcgtccaagctgtgcaccattgtcgatgacggcaccctggccggtcgccgaggctcgctgagcgtcgacgacgaaggcacgcccaccgagtgcaccacgctgattgaaaacggcgtgctcaagggctacatgcaagacaagctcaacgctcgcctgatgggcgtggcgcgcaccggtaacggccgtcgcgagtcctacgcgcatctgccgatgcctcgcatgaccaacacctacatgctcggcggcgaaagcgacccggcagaaatcatcgcctcggtaaaacgcgggatctactgcgccaacctcggcggcggccaggtggatatcaccagcggcaagtttgtgttctccaccagcgaggcgtacctgatcgaagacggcaagattaccgcgccggtcaaaggcgcgacgttgattggtaacgggccggaagccatgagcaaggtgtcgatggtcggtaacgacctgtcgctggacagcggcgtcggcacgtgcggcaaggatgggcagtcggtgccagtgggtgtcggccagccaaccttgaaaattgatgcgatcaccgtgggtggcacggggtcgtaagggccggagcttcgggtggcgaaggtcgccacccggggaagaggatcagcgcagaccgcgttgagtctcgtccagctcacggatgtacttgaagattttacggctggtggccggcgccttgttatgcgcctgctcgtgctgagcctgacggatcagggagcgcagttgctggcggtcagcatccgggtagtccagcacgaatttctccagcaccgcgtcatcgcccgagatcaggcggtcacgccaacgttccaggttatggaaacgttcgttgtactggcgagtggaggcatcggtttgatcaagcaacgccagaatcgcgtcagtgtcctgatcgcgcatcagcttgccgataaacatgatgtgccgtttacgcgcgatattcgcggtgtgcttgggtgcatccgcaagcgcccggcgcatttcgtcggtcagtggcagttttgcaatcaagtctttcttgagcgttgtaaggcgctcgccgaggtcaaccagagcatgcagctcacgtttgacctgggttttgcttttctccccatcgagggagtcgtcgtaagaatcaaccatggtggcagtccgcaaagaaacgccgccatgataaccagtcgggggccgcttgtccggcccggtcgctcgatggccttaaccgaaagcagaatttgagtggagaaaaccatgagtgcagcccaaagcgtcggtccgcaagcgttaccggcactgcaggaacaagtcgagcagatccttgccgaggccaagcgccagggggccagtgcctgtgaagtggcggtgtcgctggagcaggggctgtcgacgtcggtacgccagcgggaagtggaaaccgttgagttcaaccgcgaccagggtttcggtatcaccttgtattcggggcagcgcaagggctcggccagcacgtcggccagcgggccggaggcgattcgcgaaactgtcgccgcggctttggcaattgccaaacacacctctgaagacgaaagctcgggtctcgccgacaaagcgttgatggcgaaggacttgaaggatttcgatctgtttcacgcctgggacatcacgcctgaacaggcgatcgaattggcgctgacctgcgaagcggcggcctttgatgccgacccccgtatcaaaaatgctgacggcaccacgttgaacacgcatcagggctgccgtgtatacggcaacagccatggttttattgggggttatgcctccactcggcacagcctgagctgcgtaatgatcgccgaagccaatggccagatgcagcgtgattactggtacgacgtgagtcgccagggcgaattgctggcggacccggtcagcattggccagcgcgcggcgcagcgtgcggcgagccgtctgggcgcgcgcccggtgccgacctgtgaagtgccggtgctgttttcggccgaactcgcaggtggcctgttcggcagcttcctgggcgccatctcgggtggcaacctgtaccgcaagtcctcattccttgagggtgcaatcggccagaagctgtttcctgagtggttgaccattgatgagcgtccgcacctgatgcgcgcaatgggcagtgcggcgttcgacggtgatggcctggcgacctatgccaaaccgttcgtcgagaagggcgagttggtgtcctatgtcctgggtacttacgccggtcgcaaactcggcctgccaagcaccgccaacgccggtggcgtgcacaacctgttcgtgacccatggcgacgaggaccaggctgcgctgttgcgtcgtatgggcagaggcttgctggtcaccgagttgatgggcagtggcctgaatatggtgaccggtgattactcacgtggcgcggcgggtttctgggtggaaaacggtgagattcagttcgccgttcaggaagtgaccattgctggcaacatgcgcgatatgttcaaacaaatcgtcgcggtgggtaatgacttggaactgcgcagcaacattcgtacggggtcggtactgatcgagcggatgactgtcgccggtagttaaaacaccaccacgctccactaaaaaggcgcgccatcctacagatggcgcgttttttttatgcctgtgtctcaggtggattcatgtgccacccttgttttgattctcaatatcatttaataataaatatcattaccgagtgagtgtggatcatgagttctgtcctgcatgaggatccgtacctggaaagctggcgttggatgagtcgtcagattcgctgcggcctcgatcccaatgaacctcgcctgatcgaacattacctcaacgagggtcgatacctggcgtgctgcaccgcgacgcatccatggacgattgccgaaacatccttccgcctgttgatcgacactgccggtgatatcgccttgccctggcattggcgatccacgtgtctcgaccaagcgtggcgcccgctgcgcgacctggaaaacctctctcactgtgcctgccgcctcaagcgctggcagacctttgcctggcaattggcaacttgcgaattgctgccttccatttctgtttctgacctggtgcaaggatcctccgatgagtaacacccgtatcgaacgcgacagcatgggcgaactgcaagtgccggccgaggccttgtatggcgcgcaaacccagcgcgcggtgaataattttccgatcagcaaccaacgcatgccgacgcaatttattcgcgcgctgatcctggccaaggccgccgccgccaaggtcaatgttgacctcaagcagatcagcgaaagccaaggcaaggccatcgtcgatgccgcccaaggcttgctggaaggcgatttcatgccgcacttcccggtggatatcttccagaccggttccggcaccagctccaacatgaacgccaacgaagtgattgcgaccctggccacacggctgttgggcgaggcggtcaaccccaacgaccatgtcaattgtggccaaagcagcaacgacatcattccgaccacgatccacgtcagcgccgcattggtgctgcacgagcaaacgctgccggccctgctgcatctggtccaggtaatcgaacacaaggccgaagaagttcacccgtacatcaagaccggccgcactcacctgatggacgccatgccggtgcgcatgagccaggtgctcaatggttgggcgcaacagctcaaggccaatatcggccacttgcaagacctgctgccgagcttgcaggccctggcccagggcggtacggcggtcggcacggggatcaacgcgcaccctgaattcgcggcacgtttcagccaacaactgagcagcctcactggcgtgaagttcacgccgggcaaaaacctgttcgcattgatcggctcccaggacaccgccgtcgccgtctcaggccagttgaaagccaccgcggtctcgctgatgaaaatcgccaatgacctgcgctggatgaactccggcccgcttgcaggtctgggtgaaatcgagctggaaggcctacagcctggctcctcgatcatgccgggcaaggtcaacccggtgattccggaggcgaccgccatggtcgcggcccaggtgatcggcaatgacacggtcattaccgtcgccggccaatccggtaatttcgagctgaatgtgatgctgccgatcattgcccagaacctgctcggcagcctcgaactgctggccaatgccagccgcttactggccgacaaggccatcgccagcttcaaggtcaacgaagccaagctcaaggaggcgctgtcgcgcaacccgatcctggtcaccgcacttaacccaatcattggttaccaaaaagccgctgaaatcgccaagaaggcctatcagcagggccgtccggtcattgacgtcgccctcgagcacaccgacctgcctcgcagccagcttgagatcctattggatccggaaaagctcacggctggcggcgtgtaatcaccgactctgctttggaggctcaccatggagcactggaaacgcacgatcgaacgggccaatcgctgctttatgcagggcgagctggtcgacgctcgcgaggcctatctgcaagccctggccctggctcaagtgttattcgagcgctgggcggatgccgacgaagcagtggcggcttgcgtcatttcccatcacaacctggcggacctgcacctgcgcctgaaccagcctgaggaaagcgcggaatacctctgcgctatccatcaacgcctgttgcagaccatgcaggacccgcgcctgagcccgcaattgcgcgaggcggcactgcgccagagcagcaagacttacgtcgaactgttgaatttcatcagcgatcacggcgagtacccgcgtacccatcgcttgctcggtggcactgcggcgcaatcggatgcgtcgacccgcaacagtccttattacggagcacattgatatgtcctacaccttgcctgccttgccttacgcctacgatgcgctggagccgcatatcgatgcgcaaaccatggaaatccactacaccaagcatcaccagacctacatcaacaacttgaatgcggcggtcgagggcacagagttcgcgggctggccagttgagaagctggtgtccagcgttcagcaactgccggaaaaactacgtgccgccgtcatcaaccagggcggcgggcatgcgaaccactcgttgttctgggcggtgatgtcgccaaaaggcggcggcaaacctgaaggtgcattgggcaaggcgatcgaggagcagttgggcggtttcgacagcttcaaagacgctttcaccaaagccgccctgacccgtttcggcagtggttgggcctggctgagcgtcacgccgcagaagaccctggtggtcgaaagcagtggcaatcaggacagcccgttgatgagcggcaataccccaatcctcggcctcgacgtctgggagcacgcctactacctgctctaccagaaccgtcgccccgaatacatcaacgccttctacagcgtcatcaattggccggaagtcgccgcacgttaccaggccgccttggcctgaaattcacccaataacaagatctaaggccgactatgggcactgaaacactggcgatcagcagcggacggatgtttcgttatgcgtttggctcgctgctgctattggcaggtacagcattgctggtggcccacgggttggcctggctggatcttgaaccgcgaatcctgcgcgctttgcagggcggagcgatttgcgcgctcggcacggcattgggtgcggtgccggtgctggttattcgtcgcatgccggcagcactcagcgacacgttgctgggctttggtgctggcgtgatgctggcggcgacggcattttcgctggtcgtcccaggtattgctgccgctgaaagcttggggctctcgccgtggggcgccagtggtttgatcagcttcggcatcatgctgggggcgttcgggctgtacctggttgaccgcaaggtctctggcgccagcccggaaatgttggtgggcacgccggataaaccggttataccgccgcgtatctggctgtttgtgtttgccatcattgcccacaacatcccggagggcatggccgttggcgtctctgccggtggcgggatgccggatgccgacagcttggccatgggcattgccctgcaagacgtgccggaaggtttggtgattgcgctggtattggctggagcagggatgtcgcgggtcaaagcctttctgataggtgcagcgtcaggtctggttgaaccggtgtttgccgtcctctgtgcctggctggtaagcctggccgaagtgctgttgcctttggggttggcgctagctgctggggcgatgctgttggtggtgactcatgaagtcattcccgagtcacggcgtaacggccacgaaaagctcgccagccttgggctgtgcatcgggttttgtttgatgatggtgatggatacagcattagggtgaggctgttgaagcctcacactcatcttaagggcggggtttattcgccctcgtcgaagtagttattgatcagcttcaccaaggcttccatcgcttcctgttcttgctcgccttctgtcttcaagtggatcttggtgcccttgccggcggccagcatcatcattgccatgatgctcttgccgtcaaccatggattccggcgtgcgccccgcgcggatctggcaggggtattgaccggcaacaccgacgaatttggcggaagcgcgagcgtgcaggcccagcttgttgatgatttcaatttccagagcgggcatcgcgggggtgttcctttcagctaaggtcgcggtggcgaacctggacgttcttgagggtttgttgcagaacctggccgaggcgttcggtcaggtagacggagcgatggtgaccgccggtacagccaatggcaatggtgacataggcccgattgctcgcagcaaaccgcggcaaccatttgagcaggtagctggagatatcctggaacatctcctccacatccggttgtgcggccaggtattcggccacgggttggtccagccccgactgatcacgcagttcaggcttccagtaagggttgggcaggcagcgcacatcgaagaccaggtcggcatccacgggcatgccgcgcttgaatccgaacgactcgacgaggaatgccgtaccgggctcgggctggttcagcaggcgcagcttgatggcgtcgcgcaactgatacaggttcaggccggtggtgttgatcttgaggtcggcgaggtcaatgatcgggcccagcagggtggtctcgtcctcgatggcttcggccagcgagcggtgagggctgctgagagggtggcgtcgtcgggtctcggagaaacgcttgagcagtgtttcctcgtcggcgtccaggtacagcacgtcgcaatgaatatgcttggcacgtacctcctcgagcaattgcgggaatcgctcaaggtggctgggcaggttgcgggcgtcgattgaaacggcaaccagaggttgcgcgagttcggtgtggatcagcgcacgttccgccagttccggcagcaggcctgcgggcaggttgtcgatgcaatagaaaccgttgtcctcaagaacgttgagggcggtgcttttacccgagccagagcggccgctgacgatgatcaaacgcatgattacggcctgttttgttcatccaggacaacctggtagagcgcctcattggtattggcactgcgcagtttgtcgcgtacttccttgcggtcgagcatgctggctatctgccggagcagttccaggtgcgcatcggtggcagcttgcgggaccagcagaacgaacagcaggtcgaccggcgcgccgtcgatggcgtcgaaatcgattttttcctgcaggtgcaatagtgcacttacgggagcagtgcagccttcaaggcggcagtgaggaatggcgatgccgttgccaaaaccggttgaacccagtttttcacggtcaatcagggccttgaacacgacttgctcgtccagctcaggcacttcgcggctgatcaggttggcaatgtgttcgagggcttttttcttgctgccacccggcgcgttcacgagggaacggccgggggtcaggatggtttcaagttggatcatgggggagagttaacgacctgtaccttgcatcaggtgcagattcttttccttatgctttatgagttggcggtccagcttgtcgtagagggagtcaatcgccgcgtacatatcttcatgctccgcattggcgacgagcttcgcattcggtacgtgcagggtggcctcgattttctgcttgagcttatcgacctccatgatgacctgcacgttggtgatcttgtcaaaatgccccgcaagcttgttcagcttgctctcggtgtactcacgcaggggcttggtgacttccagctggtgtccactgatgttgacttgcatacagcttctccttcgttgccagtgcataaagcggcaggccggggtgcctgccactggaacgctatggcccgcccgtcacatcaaacgcttacgctcgctggaaggcgcgatcccgagagactcgcggtacttggcgacggttcgacgggcgacctgaatgccttgtgcctccagtaaaccagcgatcttactgtcactcaatggctttttctgattttccgcggcaaccagttttttgatgatcgcgcggattgccgtggacgagcattcgccgccttcggaagtgctgacgtggctggagaaaaagtatttcaactcataaataccccgcggggtatgcatgaatttctgcgtggtcacccgcgaaatcgtcgattcatgcatgcctaccgcctcggcgatgtcatgcagtaccagcggcttcatggcctcatcgccatattccaggaaaccgcgctggtgctcgacgatctgggtggccactttcatcagggtttcgttgcggctttgcaggctcttgatgaaccagcgtgcttcctgcaactggttgcgcatgaaggtgttgtcggcgctggtgtcggcacgccgaacaaaacctgcgtattgcgggttgacccgcagtcgcggcactgattcctggttcaactccaccagccaacgctcgttgtccttgcgcacgatcacatcgggcacgacgtattcagcttcgctggactcaatctgcgagcccgggcgagggttgaggctctgtaccagctcgatgacctggcgcaggtcgtcttccttgagcttcatgcggcgcatcagctggctgtagtcgcggctgcccagcaggtcgatgtagtcggtaaccaggcgctgggcctcagcgagccaaggggtcttggcgggcagttggcgcagttgcagcagcaggcactcgctgagagtccgggcgccgataccggccggctcgaactgctggatgcggtgcagcacggcttcgatttcgtccagctcgatgtccagttccgggtcgaaggcctcgaggatttcatcgagggtttcgtccagatagccttggttattgatgcagtcgatcagggtgacggcgatcaggcgatcggtgtcggacatcggtgccaggttcagttgccagagcaaatggctctgcaggctctcgccggcggatgtgcgggtagtgaaatcccactcgtcatcatcattgctcggcaggctgctggcgctggtctggtagacgtcttcccaggcagtgtccacgggaagctcgttggggatgcgttcgttccaatcaccttcctcaaggttatccaccgtgggggcggtttcctggtaggagggttcctgtacgtcgggattgggtttttgctcgatgttatcggccagcgggtctgcgttatcgaagtcgtcgccttcttcctggcgttcgagcatcggattggactccagggcctcctggatttcctgttgcaggtccagggtcgacaattggagcaggcggatggcctgttgcagctgcggtgtcatcgtcagctgctggcccattctcaggactagcgatggtttcatggcaggggcttaacaccttattcgccggcgcaatgcgccatccacgacagggcgcgtgagcgccaaacataagcaaattatatgcctgatatcgggggctttgcctagagcgcggtaacaataaaaaaatggaggtttttattgactcccgcgcgccttggcgaatggccagacaccgcagtgcttacaggcggaactcgtggcccaggtacacttccttgaccagttcgttagccaggatggtggcggaatcgccttcggcgatcagctggccatcgttgacgatataagccgtttcacagatatcgagggtctcacggacgttgtggtcggtgatcagcacaccgatgcccttggccttgaggtgatggatgatctgcttgatgtcgccaaccgagatcgggtcgacgccggcaaacggttcgtcgagcaggatgaacttcggcgcggtggccagggcgcgggcgatttccacacgacgacgctcaccacccgacaggctcatgcccaggttgtcgcgtatgtggttgatgtggaactcctgcagcaggctttccagctctttgcgacggccgtcacggtcgagttccttgcgggtctcgaggatcgccatgatgttgtcggctaccgacagtttgcggaagatcgacgcttcctggggaagatagccgataccggcgcgcgcacgaccgtgcattggctggtggctgacgtccaggtcgtcaatcaatacacgtccctgatccgcctgaaccagcccgacgatcatatagaagcaggtggtcttgccggcaccgttcgggccaagcaaaccgacgatctggccactgtcgatcgacaggctcacgtcgcgtacgacttggcggcttttataggccttggccaagtgctgggctttcagggttgccattagttcgccttcttcgcagcgggtttaggcgcaggctgagccgcaccgtctttctgcttcggctggataaccatgtcgatacgcggcttcggagtgccgatcttggcgccggtggcgcgaccagcctgagcgatctgcttcacggtgtcataggtgattttctcaccgtctgtcgtgttgccatcgctgctcacaaccctggcctgatcgatcaggatgatacggttctgctgggcgtggtattggatggtcttgccgtagcccttgatcggggcagggtcggcagcggcctgcttctgttcgaagtaagccaggttgccaaccgacgtcaccacgtcaatgtcgccagcgggcgtacgcgtgagcgtcaccgtgttgccggtgattttcatcgagccctgggtgatgatcacggcgccggtgtaggttgcgacaccttgcttgtcatccagctgcgcatcgtcagcctgaatgtggatcggttgctggctatcgttcggcagagcccaggcgctcacgcttcccagtgctgcgcccagaccgagcaaaatagggagggttttaacgagcctcatactgtcctcttacgttcgatagcaggtgtatcctgctttctttcaaatacgctttcattcccttgccagtcgatacaccgccagcgccgtcgattctaacgtcttgctcggtctgcgcatattgctgttgtgggaaaacggtcatgcgactactggtaatgatggtgtcgcgcttcttttcgtcagtgcgcgcaacgcgcaccgagtcgatcagttccacttgagtgccgcccttgttcacctcaccgcgcttgctggtgacgtgccatgggaactcggtgccgcggtagaggttcaggtcgggattggtcagcaggctgacgtccgtggccttgaggttctcgactttatcagcggtcatttcgtactgaaccttgccgtcgggcaggaactgtatggtgtgagcgttgatggcgtaataggcgatagcgctatcgtcgacggccgctacgggcttgtcgaggaagcgctccgggctgatattccagtagcccaccgccaggaacagcgcggcgatgactgcgaatagcaggaagttgcgaatctttttgctcagcataaaacgctctataggtaggcggcgtgggccgcttcaaggctgccctgggcacgcaggatcaactcgcagaactcgcgggcagcaccttcaccgccacgtgcggtagtaatgccgtgggcgtgctcgcgaacaaacgccgcagcattcgcgacggccatgcccaggcctacacggcgaatcaccggcaggtcaggcaggtcgtcacccaggtaggcgacctgctcatagcttaggttgagttggccaagaagctcgtccagaaccaccagtttatcctcgcggccctgatacaggtgaggaatccccaggttttgtgcgcgacgttccactaccggtgtttttcgaccactgataatcgccgtttgcacacccgccgccatcaacatcttgatgccttggccgtcgagggtgttgaacgtcttgaattcactgccatcttcgagaaagtacaggcggccatcggtcaacacgccgtcgacgtcgaaaatcgccagcttgatgtttttgccgcgttgcaacaggtcgtcggacatttacatcactcccgcacgcagcaagtcgtgcatattcagggcgccaatcgggtggtcgtcgctattgaccaccaccagcgcgccgatcttgtggtcttccatgatcttcagcgcttcggctgcaagcatctcggggcgggcggtcttgccgtgtggtgtcatgaccgcgtcaatcgttgcagtatggatatcgatggtgcggtccagggtgcggcgcaggtcgccgtcagtgaacacgccggccagtcgcccgtcggcttccaggatgacggtcatgcccaggcccttgcgggtcatttccatcagcgcgtccttcagcaaggtgccgcgctgcacgtggggcaattcatcgcccgagtgcatgacgttttccactttcagcagcaagcgacggccgagggcgccgcctggatgggaaaacgcaaaatcttcagcggtaaagccacgggcttccagcagtgccacggccaatgcatcgcccatgaccagggcggcagtcgtggaggaggtcggcgccaggttcagcgggcaggcttcgtggtccacgtgaacattcaagttgacctcggcggccttggccagcgtcgagtccgggttgccggtaatgctgatcatctggatgcccaggcgcttgatcagcggcaacagtgtcacgatttcattggtgctgccggagttcgacagcgccaggatgatgtcatccttggtgatcatgcccatgtcgccgtggctggcttcggccgggtgtacgaaaaaagccgtggtgccggtgcttgccagcgtggcggcgatcttgttgccgacgtggccggatttgcccatgccgaccacgacaacgcggcccttgctggccagaatcatctcgcaggcgcgtacgaaatccgcgtcgatatgggccagtaaaccttctacggcttcaagctcgaggcggatggtgcgttgtgcggattgaatgaggtcgctggattggctcatgtctgaaatcgtatagcctgacgaaaagtcggcgattatagcggtaatgatcaattccctcacgcaagttcgtcaggctttattcggcagttgcctgagattcgtcctcagcagcgttttttccctgtcccgaatctgaacgagcgcggttccggccttgggggcgctgtaccagcagtgatatagttcgccgccagttcggtccgcccaacccatgttgctaattattgcgcatctgtcgcaaacgaaagtcgcaagcgtggtgtctgagtgaaaggctgcatcccaaggagattagatgagtgccgataacgcctacgcggtcgagctgaagggccttaccttcaagcgcgggacgcgcagcatcttcaataacgtcgatattcgcattccccgcggcaaggtcacgggcatcatggggccttccggttgcggcaagaccaccctgttgcgcctgatgggcatgcaattgcggcccagcgccggcgaagtttgggtcaacggccagaacctgccgacgctgtcgcgcagcgatctgttcgatgcgcgcaagcatatgggtgtgctgttccagagcggtgcgctgttcaccgacctcgatgttttcgagaacgtggcgtttccgctgcgggtgcacaccgagctgtccgatgaaatgattcgtgacatcgtattgctgaaactgcaggccgtcggccttcgtggcgccatcgacctgatgcccgacgaattgtccggcggcatgaagcgccgcgttgcgctggcgcgagccatcgcactcgatccgcagatcctcatgtatgacgagcccttcgtaggccaggacccgatcgccatgggcgtgctggtgcgcctgatccgcctgctcaacgatgcgttggggatcaccagtatcgtggtgtcccacgacctggccgaaaccgcgagcattgccgactacctttatgtcgtcggcgatggtcaggtgctggggcagggcacgcctgaagagctgatgaacgctgataacccgcgcattcgccaattcatgaccggcgatcccgatggcccggtgccttttcattttccggcagcggactaccgcgcagatcttctggggaagcgctgatgcgcaagacatctttactcgagaaggttcgccttttcggtcgttccggtattgacctcgtcgaggtgctggggcgttcgacgattttcctgtttcacgcgttgctcggtcgcggcggcattggcggcggtttcggcttgctgatcaagcagctgcattcggtcggcgtgatgtccctggtcatcatcgtggtttccgggattttcatcggcatggtgctggcgctgcaggggtttaacattctctccagctacggttcggagcaggcggtcgggcagatggtggccctgacgctgttgcgcgaacttggcccggtagtcaccgccttgctgtttgccgggcgtgcaggttctgcattgactgccgaaatcggcaacatgaagtccaccgagcagttgtccagcctggaaatgatcggcgtggacccgctcaagtacattgttgccccgcgcctgtgggccggcttcatttccctgcctctgctggcaatgattttcagcgtggtgggcatttggggcggttcctgggtggcggttgactggttgggcgtctatgacggctcgtactggggcaacatgcaaaacagcgtgaccttcagcggcgacgtgctcaacggcatcataaagagcatcgtcttcgcctttgtagtgacctggatcgccgtattccaaggctatgactgtgagcccacttcagaagggatcagtcgcgccaccaccaagaccgttgtgtacgcctcgctggcggtactgggccttgacttcattttgaccgccttgatgtttggagatttctgatgcaaaaccgcactgtggaaatcggtgtcggccttttcttgctggctggcatcctggctttactgttgctggccctgcgagtcagtggcctgtcggccagccccaccgccgatacttataaactttacgcgtacttcgacaatatcgccggtttgactgtcagagctaaagtgaccatggctggtgtaaccatcggcaaggtcacggcaatcgatctggatcgcgacagcttcaccggccgagtgaccatgcaagtggacaagaaggtagataatctgccgactgactccactgcatctatcctcactgcgggtttgctgggcgagaagtacatcggcgtcagcgtgggcggggaaacagccttgctcaaggatggttcgacaatccacgacacacagtcgtcgttggtgcttgaagacttgatcggtaaattcctgctcaacacggtcaataaagacgccaaatgaggaatctgttcatgatctctaccttgcgacgtggcctgctggtgctgcttgcagcactgcctatgatggccaacgcggcgggttctgcacacgatctggtgcaggatacgaccaacaagatgttggctgacctgaccgccaacaaagagcagtacaagcaagacccgagcaaattttatgatgcgctgaataccattgtcggtccggtggtcgatgccgaaggcatttcccgcagcatcatgaccgtcaagtattcacgcaaggccacgcctgcgcagatgaagaccttcgaggaaaacttcaagaagggcctgttccagttctatggcaatgccctgctggagtacaacaaccaaggcattaccgtggcaccggccggggatgagtcgggtgatcgcaccagcgtcaacatgaccgtcaagggcaccaacggcgccgtctaccctgtgcaatacacgctggagaaggttaacggcgagtggaaactgcgcaatgtgatcatcaacggcatcaacattggcaagctgttccgcgatcagttcgctgacgccatgcagcgcaatggcaacgacctggacaagaccatcaatggttgggccggtgaagtcgccaaagccaaggaagaaaccgacaagcaagctgggaagccagcgcaatgaccgagtcggctgttcgtcttggcgacgccggtgagttgtttatcagcggcgtgctggattaccgctccgggcctgacctgcgcaagcagggccaggcgctgatcaacagcagcaacgcgcctgcgctggtgctggattgttcggcggtgaccaagtccagcagcgtcggcctgtcgttgttgctgtgctttatgcgcgatgccgaagcggtcaagaagccggtcagcgtccgcgcgctgcccgaggacatgcgcgaaattgcgcaagtttccggtctgaccgagctgttggcacatccttaatacacactattaaagaagccccccgtcagagtcctgctatgcggggttcgcaggcgcggggcttttttgtatgatgtgcgacccgtgcgcactgggcgccgatagaggttgagcatgcaggccctagaagttaaaagcttccttgaaggaaagctgcccgaaacgaacgtagaagttgaaggcgaaggctgcaatttccagctgaacgtgattagcgatgaactggcggcactcagcccggtcaagcgtcaacagcagatctatgcccatttgaacccgtggatcaccgatggcagcatccacgcggtcactatgaaatttttcagccgcgcggcctgggccgagcgcacctgagcccccaaggcgtcgagattcttatggataaattgattattaccggcggtgcccgcctagatggcgagatccgcatttccggtgcgaaaaactccgccttgccgatcctggcagcgaccctgctgtgcgatggcccggtcaccgtggccaacctgccgcacctgcacgacatcaccaccatgatcgagctgttcggtcgcatgggcattgagccggtgatcgatgagaagctgtcggtcgaaatcgacccgcgcaccatcaaaaccctgatcgccccgtacgaactggtgaaaaccatgcgtgcgtcgatcctggtactgggcccgatggttgcccgtttcggtgaagccgaagtcgcactgcctggcggttgcgccatcggttcgcgtccggttgacctgcacatccgtggccttgaagccatgggcgcgaccatcgacgtcgaaggcggctacatcaaggccaaggcgccggaaggcggcctgcgtggtgccaacttcttctttgataccgtcagcgtaaccggcaccgagaacatcatgatggccgcggccctggccaacggtcgcagcgttctgcaaaacgccgcgcgcgagccggaagtggtcgacctggccaacttcctgatcgccatgggtgccaacatctccggcgccggcaccgacaccatcaccatcgaaggtgttaagcgcctgcactcggccacctataaggtgatgccagaccgcatcgagaccggcacctacctggtggctgctgccgttaccggtggccgcgtcaaggtcaaggacaccgatccgaccatccttgaagctgtgctggaaaaactcaaggaagccggcgctgagatcaccaccggtgccgactggatcgagctgaacatgcacggtaagcggccaaaagctgtgaacgtgcgtaccgcgccgtacccggcgttcccgaccgacatgcaagcgcagttcatttccttgaacgcaattgctgaaggcaccggcgccgtgatcgagaccatcttcgaaaaccgcttcatgcacgtgtatgaactgcaccgcatgggcgccaagatccaggtcgaaggcaacacggccatcgttaccggtatcgacaagctcaagggcgcgccagtgatggctaccgacctgcgtgcttcggccagcctggtgatctcggcgttgtgtgccgacggcgacaccctgatcgaccgcatctaccacatcgaccgtggttacgagtgcatcgaagagaagctgcagatgctcggcgccaagatccgccgcgtaccgggctagtcccggtagcagcaaacaccgtcactgtggcgagggagcttgctcccgctggactgcgcagcagtcccgctctttggggccgcttcgcgacccaacgggagcaagctccctcgccacaggaaggtgtttgttgttaaatggtttgtttcaaatcgaggctgtaatggcctcgatctgtgtctggcgccgtttgcgaccggacagcaatagcctgatgaaggactgacgtttcccatgttgaccatcgcactgtccaagggccgcatccttgacgacactttgccgcttctggctgaagcgggcatcgtgccaaccgagaatccggacaagagccgcaagctgattatccccacgacccaggacgacgttcgcctgctgatcgtgcgtgccaccgacgtgccgacttacgttgaacatggcgcggccgacctcggtgtggccggtaaagacgtgctgatggaatacggcggccagggcctgtacgagccgctggacctgcgcatcgccctgtgcaagctgatgaccgccggccgtgtcggtgacgtcgagcctaaaggccgcctgcgcgtggccaccaagttcgtcaacgttgccaagcgctactacgccgagcaaggccgccaggtcgacatcatcaagctctacggttcgatggagctggcaccgctgatcggcctggccgacaagatcatcgacgtggtcgacaccggcaacaccctgcgtgccaacggtcttgagccccaggatttcatcgctgacatcagctcccgcctgatcgtcaacaaagcctccatgaaaatgcaacacgcccgtattcaggcgttgatcgacaccctgcgcaaggcagtggagtctcgacaccgcggttgactcacccgcgcggccccaggtcgcgcccgtctatccgcctcatagccagaattctcaggtgcccaagcggatcgactgctaactttcggcgcctgagcatttttgccaatcctatgaggccctcgctatgaccacgtccactgcaattgcccgactcaacgctgccgacccggatttcgcccatcatctggatcatctgctgagctgggaaagcgtgtccgacgactcggtcaacgggcgggtactcgacattatcaaggccgtgcgcgagcgcggtgatgcggcgctggtggatttcacccgccagtttgacggcctggatgtggcgtccatgtccgacctgatcctgccgcgcgagcgccttgagctggccctgacgcgcatcaccgcgcctcagcgtgaagccctcgaagtcgcggcggcgcgggttcgcagctaccacgagaaacagaagcaggattcctggagctacaccgaggccgatggcaccgtgctgggccagaaggtcacgccgctggatcgcgccggtttgtacgtgccgggcggtaaagcctcgtatccgtcttcggtgttgatgaacgctatcccggccaaagtggcgggcgtgaccgaagtggtcatggtggtgccgacgccgcgcggtgaaatcaacgagctggtgctggcggctgcgtgcatcgccggtgttgaccgcgtgttcaccatcggcggcgcccaggccgttgcagccctggcctacggcaccgaaagcgtgccgaaggtcgacaaggtggtgggcccgggtaacatctatgtggccaccgccaagcgtcacgtgtttggccaggtcggtatcgacatgatcgccggcccttcggaaattctcgtggtgtgtgacggccagaccgacccggactggatcgccatggacctgttctcccaggccgagcacgacgaagacgcccaggcgatcctggtcagccccgacgccgagttcctcgacaaggtcgccgccagtatcgacaagctgctgccgaccatggaccgcgccgagatcatcgagaagtcgatcaatggccgcggtgcgctgattctggtgcgtgacatggagcaggccatcgaagtggccaaccgcatcgccccggaacacttggagttgtccgtcgccgacccacagacctggctgccgtcgattcgtcacgccggtgcgatcttcatgggccgccacaccagcgaagcgctgggcgactactgcgcaggcccgaaccacgtgctgccgacctccggcaccgcacggttttcgtcgccgctgggggtgtatgacttccagaagcgttcgtcgatcatcttctgctcgccacaaggcgcctccgaactgggcaagaccgcctcggtgctggcccgtggtgaatcgctcagcgcccacgcccgcagcgctgaataccgcatccttgaagaggggaaataagacatgagtaaattctggagccccttcgtcaaggacctcgtgccttacgtgcccggcgaacagccgaagttgaccaagctggtcaagctcaacaccaacgagaacccctacggcccatcgcccaaggcattggccgcgatgcaggccgagttgaacgacaacctgcgcctgtacccggaccccaacagcgacctgctcaagcaggcggtggccaagtattacgggattgatgccggtaaagtcttccttggtaacggttccgacgaagtcctggcgcacatctttcacggcttgttccagcacgatttgccgctgctgttcccggacatcagctacagcttctatccggtttactgcggcctctatggcatcaaatccgacccggtgccgctggacgagcagttccagattcgtgtggccgactacgccaagcccaacggcgggatcatcttccccaacccgaacgcgccgaccggctgcgtgctggcgctggatgcagtcgagcagatcctcaaggccagcccggattcggtggtggtggttgatgaagcctatatcgacttcggtggcgaaaccgctatcagcttggtggaccgctacccgaatttgctggtaacacaaaccctgtccaaatcgcgctcactggccggtttgcgtgtgggcctggccgtgggccacccggacctgatcgaggcgctggagcgggtcaagaacagcttcaactcctacccgctggatcgcctggcgattgttggcgcggcggcggcgttcgacgaccgtgaatacttcgagaagacctgccaactggtgatcgaaagccgcaacaaagtggttgcgcagttggaaggcaaaggctttgaagtgctgccgtcggcagccaacttcatctttgcccgtcacccacggcacgatgcggccgggttggcagccaagttgcgtgagcagggcgtgatcgtgcggcacttcaagcaggagcggattgcccagttcctgcggatcagcatcggtacgccggagcagaaccaggcgcttatcgatggcctcggcgagctttaacgaccactgaaatcaaatgtgggagctggcttgcctgcgatagcggtgtatcaaacgacgtatatgtcgactgttacaccgctatcgcaggcaagccagctcccacactgatttgcgttgggtcagttacagcaacggctcatccggcttcttgttcttccagccatcgttacccggcagcagcaagttcaacgcaatcgctaccactgcacacagggcgatgcccttgaggccgaaatcatccgggccagtgccggtgccgaccagcacaccgccaatcccgaacaccagggtcaccgacacaatcaccaggttgcgcgcttcgccgaggtcgatcttgtggcggatcagcgtgttcatgcccaccgccgcaatcgagccgaacagcaagcacagaatcccgcccatcaccggcaccgggatgctttgcagcagtgcaccgaatttgccgataaacgccaggctgatggcaaataccgccgcccaggtcatgattttcgggttgtagttcttggtcagcatcaccgcgcctgtcacttcggcgtaggtggtgttcggcgggccgccaaacaggccggcagccgtggtggcaatgccgtcacccaacagcgtgcggtgcaagccaggcttcttcaggtagtcgcgaccggtcacgctgcccaccgcaatcacaccgccgatatgctcaatcgcaggggccagggccaccgggacgatgaacagaatcgcctgccagttgaattccggcgcggtgaagtggggcagggcaaaccagggcgctgcagcgattttcgccgtgtcgaccacaccaaagtagaacgacatggcaaagccaaccagcacaccggagataatcggcaccaggcgaaatatgcctttgccgaacaccgccacgatcaaggtggtcagcagtgccggcatcgagatcagcatcgccgtctggtaatggatcagttcgctgccatcaccggctttacccatcgccatgttggcggcaatcggcgccatggccaggccgatggaaatgatcaccgggccgatcaccaccggcggcagcagccggtcgatgaacccggtgcctttgatcttcaccgccaagccgagaaaggtataaacgaaacccgccgccatcactccgcccatggtcgccgccaggccgaactggcccttggcgagaatgatcggggtgataaacgcaaagctcgatgccaggaataccggcacctgccgccctgtcaccacctggaacaacaacgtgcccaggcctgcggtaaacagtgcgacgtttggatcaagacctgtgatcagtggcatcaacaccagcgcgccaaatgctacgaagagcatctgtgcgccagacaggatctggcgccaaagcgggtcgttgaattcatcctgcatgctcacgcgtccttctgcttggtgccgaagatcttgtcaccggcatcgcccaggcctgggatgatgtagccgtgttcgttcaggcgctcatcaatggacgcggtgtagatctgcacgtccgggtgggctttctcgacggcggcaatgccttcgggcgcggcaaccagcaccatggcgcggatgtccttgcaaccggcctttttcagcaggtcgatggtggcaaccatggaactgccggtggcgagcatcgggtcgatgatcattgccaggcgctcgttgatttccgggacgagtttttccaggtaggtgtgggcctgcaatgtttcttcattgcgggccacgccgacggcgctgactttggcgcccgggatcaggctgagtacgccttcgagcatgccgataccggcgcgcaggatcggcaccacggtgattttcttaccggcgattttttccacctgcacgggaccggcccaaccggggatctcgtagctttccaggggcaaatctttggtggcttcgtaagtgagcagcgctccgacttcctgagcaagctcacggaaattcttcgtgctaatgtcggcacggcgcataaggccgagtttgtgtctgatcagcgggtggcggatctcgcgagtgggcatgggaaaagctccggcggcgggcaaaaaaaccggcctagattaatctatccgagggtgttgtcctatagacatctagtacgttagtccattaaggcttgatcgttgcgcctcacatgcgtacctttgcccgcttttcttgccaccgcacccccttggagagcgccatgtccgctgatctcgagcatatccgtcaaatcatgcgcgaggctgactgcctgtacaccgaagcgcaagtcgaagaggccatcgccaaggtcggcgcgcacatcacccgcgaaatggccgacaccaacccggtggtcttctgcgtgatgaacggtggcctgatcttcgccggcaaattgctgactcacctgcaatttccgctggaagcctcctacctgcacgccacccgttatcgcaacgaaaccagcggcggcgatctgttctggaaggccaagccggaagtttcgttcatcgaccgcgacgtgctgatcatcgacgacatcctcgatgaaggtcacaccctgggcgcgatcatcgatttctgcaaacacgccggcgcgcgcaaagtgcacaccgccgtgctgatcgacaaagaccacgaccgcaaagctcgcccggacctgaaagccgattacgtcggcctgccgtgcatcgaccgttacattttcggttatggcatggactacaaaggctactggcgtaacgccaatgggatctacgccgttaaagggatgtaaccgatggcccgctttcttgatcaggcgttgttcaccgaattggccgagaaagcggccgccaaccctcgtggtcggcaccatcacaacttccatcagatggaagagccctgccatcgcctggccgtgggcctgcagcccgacacctatgtgccgccgcatcggcacctgagcgcggacaaggcggaaaccctgctggtgctaaaaggcagcctgggcctgctggtgttcagcgacaccggcgaagtcattgccaagcgcgtgctgcaggcgggcggtgagtgctcgggtgttgacctgccgccgggcgtgtttcatggcctggtggtgctggagcccgacagcgtgatgtttgaatgcaaggccgggccgtaccgcgcgttgggcgaaggcgaatcaccggcctgggcgccccgcgaaggcgatgccggcgtcgccgcgtatcagcgctggatgctcgcccagttcgattgagcctcagcgcaacggtaatccttgttctaccagagaggccagcaggcccgcgcccagcgggatgatgctgtcattgaagtcataccggtcgttgtgcaattggcaatgaccgacaccttcgctcgtcgagccaccttggccgaggtaaatgtaggcccccggccgctcctgcagcatgtatgaaaagtcttcggcgcccatggtaaggggttcgttgcacctcacgtttgcctctccaaccagacttttggcaacgcctgccgcgaacaatgcctgctcgggatgattgacggttgcggggtaacctcgttgatagtcataggtgacggcagcgccaaacgcggtcgcaacgccatgggcgatttcgccgatgcgtttctccagcagatctcgattggcgctggtaaagctgcgtgcggttccgatcatcttcacgtgggcgggaataacgttgttcgccgtgagctggctggtttgcaggctggccaccgtcacgacccccgactccagtgggtgcagattgcggctgatgatgctctgcaaggcgacaatgatatggctggcagccagcaccgggtcgattgcggcgtgtgggatggccgcatggccgccgcggccggttaccacaatttcaaagctgtccgccgccgcttccaccgggccgggctgtacggcaatgaccccggcggggtagtcggggttgttgtgcagggcatacaccgaatccactgggaactgcttgaagagcccttgttcgatcattacgcgagcaccgccgccgccttcttcggcgggttggaaaatcacgacggctttgccactgaatcggcgcgtctgggccaggtaacgcgcagcggccatcaacatcactgtatgcccgtcatgcccgcagccgtgcatgaggcccgggtggatggagcggtgggcgaagtcgttggcttcgaacatgggcaggcagtccatgtcggcacgcaggcctacgcttgcgccgggctgcgcgccctgaatgacgccgactacgccggttcccgccagcccacggtgtacttcaataccgttttccccaagaaagccggcaacaatctcgctggttcggtgttcatcaaaccccagctccgggtgcgcgtggaggtcgcgtctcaaggcagtaagtgcttgaagctgtgtttggatgtgttcaacaggattcgtggtcatgggcgagactcttgttattttggttgagctgggaatctacagccttcgcgtgttctttcaatcaggccagtgcaaccagaaatgtcgggcatgatgtaggccgttcaaagctgacctgcgtgctagcatggctgccccttcggaggtgtacatgagtgttttgatccgcagttgcgccgccttggcgttgatcttcagtttgcctttgtctgccgctccagcattgatgcacagccaattcctgccgccggacgaccttaccttgcgcgccgaaacgcctgaccaacagcaactgctgcaaatcaccgagtacgcggtagtggtcggcaaccagcggcaatccacccagcagccgatcccggtaacgtcgccgctgatgattcgtctcaagggcaaagccctgaacaaaggcgcgaccatcgctcaggtggtgctcaattttgatgccgaaagcaaaagcctgaaaaagccgctgtacgatgacgccagcaaaaccctgacgttgtcttacccggtggcgcagtaccgcgtgattgtcgacttgctgcgcaatgacacggtgtatgtacagttcctcagttatgccaatgggcatatctgggcggatctgcatacgggtgcggttcgcgctaaatagtgaggccacagacaaaccaaatgtgggagcgggcttgctcgcgaatgcggtgggtcagtcaacttttcattaactgatctaccgcattcgcgagcaagcccgcttgtgtcttgagccaggtttaaactgaggttgagagcggtgagtggcaagctgaatgccc

SEQ ID NO: 39 - DNA, 121405 bp, Pseudomonas poae FL10F
gggagcgggcttgctcgcgaaggcggggtgtcagtcgacatttgcatgactgaaccaccgccttcgcgagcaagcccgctcccacatttttaatcgcatttcagcagtcaggccaattcaggcgcgctagcgtacgcctgttccagcagcacggtgaagcgcacaaacgcgtcgattgcacctttttctaccgccgcttcttcttcggcgctgaactcaaggccgtcgagggtgcgggtaaagcttttccagccttcagcgcggccaccggccggctcgccgaggtggcgggcgccgaaggtttcgctcaggcccaggcccacggcgcgcttgatcaggaaggcagcgcccagcttggagccttcggagacgaacagccagcccagagcttcggccttgctcgggttcttcacggcgccagcaaccggtgcaggcacttcggtgtccaggtcgcccaggtccagcttggcggcttcggcgcggcagcgctcggccaggtccgggacgatcttgatcaactcagggtcgttgtacagcgccaccagttccgactggaacaggtattgcgcgaccacgaagcgggcgaagttggcttgggtttcgaacggggcgtgggctttgaccagcgcatcgagcttggtgtgtggcgcgttggtgatttggttcaggcgctgggagcgcaggcttgggcgttctgcggtaggagaagcggtcatcgaaaaagtccttgagaagagtagcgcctgggtgccctaaagagagctgttatcaactagacgaacaagaagacgcggcacagtaaaaaatcctcacctcgccgctgaaattccggcgaggtgaggagggcggcatttggggcaagcgcgatcagatgtcccagatcaggttgatcgcaaagttgcggcccggctgggtcaggcggtcgaggttggccggcgcagtcacacccgcttcgccgacgccgtcgtagctgcgcacgtcatcccagttccagtacttcttgtcggtgaggttgtagaggccgccgttgatggtcacgtcgttggtgactttgtagtagccggtcaggtcgacgatgccgaagcctggggttttgaacggggcgctggtgctgccatccggcgcgtggaaggtggtgctgtcgacgcggttctgtttcttcaccagcgtccagctgaccagcgcgccatattgctcttgctcgtagcccaggccgaacacgcctttcagcgggttgacgctgttgagcggctcgccgttgtcgtcgttgcggccataggtgtagccgaccgaaccctgggtgtagaggccttgcggtgcaccaaaggcgtcgaggttcaggcggcccttggcttcaatccccttgatggtggcgtgcttgatgttgttggcttcgaaggtttggatgtcgccgccggcgaccgaggcgtcttcgtcgataaagtcgcggtacttgttgtagaacaccgcgatgtcgaaggagccttcgtcgaaattgccgcgaatcccggtttcaatgcctttgctggtttccggcttgaggttcgggttcggctcgacggtgtagcccaggttgaggttttcaaagcgaccatacagcgccttggccgacggggtgcggaagccctcggcgtactgaccgaaccaggtgtattgatcggtcagggcgtaggtcaggccgaatttgggcgtcacacggtgccaggttttttccttgtcgctgaccgggtaggtgccggtcgggttgacggtgttaaggaactcctgggtcagcttgggtttgagctgggtgtagtcatagcgcacggcgggcaggaaggtccatttgttccaggtgatctggtcctgggcgaacagcgagtaggtgttgatggtcgggtccgggaagtcgctggattttttcacgctgtcactggcagaagggctgggcgcgccgatagccgtgcaacccccgccgaccgccaggcacgtcgcggcaccttcccgggagccggtgactttctgctgtttgagtgtggtgccataggtcacttggtgatcggtttcaccgaggctgaaggctttgtccaattgtgcgtcgaagacccactgtttttcttcgtacagggtttcgcgcgtgcgcaatacgcgacgcgacggttggtagatctcggcagtcgtctggtcggtcttggcgatctggtaattgaggctggttttgatctgatcggcaatcggcgaatcgagcgcgaagcggttttcgataccgaaacgctcacgggtgatggtgtcgttacccgaacggccgcgatagaagttgaagcctcgaccaccaacgaacggcccgcccacggcgtttttcaagtcgacgtcgcgatcatccttgaacttctcataggtcaggcccaggcggttgtcatcgccataattccagcccagcttggcgaggatattggtggtacgcgcgtcttccggattggcgccggtgcgggccaggccggtggcgttgttgccgtcgtaggactccatttcgtggccattgcgctggctcaggtgcagcaaaccgtcgaagtcctgcacgcggccggcgacggtgccggaggtcagccagctgtcgtcagcagagctgtaaccggttttcaggcgggcgccgacatcctggccgggcttgatgatgtcgtccgggtcgagggtgaagtaactcactgcgccgccaatcgcgctgctgccgtacaaggccgaggccgggccacgcaggatttccacgcgcttgacgatttccgggtcgacgtagttgcggcgagtcttggcgtagggaccgttgaagaagttatccggcacttcgacgccgtcgacctgtgtgaggatacggtcgccgtcgatgccgcgaatgttgtagcccgcgttgctggcgcgggtgccggcgccgccgaccgatacgttgggctcgtagcgcaccagttcacggatggtgttgacgttctggcggtccagttcctggcgatcatgcacggtgacggtgctcggcacgctgtcgacggcctgctcgttacgcgtggcgctgatggtcacctgctgcaggttgagcacgctgcctgcggcgcgtttttccagcacgatgttgttattgcccagtttgcggtagctcaggttggtccccaccaacagccggtccagggctttttccggcgacagcgggccgcgcacgccaggggatgacacgccctggcccagctctgccggcaggccgacttgccagccggtcacgcgggtaaaggcgttgagcgccgagaccagtggctgctgctcgatgctgaaattgtagttgccgtggctgcgggcgaccggctcggcggccgtgtcggccatggccggcgcgctggccagcaggatggcggcggtcagcaaggacaggacgggcgaagaagaccggcggttgaaacgagaggacatcgagagcgctccggaggtacgaatcttatagttgcgaaccgaatcaaataggaatcagttgcattggctataacgagacgtaccgccggttaacatcgagtaaaaataattctcatttagttcaggatgaccagcgccgggtattccgagagcttggccgaggtgatgtgtgccagtgagcgcaccacgtccagcggctggtcgaggcggtagttgcccgtgacggccacgctggccagcttgtcgttggtgttgacgatccagccggggtaataacggcgcagctcggccagcacttcgctcatcgggcagttttcaaacaccaggcggccctggacccaagccagatccttgctcacatccagcttggcgggttggccaaagcccttggggccgatgcggatactctcgccggcgcgcaggcgcacacgggcatcgtcgaagttgttgctcaggtcgacatcaccacgctgcacctgcacttgtgcttcaccgttgaggtaacgcacggcgaagtcggtgtcacgcacgctggcgcgcaccgggccggcgtcgatctccagcggcaggccacggttgggggctatctcgaaaaacgcctcgccctgatacaggcgggcgacgcgctggtggtccttgatgctgctggaaaacgccgagttagtgttcagcagcactttggcgccatcgtccaattgcaggcgctggcgttcgccgaccacggtgaggtggtcggcttgcaggcgcacgggcaggttgctgaaactgaacaggccgatcagcagcacggcggcggtggccaatggtttccaatgcggcttgacccggcgccaggcgctcggcttgcgcggcgcagccagggccacggcggcactgtgcacgggcgcgccaccccaggcggcctgggctttgttgaaggcgtgggcatgcgtcgggtcagcggccagccaggcgtcgaactcagcctgctgcccgggttgcgggcactgcaaggcgatcagccaatcgagggcttggtccatggccgtgtcttgcaacacctcatgagccagctcatgggcgcgcagtttattcgggtccgtcacggtgttcctcgggtcttcgccacgttctattcgtcttttctgcagcctggatcgacacatctgtcgggtgaagcttaaggctgatccagccgctcggccacacctacacagatggccatgatcaatttcagttccttttgcacggtgctcaaggacacgtgcaactggtcggcaatctcctgatagctgcagccatgcaggcgactgaggatgaaaatctgctgctgacgggcgctcaactgaccgaggctgacgctcaggtgttcgagcaattgctcggcctgtgtcgcgtcttcgggcgtactgatgggggcggcgacgctttgcagtacgtccagcgggacatcttcctgcagcgtgcgggcttgaatccggcgcgaacgcaggtggtcgagcgccaggttgcgcgccgtctggtagacgaagggttcgaggtgatcaatcggccgctcgctgagggcccgggtgacgcgcaggtaggtttcctgcaacaggtcctcggcggtgctgtggttattcaccatccgctgcaaggtgcgtagcagaatcacccgttgggtgagaaagacttggttgaagcgagattggctcacagtgataccagaccgatatgcagttaatgataatgcttatcatcaactcaaatggcaagtggcactttgagagggtgcgaagatccctttggggggccgggctcatgtgggagctggcttgcctgcgatgcaagcaccttggcctttcagtcagaccgaggtgatgctatcgcaggcaagccagctcccacacaagccgattcctgaacagtccgagctttactcggcgttacacagcgccaggcagttatccagcatacggttggagaagccccactcgttgtcgtaccaggccagcactttgagcaatttgccactgactttggtgtggttggcatcgaagatcgacgacagcgggttatggttgaagtcactggaaaccagcggcagggtgttgtagccgaggattttcgagtgctggctggcttctttgagcagggcgttgacttgctcggccgtggcttctttcttcagtgtcacggtgaggtcgaccagcgacacgttgatcaccggcacgcgcaccgccatgccggtcagcttgcccgccagttccggcagcaccaggccgaccgcttcagcggcgccggtcttgcttgggatcatgttctgggtggccgagcgcgcgcggtacgggtcggtgtggtagacgtcggtcaggttctggtcgttggtgtaggcgtgaatcgtggtcatcaggccgttttcgatacccagttcgcggtgcagcacctgggcaaccggcgccaggcagttagtggtgcaagaggcgttggagatgatctggtgggattgacgcaaaatgtcatggtttacgccatagaccacggtggcgtcggcgcccttggccggggccgagatgatcaccttgcgcgcgccggcggtaatatgcgcggcagccttgtcacggtcggtgaacagaccggtgcattcgaacaccacgtcgatcttgtgcgcagcccacggcaggtcggccgggttgcggatggcgcttacggcgatccggtcaccattgacggtcaggctttcctgatcgtgggcaacctctgcttcgaaagtaccgtgtacggtgtcgtatttgagcaggtgggcattgatcgaactgtcgcccagatcattgatggcgacgatctgcaaatcctggcggtagccttgggtatacagtgcgcgcaggacattacggccgatacggccaaaaccattgattgcgatacgaagagtcattggaaagtgcctgtcgtcgatttgttgtaagaattacaagattattcgcataaaaatagaaaacaagcctttttagtggcaatattttgttcaatctacaacgagtgacctgaatcaactggtccgatgatccaaacgacaccctgccatcccatgcgctgcgggcgtttgatcagcatagacactcaggtcgccacatccgttagcctggagttctacacatgcatccccgcgttattgaggtcaccgaacggcttatcgcccgcagtcgtgcaacccgcgaggcttaccttgcgctcattcgcggcgccgccagcgacggcccgatgcgcggtaagctgcaatgcgccaacttcgcccacggcgtagccggttgtggcactgaagataaaaatagcctgcgcatgatgaatgccgccaacgtggcaattgtttcgtcatataacgacatgctctcggcgcaccagccgtacgaacatttcccagaacagatcaaaaaagccctgcgtgaagtcggctcggtcggccagttcgccggcggtacgcccgccatgtgcgacggcgtgacccaaggcgagcccggcatggagctgagcctgctcagccgtgaagttatcgccatgtccacggcggtagcgctgtcccacaacatgttcgacgcggcgctgatgttgggcatctgcgacaagatcgtccctggcctgatgatgggcgcgctgcgctacggccacctgccgatgatcttcgtaccgggcggcccaatgccctcgggcatctccaacaagcagaaggccgacgtgcgccagcgctacgccgaaggcaaggccacccgcgaagagctgctggaatcggagatgaagtcctaccacagccccggcacctgcaccttctacggcaccgccaacaccaaccagttgctgatggaagtgatgggcctgcacttgccgggcgcctcgttcgtcaacccgtacacgccgctgcgtgacgcgctgacccgcgaggctgcgcaccaggtcacacgcctgaccaaggccaacggcaacttcacgccgatcggcgagatcgtcgacgaaaaatccatcgtcaactccatcgtcgcgctcaacgccaccggcggttccaccaaccacaccctgcacatgccggccatcgccatgtcggcaggcatcatccttacctggcaggacatggccgacctctccgaggtggtgccgaccctgtcccacgtgtacccgaacggcaaagccgacatcaaccacttccaggccgcgggcggcatgtcgttcctgatccgcgaactgctcgaggccgggctgctccacaacgacgtcaacaccgtggccggtcacggcctgagccgctacacccaggaacccttcctggtcgacggtgaactggtgtggcgcgaaggcccgattgaaagcctcgacgaaaccatcctgcgcccggtggcccgcgcgttctccccggaaggcggtttgcgcgtgatggagggcaaccttggccgtggcgtgatgaaagtctcggccgtggccctggaacaccagattgtcgaagcaccggccgtggtgttccaggaccaacaggacctggcggatgcgttcaaggccggcgagttggaaaaagactttgtcgccgtgatgcgcttccagggcccgcgctccaatggcatgccggaactgcacaaaatgacgccgttcctcggcgtgttgcaggaccgtggctttaaagtggcgttggtgacagacgggcgtatgtccggcgcgtcgggtaagattcccgccgcgatccacgtcaaccccgaagctcagagcggcgggccgctggcgcgggtcaaagatggcgatatcattcgcgtcgatggcgtcaacggcaccttggagcttaaggtggacgccgaagaatttgcagcgcgcacgcctgccacgggtctgttgggcaataacgtgggggccggtcgcgagctgtttgcatttatgcgcttggccgcaagctccgcagagcagggcgccagcgcctttacctctgccttggagacgcttaagtgaagcttgcgctggtcggtgatattggcggtacaaacgcccgttttgcgttgtggcgggatcaggcgctgcactcgattcgcgtgcatgccacggcggatcacaccagccctgaagaggccatcaaggtctacctcaaggaagaaggcctgcacatcggcgacatcggcgcggtgtgcctgtcggtcgccgggccggtaagtggcgatgaatttaaattcaccaacaatcactggcgcctgagcaaaactgcattctgcaaaaccctgcaagtggatgaactgctgctggtcaacgacttcaccgccatggccctgggcatgacgcgcctcaagcccgacgaattccgcgtggtctgcgaaggcaccccggagccgtggcgcccagccgtggtgatcggcccgggcaccggcttgggcgtcggcaccttgctggacctgggcgaaggccgttacgcggcgctgccgggcgagggcgggcatgtcgacctgccgctgagcagcccgcgtgaaacccagctgtggcagcacatctacactgaaatcggccacgtcagtgccgaaaccgccttgagcggcggcggcctgccccgtgtataccgcgccatttgtgcggtcgacgggcacaccccggtgctggatacgcccgaagccattacggcggcgggattggccggcgacccggtggcgatggaagtcttgaaccagttcagcatctggctgggccgtgtggcgggtaacaacgtactgaccaccggtgggcgcggtggggtgtatatcgtcggtggggtgattccacggtttgccgacttctttatcaacagcgattttgccaagagttttagcgacaaaggctgcatgagcgactacttcaaaggcattccggtgtggttggtgacggcgccgtattccgggttgaccggggcgggtgtggcgcttgaacaggcttttgcgtaggggctgatggcctcatcgcaggcaagccagctcccacattttgaaatgcattccaaatgtgggagcgggcttgcccgcgatagggcctcaagagccacaaatgacttaagcttggccataacaacaaggaggaccccgtgagcgtaatcagtaaatcgattctcctcgtcgacgacgaccaggaaatccgcgaattgctgcaaacctacctcagtcgcgccggcttccaggtgcgtggcgtgtcggatggtgcggggttccgccaggcgatgaacgaggcgccgtgtgacctggtcattcttgatgtgatgttgcccgacgaagacggtttcagcctctgccgctggattcgccagcacccgcgccaggcgcaggtgccgatcatcatgctcactgccagctcagacgaaaccgaccgcgtgatcggcctggagctgggcgccgacgactacatcggcaaaccgttcagcccccgcgagttgcaagcgcggatcaaggccctgttgcgccgtgcccagtttggccaggagcgcagcagcggtggcgatgtgtgggtgttcgatgaatggcgcctggacatgatcagtcaccgcctgtttcacatcgacggcgaagaggtgattctctccggcgccgacttcgccttgctcaaattgtttctcgaccacccccagcagattctcgaccgcgacaccatcggcaacgccacccgtggccgcgatttgatgccgctggaccgtatcgtcgacatggccgtcagccgcctgcgccaacgcctgcgcgataccgaaaaaccccctcggctgatccgcaccgtgcgcggcagcggttatcaactggcagccagcgtggttgccggcaatgcccactgagcctgtaaccgaacgccgccgccgcttcccggtgccgcgttcactgctggggcgcatgctgctgctgactttgctcgcggtgctgttcgcccaaacactctccagcgtaatttgggtttcgcaattgcgtgccacccagctcgaaggcctggtcaccagtgcccgcagccttgcgcactcgatgacggccagcgtgagttatttccgttcgctgccggtggcctatcggccgttagtgctggaccagctgcgcagcatgggcggcacgcgttttgtcgtgaccctcaacgaccgtcccctggatatgcagatattgccgcagaccccgcgcaagcaggcggtgctgcaagccgtggatgaagtgttgcgccagaccctgggcggcgacgtgcatatctcggtggagttcgtcagtgccgaagacctgcgtattttcaacgccggtttgaagctcgatgagctgccgcgttcctgggcgcattacgcgttgaccctggagccggtaaacccgccggtgctggtcacgcagatccagctggcgcccggcgaatggctgtacatcgcctcgctgctgccggagccctacaccagccttgaagaacaaggcctgccgtcgcagcaggtgtggtttatcgtgctgaccagtggcttcctgctgctgtttatcggcctgttggtgcactggcagagccggccgctcaagcgcctggcgcgggcggcgcgggacatgtcgctgggcgcggacgtggagccggtggccgaaggcggcggcagtgaagtggtggaagtaggccgtgcattcaacgccatgcgcgaacgcatcagccgttacttgaccgaacgcagccaattgttcagcgccatttcccacgatttgcgcacgccgatcacgcgcctgcgcctgcgcgtggaactgctcgaagacgaaaacctgcaaaccaaattcggccgcgacctggacgagttggagttgttggtcaaaggcgcgctgcagtgcgtaaaagacaccgacatccacgaaaatatcgagccggtcgacctcaatcacgtgctcgattgcctggttgaaccgtacctggcgcccaacggcaacggccgcatcacccaggatgggcgagccctggcgccgtacgcaggcaagccgctggcgctcaagcgctgcatcggcaacctgatcgacaacgccttgaagtatgggcagaacgcgcatttgcatatcgaagatgattgtgcagtgttcatcttgcacgttgatgatgaagggccaggtgttccggagcagcgcctggagcaagtgtttgaaccgcactttcgcctggccggccagcaacagggttatggcctgggcctgggcattgcgcgcaacattgcccacagccatggtggcgaggtgagtttgcagaatttgcgtgagggtggtttgcgagtgaccttgcagctcccgcgaaccctggactaaagcacaccgaggatcaaatgtgggagctggcttgcctgcgatggcggtgcatcagtcgaacattcgctgcctgacccaccgctatcgcaggcaagccagctcccacaatgatacttgcggtgattcagatgctttggcgcaatctggccaagtctcttaagggcggcgctccaaacaaccggctgtattcgcggctgaactgcgacgggctttcataccccacccgataccccgccgccgaggcttccagcccttcggcaatcatcaaccgccgcgcttcctgcaagcgcagttgcttctggtattgcagcgggctcatggcggtgatcgccttgaaacggtggtgcaaggtcgagacgctgaggttcacttccttggccaggtcatcaatacgcagcggctgttcatagttgccgttcaaccacttgatcgcctggctcacacgatggctctgactgttggccacggcgatttcatacagccgataaccctgcggcccacgcagcaggcgatacagaatctcgcggttgatcaacggcgccagcatcgcgatgtctttggggctgtccagcaggcgtgccaggcgcagcacggcatccagcagctgggtgtcgatgcggtcgacatacatgccgcgcgaagtggggcgagagggcacgcccatcgggccggcctcggcgatcagtgccgtcagctgcgccgggtcgatgttgatgcgcactgacaggttcgggtcttccggcgtggcgtcgatgatccgcccggccaccggcatcgcaaccgagaacaccagatagttgagtgggtcgtaggcaaagatctcgtcggccaggcgtacttccttgctgccgctggcgaggatgcacagcgccggctccaccagcaccggcatgaagtcgcgcggcgtgttgtggcggttgagaaacagcgaggtgatcgccgtgccgtaggaaccgtcttcccaggtatgccgatgcacgataccggcgagttcggcgcgctgtttttccatctcggcatcgaggggaatgggcttggggtccggcgacgacatggggtgtcctctacacgcttgtttgatgggcccagcttagcggcggctttcgaaaaagtgttacgtcgattctgcacaatccttgcctgatcctgcgagaggtcgcgaatcaggcaagtacctggcctgtcatgtgcctgaaatactgagcatgggcctggaataaaccttgggggccaaacgtcttatctacgcttctcgcaggattgtgcaataagcctgcaggaattgactaaccgcgcccacacccgcgccgttatctttgatcctgtggcaacacgccctcacagtgcttgccgagcatcacttctcaacgggagagtcgaacatgtccacccccattcccgcgagccatatggcctttatccgtgcccgtaccgggtgcagcaccgaactcggtgcacgcttgagcagtttgatcgaacccggccgtcaggcgcagggttgcctgcaattctcgttgcagcattcccaggtcgatcctgatgtatggctggtctcgggcttctggagcagcgagcaggcgatgagcgcctacttcaattctccggcgctgatgatctttaccgagctgttgaacgacatggtcgtgcgcagcatggacttccagaccttcaccgatgcatccgccgcgcatgcctacggcgagtacctgcaactggccggttagcggttagaatggccgactttccattggccaggacctgcaacatggcacgtaaagagtttgcccaccacgaagccgtttccgccttggtgcgtgaagaagaaggtggctacagcgctgccatcgccgtcaaggcactggatggcatgggcgcacccaagtttcacaagatccttgaaggacagacgttcaagaccgccgacgacgccgacaatgcggctgccgagcaattggagcggttggtcgatgtggacgaagagggtcaactgacttgggcaacagctgctaactaaacaccaccaccgatcaaatgtgggagccgggcttgcccgcgatagcggagtgtcagccagccaacaagtcggctgtttggccctcatcgcgggcaagcccggctcccatatggatctgtggtgtttgttcggcggtatttcaatcagcgagggcgatacatcttgaacaacgcttccggccccagctggaagtaatccgccggcccaccaccgcgcaagatcggctcggcagcggcggtgtcgtagatcccgtccttgagcagccatttggcaatgtgcaccgccaccacctcgcctaacaccagccagcttggcaccaactctttgtccgcacgctgtagctgaatgatctgcgtcaccttgcattcgaatgacaccgggctttcgcccacgcgtggcacgccgacaattttcgaggcgaccggcgtcaggcccgacagctcgaattcattcacttgcggcgagaccgccgcgcagctctggttcatctgctcggccaatgggcgagtggccaggttccatacaaactcgccggtctgttcgatgttgttcaggctgtctttgcgcccgacactggaaaacccaatgatcggcggaatgtagttgaacgcattgaagaagctgtaaggcgccaggttcaggtggccttcgcggtcatgggaagaaatccagccaatcggccgtgggccgacgatggcattgaacggatcgtggggcaggccgtggccgttggcgggttcgtagaagtggatatcgtcggacatggcctgggtctgctctcaattcttggaagcacatcatacccaatgtgggagcgggcaagcccgctcccagattttttagtccgtggtgatacgagagtgcttgcgggtgtccttcatggtcacgtaaaccaccagcgacacggcaatacacgccgtcacataccagtagtaaccggtttccataccaatgctcttgaaccacagcgcgatgtattcagcggtgccgccgaagatcgacacggtcagcgcatacggcaggcccacgcccagggcgcgaatttcggtcgggaacagttcagctttcaccactgcgttgatcgaggtgtagccgctgacgatgatcagcgccgccatgatcaggaaaaacgcgccccaccagctttggatggtgtgcagggtggtgaggatcggtacggtgaacagcgtgccgaggatgccgaaggcgatcaggatcgggcgccggccgactttatcggacagcccgccgaccaagggttgcaggcacatgaacagaaacagcgtggcggccgaaatggtggtggagtcggagatgctcatgccgacggtgttcaccaggtatttctgcatgtaggtggtgtaggtgtagaacgccagggtgccgcccatggtcaggccgaccacggtcaacacttccttggggtggcgcatcaaggtgcgcatcgcgctttccttggctttttcctttttggtgaacgactcggtttcttccatgccgcgacgcaggaacagcgcgaccactgcgcacaaggcgccgatggcgaacgggatgcgccagccccaggcgtacaactgctcggtggtcagcacttgctgcagcacgatcaataccgccagggcgatgagctggccggagatcagcgttacgtattggaagctggagaagaaaccgcgacgttccttggtcgccatctcactcaggtaagtggccgaggtgccgtactcgccacccaccgacaggccttgcagcaaacgcgcgaacaccagcaggatcggcgcgccgatgccgatggtgtcgtaacccggggtcagcgcgatcagcagcgagccgaagcacatcagcaagaccgaggccatcagcgcggccttgcggcccttgtagtcggcgtagaggcccatcagccagccgccgatcgggcgcatgatgaagcccacggcgaagatcgcagcagtgttcatcaactgggcggtggaggagccggcggggaagaaggtcttggcgaagtacagcgagaaggcagcgtagacgtaccagtcgtaccactcgaccatgttgccgacggagccgctgaagatcgatttgatccggctggacgtcgtgcgttctctggccggcgcagccgccgaccccaaaggcaaggtgttggagttatccattgaaggatccttcatctaattgtttttgtggagcggcgcgaacgctgcctggttcggctatagcagaagctgtgccaggtagatgaaggcccggtttagaagggtttcagaatatttttgagcggaaagttgctgatggtttgggggtgatgagcggaaatccgcttatggcgactgccctcatcgcaggcaagccagctcccacatttgaatgtgttcacaaatcaaaaggtgggagctggcttgcctgcgatggcgtctgtgaacacaacacagaaaatggcctacaggaaggtatcccgcaccaacccatgccgctgcatcttttcattaaaggtgcgacgcggcagttgcaactccgccagcactgccttgatatcacccttgtgccgaaccagcgccgctttcaggcaatgcgcctcgaatgcctcctgctgcgccgccagcgattgcccggcctcgataccttccggctccggctcacccaggcccagcacttggcgctcggcgacgttggccagttcgcgcacattgcccggccaatcatggctgagcaaccgccccagttgcgcaccgctcaagggttcggcgctgcggcccagccgctcggcagcgctttgcgcaaaatggtcgaacagcagcggaatatcttcgcggcgctcgcgcagcggtggcaggcgcagttgcgcgacgttcaggcggtaggccaggtcttcgcgaaaacgcccggcgcgcgcctcttcgagaaggtccggcttggtcgcggcgataatgcgtaaatccacgtgaatactttggttggaacccagtcgctccagcttctgctcctgcaacacgcgcagcagcttcacctgctgggccagcggcatgctttcgatttcatccaggaacaacgtgccgccgtgggcgtattccaacttgccgatgcgcttgccctgggcgccggtgaacgcgccactttcgtggccgaacaattcggcttcaaacagctgctcggggatggccgcgcagttgagcgctacaaacggctttttcgcgcgcgggccgaaatcatgcaggcagcgcgcgaccaattccttgccgctgcccgtctcgccacggatcaatacattgaccggcaagctcgccaggtccagcacctggcggcgcaaattctgcaagccgcgggacacgcccagcaggctcgactccaactgcgctcgatggtcggcctgttgatgcaggcgacggttctccaggatcagcccgcgtttgtccagggcgcgccgcaggctattaagcaaggcgtcggggctgaagggtttttccagaaaatcgtaggcaccgtcgcgcatggcttccaccgccatcggcacatcgccgtggccggtgagcaatatcaccggcaggtcggcatcgcggcgccgtacttcggccaacagctccaggccgctgaggccgggcatgcgcacgtcactcaagatcacgccggggaaatccttgggcagttgcgccaaacattcctcggcgcggctgaacagctgcacggcaaaccccgacaggctcaaccattgttcgacggccgtgcgaatactggcttcgtcatcgaccacaatcactgcattcaacataggtcgggcgtctccagcgcaatgggcaaggtcagggtaaacaccgcgccgtcgccacggttgccggcgagcaggcgcccgcccaattcatgcacgatagcgtaggacaccgccagcccaaggccgaggccgtcgcccacgggtttggtggtaaaaaacgggtcgaacacactgttcaagtgttcttcggcaatcccgccgccgctgtcgctgacggtcagccgccacaattgttggtcggcgtgcaggcggatttccaggcgtttgcgcggcttgtcggccattgcgtcgagggcgttgcgcagcaggttgatcagcacctgttccaggcggatcgcgtcgccgcgtacccaggcggggcgcgtcaggtccagcaccacgccgatggcctcgtcgcgcaggcgtgcatcgagcaagtgcagggattggtcgaccacggtggccaaatccagcttttcacgcaggccgctcgggcttttgcgcgcgaaggtcttgaggtggccggtgagtgcggccatgcgtgtgagcatatcgtccagcggcgtcagtgcctggtaggcatcgtccacgcggccatggtccagcagcaggcgcaacgtcgccaactgcatgcgttgggcggtcagcggttgattgatttcgtgggcgagggcggcggacatctggcccaatgcagccaacttggccgattgcaccagaccatcctgagccgtgcgcagcgcctgggtgcgttcctcgaccagttgctccagttcttcgcggctgcgttggcgcaggcggtccaggcgccagcgttgggtcaggaacagcaccagaaacaccagggccaaccacgacccggcggcggcgaggccggcgttgcgttggtcttcaaaggcaaattggggtttgcgcagcaggtgcagcgtccagccttcggccttcagcggtagagattcccagatgtaattggcattgccgtcggggccattgacgcgcatcaggtggctgttttcgccgaagcgctgcagggtgctggtttccaacggctgcagttgttttttgtcgtactggcgggtggccttgagctcggcgaggtcactggccgacagcggtcgcaggttgcggtaacgccaacccggctggttggcaataaacacaatgccgcgcgcgtcgctgaccagcagcaagtcattgccttgggcccattcgcgttcgagctcagggaattccagcttcacgaccatggcgccgaggaactggtcgtgctcgtcgaccactgcgctggagaggaagtaacctggaatcccggtggttacgccgacggcataaaaacgcccggtgccctggctcaaggtctggctgaaataagggcgaaacgcgtagttgtgtcccacataactgctcggcaggttccagttgctggcggccacggccaggccggtgcggtccatcagttcgagcgtggaagactgcgcggcgccgttgatgcgctccagcttgcggttaagcacgtcctgagtcgcggcatccaccgggtttttcaacgcgttgatcatctccgagtccagcgccaacacggcgggcagggcgcggtagcgttcgatcagcgtgtgcagggagttgccatagagcgtgagctgttgattggcgcgagcggcgtcatcgaccagggcttggcgttcggcatggcgagtggccaaggccgcggccagcaccgcaccagcgatgatcagcagggagtagaaggtcaggcgcaacgggcgtgggatcgcgatcatacgatgatgaacaggcacggtaaggggcgagcaccatagcatgcacgacgtttatgttgtggcgtgcggggttgtgtgggagcgggcttgctcgcgaatgcggtgagtcagtcactgcagatgcagattgatccaccgctttcgcgagcaagcccgctcccacatacccgcgttcgccataaaaaaggcgactgggccgtggggccgcagtcgcctttttccttgcagtgaggtgcttactgcacttctaccgccaggctttcactgatctttttctgccagatggcaggaccggtgatgtgcacggattcgcccttgctgtcgacagcaacggtgaccggcatgtctttcacgtcgaactcgtagatcgcttccatgcccagctcggcgaacgcaacaacgcgcgacttcttgatggcttgcgccaccaggtaagcggcgccgccgacggccatcaggtacacggccttgtggtccttgatcgcttcgatggcggtcgggccacgctcggatttgccgatcatgcccagcaggccggtttgctcgaggatctgacgggtgaacttgtccatccgcgtcgcggtcgtcgggccggcagggccaaccacttcttcgcgcaccggatcaaccgggccgacgtagtagatgaagcgacccttgaggtccaccggcagggtttcacccttgttcagcatctcgaccatgcgcttgtgcgcagcgtcgcggccagtgagcatcttgccgttgagcaacacggtttcgcccggcttccagctctgcacttcttccggggtcagggtgtcgaggttgacgcgacgggccgatgggccggcttcccagacgatttccgggtaggcgtccagcggtggcgcttccagcgacgccgggccggaaccgtcgagcacgaagtgcgcgtgacgggtggcggcgcagttggggatcatgcacaccggcagcgaagctgcgtgggtcgggtaatccatgattttcacgtcgagcacggtggtcaggccacccaggccctgggcgccgatgcccagttggttgaccttctcgaacagctccaggcgcatctcttcgatacggttctgcgggccgcgcttcttcagctcgtggatgtcgatggattccatcaacacttccttggccatgactgcggccttctcggcggtgccgccgatgccaatgccgagcatgcccggtgggcaccagccggcgcccatggtcggaacggtcttgagcacccagtcgacgatcgagtcggacgggttgagcatggccattttcgacttgttctcggaaccgccgcccttggccgccacgtccacttccacggtgttacccgggacgatggagtagtggatcacggccggggtgttgtccttggtgtttttgcgcgcgcctgccgggtcggcgaggatcgatgcacgcaggacgttttccggcaggttgtaggcgcgacgcacgccctcgttgatcatgtcgtccaggcccatggtggcgccgtcccaacgtacgtccatgcccacgcgcacaaacacggtaacgataccggtgtcctggcagattgggcgatggccggtggcgcacatgcgcgagttgatcaggatctgcgcgatggagtcacgcgccgctggcgattcttcgcgcaggtaggcttcgtgcatcgcctggatgaagtcaacggggtggtagtaggaaatgaattgcagggcgtcggcaacgctctgaatcaggtcgtcttgcttgatcacggtcatgagtcgcgctcctctataagacgggaacattcaataaaggtggcttcagtgtcgcatcggtcggctgaatccacctttccaaggcgcgtcgcgaagaagagcaagtattgttggcgcgacgctaaaaaggcgcggcagtataacccggcgcggtggccgatacacccgactatggtcaaactctgtggggcatgatttcctgtacgcgacccttctgatagagaccttatatgcctgaactgcacgtcggcgaacgccattggtcggtagccaccggcagcaacctgctggacgccctgaatctggcgggtgtggccgtgcctttcagttgccgggcgggcagttgccatgcgtgcctggtgcgttgtcagggtgaggtcgaggacaagcaacccgacgccctgacctcggcgcaacgccaggacggttggcgtctggcctgccagtgccaggtcagtggggatctgcaggtcgagacgtttgacccgctgcgtgacggtttggccgccaaggtggtcggcgccgattggctgacggcgaacgtgctgcgcctgcggctgcaaccggagcgtggattgcgttatcgggccgggcagcatctggtgctgtgggcggggcaggtggcgcgcccctattcgttggccagtttgccccaggaagatccgttcctggagttccacctcgattgccgtctgcccggtgagttcagcgatattgcccggcagttgcaggcaggagacagcctgcgattgggcgaattgagaggcggcgcgctgcaatacgaccccgactggcaatcgcggccactctggctgctggcctcgggcactggccttgggcctttgtggggcgtgctgcgtgaggccctgcgtcaagatcaccagggcgccattcgtgtgattcacctggcccatgatgcgcacgcgcactatttggccgagcccctggcgcagctggctgcgcagcatcccaacctgagcgtggagctgtggacggcggcggagttgacccaggcattggcgcaactgcggcttgtttcgcggcaaactctggccttactctgcgggcaccctgccagcgtcgaggcgttttccaagcgcttgttcctggcgggactgccgcgtaatcaactgctggccgatgtgttcctgccccgtggttgagcgctgaattcgacagccgcgagatccgccatgaccgacgccattcttcaacaacgcgaacgcgggctgctgattctgcagctcaatcggcccgacaagaaaaacgccctgacccgcaccatgtacacccaattggccgaagcgttggagcaggccgatgcggatgccgctgtccgcgccgtgctgattcaaggcagcagcgagtgttttaccgccggcaatgacatcggcgactttctcgagcagccgcccagtgacctcgacagcccaccgtttcactttatgaaaagcctgctcaactgccgcaagccggtgatcgccgccgtcgccggtgcggcggtgggtattggcacgaccctgctgctgcattgcgacctggtgtatatcagccgcgacgcgcgtttgcgcatgccgtttgtcaacttggggctgtgccccgagtttggctccagcttgatcctgccgcggctgctggggcatgccaaggcggctgagttgttgctgctgggcgaggggtttaccggtgagcaagcggcggcgtggggcattgccaccgaggcgttgggcagtggtgaggcggcattggccaaggcgcgggaagtggctgaacgctttgaaacgctggcgccgggggcagtgcaggtgagcaagcaactgatgaaaagtgttgatcgcgagcagttgcggcaggtgattgaggaagagggggcgttgtttacccagcggttgaagtcgccggaggcgattgcggcgttgtcggggtttatcacccggcgctgatgacgccatcgcgggcaagcccggctcccaccgtcgaccgcaaacccctgtgggagctggcttgcctgcgatgaggcccccaaactcaacacaaccgcccgcttgaaatgcaaaaagccccgccattcacatggcggggcttttgtttttcagcctgtcactcagaccattgggtcgccaacgtgcaggatcttcatgccgttggtgccgccgatggtgtggtagctgtcgcccttggtcaggatgacccagtcgcctttctccaccaccccgcgcttgatcagctcgtcgatggcagcttggctgacttcatgcggcggcaacgaagccgggtcgaacggtacggtgtacacgccacggaacatggccgcgcgggcctgggtttcgcggtgcggggagaacgcgtagatcggcaccgaggaacggatacgcgacatgatcaacggcgtgtagccactttcggtcaaggcgataatcgctttaacgcccgggaagtggttcgcggtgtacatcgcagccagggcgatgctctggtcgcagctttcgaactctttgccaatgcggtggctggaggtcttgctggtcgggtgcttttcagcgccgaggcagatacgcgccatggcctggacggcttccagcgggtacgggccggcagcactttcagccgagagcatcacggcgtcggtgtagtcgagcacggcgttggccacgtcagacacttcagcacgggtcggcattgggttctggatcatcgactccatcatctgggtcgccacgatcaccgctttgttgtggcggcgtgcgtgcaggatgatcttcttctggataccgatcagctcggcgtcaccaatttccacgcccaggtcgccacgggcaaccatcaccgcatcggaagccttgatcaggccgtcgagggtttcgtcatcggccactgcttcggcgcgttcgatcttcgctaccagccaggcggtgccgccagcttcgtcgcgcagtttacgtgcgtattccatgtcggcagcgtcgcgcgggaaggacacggcgaggtagtccacttccatttcggcggcgagaatgatgtcggccttgtctttttcagtcagggccggcgccgtcaggccaccaccacgacggttgatgcctttgtggtcggacagcgggccgccgatgatcacggtgcagtgcagctcggtcggggtcgcggtgtcgacgcgcattaccacgcggccatcgtccagcagcagttcgtcaccgacgccgcagtctttcaccaggtccgggtagtcaatacccacgacttcctggttgccgtcggtcagcgggtggctggtggagaaggtgaacttgtcaccgatcttcagttcgatccgcttgttggtgaatttggcgatacggattttcgggccttgcaggtcacccagcagtgccacgaaacggccgtgcttggcggccaggtcacgcaccagcttggcgcgagccttgtgctcgtccggggtgccgtgggagaagttcagacgggcaacgtccaaaccagccagaatcagctgttcgaggacttccggcgagttgctggccgggccaagggtggcgacgattttggtgcgacggacggacatgcacagactcctgagttcaagcgctggagaaggctactatgctctttcgttgtagtcattgttcgtttgcactacttatcgacgattggcttgtttttgcagcggttgaatcgacgaacatccttgaagattttcgacgaggggtcgatacactgctcaagacaggagaacccccatgcgaattttgctcgttgctgccctggccgtcagtgttgtcggctgtacccgctggtcgatggaccaccatttgaacaatgcttaccgcgcctatggggtgggcgattgcgagcgcgttaccctggaattgtcccaggtcgaccgtgagagccgtacccgtcgttatgtacaaccggaggtctcgatgttgcgcggacaatgcctggaacggcagaagttgttcgtggacgccgtacaaacctaccaattcatcatcagtcagtacccgacgagtgagtacgctttccgcgctcgcgccaggctcgacaccctgcagcaattggggcattaccccggcgccagcgtcgcgaagccacggccagcgtctttgtaattatatttgtcatgctgtagctggcccgacgccagtcttgggctattctttgagtgttcgtttgtacaagtttctactcaaacgaatgcgaggcccggattcggcagctgtttagtgaccataacgctgtacgttgtcacaccgagatccagggagagcgagccatcggctcgttccgaatcactggcacggccaaaacatggccattggatggcgatctcacatgtttatccaccgacggatcgagcggcaccagttacattgctttctgcaggtgttcaatcgtcttaccgacaagcctatcggttttctgggcaatgtttccgaaaacgggctgatgttgatcagccaattgcccatgatggtcgatgtggacttcgagttgcgcctgaaagtccctgggccggacggcgaactccaggccattgaccttaccgcgacctgcttgtggagccatgaggacatcaatcctcagcattatgactccgggttcagcgtgattgatgcgtgcgaagagtacgggcaactgatcaccgccttgttgaactacttcagttttgatcccttgcaggcatccgcctagacactgtgtgttgtcggccgggttcggtttgttacccgaacctggtcgtacacttgcgttcaaaatacgccggctttcttccaacccagataacgcgtcaccagggcggcacccagcgccgaaggtgaggtgtccactacggacaacccatgcgcgctcagccggtcgtggagttcgttacgcgtattgaggtagtccactgtgccgctataagccagcgcctcgggcaaggtctgcacgggggcctggcgcagttgatcaagcacctcctcgcgcaggctggccaccaatacacgatgctgtcggctgatgcgtttcaccgctgtcagcagtgcttcatcgtcttcatcgcgcaggttcgtgaccacgatcaccagcgcccggcgtttctgccgcgccagcagttggctggcggcggcctggtagtccgcgctgcgccgggtggtatccaggtcgtacaccgcattaagcagcaggttcaactggccgctgcccttgaccggcgccaggtagcgtggctggtcaccggcaaaggtgcacagacccacggcatcgccctggcgcagtgcgacatagctgagcagcaggcatgcgttaagcgcgtggtcgaagtgcgataactcgtcatcctggctgcgcatgcgtcggccgcaatcaagcatgaacacaatttgctggtcgcgctcatcctggtattcccgggcgatgggcgtgcgttggcgggcggtggccttccaatctatctggcgcaggctgtcgccttcgcgaaattcacgcagttgatggaattccagccctaacccccggcgctgacgttgttgcactccgagttggctcagccagttatccacacccagcagctgcgcgccgtacagccgggcgaagtccgggtagacgcgggttgtgtcgtcaacttcaataaaacgtcgtgctgaccagagcccaaaggggctgggcaggtgaatttcacaacggctgaaacggaagtgcccacgccgcagggggcgtagccgataacccagctcactgcgttcaccggggcgcagttcgatggtctgaggcaggttttccatgctcaggccgtccgggacgtgatcgaacacctgcaccgtcagtggctgcgggtagttgtgggtgagggtcaggcgaacgtcgccccagcgtccgagcgccaggctgccgggcatttgccgttgcacttgcacagaagggcgccgacgcaagcgtgcagcatccagcagggtcagcagcaacagcgccagcagcaggccccaggcgaccgaatgcaaggtgtcgggcaccttgaactgcaatcctgcggcaacgccgagcaaggtgttcaggcccagtagcgcacccagccaggccagcagcagtcgggtcggcttcatgggcacgtcactgccgcggcgccgcaatctggtccagcaactgcttgagcacctggtcgacctcaaggccgtcgatgtccaactccggtgcaatgcgcacccggtgacgcaataccgccagcgcacagcccttgatgtcgtccggggtgacaaattcacccctgcgcaacaaggctctggcgcgagcaccgcgaaccagtgcgatggacgcccgagggccggcgccgatagccagcccaggccaggtgcgtgtggcccgcgccaggcgcacggcgtagtcgagcacctgttcatccaacggcagttcactggcaatctgctgcaatcgcagtacgtcctcggcatgcagcacggtgcgcagcggttgcacatcgagcatgtctgccctggatgagcgggtcacctcgcgcaccatctccagctcctgctgtgcatcggggtagtccatgcgcactttgagcatgaaccggtccagctcggcctcgggcagagggtaagtgccttcctgctcgatggggttttgcgtcgccagcaccatgaacggttggccgataggcagcgcctcgccctcgagggtgacctggcgttcctgcatggcttcgagcagggcggcctgagtcttggccggggcgcggttgatttcgtcggccagcaacaaatgcgtgaacagcggccccttgcgcagtttgaactgttcggtatgcaggtcgtagacggcatggccggtgacatcgctgggcatcaggtccggcgtgaactggatacgcgcgaaatcgcccccgaaacaccgggccaaggcgcgtaccagcagcgtcttgcccaggcccggtacgccttcgagcaggacgtggccgccggcgatcagggcggtgagtacgtcgtcaatcacctggtcctggccgatcactgccttacgcagttcaacgcgcagggcttgcgcctgcccactggcgtgttgaagggtttcgctggtcggggccgtggctgctggaaaatcgctcatagggcattcctgagagtttgcaggcacgccacttggcggcagaaatcggcgctgctgagccgttttgccgggagtgggccgagggcctgactaatgacgtgggagggttggcgcgtcaggcgttcgagcacctgccactgttcagcggtttcgaggtgttcaaagcctgggtgacgccgtcttgcagcgcgttggacgtcacgctgcaaggcttgcaggagtgggccctggccactgcggcgcagcaggaagtcggcgctggccttcaagtgttcctgcaactgccggcgtgccttgggcgccggcgcctggattgggccttggcgcatgccggcctgccacagcgccagggcaatcagcgcaacaaatgccaccagggcctgggggaaatagcgcagcaacagggtcagtaaattgtctacgtcactgttgaacagcaaggtcacgtcagtgccctggttgagataccacagcagccaggcgttgtcgtgtttgccgatggccggggttttccacaggtcgctgtcggtcacaaccgtcacagtgccgttgccgaagtcgagttgcatcaggtggctggccttggcgctattcgcggaaaactgtgcgacgtgtgtggggtcggtaaggttgaaggcggtatcgaagctgaaataggccggggccgtttcattgtcgacgtagagcttggtcagatccggagccgctttctttttgcgcggggaggccggctcgtcagggacgtcactcatcagttggtggatgttcaagcgatcaagcagcacgtcgccgctcttgcctgtttcttcatcccataacgcttctgcaaccaccagcaggtgcccacccgacttggtccagcccaacagttgatccacttggcgcggggtcatgttgctgcgttcgcccaggatcagcaggctattgcctttggccgggagttgggtgagtcgttcgaggttgttggcatgctcaacggccaaaccttgctcacgtagaaaatgctcggcggccaggtaggggttctgccgggcctggggcgaagggccgcgatccaccacctcgtcataagggattgccttgtgccaggcataaagggctccggctcccagcaggcaggccagcagtactccgatccagaccaatgggcggttcattgggcggcccccgcactgaacaacgcacgccaatcggtgcagagcttctgctgggcaaaggccggaggtaggtggtgaccgtaggcgaggttctgccagtgacgggtcaattcttcactgaacgcgagcagctggggttgatgcagctggtgaatgcgctccagcacctggccttcggtatcggcgcttttcagtggcaggttgtagtcatgcagcaatcgactgagcaggcctcgatagagcaggccaagggcttcgcgcggctgagtgagccacagttgctcggcggtactggcaatgtcttccggcaacgtctcgatacccagttccaggccgaacaactgcgccggggctggcttggtgagtttagggctgggctgcgggcgccagccgacaaaggcgcgcagccagtcacggtagcgccagaccagcacggccaagagaccgatcaccaggctccaaaggataacttccaagccctggccgacatgtttgaaggtgttgctgttgaggctgtccagcagcgactcaagccaggctggtaatttgccgtcaccgtgcgctttgtttttagtcgcaggcttttcatccccaaaacgataacgcgtgacggtttccgggtttttgaacgggggctgctccagcacggtcttgatcgattgggcggcggcctgagtactgagtggcgtgcgtgcgtttgagtcgccagccatggccggtgggctcgacggcagcagcaacagcccgacaaccagcagtagcagcggcgcgacactgctcaggcgttggcgcagtcgacggaataccagctccaggtcccaggcttccagcacggtgcgacgattgaggtacaggctgaaaccgcaggcaacatagatcggctcccagaacaccaggatcagggcgtagaaggcattggtcaggtgttccaaccacagccagtccgatcccgtgctgagcgccaggcgttgccagtcccaatccagctcaacctgatccggtataaacagataaaacatcgccatgcagccaaaccacaggccgatttccaggtgtaccccgatgatggtcagccagcgcgcggcaccggcgttgcgttgcagcagtacccccagacgttgctggcgtgcctggccaccgaggccttcgagttggctgaccggcaacacgaaactgcgactcaggctgagtcgtcgccaggtcaggctgaccagcaactggtttttcagcagccgtggccaatggcgtacggcgtctttgagacgcggcgtttctccaaacagggccttggacaggatgtacagcggcaagcgatcgaaagccggcttgagccaccagaacacgaacatcgccatggacgggtgttcccaaagcaacacggtgagcaaggcaaacaccggcaggctcaccagcgcccaactgctcatcaacagcaggcgatgttcccgggccattaatacgccaaggtccatggcttcccaggcggtacgcgggcgaatcaccacgctggcgtcactcaggcgcatggcggctccgtccagcaagggtcaggtaagtgacgaccatgagccaaagcgcagcgccgacgaggtatttgacccagggagcgatcgatgtggtggaagaccagtaggcttcaatgaaggccgcaatcagcaggaacaccatgacgccacagagcatctgcacgcttttgcgtgccgccaggcgcagggattcgctgcgagccagcggccccggagcgatcagcgcccaacccagttgcaagcccgccgcgccggccaatgcgatggcgctcagctcgaatgcaccgtggccgatgacaaatgaccagaaggtctggccatagccaatttcggtcaggtgtccggaaacagccccaatgatcaagccgttgaaaatcagaaagaacacgctgcccaggccaaacagcaggccggcggcgaaggtctggaaggctatgccgatgttgtgcatcacgtagtagccaaacatcatccagtcttcgctggaggcgcgctcggcagcacggcccaggcggctggcgtccgggtcgtacatgctttgcatttcggcgacctgctgggggctgacgatgctgtagatcaggtcgggaaacatgtagaccagcagggctatgcccgccaggctgccaaagaacagcaggctggcgatcaggacgaagcgccactgttcccgcaccagccgcgggaagccggccagaatgaaggccaatacattcgcgcccagctggctgcggtgacggtacaactgttgatggccacgcagggcaagttgctgcagcggatcgaccaggtaactgctgtagccgcgctcttgggcgagggccaggtgctggcataaacgtcgatagtgatggggaaaatcagccacgtcactcggcttggctttaccctgctccaactgcttgagttgctcgctgaaggcttcccattgggcctggtgacggctttcgaactggctctgtttcatgtcggccccaacaagccacgggccacaccattgagctgttccacggcccgcgccggcgagacttgcaggggcgtggcgaggattgaggccagttcatgcacccgttcgttcgacagctcagcctggcgttcggcgaagccgaggatggcgcgttgctcgctcaggtccagggcaaagggcagtcgcagggcgccagcttgaggaatctgagggcgcagcagtggctgttcacggtagaccaccagcgtgccggcggccaagtcgccgaggcgcttgaaatgaggatgttgcaggcaactgatggcgccgaggaagtaaccgaagggcagcatatcgacgaagcgcagcaggttgcggatcagcgatgcggaccagccgacaggtgtgccgtcgtcctgtaccacccgcaggcccatgacttgtttgccaggggagcagccctgattgagcacctcgaacaggaccatgtaccaccaactgatcaggaacagcagcaatgagcccaggccgatgccgatattgcccagcagggccaaaggcacgagcaggatacccatgatcagcccacgcacgcccaggtcgaaagcaaaggccagcacgcgtggcagaagacctgccgggcgcaagggcagatcaataccctctggggtctcgatctgatagcgggtatccaacgggggtgatggcattgcgatccttggcagtgcgaggcggttcagagacacggatgctagcagtgtcgacgctggaagcaacccttccagtttttactggatgtttgtacaggtcatgtatcgctggccccggacgcctcgcagcgcctagactttgacggtcttcagtacaggaacagcccgtgacctccattttctggtacgactatgaaaccaccggcattaacccgcgcagcgatcgcccgctgcaggtcgccggtattcgtaccgatctcgaactcaacgaggtcggcccgccgatcaatctttattgtcagcccagcgacgatatcctgcctcacccggccgcttgcgcgattaccggtatcacccccggtattctggcggaaaagggtttggccgaagccgacttcatgacccgcgtgcacgccgagctggccgcgccaggcacctgtggcgccggctacaacaccctgcgttttgacgatgaaatgacgcgctacagcctgtaccgcaacttttttgacccctacgcccgtgaatggcagggcggcaacagtcgctgggatttgatcgatgtcgtgcgcacagcctatgcgctgcgccccgaaggtatcgtctggccggagcaggacgggcgcgtcacccttaaacttgagcgcttgaccgaggccaatggaattgatcatggccaggctcacgatgccttgtcggacgtgcgagccaccattgcactggcccgtttggttcgggagaaacagccgaagctatacgactggctgtttcagttgcgcagtaagcagcgggtgatggaccagatacgcctgctgcaacccatggtgcatatttccgggcgtttttccgccgagcgtcattacctgggcgtggtgctgcctctggcttggcacccgcgcaaccgtaatgcgctgattgtctgtgacctggggctcgacccgcaggggttgctggatctggacgccgctaccttgcgcgaacgtctctacacgcggcgcgatgatttggcggagggggaactgccggttccgctcaagttggtgcatatcaaccgctgcccggtggttgcccctttgaatgtgctgcgggcacaggatactgagcgcctgcagttggatatggcggcgtgccaggcgcgggcgctgcgactaactgacgcacaggaagtttggcgcgataagttggcggccatttacgccgaggaagattttgcgccgaatgcagatcctgagcagcagctctatgacggttttataggtgatcgcgaccgtcgtttatgcgaacaagtccggtcggctgaaccggcacatctagcgcatcagcagtggccttttgatgatcatcgattgcctgaactgttatttcgctaccgcgcacgcaactttcctgacaccttgaacagcgaggagcaacagcgctggaaacttttttgccagcaacgtttgtcgaatccggagtggggcgcacccaatacccttttggcatttaaacaggcgcgtgaggagttggcccttagtgctacatcgtttcagtgccaggtgcttgatcaatggcaggagtatgccgattcattagcggctcgcctggcgctgtagtcaggcaattgcagaattatcggaaataaaaaaacgccagcaagctggcgtttttaatgtgctgcatatcaggcaagtgcccgaccaggcttagcccagcagggtagcccagccttcaacgacgtcgccgccccacttggctttccactctttcagggttttgtggttgccacctttggtttcaatcacttcgccattgtgcgggttcttgtattgcttgaccttgcgagcacgcttggtgccggtagtttttacagcgccacgcggtgctttaactttcgactctggatccagcagcgcgatgatgtcacgcagggatttggagtattcacccatcagggtgcgcagtttaccttcgaattccagctcggtttgcagcttgtcgtcttgggacaggttcttcaaacgggcttgcagctctttgatagcttcttcggtggcacggtattcgttgatcagagacatgtggactaccttatgtagagcgctgattgacaggggaagtgagctaataatagtcaggcaattacctcaagtaaacatttaaggacgtatttatgtgaattacgttgaatgtttgtagcaaggctacgcaatcgagttaattagtaggtgcaaagcgtaaagataatctcggttattttccgataactgcccgtgctcgacgttgtacagacatatagcggtagtaaaaccttacgctattaagggctgtagccagggcgcgcgggcagaataaggcgcaaggaatactgcagtttttctgcgtaatcgctagaatggcggcctttgcgaagttctggagttcccccctaatgcgcacttttcggctggtgattgcttgcccggaccgggttggcatcgttgccaaagtcagtaactttctggcctcccacaacggttggatcaccgaggcgagccatcactcggatgatctcagcggttggtttttcatgcgtcacgaaattcgtgccgacacgctgccctttggtcttgaagccttccgtgaggcgtttgcgccgatcgccgaagaattctcgatgacctggcacatcaccgacaccgagcagaaaaagcgcgtcgtgctgatggccagccgtgagtctcactgtttggccgacctgctgcaccgctggcacagcgatgagctggactgcgagatcgcctgcgtgatttccaaccatgacgacctgcgcagcatggtcgaatggcatggcattccgtactaccacgtgccggtcaatccgcaggacaaggagccggcatttgccgaagtctcccgcctggtcaagcagcatgaggcggatgttgtggtgctggcgcgctacatgcagattctgccgccggaactgtgccgcgaatacgccggcaaggtgatcaacattcaccacagcttcctgccgtcgtttgtgggggccaagccttaccaccaagcctcgctgcgtggcgtgaagctgattggcgccacttgccactacgttaccgaagagctggacgccggtccgatcatcgagcaggacgtggtgcgtgtcagccacagcgacagcatcgaagacatggtgcgtttcggccgtgacgtcgagaagatggtgctggcccgtgggctgcgttatcacctggaagaccgcgtgctggtgcatggcaacaaaaccgtggtgttctgataaccgcgttttgaacgattgaagaataaagggcctgggcgttaaatcgtcccaggccctttttctttgcctgccattgaggattgatcgatgagcgatccactcgacaaagccacctccaaagccccggcgacgctgggggaggggtgtttgagccgatttgacccggatgacctggacgctgaggacggcaccgagtttcccggtgccgccgagctgtgggagcgtgagcacggtaaacccgagccctcgcaagactagtctgcccgccgtcgtatctgccggcgggcacgcaggtcagatgcggaaactgcccactagttgcttcaagcgtgacgcctgttgttccaggtcggtgcaggcgcgcagggtcgagtgcaggttttccacgccttcctggttgagggtgttgatctcggtaatgtccatattgatcgactccaccaccgaggtttgttcctcggtggccgtggcgaccgactggttcatgccgtcgatctcgccaatgcgctgggtcacgctgttcaagcgctctccggccaggttggcgatttccacgctgtcctggctgtgacgctggctttcactcatggtactgaccgactcccgggcgccgacttgcagttcttcaatcatcttctgcacttgttgcgccgactcttgagtgcgatgggccaggttgcgcacctcatcggccaccactgcaaacccgcgcccggcttccccggcacgcgccgcttcgattgcggcgttaagtgccagcaggttggtttgttgcgagatgctggtgatcacttccagaatttgcccgatgttcacggtcttgctgttaagcgcttctatattgctgctcgatgcgctgatcatcgccgacagttgagtcatcgccttgatattgcgatcgaccacctgttggccgtcctcggccaagtgccgcgcatcgctggcctggttggaggcttgtgcggcattgcgtgcgatttcctgggcagcggcacccaactcgttgatggcggcggcgacgctgttggtacggttggcctgctcgtcggaattgaccatcgacgaattggacgcgctgaccacgcgcaaggcgacctcgttgacctgctcggtggccgaggacacttcccgaatcgacgtatgaattcgctccacgaagcgattgaaggcgttacccaggctgccgaattcgtcgttgttctgaatggtcaggcggcgggttaagtcgccctcgccatcggcgatgtcttgcatggcgcgggtcatcacgtgcaagggttgcagcagcacgcggatcaacatgcccagcagcgcaatgatgatcaccacggcaatgagcgtggcgatcaccgccgaggtgcggaattcgctgagcatggcgaaggatttgtctttatctactgaaatacccaggtaccagttcaccgaaggcaagcccttgatcggtgtgaaggtcacgatgttgtccttgccgttggcctggacttcgctgaagtccgcgctgatcttcggcgtgtttttcgggtacacgtcagccagggtcttcatcaccaggtttttgtccgggtgcaccagcactttgccgtcagcactgaccaggaacgcatagcccatgccgccgaaattcaacgcgccgatgttatccaccagggtttgcaggctcaggtcgccgcccaccacgccgacgctctggccagccttggtggcgctcggggtggccacggaaatgatcaactgcccggtagcggcgtcgatatagggttcggtcagagttgacccgttgctgctttgggcgcccttgtaccaggggcgaacgcgcgggtcgaagccgtccggcatcttggtgtcggggcggatggtgaaggcgcctttgctgtcgccgacgtaggtggccatgaacgcggaggtcagggctttctgctcaagcaggccggcaaccacactgggttcgggattgatggcgatgttttgtgcggcgttttccaccagggcaatgcgcccgttgagccaggtttggatattgctggcggtgacgtcgcccatttcatgtaggtagttattgaggtcgtcgcgaatcgcgttgcgttgcaggtagtcgttatagagggtaaacagcgcgaaagcggcgatgacgataagggaggctgcaagcaggattttgtggctgaagcgcaggtttttattcatggcttgtagggtccgctaaggtcttaatatccgaagcgcgtccttatgggacgcgcaaaatgacagcgtcaaaaaaggtgtgatacttcttgtgatagctctgctggtccctgtaggagctatctgacctatttttagactttgtgggtcttacatcgctctatatcgacctggcggcactaaagattaatcaaaggtgacgaaatgcctgactcctcgcaactgcttatcggcgccggcctcgatggccggccaatcgcccaggccatgcgcctggccaaccgccatgggttgatcgccggtgccaccggcacaggcaagaccgtcacgttgcagcgcctggcggaggccttcagtgaggcgggcgtggcggtgttcgccgctgacatcaagggcgacttgtgcggtttgggcgctgcggccaaccctcaaggtaaagtcgccgagcgcatcgcaggtatgcctttccttaactacacggcgaaggcctatccggtaacgctgtgggatattcacgggcagtcgggtcatccacttcgcaccaccatcagcgaaatggggccgttattgctcggcagcctgctggagctcactgacagccaacaatcggcactgtacgccaccttcaaagtggcagaccgcgaaggcctgttgctgctcgaccttaaagacctcaaggcattgctcaaccacttgcgctatcacccggaactgctcggtgaagacgcggcgctgatgaccaccggttccagccaggcgctgttgcggcgcctggcggtgttggaacagcaaggtgccgaagccttgtttggcgagccggcgctgcaactcgaggatattttgcaaccggccagtgacggccgtgggcgcatccacttgctcgacgccagccgcctggtgcatgaggcaccgaaggtctacgcgacgttcctgttatggctgctggccgagctgttcgagcaattgccggagcgtggcgatgccgacaagccgctgctggcactgtttttcgacgaggcgcatttgttgtttgccgacacgccgaaggcgctgcaggatcgtctcgagcaagtggtgcggttgattcgctctaaaggcgtgggcgtgtactttgtcactcagtccccaggtgatttgcctgacacggtattggcgcaactcggcctgcgtatccagcacggcttgcgtgcgttcaccacgaaagagcagaagtccctgcgtgcggtcgccgacggtttccggcccaacccggcgttcgatacgttgtcggtgctgactgaactgggcacgggtgaggcgctggtgggcacgttgcaggaaaagggcacgccggaggtcgtccagcgcgtgctggttgcgccgccgcaatcgcgaatcgggccactcagtgaggccgaacgcgcggcactgatcgccagttcgccgttgctggggcgttacgacaagcccattgaccgcgagtcggcctatgaagtgttgatggcgcgcaaggaccttgggccgaccgaagaggctaaaccctccactgaagaaccgagctttaccgacaaggccggcgcgtttttgggcacggcggccggcaaggcactcaagtcagccatgcaacaggctgccaatcagatggggcggcaactggtaagagggttgttgggctcgttgctgggcggcagcaagcgtaaataggggctcaggctttgggcttggcgtgcgcggccaaccgctccagggctgcgcgcaggcccgggtcgctgattccatcggccgttgcctggatggtttcggcggccgtcaccgacaggttgatcgtgtgccccactgcgccttgctgcacggtgggtggctgcaccttgaactggatacgcgtcaaactggcaaattcatcaaataccatcaattgtcgctgcaggcgtttttgctggtagcgcaaacgggtcgcccaatggccatcggtgacaattaacagcaaattgccttcacgccaggacgcgacatggcaatgttctcgtgcggcaggttgcagctggctttcgaccaggcgttgcaaatggcccaggcgttgcgcgtggccgaagatggctttcaacggtttggcttcgcggagcaacacgcttggcgcgcgggctgtaagagggcgaaatgccatgtctagacaccttaagtaacagagccgccatcttagcagaaagcgcctgtgcgcccccaggcaatgcgataacaggcctttgcccgtgaaatcaataggtaacttctgcgctccatgggttgaagttccagcaaaagcccttattttaaacaggccctctcacagcgccatgccagcatcggggaataacgccactttcctcacccacgattccgggtagaatgcgcgttcgcatgcggccgtgagggctgctcgggccactgacggtgcgccctccatccctatgtgtggaagaacctgccgatatgtttgcgcctttgttaaagaaactttttggaagcaagaatgagcgcgaagttaaacgcatgctcaaaacggtgcagctggtcaatgccttcgaagagcagatggttgccctttcggacgagcaattgcgcgccaagaccgaagagttcaaggcccgcatagccaaaggtgaaaccctcgacaagctgcttcccgaagcctttgcggtcgcccgtgaagccggtaagcgtgtcatgggcatgcgccacttcgacgtccagttgatcggcggcatgaccttgcatgaaggcatgattgccgaaatgcgtaccggtgaaggcaagaccctggtggcaaccctgggtgtttacctcaacgcactgtccggcaagggcgtgcacgttgtgacggtgaacgactacctggctcgccgggacgccaactggatgcgcccgctgtatgaattcctcggcctgaccgtcggcgtggtaacgccgttccagccgccggaagagaagcgcgctgcgtacgccgccgacatcacttacggcaccaacaacgaattcggtttcgactacctgcgcgacaacatggcgttcagcatggaagaaaaattccagcgcgaactcaactttgccgtgatcgacgaagtcgactccatcctcatcgacgaagcccgtaccccgctgatcatctccggccaggccgaagacagctcgcgcctgtacaccgagatcaacaagttgatcccgcgtcttgagcagcacatcgaggaagtggaaggcgtggtgaccaaagaaggtcacttcagcatcgacgagaagacccgccaggtcgaactcaacgaagccggtcaccagttcgtcgaagagatgctgacccagatcggcgagctggcagaaggcgaaagcctctactcggcgcacaacctgggtctgttgacccacgtgtatgccggcctgcgcgcccacaaactgttccatcgcaacgtcgaatacatcgtgcaagacggccaggtcgtcctggttgacgaacacaccggccgtaccatgccgggtcgtcgtttgtccgaaggcctgcaccaggccatcgaagcgaaggaagggctcaacatccaggccgaaagccagacgttggcgtccaccaccttccagaactacttccgtctgtacaacaagctgtccggcatgaccggtacggccgacaccgaagcgttcgagttccaccagatctacaaccttgctgtgatggtgatcccaccgaacaagccgctggcgcgtaaagacttcaacgacctggtgttcctgactgccgaagagaaatacgcggcaatcatcaacgacatcaaggacggcatggcccagggccgtccgatcctggtgggtaccgccactatcgaaacctccgagcacgtgtccaacctgctcaacaaggaaggtatcgagcacaaggtactgaacgccaagttccacgaaaaagaagccgagatcatcgcccaggccggtcgcccaggcgcgctgaccatcgccaccaacatggccggtcgtggtactgacatcctgttgggtggtaactgggaagtggaagtcgcggcgctggaaaacccaagccccgagcaaatcgcccagatcaaggccgactggcagaaacgccaccaggccgtgctggaatccggcggcctgcaggtgatcgcctccgagcgtcatgaatcgcgccgtatcgacaaccagctgcgtggtcgtgccggccgtcagggtgacgccggttccagccgcttctacctgtcgctggaagacagcctgatgcgcatctttgcctcggaccgggtgaagaacttcatgaaagccctgggcatgcagtccggtgaagcgattgagcaccgcatggtgaccaacgccatcgagaaggcccagcgcaaggttgaaggccgcaacttcgacattcgtaagcaactgctcgagttcgatgacgtcaacaacgaacagcgtaaagtgatctatcacatgcgtaacacgttgctggccgccgacaacattggcgagaccattgccgatttccgtcaggacgtactcaacgccaccgtcagcgcgcacattccgccacagtccctgcctgagcagtgggatgttgccggcctggaagcggcgttgaagagcgacttcggtgtggacttgccggttcagcaatggctggacgaagacgaccacctgtacgaagagacgctgcgcgagaagctgatgaccgagctgctggccgcgtacaacgaaaaagaagagcaggcgagtgccgaagcactgcgcaccttcgagaaacaaatcgtactgcgtgtactggatgacctgtggaaagaccacctgtcgaccatggaccacctgcgtcacggtatccacttgcgtggctatgcccagaagaacccgaagcaagagtacaagcgcgagtcgttcacgctgttctccgagctgctggattcgatcaagcgcgattcgattcgcgtgctgtcccacgttcaggtgcgtcgcgaagacccgatcgaggaagaagctcgcctgcgccaggaagccgaagcactggctgcgcgcatgcagttccagcacgacgaagcgccgggcctggaagcgccggaagtgttgggcgaagaggtcgatgtggccttggctcaaactccggttcgcaatgatcagaagctgggccgcaacgaactgtgctggtgcggttcgggcaagaagttcaaacactgccacggcgaaatcaactaaggtttttgcctgacgctgcaataccccgcgccgcgaccggcttctgccgtcgcggcgttttgccattaatttcaccgtcgacacgacggcacagatatcacctaatttttaaggagcgcattcatggctgttggtcttggtcctttgcccacattgcacccggttgccggttttgaactcggtatcgcttcggccggcatcaagcgcccggggcgcaaggatgtggtggtgatgcgctgtgccgaaggctcgacggtcgcgggtgtgttcaccctcaacgcgttctgcgcggcgccggtgatcctggccaagcaacgcgttgccggttcgatccgctacctgttgaccaacaccggcaatgccaacgccggcaccggtgagccaggcctggtggcggctgcgcgcacctgcgccaagttggcccagttgaccggcgtggacgccagccaagtgctgccgtactccaccggtgtgatcggcgagccactgcccgtggaaaaaatcgaaggcgcattgcaagccgcgctggatgatttgtcggtggataactgggccgccgccgctaccggcatcatgaccaccgacacgctgcccaaaggcgcgagccgtcagttcgtgcacgacggcgtgaccatcaccgtgaccggtatcagcaaaggcgcggggatgatccgcccgaacatggccaccatgctcggctacattgccaccgacgccaaagtctcccgtgacgtgctgcagcgcctgatgctggacggtgccaacaagtcgttcaaccgcatcaccatcgatggcgatacctcgaccaacgactgctgcatgctcatcgccaccggccaggccaacctgccggaaatcacctccaccgaaggcccgctgttcgctgcattgaagcaggcggtgtttgaagtgtgcatggacgtggcccaggccatcgtgcgtgatggcgaaggcgcgaccaagtttgtcaccgttgaagtcaacggcggcggcaaccaccaggaatgcctggatgtcggctacaccgtggcccactcgccactgatcaagacggcgctgtttgcctctgacccgaactggggtcgcatccttgctgccgtgggccgtgccggtgtgccggacctggacgtgagcaagatcgacgtgttcctgggcgacgtgtgcattgccagccgtggcgcccgcgccgaaacctacaccgaagcccagggttcggcggtgatgcagcaggaagaaatcaccatccgtatcgagttgggtcgcggcgagtgcagcgaaaccatctggaccactgacctgtcccacgaatacgtgaagatcaatgcggaataccgcacctgacagccaagaggataagcgcggtgaaacgagtgcatgtagcagcagcggtgatccgtggcgtcgatggcaggattctgctggcgcgccgcgccgatacccaacaccaaggcggcctctgggagtttcccggcggcaaggtggaggccgatgagtcggtcgccaccgcgctgtcgcgtgaattgcaggaagagctgggcattcaggtcaccacggcgcggccgctgatcaaggtgcaacatgactacccggataagcaggtgttgctggatgtctgggaggtctcggcttttagcggcgagccccatggtgccgaagggcagccgttggaatgggtggctccacgggatttgagcaactatgaattcccggcggccaatgccccgatcgttgcggcggcgcggctaccggctgagtacctgatcaccccgggcgagctggaaaccccgacattgctgcgcggcattcagaaagccattgccggtggcatcaagctgatccaattgcgtgcacccaacggctacgaccccaagtaccgtgacctggcggtggacgctgttggcctgtgtgccggtaaggcgcaactgatgctcaaagggccgtttgagtggctgggggatttccctgccgctggctggcacatgaccgcggcgcaactgcgcaaatacgcgagcaagggccgcccgctgccgaaggatcgttggttggcggcgtcgtgtcataacgccgaagagctggcgctggcagaaatgatggacgtggattttgtcacgctgtcaccggtgcagccgacccagacgcatccggatgcccagccgttgggttgggagcaggcggcgcagctgatcagtgggttcagcaagccggtgtttctgttgggcggcgttgggccggctgagcgggaacaggcttgggaagctggggctcagggtgtggcaggcattcgggcgttctggcctgaggtttgatgatcgttcccacgctctgcgtgggaatgcagcccaggacgctccgcgtcccaaagcgtgacgcggagcgtcacaagaggcattcccacgcagagcgtgggaacgatctcagtggggttttgcggcggcctgccacaacacctcagccacacccttgcgcttggcaatcacccgtgccgccacaaacaacaaatccgacaaccgattgatatacgccaaccccacgccttccaacggctccagcgtattcaactgctgacaccgccgctccgcgctgcgcgccaggctgcggcacacgtgggcttgggcgatcagcgccgaaccaccgggcaggatgaagttctccaacggtccgacttcctcgttccagcgatcaatcgccgcttccagccgatcaacttccgccgcattcaatgccttgtacaccggcatcgccagctcaccgcccaagtcgaacaaccgatgctggcaaggtgtgagcacctcgatcacctcgttcagttgcgggtgcttgccgctttgctcttcaaggttggccagcaataggcccaactggctgttcagcgtatccacctcgccaatggcttccacccgagggtggtccttgggcacgcggcggccgtcgccgaggccggtctcgcccttgtcgccggtacgcgtgtagatcttcgacaggcgaaagcccatggtcattgctccagttgagtcaggtcaaaggatggaatctggctgccggccaacggcaggcgcagggtgaagcaagtgccttggccgagggtggagtgcacctccatctggcccttgtggttgttggtgatgatgaaatacgacaccgacagcccaagcccggtgccttggccgatttccttggtggtgaagaacggctcgaaggtccgtttgcgcacgttttcgctcatgccgatgccgttgtcttccacctgaatctccgcccagggcgggttgaggcgggtgcgcagaataatgcgcccaggttcgcggtcgtcttcacgcaggtgaatggcttgagcggcgtttttcagcaggttgagcaacacttgctcaagctcgttggcggtgcccggcaccgggccgagttgtgggtcgaactggcggatgatcgcctggcccttgaagtcgaaacctatggtcaggtcgaagtcgttaccggcaatttctaccgcttggtcgatcagggccggcaaatcacagggcgccatctggcgattgctgagacggctgaaactgagcatatgggtgacgatcttcgccgcccgcgcgccggcttgctggatgccgtcgagcagttgcggcacttcgcggctgtgcaggtaacggttcacggtgtccagttcgacgcccacctgttcggcgtgttccaggttcttcggcaggtcgggtgacaagcgccggcggatgttctgcacgttgtgcaggatcgcgcccaatgggttgttgatttcatgggccatgcccgcagccaggccgccgacggagagcattttttccgactgcaccatcatttcttccagggacaggcgctgggtgatgtcgtcgatacggatcaccacgccgcgcccggcaccgcccatcagcgggtagaacgtcagggcgtaatgcttggcctcgtcatccttgatccaggtgacgcgctcaatccgttccaccgtgtgttgctcaaccgtggccttgatttgcggcaggtagggcttgagtggctggaacgcgaggaagatcggctggttcagcgcttcatccaggcgcgtgccggaaagtgcactggcctcctggttccattgggttacgtagagctgctcatcgagggcgatcagcgccgagggcatcgagtcgataatgctgttcaggtaattctggaaaccggtgagtttcttctcgatcttgctgcgcacctggacttccagttccagcttgcggttggtgtgtcgcgtttcttcggccaggccttgggcctggtcgtaagccgcctgggaatcatcgcgcgcacgcttgagctgctgctcgcgagcctcgatgcgcgacagcatggtgttgaacgcttcggccaggctgccgatttcatcatggttgccgcgtccggcgcgcagggcgtagttttcttcacgggtgacctggcgcgagagctcttccagttcgtggatcgggcgggtgatcaggcgtttgatctgccgggcgatgaccagccagagcaacacactgaaaatcaggatgcccaggctggcggtcagcgtgccggtgtagaaggccaccggcagctcactgctggccaccaacagcaaatgcccggacggctggccggtgcggggcagggtgatgacctggttactgcgaaactcggtaacacgccaggcttcgatatgccggtagttttccggcagttgcaggcgattgccgtgttgcatctgcgccaggcggttgccgtcgccgtcgtacagcgccgccgcgcgcaggggcgagtagctggtcagctcattaagcagcgcttcggccttggccggggattccagggcctcaccggccagggacgggttcgacaccaggcgcccgatggcctgcaaggcctggggcgccatgctttcctgggagatccaataggcggcgctgataaacgtcaggttggccaccagcaacacggtggtcaacaacaccagcagggcggccagcagtttctgccctaccggtagattttcaagacgctggcgcagtggcatcagggttttcccaggtgatagacaggtaggcagggtagcgcgtgcctcagtcgctggccaatccgcgtgcgtgcaagtactcgaccaggcgcgcttgcacctgttgcaggtgcggcagtaccaattgatggcgggccgccgccgcgcaggcatagcccagcaggtagctgatttcggtgcgccgggcgttggccacgtcctgatacatggacgagtagttggcggcagtggcctggatcactcgctccacttcactgtgcaaatcttcggcggccgccggttggccgcaacattcaagcagctcggtcaactcggcgcacaaggtcgcgacttcacattgatgcgcttgcaggccgccgttgcggcactggtacagcacggtcagtgggttgatggcgcagttcaaggccagcttgcgccacaggcgcgtcagaatctcggtgctccattcgtggggaatgccggcggcgtgcaagtcgtccagccataacggtggagtagggtggccaacgtcccccagccaggtgtaaccatggccggcaaacacgacgcgccaatcgccgtcgcgaaacgcgccttcggtgctggaagcaaagaggcagcgcgccaggggaagctgcgcggccaccgcgtcctggctgccgaggccgttttgcaacaggatcagttcggcatccggcaccaagcgatgttgcagctgtgcgatggcgctctgggcgtcgtaggctttgcacgccaccagcaggcgctgaattggctcagggctgtcgggcgtttcgccgatcaccggatagctgtgttctacgccgtgttcgaccagcgtcagcccgggtcctgcctgatagctggacaggcgcgcggcatcgcgcaggatcagtttcactggtacgcccgcgcgggccaggcgcgtggcccagagtgtgcccaggctgccggcgccgagaatgtgccaggtggtcgacatcagattgtgctccgtggggtcgctcacagtgaacggggcgaaagaaccgctataatgcctcggcattttagctcgggcgcgctccatcgcgacgaagcgcgccccttatattggagaaatgacatgccttcgttcgacgtggtatccgaactggacaaacacgaagtcaccaacgccgtcgagaacgccgtcaaggaactggaccgtcgctatgacttgaaaggcaagggcagcttcgaattcaaggaaaaggaactgacagtcaacctgaccgctgaagccgatttccagctggaagcgatgatcgagatcctcaagctgtccctggtcaagcgcaagatcgacgcgcagtgccttgaaatcaaggatgcttacgcctccggcaagctgatgaagcaggaagcggtactcaaggaaggcatcgacaaagagctggcgaagaaaatcgtcgcccacatcaaggatgccaagctgaaagtgcaggctgccatccagggtgagcaggtacgcgtgaccggcaagaagcgtgatgacttgcaggaagccatcgccgccctgcgcgccaagaccttcgacatgccgctgcagttcaataacttccgcgactgatggcacattggggaacctgtgggcgtttttgacgtcccacgccccggaaacagtgcctacacttgagcccttcggggctcatttgcgttttaaggcagtcaataaagccgcacatccgcgcaacaggagaagatagatggatttgaacgctgaagtggatcacctgatcaagacctcgcagtcctggatcccgatgattatggaatacggcagccgggtgctactggcagttgtcaccctggccgtcggctggtggttgatcaacaaactgacccacaagatgggtcgtctgttggcaatgcgtaacgcagacctggcgcttcagagctttgttaccagcattgtgaacatcgtgctcaagatcatgctggtgatcagcgtagcctcgatgataggcgtggagaccacttcgtttgttgcggctatcgcagcggcaggctttgccatcggcatggcgctgcaaggcagcctgaccaactttgccggtggcgtgctgattctgttgttccgcccgttccgcattggtgactggatcgaagcccagggcacttccggcactgtcgacagcatccagattttccacaccgtactgcgcaccggcgacaacaagaccgtgatcgtgccgaacggcatcctgtccaatggcatcattaccaataccaaccgtcagccgacccgcaaggtggtgtttgacgtgggtgtcgactatgaagccgacctgcagaaggctcgcgaagtgctgttggagctggcaaaagacccgcgtgtattggcagatcctgcggcagttgctgtggtgtcgaccttgggtgacagttcgatcaccgtgtctttgcgctgctggaccaaaacgtccgattactgggacgtgatgttcatgcttaatgaactggcgcgtgatcgtttgaaaggcgcggggattgatattccgtttccgcagcgagttattcgcgtgatgcaggaaccggcggcgaaataacggagcgataaaggctatcgaacttggccaataggtcaggttcgagactcggggttaatctcgttagttagcttgctagttattttttcaatgtcataaagttgcaataaaaaaagccgctcccttgtaaacaggggagcggcttttttgtttaaggccgaagccttaagccatcgttgtaattaaacggctaattacaagatgttcagcgggtattgcgcgatcagacgcagttcgtccaaggaggccgaaccgtagtaaaccgcatcgctggagcgataagtcgcttgacgcagacgcaggctcaggtctttagccgggccgctctggatcacgtacttggcttcgatgtcgcgttcccactctttcgcgttgttagtgacaccgttgtcggcgccgctaccagtgacataacgcgtcatgaagctcaggcctggaatgccgaaagtggccatgttcaggtcgtaacgagcttgccaggatttttcgccttcagcgttgaagtcagaacgagcgacggagttggccaggaagatcgtgccgccaccgtctacgccataaccgtagtcgccatcaccggtaaccttctggtaggccagggtaaaggtgtgagcgtcgatggtgtacgcgccctgcaagctgtaggcacggttgtcgagcttggtggtgttgtctttttctgcgcgaacaagaccttcgccatcacttttggtgctgtagatgttgaagtcaaaggccagcgactgttccttgctgagggcatgggtccagttgacgttggcgtaagtcttcttccagtagtcttcggtttttgcgtagtagaggctaccggtcaactctggggtgaacgcgtagacgccgccgatgaagttggtttccttcaggcccaggctgtcatggtaagtcgcgttttgcgcagtggaggccgtgaagtgaccgccttccagtttcaggcccttgatttcgttgctggtgatcgagataccttgtggcagctctggcagcagacggctgtcatcggacgcgaagaccggtgcggtggtgtactggtcaccgattttcagcacggtgtcggagaaacggaacttgatggcgccgccgcctttggagtaatcgtcctgggcacggccgtcagcaccgttagggaacaggccggtaccggcgtgaccccgaccactgtcgagcttgacgcccagcaagccaataacgtctacaccgacaccgatggtgccttgggtgaagcccgattggtacagggcattgaagccaaggcctgattcttcggagatgcttttgcgttcagtactgcccggtttgacgggtttgtagccgccacctggttcgttacggatatcgcggctgaaatacagcgcacgggtattgatgctgaaagtactgtcgtctacaaagcccttggaatcatcttgggcggacgccattgcgaactgcgaggtgccggctgaaacagccagggcgatcatgctccacttcatcacgcgcatcgtgatttgctcctttggttttaggaagagtactgccgtcccacctgtatttttatctgggcggctctttcttttttgtgtcggcgcaaagttatatcacgcagaccctattgacgatactgactcatctatcctttcagcttctttacgaggctgtcgtaaattgctagttccatgtcgcaaattcacagccctaatgtaaccaggctgacaacttaaatgctgttttcagacccctttcgaagtttgaactcttccttggtgcgcattcaaacgctgctgttcttttatcgcgaaacacctgcttccaaacgggtgccgttgccgacgatacgggtgtgaatgcaacaagcgtgcacaaagcggtaaccgaatgtcattttttcgtgaaaaacgttacggcagtgtaaaaaccgcataagcacgggctttttacgtcgtttggtttgggcttgacgcccgggtatttcacctgtgtgcaggtacataaaacctgtgccagagcaaaacgttaccggttcaccccgctgagtgggtagttggcggatccctttgaagcacaggtgggtcattttggtgcatcccgctgaggcccgatttagcgtagctcaaatattcgcccgcctctaaagggtgcagattttttatctgcttgcatcgagggtatgctgggcgcctgatattgacctgccgaacggagtgcccgcgtgttcgccttagatcaacgcctgcaacaagacacattggtcatgggtgacttcccgctctgtcgcctgctgctgtccaatgactcgaattacccctggttcattctggtgccgcgcatcaacggtatcagtgaagtgtttcagctggatgtcgccgatcagcagacactgtggcaagaaaccacagccctggcgcaattgctcaatgagggcctgctggccgacaagatgaacatcggtgcgctgggtaacgttgtcagccagttgcatgtgcacgtgattgtgcgcaaacgcgacgatgccgcctggccggcaccggtctggggcaagcacccggcccggccgtataccgaagagcaagtggcggcgctgcgcacccgactgcgcgcgttattgcctgccgacttcatttttacccaggactgaaccatggacctgcaagaccgcgtcaacgacctggaaagccgcctggcgtttcaggacgacaccatcgagaccctcaatgacatcctcgtcacccagcagcgtgcggttgagcgtctgcaactgcagatgacggcgctgctcaagcgccaggaagaaatgggtggccagttcgagtcatccgaagaagaagcgccgccgccgcattattaaggcgcgcaataaaaaaaccgcgatccagcagggctggatcgcggttttttattacgccgagggtgggaatcagcgacgcggcaatgccgcgatcacgtcttcggcttgcaggcccttgtcgcggttcatgacggagaactccacgcgctggccttcgaccagaacgcgatgaccttcgccgcggatggcccggaaatggacgaagatatcgtcgcccgaatcgcgggaaataaagccgaagcctttggaggtgttgaaccacttgacggtcccggtatcccggttggtcatgtcgtaggtttgcgacgcagcggctggggacgaacggtagaagctgatggccaggtgaagaacgatggcgaccacagcaatcaccaggctgagcaggatggccgggtggccgccgacttcaggcatcggtgcgaggagggtgagggtttgaacgacaacggtcagtaccagcagcgcgctgaccaggttttgcagttgatgacgcgtgcctttgttccagtaagggatcaccggtgccagcgtcaggttaagaaggccgaacaaggccaggtacagagcgtcgtgttgttccaggtagggagggcttccctgttgcaagctcggtataaaggacagcagcaacgctgcaacgcccgttagcaggtggacgattttcaacattttgattaactcacgttaagaaggatcacaaggaagagctgactggcacggttcgcttctgaacaatgggaggcgttgggcacgtgcacgggtatcagcctatgtggcgtgccgcagaaataaacggcgcaccacacgacgtctatttaacagcaaaggctgtgcctactcaaatcaagcatttcggggtgttgcgagcgcgttggcatttctgcggcaaacacttgtcctagacaggtgcgggatttttgagcagcatttttagcgttttcctactctgcgcaaaggcttgcatgccgctgtcacgtgaccggcaggtgcatgcgcagaaggggcgatttgccgcacgccagcggtgtatgtcgggctgcacacagccggcactcttgctagagtggtcctgcacctgatcaatgaatactcgtcaattgaaggggaaaaacatggcaatcgatattggtatcagtgaagaagaccgtaaatccatcgtcgacggactttcacggctgctgtccgatacctatgtactgtatttgaaaacccacaacttccattggaacgtcacgggccccatgtttcgtacgctgcacttgatgtttgaagagcagtacaacgaactggggctggcagtggactccattgccgaacgtatccgtgccctgggtttcccggcgccgggtgcctattcgatctacgcccgtctgtcttcgatcaaggaagaagagggtgtgcccagcgccgaagagatgatcaagcagttggtggcgggccaggaggcagtgacgcgtaccgcacgcggcatcttcccgctgctcgataaagtcagcgatgagccaacggcggatttgctgacccaacgtatgcaggttcatgaaaaaaccgcgtggatgctgcgttctctgctcgaaaaccagtaaatctacacctgagcggcgccgccctggcgccgctcagtggtttccccgcgcttcctggcgttgtcctacgactaccgactccctgtcttctggtcgcccctcgcatcctgctgttttatagacccactgttccatgggagaaacccgtgggctgttgtttggcaatggagtgtcaggtgtatgtcacgcgcagtgggtaatggagtgatggaaacctgtggttttcataagataaaggtcgacccctttgcaaaagggttcgatatgggactggccaagccactgtcccggtcggtcaggctcaacgggttttccacctgcctgcggctcgaacagatctactggaatatcctcacggagatcgccaggatcaatgcctgctcagtcagtgcgttgctgtcgtatgtcgaccgggaagtgcatttgcgttacggaggggtgaagaacttcagcggattggtcagggtggtgtgcgtggttcacgtattaaaagcttgcaccaccccgatgagtgccgattaatccggcggttgcgcagccggcccgccgtcgaggtgggccggccttggggcagaaagccggctgcgctgcctcgatttaccagatataatcccgcgctttgctgcgcatgcctgggtttatccacagggcagggcgtggcgcagtaatgatctgatcgccgagacatctccatgcccatgtacgactatcaatgtgcttcctgtggtcatcagttggaagccattcagaagatcagcgccgcgccgctggtcgattgccctgcctgccaggcacctgagctgaagaagatgttgtccatgccgggcttccgcctgagtggcggtggctggtacgagaccgacttcaagaccggcgccaagaaaaacctggcaggcggcgacaaagcagactgagttgaactctacgcgcaggctcctgcattatccgtcccctgcttaactgtacggtgacgaggcgagcctccaccgaatttcgaattacgagaagtgaaaccactaccatgatgcgcagccactattgcggccaactgaacgagaccctggaaggtcaggaaatcaccctttgcggatgggttcaccgtcgccgcgaccacggcggggtgatcttcctcgatatccgtgatcgtgatggtctggcccaagtggtgttcgacccggaccgcgccgagagcttcgccgccgccgaccgcgtgcgcagcgaatacgtcgtgaaaatcaccggcaaggtgcgcctgcgtccggccggtgccgtgaacaagaacatggcgtccggcggtattgaagtgctgggctacgagctggaagtgctgaacgagtcggaaaccccgccgttcccgctcaacgaatactccgacgtgggcgaagaaactcgcctgcgctaccgcttcctggacctgcgtcgcccggaaatggccgagaagctgcgtctgcgttcgcgcatgaccaccagcatccgccgcttcctcgacgaaaacggcttccttgacgtcgaaacgccgatcctcacccgggctaccccggaaggcgcgcgtgactacctggtgccgagccgtacccacgccggttccttcttcgccttgccgcaatcgccgcaattgttcaagcaactgctgatggtggccggcttcgaccgttactaccagatcgccaagtgcttccgtgacgaagacctgcgtgccgaccgccagcctgaattcacccagatcgacatcgagaccagcttcctcgatgaaaaagagatcatgggcctgaccgaacaaatgatccgcaacctgttcaaggaagtgctggacctggagttcggcgaattcccgcacatgaccttcgaagaagccatgcgccgctacggttccgacaagccagacctgcgtaacccgctggaactggtggacgtggccgaccagctcaaggaagtcgacttcaaggtgttcagcggcccggccaacgacccgaaatgccgcatcgccgccctgcgcgtgcctggcggcgcgagcatgccgcgcaagcagatcgacgactacaccaagttcgtcggcatctacggtgccaaaggcctggcgtacatcaaggtcaacgagcgcgccaatggcgttgacggcctgcaatcgccgatcgtgaaaaacatcccgctcgacaacctgaacgcgatcctggaccgcgtcggcgcggttgacggcgacatcgtgttcttcggtgccgacaaggccaagatcgtcagcgaagccctgggcgcgctgcgcatcaagctgggccacgacctggacctgctgacctgcaagtgggccccaatgtgggtggtcgacttcccgatgttcgaagagaacgacgacggcagcttcagcgccttgcaccacccgttcaccgcgccgaagtgctcgcctgaagagctggaagccaacccggcaggcgcgctgtcgcgtgcttacgacatggtcctgaacggcaccgaactgggtggcggttcgatccgtatccaccgcaaagagatgcagcaagcggtattccgtctgttgggcatcaacgaagcggaacaggaagagaagttcggcttcctgctcgacgccctgaagtacggcgcgccgccgcacggtggcctggcgtttggcctggaccgtctggtgatgctgatgaccggcgcccagtcgatccgtgaagtgatcgccttcccgaaaacccagagtgctgcggacgtcatgacccaggctccgggcgtggtcgatgccaaggcgctgcgcgaactgcacattcgtctgcgcgagacgccgaaggctgagtaaggctgctgcgtgaaagcgcgataaggttgtaagcagtcaaaaaggcgcatcttcggatgcgcctttgcgtttaaaagagggaattcctgcctggggtgggattgttaaggttactagagaatttcggagttgtgttatggctggccattccaagtgggcgaacatcaagcaccgcaaagagcgtcaggatgccaagaaaggcaagatcttcaccaagtggattcgcgaactgaccgtcgctgcccgccagggtggcggtgacccgggctccaacccgcgcctgcgcctggcgctggacaaggccttgggcgcgaacatgagccgcgacatcattgatcgcgccgtggcccgtggtgccggcgcggccgacacggacgatatggtcgagctgagctacgaaggctacggcccgggcggcgtggcggtgatggtcgagtgcatgaccgacaaccgcaaccgcaccgcggctgccgtgcgtcacgcgttcagcaaatgcggtggcaacctgggcaccgacggctcggtggcctacctgttcgagcgcaagggccagatctccttcgcgccgggcgtggatgaagatgcgctgatcgaagccgccatggaggccgatgccgacgacgtggtgagcaacgaagacggctccatcgacgtattcacctcgttcgccggcttctatgcggtgcgcaacgccctggaagccgccggtttcaaaggcaccgacgcggaaatcgtgatgttgccgaccaccagcgccgagctggacctggacggtgcgcagaaagtgctgaagatgctggatatgcttgaagacctggatgatgtgcagaatgtgtactcgaatgccgacatcccggaatctgtagccgagcaactcacctaagcatcacgcccctccactgtggggactggcttgggtgggagctggcttgcctgcgatagcatcacctcggtttgaaagaaccaccgaggtgtctgcatcgcaggcaagccagctcccacattcgatctatgttggtcgcaagaattgtgtttttcccacttcgcaggcgttatgactttaatcctaggtatcgaccccggttcgcgcatcaccggttttggcgtggtgcaacagaccccgcgcggctgtgtgtacgttgcctcgggctgcatccgcaccggtgcgggcgagttggccgagcgcctgcagatcgtctatcgcggcgtgcgtgaagtgatccagacctacgggccggtgaccatgggcatcgaaaaggtgttcatggccaagaacgccgactccgcgctcaagcttggccaggcgcggggcgccgccatcgtcgccggcgccgaggaaggcatggaaatcgccgaatacaccgccactcaggtcaagcaggccgtggtcggcaccggcgcggcgaataaggaacaggtgcagatgatggtcatgcacatgctcaagctcacctcaaaaccacaaattgacgcctccgatgccctggccatcgccatttgccatgcgcatacccgctcaagcctgttgccgcatggcctgggcacggcacgcagtcgtggcggtcgcctgcgtctctgatagcatcagcgcaatcgttatttccggtcaggccttatctgaccccaagctttaaggatttgaaccgtgattggacgcttgcgcggcaccctggctgaaaaacagccgccgcacctgattctggatgtaaacgggttggggtatgagctggaagtgcccatgaccacgctgtaccgtctaccgtcggtcggcgagccgctgaccctgcacacccatttggtggtgcgcgaagacgcgcaattgctttatggttttattggcaagcgcgaccgcgacttcttccgcgagctgattcgcctgaacggcgtaggccccaaacttgcgctggcattgatgtcgagcctggaggtggacgagctggtgcgtgcggtttcggcccaggacacctcggcgttgaccaaggtgccgggcgtcggcaagaaaacggccgagcgcttgttggtggagctcaaagaccgcttcaaagcctgggaagtcgtaccgagcatgtttgccctggtgccgaaccagccggatatgccggcaggccaggtggccagcgccgaaagcgatgcggtcagcgcgttgatctccctgggctacaagccgcaggaggccagcaaagccgtatcggccatcaaagacaagaacctgagcagcgaagacatgatccgccgagccctgaagggaatgatttaagtgattgaagctgatcgtctgatcgcggccaccggcccgcgcgaccgtgaagaagtccaggaccgggccatccgcccgctgagcctggccgagtatatcggccagccgaccgtgcgcgagcaaatggagctgttcatccaggccgcgcgcgggcgcagcgagtctctggaccacacgttgatcttcggcccgccggggctgggtaaaaccacgctggccaatatcatcgcccaggaaatgggtgtgtcgatcaagtccacctccggcccggtgctcgagcgtccgggtgacctggcggcgttgctgaccaatcttgagccgcacgacgtgctgttcatcgacgagatccaccggctttcgccgattgtcgaggaagtgctgtacccggccatggaagacttccagctcgacatcatgattggcgaaggcccggcggcccgctcgatcaaactcgacctgccgccctttacgctggtgggcgcgaccacccgtgcgggcatgctgaccaacccgttgcgagaccgtttcggcattgttcaacgtctagagttctatagcacggcggatttggccaccatcgtcagccgttcggcgagcatcctcggcttgcccctggacccggaaggcgcgtttgaaatcgcccgccgggcacgtggcacgccgcgaatcgccaaccgtttgctgcgtcgcgtgcgcgactttgccgaggtacgggccaaggggcatatcaccaaggccgtggccgatctggccttgaacctgctggatgtggacgagcatggcttcgatcaccaggatcgacgtctactcttgaccatgatcgagaagttcgacggcggcccggtaggtgtggacagcctggcggcggcaatcagcgaggagcgccacaccattgaggacgtgctggagccgtacctgatccagcagggttacatcatgcgtacgccaaggggccgcgtcgtgacgcgccatgcctatttgcactttgggttaaacattccgtcacgattgggcgagatgcctgtagtagacgaattcctcgatgcagtggacgattaaaaaggtcacgcgggacgatttattcaaggtttgtgctgtcctagtggctggcgtcgtcattcagtcgcaggaaatgaaaaaacagttgcccagccggattggcaacctgaggagtaagcactagagtatgcgcgcgcaaaacggggatcagtcgttcgcacatcgctgtcgcgtttattacgaggacaccgatgccggcggcatcgtttattacgtcaactacctcaagttcatggagcgggctcgaaccgagcggctacgggagctgggctttgcccaatcccagctggcaggggaggacctgttattcgtcgtgcattccagcgaggcgcgttaccacgcaccggcgcgattggacgacgagttgctggtcagcgctgaagtaatcgaattgaaccgtgtcagcctgcgctttaaacagcaagtcaggcgggcgacggatgcaacgctgctctgtgaggggcagttcctggtggcctgtgtgcgcaccaatagtttgaaaccccgggccattcccgaagctctacgtgcggcctttgccggcgtaagcggcgcgggtaaacaatcaaagcaggagatttagcgtggaacctaccgtcgtcgaccattcctccatgtggagcctggtcagcaatgccagtgttgtggttcaactggtgatgctggtcctggtagccgcttcggttacctcttgggtcatgatttttcagcgcagcaacttgctgcgtgccggtcgacgtgccctggagagctttgaagagcgcttctggtcgggtatcgacctgtccaaactgtaccgtcaggccggcagcaacccggacccggattcgggcgtcgagcagatcttccgcgccggcttcaaggagttctcccgcctgcgccagcaaccgggcgttgacccggaagcggtcatggaaggcgtggcccgtgccatgcgcgtcgccatttcccgtgaagaagagaagctggagcagagcctgccgttcctcgccaccgtcggttccgtcagcccgtacatcggtctgttcggtacggtgtgggggatcatgaactccttccgcggcctggcccaggcccagcaagcgaccctggccaccgtggccccgggtatcgctgaagccctgatcgccaccgcgatcggcttgttcgctgctatccccgcagtaatcgcctacaaccgttttgccgcccgtggcgaaaccttgatcagccgttactacaccttcgccgacgaattccaggcgatcctgcaccgtaaagtgcacaccagcgaagaataagcaggtaattcccaatggctttaatcgctcgagctcgcaaaaagcgcaagccggtcgccgagatgaacgtagtgccttacatcgacgtgatgctggtgctgctggtcattttcatggtgaccgcgccgatgctcaatcagggcgtgaaggttgatctgcccaaggtttccagcgaagccttgccgcaagacaacaacactcaggtcctgaccatttcgatcaaggctgacaagacctattactggaaccttggcagcgaagtcgacacccagaaacagcaggacaaggccatgaccttgccgcagatgaccgacgccgtgaccaagatcattcggtccggcaacgaaggcggcaagcacacccaggtgttcattcgcggcgacaaagtggtcgactatggctccgtcatgggcgccatgggcgggctgcagaaggccggcgtgggtaacgttggcttgattaccgaggcgccctgatgcagcaacagcgagagccgtccgcctcggaaagctacttctggcctagcgtctgggcaattgccctgcacgtcctggtgtttggcatgctgttcgtcagctttgccatgaccccggacctgccgccagccaagccgatcgtgcaggcgaccctgtatcagctgaaatcgaaaagtcaggccaccacccagaccaatcagaagattgcgggtgaggcccagaagtcggctgcgcgccagactgaagtcgaacagatggaacagaagaaggtcgagcaggaagcggtgaaggctgctgcggaacaaaagaaagaagaggcggctcaaaaggccgaggaatcgaaaaaggctgacgaagccaagaaagctgacgaggcgaaaaaggctgatgaagccaagaaagccgaaaaagcggccgaagctaaaaaagccgaagagaaacaattggctgatatagccaagaagaagtctgaagaagaagccaagaaggctgccgaagaagaggccaagaaaaaggccgctgaagaggccaagaagaagatagtcgaagacgcgaagaagaaagccgccgaagacgccaagaaaaaagctgaagcagacgaggcgaagaagaaagtcgccgacgacgcgaagaagaaagctgccgccgatgccagcaagaaaaaggcccaggaagcagcacgtaaatccgccgaagagaaaaaggcccaggccttggcagatttgctttccgacacgcctcagcgtcagcaagccttggccgatgagcgtggtgacgaagtcgcgggcagtttcgatgacctgattcgggcacgggcagcggaaggttggacacgtcctccttcggcacgcaaaggtatgacagtagtgctgcagatcggcatgttgccggacggtacggtgacttcggtcagcgtggccaagtccagtggtgacggttcgttcgacagttcggcggttgccgcggtcaagaatattggccggttgaccgagatgcagggaatgaaaccaagcgacttcgctccctatcgttcattcaagatgacattcacacctgaggatctagccttgtgagaaaccttcttcgaggaatgcttgtcgttatttgctgtatggcagggatagcggcggcggatgaaaagaacatcctggttaccagcggtagcgatcgggccaccccgatcgccgtagtaccgttcggctggcaaggcggcagcgtgctgccggacgacatggcccagatcgtcagtgacgacctgcgcaactccggttactacgcgccgattccaaaaggcaacatgatcagccagccgacccaggccagcgaagtcatcttccgtgactggaaagccgtcggcgcccagtacctgatggtcggcagcatcacgccggccggcggtcgcctgcagatccagtacacgttgttcaacgtggccaccgagcagcaggtcttgaccggcagcgtatcgggcaccgccgaacaactgcgggacatggcgcactacatctccgaccagtcgtttgaaaagctcaccggtatcaagggtgctttctcgacgcgtctgctttatgtaacggctgagcgtttctctgtagacaacactcgttacaccttgcagcgctcggactacgacggtgcacgggctgtgaccttgctgcaatcgcgtgagccaatcctgtcgccgcgtttcgcgccggacggcaagcgtattgcctatgtgtcgttcgaacagcgccgcccgcgcatcttcgtgcagcacatcgataccggtcgtcgtgagcagatcaccaacttcgaaggcctcaacggtgcgccagcctggtcgccggatggttcgcgcctggcgttcgtgctgtccaaagacggcaacccggacatctacgtgatgaacatggcttcgcgccagatcagccgtgtgaccagcggcccgggcatcaacaccgagccgttctggggtaaggatggttcgaccatttacttcacttccgaccggggtggcaagccgcaggtctacaaggcaaatgtaaacggcggcggtgcagaacgcgttacctttattggtaactacaatgctaatccgaagctttcggctgatgaaaagacgttggtgatgattcaccgtcaggatggtttcactaatttccgggttgcggcccaggatttgcagcgcggaaccgtaaaaatccttacagataccaaccttgatgagtcagctactgttgcgcccaacggcaccatggtaatctacgccacccgccagcagggccggggagtcttgatgctcgtatccattaatggacgcgtaaggctcccacttcctaccgcacaaggcgaagtcagagaaccatcctggtccccttacctgaactgacgcggcgctacaaaaagaagtacttaacacactggggttcattaggagtttcacgatggaaatgctgaagtttggtaagtttgctgctctggctctggctctgtccgtagccgttggttgctcgtctaaaggcggcgacaatgccggtgaaggcgcagctgttgatccaaacgctggttacggcgctaacactggtgcagttgacggctccctgagcgaagaagctgctctgcgcgctatcaccactttctacttcgaatacgacagttcggacctgaagccagaagccatgcgcgctctggacgttcacgcgaaggacctgaaagctaacggcgctcgcgttgttctggaaggtaacaccgacgaacgtggtactcgtgagtacaacatggcactgggcgagcgtcgtgcgaaagccgttcagcgctacctggtactgcaaggtgttgctccaggccaactggaactggtttcctacggtaaagagcgtccagttgctactggccacgacgagcagtcctgggctcaaaaccgtcgcgtcgaactgcgtaagtaattcgtcatgcgaacgtgccgtcgtgctctaactgtattggctctcagcctcgcaccgcttgcggtgtgggctgcggttcctgtggaagatagcaactctggctataacaatagcgggagcagttatccgccagcgggttatggcacgaacggcgcctatgctgggggagcggctacgtccgctccctcggcacagggcgaactgttcaaccagctgcaacgcatgcaggatcaattgtcgcagcaacaaggcacgattgaagttctgcagaatcaagtgaaccagctgaagcaagaaggcctggagcgttaccaggatcttgatcgacgcattggagccggcgtaacaccagccgccactcctgataattcttctgccggtagcgcgccaagcgccgctgccggtggtgcagcagcgggggctgcggccgcaagccaagcccctgccgccagcagcgaaccgggtgatccggccaaggaaaagctgtattacgatgcggccttcgacctgatcaaagccaaggatttcgataaggccagccaggcttttaccgcattcctgcgcaaatacccgaacagccaatacgcgggcaatgcccagtactggttgggcgaggttaacttggccaagggtgatttgcagggcgcaggccaggcgtttgccaaggtcagccagctctacccaaagcacgccaaggtgcctgattcgctgtacaaacttgctgacgtagaacgccgcctgggtcacaccgacaaggtcaaaggcattctgcagcaggtcgttgcccaatatccgggtacgtccgctgcccagttggctcaacgagatctgcaacgcttgtaagcgatgctttcccgtttagaagaaacccgcgcctggcgcgggttttttcgttagaatccacgcccttttatgaaacacgcttcctggggtttacgcgtttgcgaaattccttgaagtgcctgacggaggcggacagcctgtttagctgttacgcccgtggcgactatgcaagacacattacgtattaccgaagttttttactcgttacagggtgaaacgcgaaccgctggcctgcccaccgtatttgtacggctgaccggctgccctttgcgttgccaatactgtgacagcgcctacgccttcagtggcggcaccgtgcgcagcctcgacgacatcctcgagcaagtggccggcttcaagccgcgctacgtctgtgtgacaggtggcgagccgctggcccaacccaacgccatcccattgctcaagcggctgtgtgacgccggttacgaggtctcgctggaaaccagtggcgccctggacatctcggctgttgactcgcgcgtgagccgggtggtcgatctcaagaccccgggttccaaagaggcgcaccgcaacctctacgagaacatggacttgctgacggccaacgatcaggtcaagttcgtgatctgttctcgtgacgactatgactgggcagcctccaagctgatccagtacggcctcgaccgccgcgccggtgaggtgctgttctcgcccagccatcacgacctgaacgcccgcgacctggccgactgggtcgtcgcggacaacctgccggtgcgcctgcaattgcagttgcataaatacctgtggaatgacgagccggggcgctgacatggccgatgaaaaacgcgccgtcatcctgctctccggcggcctggactccgccacgttggtagccatggtgcgcgcccagggctacagctgttacaccctgagcttcgactacggccagcgccaccgtgccgagttggacgccgctgcgcgtgtcgcccgtgatctgggtgtggtcgagcacaaagtcatcggcctcaaccttaatggcatcggcggttcagcgctcaccgacagcagcatcgacgtacccgaggcgcccagcgaaggcatcccgctgacctacgtgccggcgcgcaacaccgtcttcctgtcgctggccctcggctgggccgaagtattgaacgcccgcgacatcttcatcggcgtcaatgcactggactacaacggctatccggactgtcgccctgagtatgtcgaggcattcgagcgcatggccaacctggccaccaaggccggtgtagaggggcagggctttcgtatccaggcgccgctgcagaacatgaccaaggcggatattgtgaaggctggtgtaggacttggtgtcgactacacgctgacagtttcctgctaccaagcagacaatgccggccatgcctgtgggaaatgtgacgcttgcagactgcgtgcagaaggcttccaagccgccggaattgctgacccaacgcgttatttctgatttatttaaaataaggtgttgaataatccttagaaatcagtattatacgcgccaccacacagcgggtcgttagctcagttggtagagcagttggcttttaaccaattggtcgtaggttcgaatcccacacgacccaccatttttggcggtttagaaaatccggaaggcccacgcaagtgaggatttccgggtttttttttgcctgaaatagggtgtatgtgcggtctgggaaggtgtgcaatgcactgatatcttcgtagacatgcagccgtctgatcgaaacagtagtgtcggctttgtgtgatgtcaatatggaacggccaacttgctgagcgttttcagtgaaactggctgtgtctgtcagcctctcattttgcgactactgggaaatttcctagcagttcgcaagctgcttccgacgttcacttttcttgaaacagcaagatgcctccgatttctcggtgaggtctttttgtggctgactgtaagaaatcagataagggccgcttcagccccagctatggctcttcatgccgcccaggccgatcatcagtgtgagcatcaaggatgcatccgagctctcatccacggatggtggcggtaagtctagctcttgccaccaagtgccgggtccgtcccatgtcagttcgtggctgagcgccgtgcctgcaggaagtatggcttgatccagtgaatagcggtctgaactcaaactcgtgacctgggtcagcagctttgatgtaggtggcgattcaactggtagttgctgcgacgaggtgtcagcggcaacgcccccgatcctctgtgcagagatatgttctattactgatgggactgggtctggttcttcaggtgcaacgagtgcaggcaactccactcttgcaggtatctgttcgtcaacgcggcgctcgaacgtgatcgctccctgagccaggctccgttcatgcagtacggttcgcatatgatcgtaatcgacttcgatgtagcccaatgtcgttgcgatgttggaatgattcagcaggctcttggtgaggtggatgttgcgctctggttgacgcatgaggtcagtggccagggtgtgcctgaatcggtgcggggtcgtacgcgttccgatttccacgatgagcttgcgatacattccctcgatctggtcaatgttcatgactttggagcggtagtggctggagaaccgattgacgttgaaaatctgatcgtttggttcgaagccgattcgatcagcggcatccaaaagccccctgatatggggttccaggcccgccatgatcggaattgaaaactcacggtgagttttctcagtgtctacctgcactcgaatcaggcgattgtcccagtcaatatcttggtagcggagacttagcaacgcactcagccggatacgagcagacatcaccaagggcttatacctgacacatgctcgatgccttgccgccttgccgccttgaacggctggatcgcggttcgcttgcaacgccggtggggcctgtccggcgctgatgaatatcggggcctgcgcccaggttcaaagctggttaccacacacaagggccaagcgtatgaacttgcgtttaaacatcgccaattggacagcggtccggaggcttaccgtgcctgtgattcgctccagcagacgatcagtcggctctaccggcaggccggtatcaagcagggttcgtcacactgtggcaggcgatctctggcggcaaaggtgctggctgctaccggcgacgtggagacggtacagaccatcctcaatcatgcctgcctcgatcacagcaagccgtatctaactgttgacattgaggttatccgtcgtgctttcgagcttgcactggcatagtgatatcggtaactctttccgctggtcagcattgatattgaaatgtccgtccaggggggaggtttttgcccccgagaacttgaggaaatcaacaatggctaggctcacactgaccgattttgacgaatggctcgatggcgctgtgcagacggacgtagaggacgtgtacgccctacatgaagccgttgacggtgaaacagagttcgctcaatacaaagccgagcgtgcaccaaatggacagctcttggtctcgtatggcgacgatagcccttggttgaggctgtccacggaggaagctaagcagggttttcttcgtcgtcttggcggccgttacgttggggaaggttgtatgggcatcggtgcgtggtatgtcatgcacatgggattagcgtccgattaaaggaaatgtggctaccgcgcccatgggcttgctggctgcttccgactaggtcgacaagtcatcccgtccacaaccagctccacgaataatggaaatctatttcctaccgttaactcgggagcgtctgacgccttccatagtgctggatgcaagcatcataaatgcccagcaagaccccgagccctggcctaaaaaccggggccaaggacgtagagggacgctcattttcgcgtccgcgaaaacgaaggaatgatgatcatgattgaaccgtgggaaaaaagccaaaccccaaaactgaaggagctagtgcaaaagctcaaagaacactcagtttcgaatccggacgacaacccaaatctgaccggggaagagttcctatctacaactgatgaaagaacccgcgagctgattggacaaatcgttgaagtcgctcgtgttgtccttttcgaccgcgaggggagaaggcagggccagtcccgtgcggcgatgatgcgtgctggacacaccgtctcagtggttggtgatcctcacgacgaagacgatggatacaaaactacccttcagatcaaaactcatcatggcgaactgacgcttgaagcgccgctgcttgggcgttaagggtcagcgaacatagggattatgaaagcaatgatcacatttgctacgcgaaagccgagttggctcgcgaatgaggggtattggcgtgtgctgcaggttgttcagtggctcatatttgtgccgctaatggtgcttggcgttgtgacctatggggttggcctgtttaattttggcgaagtttcctccaacgtattttgggctgcaactgcgttaacggtgggggctgttgttggttttttcacagtacgagctttagcgtggttgatcgtatgggtgatcgcaggtttttctgaatctaagccttagaaaaggtcgctcagttgcaccagaagcctcggccgtaaaaagctggggccaaggccgtaggagaggggcgtttttcgatcctcaaaaccgagtcggagaactcacatgccagcgattaccgaccctcacacagggctgatcagttttcaaaaggcgctgctcagcggcactatcaagcccaagcgttgcaagacacagcgcgagctttattttcttcgtgataagccgactcctgacaccgttcggctgacttacgcaatgatcgtaggccgccaggtcaaggccatggccacttacattgaagctgagccaaacgaaggaaaacgctgttttggtgtgggctataccgttgcgattcccttccgtggtcaggggctagccaaggccgtcctctccagcagtttgaaagagtttaaaggactgttggaagccgaattatcggagcccggcttttaccttgaagccattatcggtgtagataacgggcggtcgcatagggtggccaagcagatcatcagtcaggaacctaacgagatttctgatagcgaatccggattgccagcactgcactacatcacgctcgtgacttgatagcgaactgtctaggaaaagtacaccaataccccaacattcatgacaaggagttacatctatgaccgcgacgaaaatcgcccctctcgattacgcttcggcggaacgcaagctcaatgcactgccaattcttgccaaggaccgtcaggttctggaaacaacgctcagagctattgatgaagccagcgacagccgccacttggaactggtgatggcgcacgctggtggtctgcttcaggggctggctatcggattggtggtcaagtacgaagttctggcacaagttggcgagttgtttgaagccgtagcccagtacgagcgcgaacgaatggtggtttgagcggatctcgaatacaaaagccgcgattaagaaaaaaacagggagtgatcgatgcgcaatcagagcaaaagccgaccggaccacagcaatgttgattggagaaaactggtcaagacaggagaaagctttcgaaaattcaagttttttaaagctaggtttgagtttagccagctgaaaaactgcgacttttctgctgtgtcggcaaaacatgcttgcttcattcgggctgatctttctggggctgatttcaccggggccaacctggaacatgcaaactttggcggggccaatctaactggtgtgatcttcaaaagcgcaatccttcacggtgcgaattttgaaggtgccatcctggaaggggcaacctttgttcaggctagctacaagcgggctaaaaaactaaagctgtcagacgatcaacttcgggaaattgacaacgctttgcaggccacaaaagccgcgacactggcagatctcaatgctcgaaaggctgcgaaagaaagcaccgctgaatcacaagccaactgaccacggaaaaggagtgagtgatgtttagggaaagcttccacgatttagacgaaggttatgagcttcagacggtcatctcgcgcaaggatggagacgagatcgcttttgatttttggcactcaggtgatgagcagacctacacagttaagctctctaggaacaacggttccatttttacaggcgttgcaacaagccaagaatcgcctgacgtcgcccagctcacctgccgagtgtttgtcgatcctgacgagggcgacatgattatcttcggttcaaaatggaaataccccgacaaccctaagacatttaactgggttgtacgcctggaaggtgagtagaaggaaaaatcgctgcaccaccaggcccgcccagtcgcgggctttggcagtatcagggtgcggttttcgcgccctaaggaacgaataaggctctatgaacagcatatatatcttgaagcacttgaggaatttgaaaccctgacgggcacgcccttcagcgatgatctttatccaactccagcgtctgttcctgctgaattgctcaacgtcgtcagcaaggcaaaaatcagccaggcgagcgcccagcaaatgaacattttccatcagatgcaggtgttcaaacaaggccagatcctcgtactgccagacgacaaaaagtatttggtggttgactttgaagcgtgcggagaacaaataaagctatggagtgctgcacgttcagatcgtcaaaatacctaggaaagacgttatgaatggactgctgaactcatgttgcaagagcttcgccatcatcaccatggcagctttcgcagcgccggcgttttcgtgtgactgggaggttgaaaaaactactgacccgatgacagatgcggtgacatgttgggttagctcagctagcgcgaaggtatctttctaccgacgtggtaaagaccgtccaaatgtctacaacaaaagtgcttacagcgaatcttggctgatgatacgcgtagacgataacaaggcgatttccatgggtgaaaacgcctatacacgccaaaaagcgctggacgaattgttaccgcagatacgaaccggtaaacgagttcgcacctccttcgatgattatccggagcggcaaaatggtgacgcgcagatctgcgatttggcgaagctgctcgacgcttgcaattcataggagagttacatgattgattcaaaggagaaggaatgccgtttgtcagaatgggaatcaacccttacagacatgcgcgtgaaaggaagccttagagcctggcgtttttttctgctcgacgaaattaacaacatgctcaatgagcaattgatcaatacccacgaagcaaagtctatgcgcgagcgtgttgagcaggcctacgctgctcgcgaaacgggcatgtagctgacctgctttggaaaaaagctgaatccacggaaaaaaggcgcggttctgccgctcagctgcaccccaagccttgccctaaaaagctgggcagtggcagtaagaacgggacaattgtcgcgcctgcgaaatcggagaagggagcatcaatgcgaatcgtaggatggatacttagagtcttggcgtgcatatggctcgtgtttggcggactgcgtgttttcctcgcactcacgggcacgggtgccctgggccctgggaatcatttcttggcagggattatcacgctgttgttatctgttgctgcgttctgggcaagtggcaagttgctggatcgatccgataaagcaaaacaggcagcccacgagaactcttgagtcggctggtgacagtcacagacacaacggaaaatcatgatgaccgaagaagagatgcgccatgcattgtttggatcggccgcgcctgctgaacagttaacggttccacagatccagccgcatgccatcctcgccgcaccatcgacactagcgagcaggcggaaggaggccaaatcgttcgaaccaaagctgcaggtcacattgcgtgtaggaaacgagttcgaaggaaaaaccgagttgttcacctacgaggccgacacattaagtacgcttcaggctgaactggacgcgaagaagatggcaaggaagaaataccggttcattgaggtcgtttcggtcaagcctgcgaagtagagataaatcggctactgcgccctaagactgatggctgctgcaagccacggcgagaagtcaccccggtcaccaccagctccacgaacaacggaaaatgcgatgaaccggatttttacaatagcgttggcattatcagctattgcacacagcgcgcttgcggccgaagtggcaaagcccgaacccaagctggtgacgaaccttcacgacaatcagggcattcatgaagacctgattgcatcgcaggagctgattgctttggggtgcatgggcaaattgaacattaccgccacggcatctggatattatgacgctgcctctctggcgaaaatccagcaatgcgcagacaacgagggtactgaccttgccgcaaagctactggctcaatacaagcgaggtgagattgagaaggcaagaatgccaacctacacgttgcattactcggcaatttttgcgaaagaaaacaatattgaagctcagaagacggcaacggctgatttgatcaaggctgcgagagagcaggggaaaaagcattatccatacacggggaagtaagaaggaaaatcagatgagcaagcgagccaatattgccccacctgttcaatcatggcccacttgggcgaactggtgcggtctcgatccggccgggtactgggtgttctacgaaaacgagccggccactacggcagagggacggctgcctaatgacgggcaatggggcatgtcgcgagagtgcgatgtgacggtctacgaatcctgggaggcgctgacgttctcacgccttgccgcgacagtgcattgaaataggaaatgtattcgctgcaccccaatccctggccttcaagccggagcggtatagtttttgacccggctggatcgcaaggtcaccagctacaacgccaatctcaaaaggaaatcgtcatggtcgatgatgtgaagtcagaactgcgtcagaagtggtcaaaactggtagttgatctattcaacggggctgtaccggaaaaggctgaatggacccgcccggaagacatggcggctgtgttgaacgcaatcgcaagcccagtaaaccacctgttctatcccgagggtggtggtaacgacattcgtgccgcgagaattaccaccaagggcgagcttgaatggtcggtcgagcatgatggtttggatcgattcgttcatgttggcatcccgctcaaactgactttctggagtccgggaccatacgaccacgaagctcatttccttttggagcttggcgcactggaccctgtaggcgaacccgttacgcacggtgggtatgcgcaagaattgaccgagttgcgtgacggcacctttgcccctcgcagcgtgtgggatgaagaagataacgagggcgccaggctggttgttcgctacacgcaagctggacgctttgtgatcttcggaaaaggctcgctttacaattcattccgcgataaaaaattcgacgcctacgatgcgtaccataacgacgcagccgcgttcgaagccatcgtgacggaaatggcgaaaatcaaagtctgacctgaatctttgaaaggtaataaacccctgtgcatccaggtgccggggggggcacaccttcatgcttctttgtccttacgtggcttgttgggacgtgaggctttacgtcagcgtgagagttaggaaaatcgcaccagatgcacccaagccccgccatcaaacgtggggctgaggacgtagaaggatgccgtttttagcgtccactaacccgacggaccgacaacatggccaccacatcccaagctaatgccctgagcgacgctcgtgtagagattgcacggatcactgattcggtaagtgagcaggttcttgatcaacaaattgcgtatgcagctgggtatatccgctgcgcgcaagaccaaatgctgattactgtaggtcagtggaaaactttgactgatgaaattgaggctgaaaatcactcttggagaagtcgtcaggccggacaaccgaagtagcagggaaaagacgacatggaacggagaagtgttcgtaccgcagtaccatcagatctgccttacatacatgaatggctcaagcatgaggtatgtaatggggttggcttcatcaacaattggcccatgatccaggatgcttgcgcccaaaatcggatgacagtttttgttgatgctgaaggaccggtcgcctttctcacacgcggcatatgcggcgacaccatcttgcagacaaaaagcgattgtcagcggcgcggaattgcgcgggctctagtggagcatgccattcgttatgaagaaaccagtaacaatgctgtgctcgttgtccagtgtgagccacgcagctccgtggagttctggtcaaagatgggttttgaagctcacagggatgctgaagatttcaagtaccacaaggcagtctacatgcaccgcctttcgaagttggtgcacccacacgttcgaggcgatgaactggagatggtcattgttcgcgtttaccccgaaaaggccctttacccgaaagagccggtaaagccagatcgcgtgcattatgtgatggctaaattcgacgaaaaaacacgcactctcgaattggctcaccgcgtttcagtcgctcacgaggccatgctaaaagatccggtggttgaagtcagctggagcggaatggacatcgtcatgggtaaggccaagcacgagaaagcggtagctgtcggctttaagcgaacgccgaactgctgtggcttttatgttgatgtcatcacactccctgataactttggcgatggcacggtgtgacccaagggcgttggccaactcgaaacacataggaattgaccaccatgaacgaatgccagttccacaacaattgcggcggctgctgtatcgctgtcaggttttgtggttggggaatttatcttccgatgaaatggataagattagtgagctagccccagtcgactacagcgatgttggatacaacattggctgttcggaggtttgagatgagtcgaagaaatgcagacgcgtttctgaaagaccatttctcattcgggggcggtgccatatgcgtgggaaaagccgcaaaaggatcatctgcattgatcgagaacaggtggggcaatagcatgcgaacagttcaggtgattctcgtcttgatcctctctgccttggctggtggagccattgccgatgatcccggaatcggagggtggcgcaatctcggactccgcccggagattgagttgaacggctccaagtctgctttcgcaatacttccctaccaggctgccttaggagcccgtttctccgtgctggacaggggacaatggcgcgcggtgtgctgcgtggaagttgtaagtccgcccttgtcggaggctagcctcagtggctcctacagggttccttcggtttgggcgcttgatatgacatacaactggaatgaaaatcccagctttaagtcttatgtgttcgcgctgaaaaaggtgggggatcttgcgagtcatggcttcagcggggcccattacgatagtggtgaatggggcggtcttctgctgccggaggatgcgcgtacaggcatgactggcaaggtggtgatgtccgggaagcgctactcagtgcatatagactcagaagaaacggccgacggggacggtgtgacggagcggtatctgctcgctccagattctggcggatcggcgctgcagcagagcgtccggttcaccaactactaactgaagtgtcgatgaagtccactatcttggctagtttggagggcggtctggagagcgtgctggccagacggttacgattattcatcatcgccagcctccttgtatgtgctcagccaatcaggtcaagatcgagtgaatggggggcgccgactacatattcatggggcgaaccaaactggtctttctcgctccctatcggcggtgccattgcgagctggtgttgaagggtattttccgcatggcgcgtccagcgccccaaaccttcggcccacacctcctggcggtgcgcatagtcgccatacacgtctgccaaactgatccgttggaagcgcaaagtttccagacgtgcacgcgtcatagccaccttgtcgacttcacgggagagtgcctgcacggagtcttcatgagcacgagcataagcctctgggcgcccataaatttcgcgctttttttgccgtaattggttgatgatcgaagctaacgcatcatcaattactgtgtactcacgggctgtaatcagcccacgacttagcgcttgagcctcttgccagcgccgtaacgtcatccaacagtgaggaatgtagcttcccgtaattgaatggtcgccgccgtcgagaatctgtttaagaaacgatgaacgtctgggcaagcccttagattggttgaccatctcactgcaggctgcgtgttgcgcgacggtgtcacaccccggctcccagagaatcgaagagttttgtttagcgtcgaaaatcacgggcataaaatgccgaagcgttccgtggtgctcatatcacaaaacgacaaacagccatcatcgctttcgccgtcatccaaacctgctcaaagatgggccgatttaggtagtcgccaaggcgccagagcaagtatgggttgcggacatcacctacttaccaacgcaaacgggtgtggcttatctgagtttgatcaccgatgcgtactctcgaaaaatcgtggggcaccatatccatgaaagcttgcacaccgaatcggtgatccaggcgttcaaaaaagccctcaagcagcggacaacggaacaacgcctggtgcatcactcggacagaggcgtccaatactgctccgagctttatcagcggctgcatgccaagtacggcataacctgctcaatgaccgatggctacgactgctaccaaaatgcattggctgagcgtgtgaatgggattttgaaaaacgagttattgctgcatcgccccaaagattttgcagaggccatccggatggtggacgagtcggtgcagatctataacaacgagcggcctcatctgtcgctgaaatacaaaacgcccgatgcggtgcatcgggcgttttaaggctaaaacaggtgtaaacctatttcaagactagacatggtttagaaaatccggaaggcccacgtaagtgaggatttccgggtttttttttgcctggtgaaaaagccgcctgcaacaggcggcccgtggcccctctgtcgggcccactcagccaaaccgcccggtaatatagtcttccgtctgcttcatcttcggcttggtgaagatctcgtccgtattcccatactcaatcaattcccccatgaacatgaacgcggtgttgtccgacacccgcgcggcttgctgcatgttgtgggtcacgataatcaccgtgtactgcgctttcagctcagtgatcaattgctcgatgcgcccggtggaaatggggtcgagcgctgaggtcggttcgtccagcagcaacacctgcgggcgcagtgcgatggtgcgcgcgatgcacaaccgttgttgctggccgccggagaggctttgggcgctctggttaagtttgtctttcacctcatcccacagcgcgccgccgcgcagggcttgttcgacgcggtcgttcatctcacggcgcgagagtttttcgtggtggcgcacggcgtaggcgatgttgtcgtagatcgacatcgggaacggcaccggcttttggaacaccatgccaacgtggctgcgcaggcggttcattgaataaccaggggcgaggatgttttcgccgttgagcagcacttcgccacgtgcttcctgcttcgggtacatcgaatagatgcggttgaacacgcgcagcaaggtggacttgccgcagccggaggggccgatgatggcggtgatgcgcttttccggaatgtcgatgtcgatggatttcagcgagcgttggtggttgtagaaaaactccaacccgcgcacttggattttggttttttcgggaacaatgccggtggcgtccatcagtgagacctattgcgtaaaaggatcaggcgagatgccaggctgagcaccagcacgaacagtgtgagcaccagggcgccggcccaggccagtgagtgccagtcgtcgaacgggctcatggcgtactggaagatcaccaccggcacactggcaatcggcttgagcaagttgctgctccagaactgattgccgaaggcggtgaacagcagcggggcggtttccccggtgattcgggccagggccagcaggatgccggtgaccaccccggccttggccgctctcaacacgatctgcaaggtcagtttccattgcggcacacccagcgccagcgcggcctcgcgcatggtggaaggttgcagttgcagcatttcatcggtggtgcgcaccaccactggaatcaccagcaggcccagggccaaggcaccggcaatggcggaaaaaccaacctggtgattggtcagcaggttgagtggcaagatcacgccggtgtagataaacaaacccagcacaatcgacggcgccgacagcaggatgtcgttgataaaccgcacggtggtgcccaggcgcgagtggcgcgcgaactctgccagccagataccggccatcagcccaatgggcgtgccgatcagcaatgcgatggcagacatcaatgcgctgccatagaacgcgttggccaggccgccttcggtgccgggcggcggcgtcatctgggtaaacaggcgcaggttgagggcctggaacccattgatgatggtggtcagcagaatccacgccagccacaaaaggccgaaggctgtcgcgccgcaactgaggaacatcgccaccgcgtttttcagcgcgcgttttcggtacaggcgttcgttggcgttcataacccttccttacgcgacaggcgcatcagcatcaggcgcgccagtgccagcaccacaaaggtcacgataaacagcaagaagcccagcgcgatcagcgcggagcggtgcaggtcggtgtaggcctcgctgaactcgttggcgatcacggacgcaatcgaactgctgggcatcagcagcgaggcggagaattgttgggcgttgcccagtacaaaggtcaccgccatggtctcgccaagggcacggcccaaaccgagaaagatcccgccgacaacggccgagcgcgtatagggcaagacgatgtcccacaccacttcccacgttgtgctgccaagcgcgtaggccgattctttcaatggcgtcggtacactgcgaaacacctcatgcatcaccgaggttataaacggcatgatcatcaccgccagcacaatcccggcagtcaacatgccgatccccagcggcgggccctggaacagcgagccaataaagggcagggcgccgaggtagtcgttgatcaagggcgacaggtgttccgccataaacggcccgaacacgaacaagccccacatgccatagatgatcgaaggaataccggcgagcaattcaatcgccgacgcgaccggcatcttgagccagggcggcgcgacctcggtgagaaaaatcgcaatgccaaaactcaccggcaccgcaatcagcaaggccaggaatgaggtgaccaaagtgccgtaaatcggcaccacggcgccaaagtggttgttcaccgcatcccattcggtgctggtgataaagctgaaaccaaaggtcttgaacgccaagccgccgccccacagggtcgaggccgcaatggcacccagcaatgccaacaccagcatggcggcgccgaacatcgagcgtttaaaccacagatcgtggcgttgatcgcgggtggcacggcggtcgcccgcggtgtcgcctgcgtgagaagtcatgaccagcgggtggacggtgtcgttcatatcagatgtgctcaccgccttacgcagtcaatgcgcaaggcggccgtaggacgaatcagttggcgaagtcagacttccagtaaccttcgattcgcgacaccagggagtccggcagggctacgtagtccagcgccgctgcctgttgctggcctttttccagtgaccacttgaagaagctgaacgccgcctggctttgctcggcattcttcggctgcttgtacatgatgatccaggtggtcgccgtgatcggccacgcgccttcgcccggggcgttggtcatgatcaggttgaagtctttggcattcgcccagtcagcggtatctgcggcggcctggaatgccttggcatcaggttttacgaatttccccgaagcgtttttcagttgggcataggtcattttgttctgcagggcgtaggcgtattccacaaagccgatcgagttcttgatctgcttcacgtaggccgaaacgccttcgttacccttgccgcccacaccgaccggccacggcacggtggtgccgaaccccaccttggttttccagctgtcactgactttggccaggtagttggtgaagttgtacgaggtgcccgagccgtcggaacggtgcaccacggtgatgttcgcccccggcagattcaagccggggttgagggcagcgatggccgggtcgttccaggccttgatgtcaccgaggaaaatcttcgcgagcacgtcgccatcgagtttcaactggccagccgctacgccctcgacgttcatcaccggcacgatgccgccaatcacgctggggaactggcccaggccgccggctttgagttcatcggccgacagcggggcgtcggaggcgccgaagtcaacggtggctgccttgatctgggcgatgccgccgccggagccgatcgactgatagttgatgcggttgctggagttcttgctgtagtcctgcgaccacttggacagcaccgggtagacgaaactggagccggcaccggtaacgtcggtggcgtgggccacgccgctcaagcacagggcagcgaacagaacagacagactttttttagtcggcaacatcacgacaacacctcaagggaaggggtaagtggataggtccacctgtctaagacgtgacgatttaattcctgagatatgtctgtttaatgacggtttggctttatgaagaaacatttagaaatgtttgcgccggtgaacgtgggttgcccacgtccaccgccgccgtgcgacttagttgatgctctgctctatcccggcctgcaacacctggctgtcgctgtgcccgccgacccgcagcggcccaaggttgaaagcctgatccttacgcgtggcgtcgtcctgtttccgggtcagttcatccttggcgcccagggccaggttgaccggtgacttcgacaggttcagcccgacatcggcccggtagtcgctgccagccagcgtcgtcgccttgaccgtggaaccgccgaggtcgaccttgcccttgtccgcgctgatctgcgcacccgtgaggcgtgtttcgccactcacgtgcagagtcacgccctgagtgccgcgcaggcccgacgcctgggtgacgctgtctttcaccacgtggctgacgtccaggttcaacgttggggtgtaggacgtatcgccacttttgtcgccgaacagcaggttttcggcggtattggccaccgagctgccggtggtgttcttgccgctgacggtgtagctgtccgtggtttttggccagactttttccttgaggttggacaggcgagtgcccacggcgtccttcttgtccgccaggtaagccttggcttggtctacgcgtgtgccaaaggcgccacggggctcggggttcacgtcgtagctaccgctgcgggtgagtttttcgcccaggcgctccttggcgttgatcacgctctctttggccgaggccaggtgctccgcgcccttgtcgacggcgttctccagtttttcgcggtgtttttcgaacgcgccctcggccttggcttgcaccttgtccttgagcgggccgctggccttggccagtttgttgaccacaccgggttggtttttctcgacgtcgagccgggtgtcgacgttgacctgggtgctgctgacgtggtccttgcggctctcgatgacgaggttgccgccgacgttgccgctgacctgctcggcttgaatccgcgcgccggccagatgggtatcaccggcactgttgatcaccaccttgttcgccttgatcaggctgtcgtgctgggtggtgccttgcaggtgatcgacgtcgaccttgacccgcgcattgatgccgtactgggttttggctgtgtcgtgttcaccggcgtcggccagggctgttttgccgccgctgccacctgcgcccagggtcacgccccagctgttatgcgcctgggtggattgcgccgacgcttgcagaatgccgccgcctttcgccgtcaggttgaccctgtcggccactacctgggtgccttgcaggtggatggcatccgccgcatctgcgccactggcgagggtaacgttgccgttgctgtgcaattgcccgaccactacgccctgatcgttctcggaaaccttgccgatgttgaagttggcgctcaggctgccggttgtaccgctgctttcggcactgctggtcttgccggctcccaccgtcaagccgccgcccaggttgctgccgctgctcacatggttttcggtggccgcttgcaagttcagtttgccgccagcgttgaggctgatgtcaccggtcttcgcggtgctgctgccgatctgagtgccttgcagggtcatgtcgccgccactgctcagttggatcggcccgctgccgtggagcgtcgcgacacgtgcctggctgtcctgggtgtcgaggcgcttgttatccagttgaacgccggcacccaggttcacgttcgtacccttgctgcccggcgctgtgcccaccgtcaacgagccgctgccgcgcaggctgttgtcggttttgtgttgggcatcgctggcctggttcagcgccaattcgccccccgtcttgaggttgacgcctgcctggccaccgttgaagtggctgccttcatagcgtgcatcgccttgggtctgaatgctcacaccctgagccccggcgtagctgccgaccaccgccgtgctgcttgattcgcgcacatcgctgctgctgccggtgccgctgccgcgcacgttcaagtcttcccccgtggtggtgtaaacccgcacgcccgccttggcgtccacgccttgctcgctgctgctgtgagtgttggcggctgcggtggcaaggtgctcgccggcattgatcttgagcccgccctcgctggcgcggtattgagtgccttgatcctgcagcttgccagcgacattcacttgtaccgtgccaccactgaactggctgaccaccgcggtgctgtcctgctgtgtgcgggtcgtgtgggtatgaccgacttccacatccagcccgacattcggctgctcgaacgcatcgagcaaacctggctgatggaatttggcctgggccacgccctcgacggctttttcgatcggccgggtgatgcctttgtattcgacattggcgccgacatcggcggtccagccattctccttgtgggtgctggtctcggtgttatgcgccgcctggttatcaacctgggcagcgttgacctgcaactcggaaccggctttgacctgcgcgccttggctggtcagggtgttgcctgcgttgatcgtcagcttgccggccgccgctacattgctggtttgcgcggtggttttgttgcgggtgtcatcgctgctctgatggctgaattgcgcaccattgccggcgcggtccaggccaccggtgtagtacacgccgcccgcagtggtggtcgtgtcggtttggttgcgggtgctgtcatgcgccgccagcagctcgacgtttttgccgctcacggtcgcgtcgccctgggtggccttgagctcagagcccttgatgctcacatcgccacccgctgtgacggccaggctgccaccgctgaggctggcagcctgctgccgggtggtgtcggtcttagctgtttgctgttgatcttcgtaggtgacacccgcgcggtactgacggctgccttcggcggtttgcttggcgtagccatcgaaaccacgggtgtgagtgcttgtggtatcgctggaggtgtcttgcgccgaagcgaccttgatatcgcccttggcgtgcgcctgcaatgaacctgtggcagccacttgagagccactgacttcgatgtccttggcgctttgcagtctgaggttactgtccgagcgcaggttgctggcgacggtggtgctgtccttgaggttcttgcggctttcatcctttgtaatgccgaagaacttactgtcgttgctgtagctattgtcgtgggaggtgtcttgtacgccgtcgatcaccagcgagcctttgtcgctgatgacgctggcctgtttgccgccgcgcgcctggctgccgctgatgcgcacgtcatcggccttgacgatcaacttgccgtcggcattcacctggctgccggtgttcaaggttttgcccttgtcaccgtcgccgcttttgccgaagaagctgccgcccgtgaggtcgccggcgtaggcgttgtcgctgctgcgctgggtgcggctggcgctggcgatgtctacctggcggccggccaattgaatgtcgcccgccgatttcagctcggcgccctgcaactgcagtttttgctggctgctcaggtccagcgttttgccggcgttgaggctgctggtgacgctgcgttgttcactgctggctttgtcccagttggccttccacaggtgcttgcggtggttgccttgatcgcgggtttcatgggtttcggtggcagcgttcacctgcaggtcggcgccgctgttgacgcgcaaggcgtcgccggcttcgaccttgctggcggtgagggtggtgttggcgccggatgtcagcgcggcattctgttgcgcgacgacatggttgccgtgctggcgcgagtccttgtcggtggtggtgcggtcataggtttcgtaggtgaacaggaagttgctgttgttccactgttcacgtttttcctggagcttgcggctttccaggctgctgagggtcaggttgcggctggcgtcgagtttgacgttgcgcccgctgacgtccgcagcggcgaggctcaagtccttggcgctgtgcaagtcaacatcgccctggcggctgtgcacgccggcgcgggtggcctcaaggctgtcggcgtgcacctggccgctgatgtcgaggtcgccggccgagctgaccttcacgccgtcgcggccctcaagttgcaccgcgcccacacgcacgccggcgccttcggcggtactgatgatattgatacgcccggcttgcatcgcgccgaacaggcgggcgtcgatgcgctggtcctgggtcttgctcgccgggtcgacctgacgcacttggccgctggcgtagtcgatctgattgcggccgaccgtgaggttcaattggtcccgcgcactgaggcgcccatcgctgtcgatgtgcggcgcgatcaggtggatcgagcccgcgtcgttttgcaggccctggccttgcaccgtcagctggccgcttgcatcgcgggtgttcaaaccttgcagcttgccgtcgttgagctcggggcggcccactaccaggttggcattcggggtgttgatgaagctgccgccgttcacggaaatgccgttcgggttggccagcacataatcggcggcgcggccgaaaatctcctgggcgccgttgatggccgaggcgttgcggctcaccacttcgttgaggatcacgctggccgcctggccctggaactgcgggttggctgccaactgcccggcaagttgcgattggcccgcctgcaacgcgttgttcagcaccacgccctggcggtcaacgttgtagtccagaaactggttgtgggacaggccgccggcattcggcgcgacgatgttgacgatgggcacgccgccctgattttgcagctgcggcgtgccgccaggcccttcaacgacggtcacgccaccggccagcaccagctgcggcagcaggaacaggctggcgatggcccagcgcagtttgcccttgggggagaggtgaaacgtgtgtgtggcagtcggcataataaattcgctctgtgttggctgatccacgacgtgcgttgttcggtgcaacactggtgtagtggtcaggtacggcggttatttcaggctaatcatgtgtcagctcaaatctgcacgctaaggcgcgtcagccaaacctccggctcctggccaaaccctgtgggtgtgttgaggctgcgttggtaatcgaggtccagctgcaggttcttccagctcaggttgagcccgacgctggcgccgctcaggcgttggccctgggcgccgtgttcgcgcttgacccagccgttgtccaggcccaggcgcggggtgatttttatcggcaggtcgctgttgagcggcaggcgcaaggtgttgcgccacaccgcaccgatggcaccggacgcgctgtattcgcggtagccacgcaccgccgagtcgtcggtgcccagcagttgttcgatggcgggcaaggcgtccgggctgtattgcgctgacagctggctctgccattgccacggttgcccctgccattggccgttgcgccattgggtgaggttggcgcggtacttgtggaattgcgccaggggcaggtttttttgcgtttgctcggcatcgcgatcagcgccgaaccacgtcaggccttgggcgtaattgacgtcgaggttccacaccgcgctgttgagccagaacaggttcaggcccgcctcggccacggtcagtgttgggctctggatgcccaggcggaccttttgcaggtagctgtcgacgtccttgtaggccagttgcaggttggcactgagttgatggccctggtcgcgccacagcacccggtcggtgcgcaaactgacctgatcggtgcggccgctgttatacaaggtggtgcgactgagcttgaacggcgagcggtattcggcatggctggcgaacaggctgtaggtccagtaaccgtaagggatggcataaaacaggctgttgctgcggctgtaacgcggcccgtggttgagcgtgtcgctgaagctcaggttgagcgaatcgttgagctccagcgggctgtccaggctcaggttgatcgcattgcgatcacgcccggtgcccgcgcttccaaggttatccagcccaagtcccaaggcccagcgcgaagccgtgctgcgcgagcgcaggatgatgcgcgaggcgccaggttcactgccgggagcaatgtcggcggtgaggtccaccgagcgcaggcggttgagctggtccaggccttgctccaggtcgcgcaggttcagcggctggccgagcattccgggaaatgccccggttaacgacacgggcaggctctggtcggccagttcgatggcttccaggtaaccttcttcgacgtgaatatccagcggcagcccggcggccggcgtgctgatcaggtacgggcggctggcgatatagccggcctccacatacagctgggtgatctcggccagcaggcggttgatctgggtgacgcccatgcacggcgccacgtagggctcgatgcgtttgttcagttcggccctgttgaacagcgtgaccccggccaggcgtgtaccgctgagcggccagcagcgttcatctttgtcgacagcgttgggcaaggccggcgtggccggttgagtaccgaaactgccgcgttgcatctgccgctggcgctgctccagttgtaactgttgcaggtcgcgctgttgttgctgctgcaagcgcagggtttcctggccgggctgcgggccatcggcggcggccaccggcaacgcgcacaggcagagcagggcgacactccatctgcggatacagcaaaggcgttgggttgagggctggtttggcactcgacatccttaacgtagaaatacacacaattcatgcccctgagccaaaccgtgagctcaaggtatgccgcacttgagtcatctttaaacggattgttacatcggctgtaggatttattacttaaaacgtgaggaatgccgcgttattcaggaaataaatgcacatttttagtgcgcaggtgcaggcgcatgccggataagccacgtattttcggggaggatgagaaggggggtgtacgaagaccgtttttgattgttgcagcgaaatcgcttaatcggggcgtttatagcgcaagcgcacgccggataaaaccgggcagtcacgaatagattaaaaggtcataaaatgaagcctaaaaatcaccaaagtccttgaaatgcttgagattgtcggacaatccagcagatgaaaaactcttcataaacgctccgctcgaaggttggtagttttcccagcgctgcccaataattcgagtcctaataatgaataacaaaactcttaaaggcgccttggcgctgtccgtttcgctcgcctccacacaattgctcgccggtggttttgcgctcaatgaacaaagcgtcagttcaatgggcacgggctacgccggtcgttcttcctcggccgacgacgccagcacggtgttcggcaacccggccggcatgtcccgcctcaagcacaatgaagtcagcatcggcgcgacgtacctcgatgccaaaaccaatatcaaggacgccagctccagccagggcggcgtcgataaccccggcaccaacaagggcgacatggtgcctggcattgccgtgccgatgggttacctggtcacgccgatcgatgagcactgggcgtttggcctgggggtttacgcaccgtttggcctggtgaccgactatgaacacagcttccagggcaatggctttggcaataagagcaagattcaagtcaccaccgtgcagccgaccgtcagctacgcgttcaatgacagggtgtcggtcggtttcggcccgaccttcaacaagatcagcggcgagctggactccaaagtcccggcgttcggcctcggcaccgaagcggtgaagatcaagggcgacgacaccgcgatgggtttcaacgccggtatcctggtgcaggcgctggacagcacccgcatcggcgtcacctaccattcgcaagtggtgtatcacctgagcggccatacccaagcctcgggcgtgctgtccgacctgctggacggtgggccgcaaaagtatgacgccaagctgaacgtcaccacgccttcttccgtggacttctcggtcactcaccagttgaccgatgccttgaccctctacgtgggcagcacctacacgcgctggagccagttgaagaaaatcacggtgaacaacgccggcgtgtcggatattacggctgagctggcaggcctgggctccatcaccgaagagcagcactggcacgacacctggtcccatgccatcggcctgtcgtatcagctcaacaaacaactggtgttgcgcaccggcttctcggtggacgagacgccgaccaacaacaccgaccgttctgtacgtattcctacgggcgaccgtacggtattcagcgtgggtgccggttggacgcctgtggataacctgacctttgacgtggcctattcctacctgaaggaagaaccgatcaaggttcgcgacaacaaccctcagttagcgctgaactacgacgccaagtatgaaaacagcgcgaatgggtttggtggttcggtgacttaccgcttctgatcgatgcaatccggcgaagagccagttttttggcatggctctttgccagttttgttgacatcaatgctgtcatttacggcgcgtgttggttagattgaaagctactcagcttttaagacatggactgtcatgactacgctaacgcctgttatcgcgaccaatccccttattgttcgggctgcgaccaccgcgcctcccgccaccctggcgaacattgtcgatgtctcaccgacgcggccttccgcagtggtcagccttggcaatccggcagccgatgtcgtcgatacctattctcgcaacggcttgttgcccggccaggaaagcgtgcggacctgggaaaacaacagcgatgattcgatcacctgggccatcaactccagcttccactcggtcactacggccggccgctacagtgggctgggcgctgcgttggtggaccaattcaccaaaggtggcggtgccgctatttcccagtcgctgctcaacatcaccgctgaccgcgccggcgacaccgatgcaatcaaggcggaccagacgctgctgcacagcaaggccgacaaccaagtcagcctcagcatcaagactgccagcggcaagacggtgacgttcagcctgtccaaccagaaagatggcctgggcgtacaggccaccgtagaaggcggggagttgaccgccgatgaactcaaggccgtcggccagttgggcggcgcattccaggcctcggtcgacgggctgaccgccgtgccgccgaaactcgacttgagcaggctgactcagttcgacgccaagctgctgtcgtcggtggacctcaatgccaaagtgaaggcctcgaacgatgaggacattaccctggcctttcatgccgacagcgcgagccgtaccacgcgcatgagtggcccggcgggtcagattgacctcacggtggacctgagaaacgcggcgatcctcggcaatgccaagcagcaggccaaggcgctgcaaacctacctggcgcagttcgaccgcgtcgagcggcgtggcagtgccaacgcggacctgatggccatgttcaaggacgcgttcagcgccatgaacagcaactatccgcccggggctggcactgcaaacccgctgacgaataacccgaccgacaaaggcttgctgacgggcctggctgacttcaaggcctcgatcaaacaggcggcgggcgcgcccaattcgatgcgtcggtcggaagttgagggtttttcctacagcgtgtcgcagaatacccaggtcaatggccgcagcacgggcgaccgcagcgtcacccagaaccagcaatcgctgctgtcggcgagcttccataaaggcctcgacggtggcaaaccgccggtttttgacggctctcgcgaatcgcagaattacctgtatgtgcaagtgcaggacaaggccagcagcaccgcaaacttcgcctataaagatggccgactgacaaatgcgtccgttacccaatcggcttcccagaacacccacacgcagaagtacgtgatgggcaaccgggtgcaagacagcgtggtgccgaaggaagcctcaaccaagcgcgactacctggcgctgcttgagcacgccgcccagcagagcaaaaagtccaaggatgccctggagcagtcaaccttgaaggatgccttggccaacatgcatgactcgatcctgttgcagaacgatccggatgtgctgatgcgctgacgttcggcgtgatcaaagcgggaaggcccagtgatgcgccttcccgttttttttgcccgatgagcgtgcctgtgcaggccagattaggcttttgaatccattcgatattctgtagccttgcgcagcttcacccgtgcttgatgaacacaatcacttcgtccggcggcgcccgaagggctccagagccggtggtacactcgactttcgcgcttactgcgcctgcaggtcttgcgaacatgacgcaaatttccgaacgcctactggtccaagcccacctcgatgccaagcagcccaaggcgctgagcgccgaagaagaggcgagcctgcgtgccgccatcgccgccgagctcaaggctcaggacgcggtgctggtcgcccacttctattgcgacccggtgattcaggccctggccgaagaaaccggcggctgtgtctccgactccctggaaatggcgcgcttcggcgcagcccacccggccaagaccgtactggtcgccggtgtgcgtttcatgggcgagaccgccaaaatcctcacccccgaaaaacgcatcctgatgcccaccctggaagccacgtgctccctggacctgggctgcccggtggatgagttttcggcgttttgcgaccagcatcccgagcgcaccgtggtggtgtatgccaacacctcggcggcggtcaaagcccgggcggattgggtcgtcacctcaagctgcgcgctggaaatcgtcgaaagcctgatggacaacggcgagacgattatctggggcccggacaagcacctgggcacttacattcagcgccagaccggtgcggatatgttgctgtgggacggcgcgtgcatcgtccacgaagagttcaagtccaaacagctcgaagacatgaaagcgctgtacccggacgccgcgatcctggtgcacccggagtcgcccacggcggtgatcgagctggcggacgccgtagggtccaccagccaactgattgcggcggcccagcgcttaccgaacaagacctttatcgtcgccaccgaccgcggcatcttctacaagatgcagcagttgtgcccggacaaggtcttcgttgaggcgccgaccgccggcaacggcgcagcctgccgcagttgcgcacactgcccgtggatggcaatgaatacgctggagcgcacgctgcaatgtttgcgtgagggcagcaatgagatctttgttgagccgtcagtgattccgcaggcggtaaggccgctcaagcgcatgctggatttcactcaggctgcgcgcctgaaattggccggcaacgcctgacctgaggcgagcacggtaagaaaatgtgggagcgggcttgctcgcgaatgcagtgtgtcagtcgatacatctggtgactgatccaccgcattcgcgagcaagcccgctcccacatttagatctccattattcagcagttacttcttctgcttcggaatccgcaccaactgcgtatccgaataaatgtcatgccagctgcgtttgtgcttatcaaacagcgaccagataaaccccagccccacgcacaaccacgacgcaatcgacaccacaaagcgcagcagcgcctgccacaggctgatccgcgagccatcggcgttctgcacgcgcacgccccacacctgcatgcccagggtctgcccggaataggtccagaacttggcaaaaaaaccaaacaatacaaaaaacaaaatcgtcgacagcaacgggtcaccgtccagcgcgccggattcggtgagcgtgcgcatcttggcttcgccgataaacgccatccacaccagcttgtagataaacgcggtgacgatcagcagggcggtgcacagcagaaagtcatagaacatcgctgccaggcgacggcccaggccaacggcggggaagtcgccttgggggctcagcaggggtttggacatggcagtctctctagagaaaaaagccattttacgagcaaacgcacataaaaaagcccctgatgtcaccatcaggggctttttgtcgcagcaaggatcagccttctgcttgtacttcgtcagcctgcatgcctttctggccttgcacagctttgaaagtgaccttctggccttctttcaggctcttgaagccgttgccttgaatagcgcggaaatgcacgaacagatccggaccgctttctggagtgataaaaccaaaccctttctcgtcgttaaaccacttgacggtaccgctctgacgatctgacattttcttctttcctttgacgctaaaaattaatgacagcccctttcacacgaaagagtactgggctgagttgcaggaaagtaagagacgtcgaacgggttgtagcaaacttttggctactgcccaggtccaggttcaaagcgacccatgcaaacacagtgaacaaactttacgccaactaatggagaaaaaacaagccctgccaaaagcccaggttttgcttggcttcgtgactgtttgagcaacaaagtggatcccgtttattcgatagagttgatcacttgttataggcgcgggcctattacattgtctatcgtcaatgcactgttttatggcggttgcgttacagtttagtgcacgttaacgcaaccgcgttacttatagaaacagtcaatcagccacggtagtaacgttgcggtacaaatggcattttacttacacgtaatggcacctttttcccacgcaccaacgcagacacttcggtgtccagtgcgatgaaggcgctgtccaggtaacccatggcgagcgggccgcccaaggtcgggccaaagccgccgctgcacacgctgccgatcacggtgccgtgttcgtcgacgatttctgcgccttcgcgcaccggggtgcgttcctggggcagcaggccgactcgcttgcggctcacaccggcttgctgctgggtgaagatccggtcggcaccggggaagccaccggcacgtgcaccgtcggcgcgccgggccttggagattgcccacaacaggctggcttcaatcggcgtggtgtcggtgttcatgtcgtggccgtacaggcacaggccagcttccaggcgcagcgagtcacgcgcgcccaggccgatggcctgcacttcggtttcggccagcaggctgcgcgccaggctctcggcattggcagcgggcaccgagatctcaaaaccgtcttcaccggtgtagccggagcggctgacgtagcagtccacgcccagcagacgcaaggtggcgaactgcatgaacgtcatcttggtcacttcaggtgccaggcgcgccagtaccttcaccgctgccgggccttgcagggccagcagggcgcgttcttcgaagagtggctcaatgctgcactgctcgccaatgtgtttgcgcaggtgcgccaggtcctggtccttgcaggcggcgttaaccaccaggaacagttcgtcgttgcccagattggccaccatcaggtcgtcgagaatgccgccctgatcattggtgaacatggcgtagcgctgcatgccaaccggcaggtcgatgatgtcgacgggcaccagggtttccagggctttggcggcgtttgcaccggtcaggcgaatctggcccatgtgcgacacatcaaacaacccggcgtgttcacgggtgtgcaggtgttccttcatcacgcccagcgggtattgcaccggcatgtcgtaaccggcgaagggcaccatgcgcgcgcccaattcgaggtgcagcgcatgcagtggggttttcaacagggtttcggtggacatattcagctcctgaaaaacgtgcggacgcgctgttaggcgtcagcactcgataatgttgaccgccaaaccgccacgggcggtttccttgtatttgcttttcatgtcggcgccggtctggcgcatggtgcggatgactttgtcgagggacacaaaatgttgcccatcgccgcgcaaggccatgcgcaccgcattgatcgccttgaccgagcccatcgcattgcgctcgatgcacggcacctgcaccaacccgccaatcgggtcgcaggtcaggccgaggttgtgttccatgccgatctcggcagcgttttcgacttgggacacgctgccccccaacacctcgcacaacgcaccggccgccatcgaacaggccacgccgacttcgccctggcaaccgacttcagcgccggagatcgaggcgttttccttgtacagaatgccgatggcggcggcagtgagcagaaagcgcaccacgccgtcttcgttcgcgccggggataaagcgcatgtagtaatgcagcaccgccggcacaatcccggccgcaccgttggtgggcgccgtgaccacacgcccgccgttggcgttttcttcgttaacggccagcgcgtacaggttgacccagtcgagcaccgacagcgggtcgcgcagcgccgattcagggtttttgcacagctggcgatgcagcgcagccgcgcggcgcttgaccttcaagcctccgggcagaatcccttcgttgcgacagccggcgtccacgcagtcttgcatcacttgccagatcttcagcaagccggcgcgagtttccgcctccgggcgccaggcactttcattggtcagcatcacctggctgatcgacagcccataggtggcgcaatggcccagcaagtccttggcgtgtttgaaagggaaggtcagcggcgtggtgtcttcgacaatccggtcggcgccggccgcgtcttcatccaccacaaaaccgccgccgaccgagtagtactcgcggctgcgaatctggatgccggcggcgtcgaaggcacgaaaaatcatgccgttgggatggtaggcgaggggtttgcgaatcatcgccaagtgttctttctcgttgaacgcaatgctgtgttcgccgagcaggttcaaacgaccatcgctgcgcatctgcgcgaggcgtgcggcgacagtttcggtattcacggtgtccgggtgttcgccttccaggcccagcagcacggccttgtcactgccgtggcctttgccggtggcgcccagcgagccatagagttccaccttgatgccggtggtggcgcccagcaggttgtcgcgcttgaggccttcgacaaatcgggcggcggcgcgcatcgggccaacggtgtgggagctggaggggccgatgccaatcttgaacaggtcgaacacgctgagggacatggttgttctccggtttcttattatgtgttgggtgtactcgacctgactgtggaagaggtccaggtgggagctggcttgcctgcgatgcagacaccccggtctatcaggtagacccgggtgatgccatcgcaggcaagccagctcccacacaagccagcttttacattaaatcgagtacatcctcaggttacgcgtagctctcaatcgacgggcacgcacacaccaggttgcgatcgccaaacacgttgtcgacccggccaaccggcggccagtacttgccttcgatcagcgacgcaaccgggtacaccgcttgctcacggctgtacgggtggctccattcaccgacgatttcagcggcggtgtgcggcgcgtttttcagtgggttgtcgtccttgtccagggtgccgttttccaccgcgcgaatttcttcgcggatggcgatcatggcgtcacagaagcggtccagttcttccttggattcactttcggtcggctcgatcatcaaggtgcccgccaccgggaacgacatggttggcgcgtggaagccaaaatcgatcaggcgcttggccacgtcgtcgacgctgatgccgctgctgtctttcagtgggcgcaggtcgaggatgcattcgtgcgccaccaggccgttgctgccggtgtagagcactgggtaatgctcttcgaggcgacgggaaatgtagttggcattcaggatcgccagctgcgaagcacgcttgaggcccgcgccgcccatcatgctgatgtacatccaggtgatcggcaggatgctcgcgctgccgaacggcgccgcgcataccgcgccttccttgcgttccatggccgcatggccgggcaggaatggcgtgaggtgcgacttgacgccaatcggaccaacgcccgggccgccaccgccgtggggaatgcagaacgtcttgtgcaggttcaggtgggacacgtcgccgccgaacttgcccggtgcgcacaggccaaccatcgcgttcatgttggcgccgtcgatgtacacctggccgccgttgtcgtgaatgatcccgcagatttcgcggatgccttcttcgaacacgccgtgggtggacgggtaggtaatcatcagcgcggcgaggtgctcgcggtgttcgatggccttggcccgcaggtcttcgatatccacgttgccgcgtgcgtcgcaggcggtgaccaccacgcgcataccggccatgttggcggtcgccgggttggtgccgtgggccgacgacgggatcaggcagatgtcgcggcgctcttcgccacggctctggtgataggcacgaatggccaagaggcctgcgtactcgccctgggaaccggcgttcggttgcagcgagatcgcgtcataaccggtggccgcgcagagcatggcttccaggtcggacgtcagctgcaggtaaccagcgctttgcgcggccggggcgaacgggtgcagggcaccgaactcggcccaggtcaccgggatcatttcactggcggcgttgagcttcatggtgcacgagcccagcgggatcatggtgcggtccagcgccaggtccttgtcggccagtttgcgcaggtagcgcatcagctcggtttcggagtggtaacggttgaacaccgggtggctgagaatcggcgactggcgcagcagcgcggccggcagcgtgctttcagcctcggcgaaggcgggcagtgccttgccgtcggcgaaaattgaccacaaggcttcgatatcagcctgggtggtggtttcgtccaccgacaggcctagacgctcagcatccaccacacgcaggttgatgcgctgggcgcgggccttgtcgtgcagggcggcggtttgggcgccggtgttgagggtcagggtatcgaagaagtgttcctgctcgaccttcaggcccaaagcggtgaggcctttggcgagaatcgcggtcaggtgatgaacacggttggcgatctgcgtcaggcctttcgggccgtggtacacggcgtacatgctggcgatgttggccagcagcacttgggcggtgcagatgttgctggtggccttctcgcggcggatatgttgctcgcgggtctgcatggccaggcgcagggccggcttgccgaaacggtcgacggacacaccgaccagacggcccggcatgtcgcgcttgaacgcatccttggtggagaagtacgccgcgtgcgggccaccaaagcccagcggcacgccgaagcgttgcgcgctgccgatggccacgtcggcgccgaactcgcccggaggcgtcagcaaggtcagggccagcaggtcagcggccacggcgaccagggcgttggcggcgtggaagcgttcggtcagttcgcggtaatcaaacacgtcaccgttgctggccgggtattgcagcagggcgccgaagaacgggctgacgtcggtcagttcgcgctcatcgcccaccaccacgtcaatgcccagcggctcggcacgcgtgcgcagcacgtcgagggtttgcgggtggctgtggatcgaggcgaagaaggcgttgctgcccttgttcttgctcaggcgcttgcagaaggtcatcgcttcggcggcggcggtggcttcgtcgagcagggaggcgttggcgatcggcaggccggtcaggtcgctgatcagggtctggaagttcagcagcgcttccaggcggccttgggaaatctcgggttggtacggggtgtaggcggtgtaccaggccgggttttccagcaggttgcgcaggatcggcgacggcgtgtggcagttgtagtagccctggccgatgtaggtcttgaacagttggttcttgccggcgatggccttgatcttggccagggcctcggcttcgctcaggccgtcttccaggccgagcacgctggtgcctttgatgctttccgggatcacgctggcgctcagggcttcgagcgagtcaaagcccagctttgcgagcatttgctgctcgtcttcctggcgtgggccgatatggcgggcgatgaattcgttggcggtagtgagattaacggtcatggcgcgctcctcaggcttcagcgttggctttgatcaggcggtcgtacgcatcttgatccaacagcttagccactgcctcggcatcggcgggtttaaagcggaagaaccaaccttcgcccatcgggtcttcgttgaccagttccgggctgtcgctgagcttttcgttaacttcgaggacgtcgccgtccagcggcatgtacacgccactcgcggccttgaccgactcaacggtggaggcttctgcacccttgtcatagtgctgcagctccggcagttgcacgaaaaccacatcacccagcgcgttctgcgcgaaagcggtgatacccacggtgacgctgccatcggcttcggcgcgcagccattcgtgatcttcagtgaaacgcaactcgctcatggaaactcctcaaggccagattcgtctggtggacgggattggaataatggggagttgcttagcaatatcgcggccaacgttattaattcgttataaatcaataggttaataaaattggttatggcgcggggagtttttgctgtagcgatttcgctacactcgggcctgtgaaaaaaagcctatgtggatcaaagccttgcatggcgcgcaaaaaacagggttgtagcgatatcgttacgctgtagcgctttcagtacactggatgtcgttctcagaccaaaatctggagtgccgtccatgtgggaggtgcttgtgtgggagctggcttgcctgcgatacaggcacctcggtctttcatctaaaccaaggtgatgctatcgcaggcaagccagctcccacacaagccagctcccacagaagcctgcccccacagaagccagctcccacattttgatcagcgtttatccagtcagggcttgttgggaatgccgtacttgcgcagccgatgcgcgatcgccgtgtgcgaagtctgcaggcggctcgccagttggcgggtcgaggggtagctggcgtagagcttttccagcaggctgcgctcgaagtcttcgaccgcctgttccaggctgtcgacttcgccgtcgctttggcgcgctaccgaggtgccggcgatgtccaggtcgccgatgtccaccaagctgctttcgcaaatggcggcggcgcggaagatcacgttttgcagctggcgcacattgcccggccagcggttgcccagcagcgccgggtaagtgccgggcgccaggcggcacaccgggcgctggatctgcgcgcaggcctgctgcatgaagtagcgggccagcagcaggatgtcctggccgcgttcacgcagcggcggcacttcaacgttgagcacgttaaggcggtagaacaggtcttcgcggaaagtaccctcgctgaccattttttccaggtcgcggtgggtggcgctgagaatgcgcacattgaccttcacttcgcggtcgccgcccacgcgccggaagctgccgtcattcagaaagcgcagcagcttggcctgcaagtacggcgacatttcgccgatctcatcgaggaataccgtgccctggttggccagctccatcagccccggcttgccgccgcgttgggcaccggtaaaagcgccgggtgcataaccaaacagttcactctcggccaggttctccggcaacgccgcgcagttcagcgccaaaaacggcgcactgtggcgcgcgctgatcgcatggcaggcccgcgccaccagctctttgccggtgccggtttcgccctggatcaacaacggtgcatccagcgccgccacccgctgcgcacgcgccttgagggtgcggatcaccggggattcgcccaacagcgcatcaaagccttcggcatggtcatggtgcagcgccgacaattgctcgccgatgcggttgggctggtacagcgtcagcaaggcgccagcgtcggtgataggcgtggcgtcgagcaaaaaggtctggccgttgacgctgatttcgcgcagaggcaggcgaaaaccatgctccagcaaagtctccagcagcgccgggtcattgaacagttcgctgatgctttcccccgccggttcgcggccgtacagcgcgatcaacgccgggttggccagcaggatcttgccggcgctgtccagggccaataccgggtcggtcatcgcggccagcagggcgtcgagttgcaagtggcggcgctggccgggaaggatgtcgaccacggtgaccgcctgcacgccgtgcacgctgaacagcgcgtcgcgaagctcttcgaggacctcggcgctgagggtcggcgcgtcgatgtagacgttgggcggcaccatctccaccgcatccaggttgagattgcgcccaccgagcaaggccaggacttcctgggtaatgccgacgcggtcgatgaagctgacgtggatacgcatggggtggctgacaaatctgcaaagcgagaggccgcaagtatgccttggagctgatggagatcaaaatgtgggagcgggcttgctgtggcgagggagcttgctcccgttcgacagcgcagctggagtcggctttttgggggcgcttcgcaccccagcgggagcaagctccctcgccacaaaagccagctcccacattggagttacggtgttgttattccaggtgctcgggctttaccggatcgcccgccttcacatccaactgatgccgcacatcctcaaacatcaagtcgtactgcttgtgcatctggccgttgagcgtagcaaccttcggcatgccatatttctgcgcgatgttcatcgcatgccgggcgaaatcaaatgcctggtccttgggcaaaaagaattcctccttgaggtccttgccctgcaccgaaccgtgcagtttgaagagcattcccttgccttcctttgggtcctggctgacttcgtagtcgatgcacaggttgtagctgtaatcatccttgttgagcgcgtgacgttcgacgtgcaggtgaccgggttcaaaggtggccataggcgtttctcctctacttcacaggtaggtgatgccaggtgttgccgtgctgatgcgtgtgccggcgctgccctggacgatggcttcgatgtccgagagtgaaccgatgacggcggttttgccagtctggcgggcgaactcgcaggcggcttgcaccttgggccccatggaaccggcggcgaagccgagtttttccatttcatcggggtgagcctggccgatagctttttgggtcggcttgccgaagtcgataaaggccgcgttgacgtcggtggcgatcaccagcaaatcggcgtccagttgcgcggccaacagcgatgagcacaggtctttgtcgatcaccgcttcaatgccgcgcagcttgccgtcttcgccatacattgtcgggatgccgccaccaccggcgcagatgacgatggcgcttttttccagcagccacttgatcgggcggatttcaaagatgcgtttggggcgcgggctggcgaccacgcggcggtatttatcgccgtccggggcgatggcccaacctttttcggcggcgagtttctcggcttcggctttggcgtacaccgggccgatgggcttggtcgggttcttgaacgccgggtcgttggcgtccacttcgacctgggtcagcaatgtggcaaacggcacttcgaagtccagcaggttgcccagttcctgctcgatgatgtagccgatcatgccttcggtttcggcgcccagcacgtccagcgggtacggcgacacgctggtgtaggccgccgcctgcaacgacagcaggccgacttgcgggccattgccgtgggcgatcaccagctcgttgccggggtggatcttggcgatctgttcggtggcgatgcggatattggcgcgttggttgtccgcggtcatgggttcaccacggcggagcagggcgttgccgcccagggctacgacgatgcgcataaagaatgtccttctaaagttgatcgttcccacgctctgcgtgggaatgcctcactggacgctctgcgtccgctcttgtgacgcggagcgtcacgggctgcgttcccacgcagagcgtgggaacgatcagtgtgagggttagatatccgccagcgccgacaccagaatcgccttgatggtatgcatgcggttttccgcttgctcaaacgcgatgttggctggcgactcgaacacctcttcggttacttccacgccattggccaggttcgggtagcgtgcggcgatgtccttgccgaccttggtttcgctattatggaacgccggcaggcagtgcatgaacttcacccgagggttgcccgaggccttcatcatcttggcgttgacctggtacggcagcagttgctcgatacgctcgtcccacgcttccaccggctcgcccatcgacacccagatatcggtgtggatgaagtccacgcctttcactgcttctttcgggtcttcagtgatggtgatgcgcgcgccgctctcttcggcaaacgcctggcactgcttgatgaaatcttcgtgtggccacagcgcttttggcgcgccgatgcgcacgtccatgcccagcttcgcgccgatcatcagcagcgagttgcccatgttgtaacgcgcgtcgcccaggtaggcgtagctgatgtcatgcagcggcttgtcgctgtgctcgcgcatggtcagggtgtcggcgatcatttgggtggggtggaattcggcggtgaggccgttgaacaccggcacgccggcgaacttggccagctcttcgacgatttcctgctcaaagccacggtactcgatggcatcgaacatacggcccaagacgcgggcggtgtctttcatgctttctttgtggccgatctgcgacgacaccgggtcgatgtaggtgacgtgggcgccctggtcgtgggccgccacttcgaacgcgcaacgggtgcgggtcgaggttttttcgaagatcagcgcgatgttcttgccttgcaggtgcggacgctcggtgccggtgtatttggcgcgtttgaggtcgcgggacaggtccagcaggtaatgcagctcgcgggtggtgtggtgcatcagcgacagcaggctgcggttgcgcatgttgaaagccatgatggaatctccttagtagtcgattgggtcgcggatgatcggacaggtcatgcagtggccgccgccacggccacggccgagttcaccggcgctgatggtgatgacttccacaccggccttgcgcagcaacgtgttggtgtaggtgttgcggtcgtaaccgatcaccacgccaggctccacggccaccacgttgttgccgtcatcccactgctcgcgttcggcggcgaagctgttgccgccggtttccaccacacgcagggccttgaggttgagggcggcggcgacggtttcgaggaagttggttttctcccgttggatgtcgatgccgtgcggcttgctttcatccgggcgcagggtgaagggcacgatctggttgaccacttcggggaagatggtgaccaggtcgcggtcgcagaagctgaacaccgtgtccaggtgcatcgctgcgcgggatttcggcaggccggcaacgatcacgcgttccacggctttgttcttgaacaggttgcgcgccagttggccgatggcctggtgggacgagcgttcgcccatgccgatcagtaccacgccattgccaatcggcatcacgtcgccgccttccagcgtggcggcgccgtgttcctggtcggggtcgccgtaccagatctggaagtcggcgttggtgaactcagggtggaatttatagatggccgaggccagcagggtttcctggcgtcgcgccggccagtacatcgggttgagcgtcacaccgccgtagatccagcaggtgttgtcgcgggtgaattgggtgttgggcagcggcggcagaatgaaactggcgtggccgaggaagtcgcggaacatctcgatggtcttgccgccaaagctgcccggcaggtcatcggccgacaccccaccaatcaggaactcgctgattttgcgcggctccaggctgcgcagccacgagccgacttcgtcgaccaggcccaggccaacggtattggcggtgatcttgcgctccaggatccagtccagcgcttcggggatggcgacgatgtcggtcagcaggttgtgcatttccagcacatcaatgtcccgctcgcgcattttggtgacgaagtcgaaatggtcgcgcttggcctgggccacccacagcacgtcatcgaacagcagttcatcgcagttgttgggggtcagccgctggtgggccaaacctggggagcacaccatgactttgcgcagtttgccggcttcggaatgtacgccgtacttcacttttcccgtggtcattacagatcctccagtgaacaaaagttacagagtcaggaagccgtcgtagaggccataggcagccaccagggcgccaatgacgactgcggcaaaaatcagcttctcgacgttggtgaaaatcggtttgcccagttcatgcttggccttggcgaacaggatcacgccaggcgcatacagcagggcagaaagcagcaggtatttgacgccgccggcgtagagcagccagaccgcgtagatcaacgcgatggcgccgatgaacaggtctttcttgcgctcgcgcagggcgttttcgtaggtctcgccgcgcaccgccagcaacaacgcgtaagccgccgaccacaggtaaggcaccaggatcatcgaggtggcgaggtagatcagcgacaggtaagtgctggcggagaacagcgtgatcaccaggaaaatctgcaccatggcgttggtcagccacagggcgttggccggcacgtggttggcgttctcgcggcgcagaaactccggcatggtgtggtccttggcggcggcgaacatgatctccgcacacagcagcacccacgacagcagtgcgcccagcaaggaaatgatcaagccgacgctgatcagcaccgcgccccagtggccgaccacatgctcaagcacggcggccatcgacgggttctgcagcttggccagttccggctgggtcatgatccccaacgacagcacgttcaccagcatcaggaacagcagcacagtgataaaaccaatcaccgtggccttgcccacgtcgctgcgtttttctgcgcgggaggagaagatgctcgcgccttcgatgccgatgaacacccacacggtgaccagcatcatgttgcgcacctgattcatcacgctgcccaggtcggggtttttcacgccccagatgtcagcggtgaagatgtccagcttgaacgcgaacaacgcgatcaacacgaacagcaccagcggcacgactttggcgacggtggtcaccaggttgatgaacgccgcttccttgatcccgcgcagcaccagaaagtgcacggcccacagcaataccgacgcgcctatcaccgccgctggcgtgttgccttcgccgaagaccggaaagaagtaaccgagggtgctgaacagcaacacgaaataaccgacgttgcccagccaggcgctgatccagtagccccaggccgacgagaaacccatgtagtcgccgaaccctgccttggcgtaggcgtacacgccaccgtcgagatcaggcttgcggttggccagggtctggaacacgaaggcgagggtcagcatgccgatggcggtaatcacccaaccgatcaacaccgcacccacatcggcgctggcggccatgttttgcggcagtgagaagatcccgccaccaatcattgagcccacgaccagtgcaaccagtgcgcctaatcgaagttttccgggagattcagacattgcatgactccaatgcaggagaagagagaccacagaataagtctgtgcgctaatcaaacagctgactcagatcacttcattggcacattccattgtgaattaatgacttaggggtaagatccgcgggcaatactgctcctcgcaaagtcgcgtcccagagcggctctgcgttgtggttaatcatttagtgcgtttgagtggacttttgaaactagccctttttgctgaatgtgcaaactatttcgggcctaattgccaaatagctagaaggtggcatagtgcctgccgcctttaaattttaaataaatctaaactttataaaacgtcatgcccttacgttattgagcgtgagggttttatcgctgtctttaataaacgctacgctcgctgaattaattagttgagtgcacggttgtcagctcaaactatttttatcaggagtcttcatgtcccaaccggcccaaaaactcaagctcagcgcgctgatcgcgctggtggtgggctcgatgatcggcggggggattttctccttgccgcagaacatggccgcacgtgccgaagtgggcgcgatattgatcggctgggcgatcaccgccgtcggcatgctgaccttggcgttcgtgttccagaccctggccaaccgcaaacccgaactggattccggggtgtatgcctacgccaaggccggtttcggcgattacatgggcttctcgtctgcgtggggttactggatcagtgcctggatgggcaatgtgggttacttcgtgttgctgttcagcaccctcggttacttcttcccggtgttcggccaaggcaatacgccggtggccatcggctgcgcgtcgctgttgttgtgggccgtgcattttctggtgctgcgcgggatcaaggaggcggcgttcatcaaccagatcaccaccgtggcgaagatcgtgccgttgctgatgtttatcgtgatcgccgccgtcgcgttcaaggcggatatcttcacccgcgatatctggggcctgggcaacccgcagttcggcagtgtggtcgatcaggtgcgcaacatgatgctggtcaccgtgttcgtgtttatcggcattgaaggcgccagcgtgtattcggcgcgcgccgagaaacgctcggacgtcggccgcgccacggtgatcggctttctgggtgtgctggcgctgctggtgctggtgaatgtgttgtcgctggggatcatgagccagccggagctggcgcaattgcaaaacccgtccctggccggcgtactggagcatatcgtcgggccttggggcgcgatggcgatcagcattggcctggcagtgtcgttgctcggcgccttgctgtcctgggcgctgctgtgtgcggaaattctctacgccaccgcccatgacaaaaccatgccggcctttttgaaaaaggaaaacgccaaccgcgtgccggtcaatgcgctgtggctgaccaatgtgatgatccagatcttcctggttatcacgctgttttcccacagcacctacaccacgctgatctacctggcctcgtcgatgattctggtgccctacttgtggtcggcggcgtatgcggtgctgctcagcgggcgcggcgaaacctatgacggcgcccagcgccaacgctacaaggacttactggtcggcctggttgcgcttggctacgccgtttggctgctgtacgccggcggtttgaaatacctgctgctctcggcgctgctgtatgcgccgggcgtgatcctgttcgccctggccaagcgcgagcagggccagcccttgttcacccacctggaaaaaggcattttcagctgcgtggtcgcaggcgcggggttggcggcgtatgggttgtatagcggggtgttgtcgttgtgagatgggtatattagccgcccgatgactgggcggcgatgctgggctttttagcggcgcggcagccgttgagggcgtatgcggcgcagcatttgtggacgtcgttgccgggtggattagtggcgtctgggagggcctcttcgcgagcaagcccgctcccacattttgaccgcgtttcagaggagatactcggtcaaatgtgggagcgggcttgctcgcgaaagcggttttcaggtcaccactgagcccgatgcgagcccaattccccggccggcaaatcccactgcaacggcgtaccgctgatgctcaccggcgccagcaggcgatgggcctggccccaggccgtctgctccaccaccaagccctgatcgcccggctcctcggcgcgcaacgctggctgctccggcacttgcccggcctccaccaacaacttcgccgtacgcgccaacgataaccgcgccgacccgccgcgcccggatttcaagcgttcgctcaatgcctgaagcgcgctggccgccatcaaatacccggtggcgtgatccagcgcctgcagcggcagcggcaccggtttatccgactgcttccaggccatgcccgcgtcggctatcccgctgctcatctgcaccaggctgtcgaagccgcggcggttacgccacgggccgctccagccataggcgttgaggctcacgtcgatcaggccgggggcgagggtttgcaactgcgtggcggtgtagcccagttgttcaagggcgtcggcgcggtagccgtgaaacagaatgtcggcgtccttgagcaggctttcaaacacctctcggccctcggggcttttcaggtcgaggcgcgcgcagcgtttgcccaaggtcatttccggcactacgccgggttcgttccagctcggtgagtcgatgcgcagcacattggcgccgagcccggcgagaaaacgactggccacgggaccggccaatacgcgcgtcaggtccagcaccttgatgccggccagtggccgcgccaccgagccaagccagggtttgtcggtggtggtgtcgaaggtctggcgctgcaccaacggctcagcgttcaccgccagcccttgagggtgggtttgccaggcttgccacgaacgcatctgcgccgcgcagccaccggcatcgacaatcgcctgctccagttcggcagcattccaggccgcgacgttgctggccatctcggcgcggtcattgaccttgcccagcacccgctcggcggcggcacggtggtgtggcgcattggtgtgcaggcgaatccagccatcggtgcaggcgtagtcgccggctaccgggtcccacagcggcggcgtttgccagcctaccgagcgcagcgaggacgaaaaccagaacgaggccaggcgccggtcgatactgacgcttggcaagcgcccggtctgttgctggatcagttgagcgacggcttggccggcggcaccgaggctggcgctggccagttcggtcacggcaaaggtcgagggcagggcgccggcttcgctgaaggtcaacgcggtgtgcggtagatcgagtgcggcttggatgggggtcagcaggtcagtcatcaaaggccctccgtttagagaagggccactatagaagatcatcacaccggtgtgacaactcccggctccaacggcaagtcgatgctggcgatgaacccaccctcggcatggttagccaggatcaggctgccgccatgacgttcggcggcgcgccgcgcgatggccaggcccaaaccgtgaccctgggcggtttgcccgggggcgcggtaaaacggctcacccagttggctcaggtgttcggcgtcaacgcctgggccgtggtcacgcacgctgatgaagattctttcacccgcgcgatgggcgtgcatttctatcggctgccccggcgggttaaagcgctgggcattgcgcagcaggttatccaccgcgcgctcgatcatggtgggccagcccttgaggtgcaggtcggcctcggcattcagttgcaccacctgctccggcgcgctgagctgggcgtctttttgcagggtcttgagcagcgggttgaggtcgatgtcttcggcgctggcgttgtcggcatcgacgcgggccaataccaggatttcgctgatcagcgcttccaggcggtcgcactcgcgggtcaggcgtggccagagtcgttcgcgctcttcggggctggcgcgttcggccagggccagggcaatgcgcagccgggcgagcggcgagcgcaactcgtgggacacgtcgcgcagcaactggcgctggctgccgatcaggctttgcaggcgcgcgcccatgcggttgaaatcagtggccagcacgccgaactcatcgcgccggttggccaacttcgccaggctgttttgctggtaggtggcctggccgaggtcatgcaccgcgccgcgcaggcggctgagcgggcgggtgatggacagcgtcaccagcaggctgaacagcgtcaacaccaccagcgcaatcgtcagcgcgctcaacggccacgtcaggctgctgcggtgccattcgtccagttccgggtgcgggatgcggtagatcagcaggtaagtgtcaccggttttttcgctggtgtactcagcggtcaggcggcgccagggcagatggccgtccttgctgtcattctgccgggcctcaaacgccgcagcacgccgtgggaaggtgccgcgcaccaccgggtcgccgctttcattcagcacttgcacgtcgatgtggtactggcgtttgcgttgttgcagcaaatcctgggcagcgtcctcgccctgggcttcgtagagttgcgtccactcctgcgccaggttgttgaggccagggtggcggctgagaatccaggcgtcctggttgagcatatgccccagcaggatcgacaacccggcaaccagggcgatggccagccagaaactggccaggatgcgccagaacaatgaacgcacaggaaaccctcaagcaggaaaagcccagcggcgtaagccactgggctggggagtgaagctaacgcattattgcgctttttgcggctgttgggctttccaggcctggaattccttccactcggcgcggcgctcggcttgtttcttgacgatctcgtcgaatttcttctgttgatcgggtttcagcatggcacggatgtcggcctgggttttctgcttggcggcagccatttcgttcttcatggcttgctggtcagcggcgggcagtttgtccaggtacttgcggacgatctctttgcgaccgtgccattgttcgcccatcagcttgccgatttgctcgcgttgttcgcggctcaggtcgagctggctgaatgggccgcctttgccacgcggaccgtgttcaccaccgtggcccgggccacccatcatgtggccttcagggccgcccatcgggcctgggccttctggcgctgcggccatggcaacggtgggcagggcagcggcgaacatcaaagcgataagggtcttgcgcatggtgattctcctgtctctattccggtgagtccggatgtgagtagattacggagatcaaggtcagcggcggtcaggtgtgggtaaagcttgggtaaagaggtttttggtgggcgctgacaaaactttcaacgcaggtgagatcagtgtgggagctggcttgcctacgatagcggtttatctgccacatctgtgctaactggcccgccgtcatcgcaggcaagccagctcccacaggagatagtgtgtattcagaggctgtagtagtagccgcgactgcgcagcgccacgatccgtggccggccatccgggtgtgggccgattttcttgcgcaggttgctgacgtgcatgtccaggctgcggtcatagagtgtcagtttgcggcccagggcgatctgcgccagttcctgcttgtccagcggctcgccgggctggcgcagcaaggcttcgagcaggcggctttcggagacggtgagggcgaactcctgttcatcgatggtcaccacaccacgcaccgggctgaagcacaggtcacccagctccagctgcgtcgacacggcagccgggtggctgcggcgcaatacggcgcgcaggcgcgctgtcagctcgcgtgggtcgcagggcttggccaggtaatcgtcggcgcccagttccaggccgaggatgcgatccagtggctcgccacgggccgagagcatcagcaccggcagttccgggtggtcgttgcgcaattgcttgagcaactccaggccactgccgtcgggcagcatcacgtcgagtaccacggccgccggggcgctgtcggccaaggctctgcgcgcgctcaagccatcgtggcaggcgcgcacctggaaaccttcctggcttagccaactggtcagcagctcacagagctcctggtcatcatctatcagtaacagctcgctcatgactcactcaatttagccattgtcgacggcgacggtgcccaccgctggcgaagattccgcacagcaacgcgatcagtgcaacggcgccaccggtgacaaaccattgctgttgctcggtcagccagcgggtcaaggcgccgccctgtgtttctttgagttgctgggtaaggcgttggttctcttggcgcaagcgactcagttgggcgctttcgcgggcagcgtctgcggtttgcagttgtttgctcagttcttcacgcaggcgttcgctttctttcaagcgctgctgcaattcggtgatctggctgccggcactcaaggacaggggcgtggaactgccggtgttcgaggtttcttcagcgtgggccgcagccccgatcgttaacactgccaacagacacaactgacgtaagcgcatcggaactcctgattccacacgaatattcagaacgttgtcggcaggttaccgagaataatgagcaattaggagcgcgccgaaccgattaggttcggcgcggctttattaaagaaagcgcgttcaaggcaggacttgcttgaacggcttgatcaccacatcggcgtagacgcccgccgcgatatacggatcggccttggcccaggcctgggcatccgccagcgaggcgaactcggcaacgatcaggctgccggtaaaacccgccgcgcccgggtcattgctgtcgaccgccgggtgcgggcccgccagtacgaggcggccttcggcttgcagcacagtcaggcgttcgaggtgcgccgggcgcacgctcaggcgtttttccagcgagttggcaacgtcggtagcaatgatggcgtagagcatgtcagtcctcggttttcggcgtggtaggggcggtgtcatgcaggtggcgcgacaggtagatgccttggccgatcaggaacaagacggtcatgcccaggctgccgaagaccttgaagtcgacccagtaggcttgaaaggtaaaggccacgaacaggttggcggcgccgcagaacaggaaaaacacgatccaggccacgttcaaacgtgtccacaccgggtccggcaatgtcagcgcatggcccatgatccgcttgatcagcaggcgatcaccgatgaagtggctgccgataaacaccagcgcgaacagccagttcaccaccggggctttccatttaaggaaggtttcgctgtggaaggccagggtcaggccgccgaagaccaggcaggcgatgagggtcagccattggcttttttccagcttgcgctgggagatgaagatggcgccgtagaccacgatagagctgatgatcagcaccgcggtggcgctgtagatgcccccgaacgtcagttcgtgaccggcgatatcgatgaccctggggtcgagtttggtaacgatgaaaaacagcaacagcgggatgaagtcgatgaattgtttcacagtaagagccagaagctggatgtggcggcataataacaaacatccttggtagcgaaagcgccagctgacttgaggttacacactcccgtgaatgttgatttgcactgccacagcacggcctccgacggcgccctggcgcccgcggtactggttgcgcgtgcgtttgaaaaaggcgtgcgagtcctgtcgttgaccgaccacgacaccctcgaaggcctcgatgaagcccgcgaagcggcccaggccctcggcatgcaactggtcaatggcgtggaattgtcctgcacctggggcggcgccaccattcatgtgctcggctatggctttgatcaaaacgccccggcgttagtcgccgccatcgcccaattgcacgatggccgctggctgcggtccgaagaaataagccgcaaactcagcctcaagggcatgcccaatgcactcgacggcgctcgcgccatccagcaggaactgggcgacagcggcaatgcaccggcccggccgcactttgccgactggatggtgcgtgaaggtttcgtcaaggaccgcgccgaagcgttccgcaaatggctgggcgccggcaagttgggtgacgtcaagcaacactggccgaccctggaagacaccgtcggcaccctgcgggcgtccggggcctgggtcagcctggcgcatccctggcattacgatttcacccgcagcaagcgccgcaagctgattggcgactatattggagcgggcggccacgcaatcgaagtggtcaacgggcaccaacccgccgaacaggtggggagcctggcgattcttgcccgcgaatttggtctgctggtcagtgccggcagtgattttcatggcccaggcggctggtccgagattggcgagtaccgccaagtcccggaagacctgccgctgttgtgggggcgattcaagcatgaccccattattgccaccgtctgaacaggtagaacacgtgagtcaattcttccagattcatccggaaaaccctcaagcgcgcctgattaaacaggccgtggagatcatccgcgccggtggcgtggtgatctacccaacggattcgtcctacgcgattggttgccagatcggcgataaaagcgcggttgaacgtgtaagacgtctgcgtgacctggacaagaaccacaactttgcgctgatctgcagcgatttgtcccaactggggctgttcgccaaggtcgacaccggcaccttccgcctgctcaaggcccatacgccggggccttacacctttatcctgaatgccacccgcgaggtgccgcgcctgttgctgcacccgaagaagcgcaccatcggcctgcgcgtgccggagcacccgattgcgctggcgttgctcgcggaactgggtgagccgttgatgagtgtgtcgttgatcctgcccggtgaagaagagccgctgtacgacccgtacgaaatgcgccgcctgctggaaaaacacgtcgacctgatcattgatggcggctacggcggcaacaaggcttccaccgtgatcaacctggccgacggcgagccggaagtggtgcgtgtgggctgcggcgacccgacgccgtttatggtcgaggcctgaatgtcggtcgtggaaaccgtcgacagccaggccggcgcccagcaggaactgccttttgccatggtctatggccaggcggtcatggagatgccgctggatttgtacattcctccggacgccctggaggtctttcttgaggcctttgaaggcccgctggacttgctgctgtacctgatccgcaagcagaacatcaatattctggatatcccggtggcggaaatcacccgccaatacatggggtatgtcgagctgatgcagtcggtgcgcttggagctggctgccgagtacctggtgatggccgcgatgctcgccgagatcaagtcgcgcatgctgttgccgcgctcggagaccatcgaagccgaagaggacgacccgcgcgccgagctgatccgtcgcctgcaagagtacgaacgcttcaaagcggctgccgaaggcattgacggcttgagccgcgtcgggcgtgacgtggtggtgcccaaactcgacgccccggaagcgcgagcgcgcaagctgctgccggacgtcagcctggaagaattgctgatgtccatggccgaggttctgcgccgtggcgatatgtttgaaagccaccaggtcagccgcgaggcgctgtcgacccgcgagcgcatgagcgatgtgctcgaacgcctcaagggcggcgggtttgtgccctttgtcgagctgtttaccaaagaagaagggcgcctgggggtggtggtgacctttatggcgatcctcgagctggtcaaggagtccttggtcgagctggtccagaatgagccttttgcggctatccacgtgcgggcgcgagccgaataaagagctgaatcgatgaatttgactgaaccccgcgaactggcgccgctgctggaagcctttctcctggcctcgggtaaaccgcaatccctggagcgcctgttcgaactctttgaagaggccgagcgccctgaaccgccggtgttcaagaaggcgttggagattttgcgcaaatcctgcgacggccgcgcctttgagctgcgcgaagtggcgtcgggttatcgcctgcagatccgtgagaagttttccccgtgggtcggccgcttgtgggaagagcgcccgcagcgttattcgcgggcgatgctcgaaaccatggcgctgatcgcctatcgccagccgatcacccggggcgaaatcgaggatgtgcggggcgtggcggtcaacagccatatcgtcaagacgctgctggagcgcgagtggatccgcatcgtcggctaccgcgacgtgcccggcaaaccggccatgttcgccaccaccaaggtgttcctcgaccatttcaacctgaaaaacctcgacgacctgccgccgttggccgaactgcgcgagatggaagccgagccggtgctcgacttcgacgacgcgccggtcccggccagcctgcaggaactggccgacgccaccgccgagccggaagaaccgaaagacgaaaccagtttccacaccttgttgctggaactggacgacatggagcagggcatcaagaccgactttgatgatttgttgcgtgatggtgcggctgagccggaaacccaagtgaacgttgaagttgagcctgaagtcgaagctgaagcagagcctgaggaagatatcctcggcgtggccgaagcccgcgagaaactcctggctgccgttgccgctcttgaacagccgccgttgagcgacgaggaagacgaggcccgagctttggctgaagcgatcgaggccgaacgccgccaatttgatgattaactcgatccaatgtgggagcaactgtcttgatggcttttttccaagctgctgttccagagatgacagtgcccccacagcagtacac

SEQ ID NO: 40 - DNA, 117500 bp, Pseudomonas poae FL10F
tgccttgatgaaaggacaaaccgaataccaaccgaagattggttgagggttgcccctcaaccatagaatctcccacatttgttcggtggtgttcagggaaatcgcatcattgtcaccaatggtcagccaacaagttttccacttcattcagcagtactgtcgcgccatccatcaactgcccaagcaacgcctcatcctcatccatatacccttcatattccgccaggtttcggcgctcatgacacagcgccagtaacctcacctgcaccttgctcaagtcggcggtgtgaatcaaacattgaaagaccaaatagcgtttgtcagaacgatacccttgcaggcgtaaagctgtgagcgcgatagcgtgggcggcgttgtaggccaagtcgaaacgactggcgaacgataactgtgaattactggcatcccttaaccgatcccgcgccgagcgcatcagcccatcacactccttgcgatccggcggctcagccttcaagccaccgctacgttgcaggttctccaggtttgccttgctgtccatccatggattccagggggttgcccccaatcagattgatcttggcttgctgcacaacccgctgcacaaaactgttcccggcattccatttgccgatccagtcttcaggggtgtaaagcgtcgggttgatggtgcggcccagttgctcttccagcggtatgagctgctccatgacttcactgtagttgaggctttggccgatcagcatcagatctatgtcactggatgagtgcgcctcacccttggcgatagagccgtagataaaggcccaggttatctgctcggcgaacggtgccaatgcattgcgcaggggggcgtccaggctcagggttttgcgcacgatggccaacaactccgagtaaatcgggcattgggggttgaccttgtagtgggtctgattgccttggcgcgtcatgctcaagatgcccgccagctgcaaacgctccagctcgcgggtaaggctgcccttgcccacctgggcccaacgcgcgatctcgttggtaaagaaactttgatcgggcttgccgaaaagcaggcccagcactttctgctgagtgtttgtgaagagtgcagtgctgagcggcaaggtatgcatggctgcggccaaagagtcccaaaaagggaacgataggtccctttttgggaacgatcaagttttgatcgttcctacgctctgcgtgggaatgccgcttggggcgctccgcgctctgccagtcagtgcaattctcgagtcgtgaacgaaggtgacacggagcgtcacaagatgcatttccacgcggagcgtgggaacgatcaactggattcgagccgaatgaagctcaaaatgtgggagcgggcttgctcgcgaatgcggtgggtcagttacacatttaacgactgacaccctgcattcgctggcaagcccgctcccacatttgttcggtggtggttgttagatagcggtcccaaacagggaccgatttaaccttccggtgcagggctgacttgttccagcgctctatcgaccagcaactgactcaactcggccatttgctgaatgccgagcatgattgcgcgctgggaggtgtccaggttgaaggccagattgcaggtcatggcgtttagcgacgataaggtttcgctggcgttgaccagtagagcttcggtgttttggtgggggttgacggtgaagataggcggattaggggtgggtttagccatgatttacagctccgatatgtgatggaggctgccgtcatccgcttgcacgcgaaatagggtggcagccgtgcgcaggtgtgcaagaccgggcatatcggaccccggcagaccccaagggatctcccgcgcacagccgccataacaaatacagcaggcataaaaaacgcccgttgaatggctatgggcgttggtgcgccgacatgtaaccggacttgcacgtccgtgtcaccgttttttcgatgacgggacgaagactatccgccatgactacccacaacaagttcatgcacagcccgaaatcttgcaggaaaaatccgaagactggcccatttgatcgttcccacgctctgcgtgggaatgccgcctgggacgctccgcgtcccgccagccagtgcaacgctcaagttcagcacaaaggtgacgcggagcgtcacgggatgcattcccacgcggagcgtgggaacgatcatcgcagtcaggccaggccggactccaccaacaaggcttcaagccccataaggtcaggcaccttcgccacatgttcccccacttgcactgccgccagttccagcgggcacagcggcacgtcgacgtaactcagttggctatccaacttgtacgaacgcggaatgccctgaatcaccatcgcaataaacttcaacgtcggccgcccgcccaaggcgttcaacaccacaatccgtgagcgctcgccggtcacgctggcctcgccgcacacggcttcaaagctgatcaacggcaactgccggtcgcgccatgtgacttgccgcagataccacggcggtgcgtcgctggcgggttcgccgcgttggtagtcgatcagttcggcgatggcgacgttgggcagcaccaggtggcggtcggccaggggcagcagcaggccggtgagttggctggtgcggtggtcaagcatgggacttgctccagtaggcgatgctttccagcagcaccgactcttggtacggcttgccgaggtagtcgttgacgccgatggccatggcgcggtcgcggtgtttctggccggtgcgtgaggtgatcatgatgatcggcaggcgcatcagccgtgggtcgttgcgcacctggatcgccacttcgaagccgtccatgcgcggcatttcgatgtcgagcagcatcaggtccggggtgtgttcttcgagcagggcgatggcgtcgatgccgtctttggccgtgagcacgttcatgccgttgcgttccagcaggcggctggtgactttgcgcacggtgaccgagtcgtccaccaccagcaccagcaacgggcgtttcttcagcgggtcgttgaggatcagcggcgcgtcgaccgactgcgccggcaacgccggttggcgggcgcgaatgtgcgccagcaagtcgataatcagcaccacgcggccatcgccgaggatggtcgccccggacaagccctgcaccccggcaaactgcggccccaggcccttgaccacaatctcccgcgtaccggccatggcgtccacctgcaccgccacgcgccgctcgttgcattgcaccagcagcactggcaccggctggtattggccgagcagttttggccgagcgacggtgtgcagcaggtcgcccaggtaaaacagttcgtagcgttgaccggcgtattcgtaacgcggcgggtcttgttgatagtgcccggccagctcgtggggcagcacgcgcaccaggccttcgatggtgttgagcgggatcgcgtattgatcgtccgcgcactgcaccatcaacgcgcggttaaccgacacggtaaacggcaggcgaatgcgaaagtgcacgcccgcgcccgccgtcgagtcgatgaacatcgagccgccgagctggcgcacttcttcgtgcaccacgtccatgcccacgccgcgcccggaaatctgggtgattttttcagcggtcgaaaagcccggctgcaggatgaactgcaatacgtcgcggtcgctcatgtcttgatcaggcgcgagcaagccgcgcttgatcgccttgcgccgtaccgcgtccagcggcacgccggcgccgtcgtcgcgcatgtcgaagacgatatcgccgccttcgtgcgtcaggtccaggctgatacgccctctcgcaggcttgcccgccagcagccgcgcctcgcgggactccaggccgtggtcgacggcgttacgcagcatgtgttccagcggcgccaccatgcgctccagcacgttgcggtccatctcgccttcggcattgccgaccacgaattcaacgtccttgcccaactcttccgccacctggcgcacgatgcgtttgaggcgcggcagcatgcgctcaaacggcaccatgcgcgtgcgcatcaggccttcttgcaactcggtgttgatacgtgcctgttgctgcaacaggttatgcgcatccgcgttgcggcggtcgagggtttccttcaggtccagcaggtcggaagccgattcggacagcgcgcgcgacagttgctgcaactgcgaatggcggtccatttccagcgggtcgaattcttcataacccaggcgctcggcctcggcctgctggcggctgaggatgcggccctgggtttcggtgtcgaggcggcgcagttggtcacgcatgcgctcgatggtggtttcgacttcgttgagcgcgatgcgcgcgtcgttgacctgctgttcgatacggccccggaagatcgaggtttcaccggccaggttgaccaggtcgtcgagcaaatcggcggagattttcaccatgtcggcggcgggatcaaccgctgcttcagctttaccgacgggcaaggcgaccggcgctaccggctcatcgctggggtgcaccaggcttttgatgcgctcgatgagtttatccaccgagcccactggcaacccgcccgccaccgcgtcgatcatctgcgccaggcggtcgtggcagccttgcagcaacgcgaacagctccgctgacggcgcgagtaaacccgccgacagcccctcgtagagaaactccagctcatgggccaaatcgccaatgggcccgatctcgaccatgcgcgcgccgcccttgagggtatgcaggtcgcgcagcagggtttccacttcctggcggttgctgggctcggcctgccagcgcagcagtgcgctgcttgagctgtcgagaatgtcggcggcttcttcaaggaaaatatccagcagttcgggatcagccgcggcggtttccgggtcagcggccgcagtggcgggcgcgctgttctggcgcaacgcacgcagctgggcgaccaggtcgctggagtcgctcaggggctggtggtcctgcagttcatccaactgcaaggccagccgttcatggctggccatcaacacgtgggacagttcggcggagtagctgtagcggcggtcgactaaaccttcgtacaggcattccagctcatgggccaggtcgccaatcgggccgatttcggccatgcgcgcgccgcccttgagggtgtgcaaatcccgctgcaacgacgacaacggcgccgcgctgtccggctccagcagccagcgtttaagcgattgcccggcgctgtcgaggatatctaccgcctcttccaggaagatctcgacgatctcgtcgtccatcgccgtgtcctggtccaactgtgcggtggcggcacccagttcggaaatactcagcgcacggctgccgtcgcttttgaccaggccggtagcggaggggtcgagggcttcatccagcagttcgcgcagggcttgcacccgcgccggtgcagggttgatttcctggccggccgccagttggtcgagcatgttgatcagcgcttcatgggcctgttcggcctcatggaaaaaccgctcgctgactgccaggctgctctcttcaacggcgccatacaggtcgagcaaggcttcacacagttcgtcgatggcgtgcaggtcggcgaggtgcgcgccctcacccaaggtggtcaattcatccagcagcgcggtcagttcctggcgttcgccggggtgttgctgccaacggcgcagcaggctttcggcgtccagcaggatgtccatgccctgggccaggaagttggcaatcagctgcgggtcgcgcttgatccgcaggccggtgctgggcgcgtcgagcaaggcttgcagttgttggtcgagcaggctttgggtgcggctgatcaagtccggcgcgcctttgatcggcaccagcgggtcgccgtcgagttggcgcaagccgcgctggaacaggccttcggcctctagcagcaactccacttcatccaggtccagcggcaggcggtgggccttgtactcgcgggtcaggtgatcgagcggccgcgccagctcggcaatcggcagcacgccggccatgtaggcgctgcccttgagggtgtgcagggcgcgttgcagctcatcgctgacttgcagcggcacatgctcggcagcctgttgcaggaaatggttgaggctgtcgaggtggctctgggcttcgttgcgaaaaatctccagcagcatcgggtcataaggctctgcggtcgacgcgccagtgccgctggccaaagcgtgcgcgcgggcggccagggcgtcgacttcatcgcgctggcgttggtcatcggcagcgaagtcggcgatcaattccggcagcagcgccacggcttcgtccaacacgtgctgcacgtcagggctgagggcgacgctgcgttcgagcacgcggttcagcaggttttccaccgcccaggccagctcggccagtaccaacgcgcgaaccatacggccgctgcctttcaaggtatggaaggcgcggcgcatttcgccctgggcagttttgtcggcgctgttgggcaaatagcggtgcagcacttcaaggacttcatcggtttcttcgaggaagacttcgcgcagctcatcgtcgacaggttcttcgcccgcgggcggcggcaggaggctgcccggacgctgctgggccggcgggttcagacgtgacgtggggttggccaatgcatcgaattgcgattggctcggcgcggcctctgtcgacagggcgccatccggcgcagccagggcctggcgccaaggtttttcggcaggcaaatagccgagtgcagccaggcctcgggtggccaattccagcacccgttcaccagcagcatcggcgtcctggagcatgcgctcgaggtagtactccaggctgctgatcacgtcggcaaagtgccccagctgcgcctcggagggcgcggcctcgctcaccatcagctgttcgtcgacatagtcggtgcagccgcgcatcaggctcgccgcgcgcggcaggggaatcatcgccaacgcgccacgcacttggctgagcaactcgggcagcgactccaggcgctggcggtcccagtgcgcttcaacgcagtcgatgaccagctccttggcttgcctcaggcactggcaggattcgcggatcaccagttgatgaatctgggtcaggtcggtggtgggcaggcggctttcttcgcggctttccggctcgacggtgccgaccatgccggccagcgtggcttcgacgtaaagcaaggcgccggcgacgtccatcagcactgcgtcattgggttcgcgctggccctggaccaggctcagcaccacggcgagttggtcgatgataactttgcgcggctggccgaaacccagcaccgccagggtatcggcgatctgccgcagcggcgccagcaaggcatcgaggtcgctggtgtgttgacggtcgctgcgcacgaacaggtcgagacgctccttgactcgcaccagttcctcgcacaaggcggcgagcaccgagcccatggcattgcggtccggcccggccaggcgcgcgcgttcggcgtcgaccacggcgctgtcgggcaaggcttcatccaggccgtaacgttctttgaggctttgcatgcgcggcgtcggccgggtgaccttggccacgtagaacagcaggcttttgagcagttcatccggcgcaggctggttgatgccgccgatgccctggaccagcaggcgcttgagttgtttgtcgctggccttgagcaggctgcgcagcgccgggctgttggcgatcacgccggtgagcatgccttcgaccagcgccgaggtgacttgccacaacggcagcaacggcgcgccctggcacaacgcttcgagacgcgcgaacacccgcgccatgtcttccaggttgctcgggccgtggtcctcgcgcagcaaaccggccagggcctgttgcagcagttgatgccattggcgcagttgctcgtgaaggtcaggcggcatacgctgggccaaggcctcgtcgggcaacggcgcaatcgacagcagttgcgggctgaacaggctggtctccgacagcaggctttcgccgcgcgcgctgcgcaggtcgttgagcagcggcaacaccaccagcggcaggtcgcggcgggcgctgtgcacgcggtcgaggtacagcggcagttggccaagggcctgttgcagcaggcggatactttcatcgcgctggctgacatgctcggcttgcagggccagggccagtgcttcgatctcttcggccagcagcgctgcgccgtagaactcgaccatttgcagcgcgccatgcacttggtggatggcggccaggcactcagcgatggcgtcgctgtcactggtttcgacgaacgcgtccagcgccgaacgggcctgtttcagggtttcggcaatgtcgcccttgacccattcgagggccacgtagtcgtgccgatcaaccataactgctccgcttagaattcgtgaattgcgtgtgttgccaagatcaatggagttccactgtgggagctggcttgctcgctcccacattttgattgcatttcaatcatccgccgatcgtggcggcggcaaggtgaaacccgacaccgacctgcgcagctggctggccattttcgccaggttgccgatgctttccgccgtggccgtcgagcccgacgaggtctgtgtggtgatctgctggatcacgttcatggtcagggaaatctgcccggcggacgaggtctgttgctgcgcggcattggaaatactctggatcaacgccgccagggttttcgacacgccttcgatttcttccagcgccactccggcgtcttgcgccagccgtgcgccgcgcaccacttcggtagtggtctgttccatggaaatcaccgcttcattggtgtcggcctggatcgcccgcaccaaggtttcaatctgtcgcgtggcggcggacgaacgctcggccagccgttgcacttcatctgccaccaccgcaaaaccacgcccggcatccccggccatgctcgcctggatcgccgcgttgagggcaaggatgttggtttggtcggcaatgtcgtcaatcaggctgacgatgtcgccaatttcctgagacgactcgcccaggcgcttgatgcgtttggcggtgtcctggatctgctcgcgaatgttgtccatgccgtggatggtgttgtgcaccacctcgttgcccttgttggcgatttccaccgagcgctcggccactgccgaggattcggcggcgttggccgagacctggtcgatggactgggccatctcattgatcgcggtagaggcttcggcaatttgctgggcctgatgctccgaagcctgggccaggtgcatcgcggtggcctgggtttcctgcaccgcgccggcgacttggccggcggtgaggttgatggtggcgaccaggtcgcgcagttggtcgaccgaataattgatcgagtcggcgatggtgccggtgaagtcctcggtgaccgacgcggtcacggtcaagtcgccatcggcgaggtcttcgatttcgtcgagcaggcgcatgatcgcgttctggttacgctcgtttttctcggcggtttcatgcagttggcggttggtttcgcgcaccatcaccaggccgatcaggatgatcgaagtcagcgccaacaggcccagcacgtagccgccaatggtgtcgaagctgcgcccgctggcaaggttttcaaacccggtggccaggtgcgaggcttcatcgagcagggtttgcgacaggttgaagatattgctcgccgacgcgcgtacctggaacagctgcggcgaggtttcgaggatttcatccacggagccggagacaaactcgaacagctcggcgatttccgccaggcgcgcgcgggcgtcgtggtcttcgacctgggtgatgcgcaaccccgggttgccgttcagcatgccgttgagcaccacgccgaagcggttggcatcacgaccaaaggcgtcggcggcctgcacggcggtttcgtcaccggcgagtacggtgttgaccgcgccgagaatgcgctcagccagcagcgattggcgttgggccaaggccacctggctggccggggcgccgcgttgcagcaggatgtcgacgaccttttccgattccatctgcaattgcggcacggtttcggccagggtcgcggccacttggtgcaacgacaacacggtctgttcgctggcgaggattgcgtcggtgtttttcagcagcgcttcccagtcggtctgcaccgcgcgcatttccgcgcgcaccgcgttgggcgcggcgggcaggccggtctcgatgtcaccttttttcaggtagccccaacgctgggcgaagtcgttgcgcgcatcgcccagcagcttgaacgccgcggccttgccggcggcggcttcggtggcgtttttggcgatacgttgtgacagcacgcgcaactcaccggcgtggccgatgtactgtttgtcgtaagtggactgggtgttgaggtacgcgaagttggcgaacaacagcatgatgaacacgatcagtgcgataaacagcacgatgatctgcgaacggctgcgcgacgcggcttgcggtttgggagaggtgacagtggtcatgcggcaacgtccatgaagcctggggcctgggccagagcgaaggggctgaagacctgccacagttggtcgctgtcgaactggccctggataaacggtgcgccgggcggcacgctcgccagcaatgcgtcttgtgcaaaatgttgcatgcccaccacctcgtccaccagcagcccgacaaacatgtcgttgaattccaccaccagtacccgccgctgcttgcgcgccttggacaattccaggccgagaaacccgcccaggtccatcaccggcagcaaacgcccgcgcaggttggccacgcctttgacccagggcttgaccccaggcatcaaggtacagcgcggctcatgcaacacttccgcgacttcgcccatcggcgccacgtaccaatacggccccaggcgaaagccgatcccgctccaacgctgctggcgggtttcctgggacggcaggtcggcggccagcaggcggcagcggcggtcgatgtccagcagcagctcgaaggcggtttgcgactcggtcatgatggcgtgccgtcagccggccagcaccttgttcagggtggcgatcagggtttcttcgtctacgggtttggtcaggtaatccttggcgccctggcgcgcgccccagattttgtcggtttcctgatccttggtggtgatgatgatgatcgggatgccattggtttccggctccttggacagctggcgggtggcctggaagccattgaggcccggcatcacgatgtccatcagcacggcgtcgggtttttcctggcgggccagggccacgccgtcggcaccgttttcggccttgagaacctggtggccgtgcttttccagcatgccggtcagtttgtacatttcggtcggcgaatcgtcgacgatcagaacacatgccatggttttccccactacattggtggacgccggcccttgtgaggcggtgtcagtgtgcttgttctactgcggcgaaacctggcacgtaggccttgatcgcactcagcagttcttccttgctgaaaggcttggtcaaaaactgatcgacacccacgatgcgccccttggccttgtcgaacaggccgtccttggaggacagcatgatcaccgggatcgacttgaacgccgggttgttcttcaccagggcgcaggtctgatagccatccaggcgcggcatcatgatgtcgacaaagataatgtgcgggtgatgatcaacaatccgggccagtgcatcgaaaccgtcgatggccgtaatgacttcgcaccccacgttcttcaacagggtctcggcggtgcggcggatcgttttcgaatcgtcgatcaccatcactctcaaggcgttggaatgctgttccatatctgctctaccatcgccacagcgaatcggttttcggtgtgtactgcctgatgtctcacaggatgaacgctgcaagccttggaattcaagggctgctgtactgtggcagtctttttagcacagtctccgggcgcaatctatcgagcgaccggccaggtggtttttccttgacccacaacagccgcagcgccactctgacgccacttttatgcgccctaatttgctagaggaaatcccccatgagcgttcgcgtcggcattgtcatggaccctattgccagcatttcctataaaaaggacagctcgctggccatgctcctggccgcccaggcccgcggctggaccctgttctatatggagcagcgcgatctttaccaaggcgacggcgaagcccgcgcacgcatgcgcccgctgcaggtgtttgccaaccctgaaaagtggttcgagctggcggatgagatcgacagccccttgagcgatctggacgtgatcctgatgcgcaaggacccgccgttcgacatggagttcgtctactccacctacctgctggagcaggccgagcgcgctggtgtgttgatcgtcaacaagccgcagagcctgcgcgactgcaatgaaaagctgttcgccacccttttcccacaatgcacaccgccgacggttgtcagccgccgcgccgacgtactgcgtgaatttgccgccaaacacggtgatgtgatcctcaagccgctggacggcatgggcggcacgtcgatcttccgccaccgcgcgggcgacccgaacctgtcggtgatcctggaaaccctgaccgcgctgggcacccagcaaatcatgggccaggcgtaccttccggcgatcaaggacggcgacaagcgcatcctgatgattgacggtgagccggtggattactgcctggcacgtatcccggccgccggcgagactcgtggcaacctggccgctggcggtcgtggtgaggcgcgaccactgtcggacaaagaccgctggattgcttcccaggttggcccgaccctgcgggaaaaaggtctgctcttcgtaggactagacgtaatcggtgaaaacctcaccgaaatcaacgtcaccagcccgacctgtattcgcgagatcgacaacgcatttggcacgaacatcggcgaaatgctgatggccgccattgagcgcaagctacaagccaagtgacatagaacagccggacacacaccaacattgcgttatcatgcgccacctgtgaaacgcgcgatgttggtttttttgtcatgacgctcccgcccgatctgccccccgaactctcccacagtggcgtgcgcccggctgatcggctcggatttaccctgttcctcgccgccttgatccacctcgcgttgctgctcggcctgggttttaccttcgccgaacccaagcagatcaccaaaaccctggaaatcaccctcgccacgttcaagagcgaaaagaagcccgaaaaggccgactttctcgcccaagacaaccagcaaggcagcggcaccctcgacaagaaagccgtgcccaagaccaccgaagtggcgccgttccaggacaacaaggtgaataaagtcaccccgccgccgacgcccaagcccgaggtcaagcaggccgcgcccaaggccgccgtgaccaccgtcgcaccaaaaccgcaaaaagccccgacccagcgcgaaaaaaccaagaccgaaccacagcccgagcccgtgaagccggcgccgacctttgacagttcgcagctttccgaccagatctccagcctcgaagcggagctggccaatgaacaacagctgtacgccaagcgcccgcgaatctatcgcctgaacgccgcctcgaccatgcgcgacaaaggtgcctggtataaggacgaatggcgcaagaaggtcgagcgcatcggcaacctcaactacccggatgaggcgcggcgccagcagatttacggcaatttgcgtctattggtgtcgatcaaccgtgatggttcgctctatgaggtgcaggtgctggagtcgtccggccaaccgctgctggaccaggccgcccagcgcatcgtgcgcctggctgcgcctttcgcgccgtttaccggcgacctgaacgatgtcgaccgcctggaaatcatccgcacctggaagtttgcccggggtgatcggctgtccagtaactgatcgctcctgcactccgcaaaaggcagcggagcttgtcgtggcgagcgggcttgccccgcgttgggctgcgaagcggcccccaacagggccaccgcgttctacctgaaaaaccacagcgccagatttcagggccgcttcgcgccccaacgcggggcaagcccgctcgccacgacagccccgctcgccacaattagcgtccgccgcagcttgtcagttcgcccctccaacgccacactagtgggcatgaaaaatgtcagcccgacctacctcaagcaccaattcctgatcgccatgccccatatggccgacccgaactttgcgcagaccttgacctacatcgtcgagcacacggccaatggtgccatggggctggtggtgaaccgcccgcaagagctgaacctggccgacattcttgagcaattgcgccccgagatcgacccgccggcccgctgccagagcgtgccaatctacatcggcgggccggtgcagactgatcgcggttttgtgctgcaccccaccgggccgaagttccaggccacggttgacctggaaggtgtgtcgctgtccacgtcccaggacgtgctgttcgccatcgccgacggcgtggggcctgagcaaagtgtgatcaccctcggctacgccggctgggaagccgggcagcttgaggcggagctggccagcaatgcctggctgacctgcccgttcgacgccgacattctgttcaacaccgccagcgagctacgcctggaagcggcggcggccaagctgcgggtcaacctcagcctgctgaccagccaggcggggcacgcctgatggccttgcgtttgatcctcggttttgactacggcaccaaacagatcggcgtagcggtcggccaggtgattaccggccaggcccgcgagctgtgcaccctcaaagcccagaacggcgtgccggactggaaccaggtcgaagccctgatcaaggagtggaagcccgacgcagtcgtggtcggcctgcccctgaacatggacggcacgcccagcgacatgtgcctgcgcgccgaaaagttcgcccgccgcctcaatggccgctacaacctgcccttctatacccacgacgagcgcctgaccacctttgaagccaagggtgagcgccgcgaccgtggcgggcagaaaggcagctaccgcgacaaccccgtggacgccatcgccgccgccttgctgttgcagggttggctggatgaaaacaccgctttatttgaatcctgactgacgcggcttgccgcgtctttttacgtttgagcccggaccttgcctgcgcgagaccttgaaggagccaccatgagcctgcccaatcccgccgaactgatcagccagatggcgattcgcctcagggcgcacctgcaacaccgcgccatcagcgaaccgcgctttatcggcattcgcaccggtggtgtgtgggtcgcccaggcgttgctggaagaactgggcagtgactcgccgctgggcacgctggacgtgtccttctaccgcgacgacttcagccagaacggcctgcacccgcaagtgcgcccttcggccctgccgttcgagatcgaaggccagcacctggtgctgatcgacgacgtgctgatgagcgggcgcaccatccgcgccgccatgaacgagttgttcgactacggccgcccggccagcgtgaccttggtgtgcttgctggacctggacgccggcgaattgccgatcagcccggatgtggttggcgcaaccctgtccctggaagcccaccagcgggtaaaattgtccggtcccacgccgctcgaactcgaactgcaagaccttgccctttaaaccgccttgtacagagtccccgcgatgacgcctctagatgccaagcgcccgctgcagctcaatgctcagggccagttgcaacacttcctgtccctcgacggtttgccccgcgaactgctgactgaaatcctcgacaccgccgactcgttcctcgaagtcggtggccgcgcggtgaagaaggtcccgctgttgcgcggcaagaccatctgcaatgtgttcttcgagaactccacccgcacccgcaccacctttgaactggcggcccaacggctgtcggccgacgtgatcacgctgaacgtgtcgacctcgtcggcgagcaagggcgaaaccctgctcgacaccctgcgcaacctcgaagccatggccgccgacatgttcgtggtacgccacggcgactccggcgccgcgcacttcatcgccgagcatgtgtgcccgaacgtggcaatcatcaacggcggcgacggccgtcacgcccacccgacccagggcatgctcgacatgctgacgattcgtcggcacaagggcggctttgaaaacctctcggtggccattgtcggcgacatcctgcactcgcgggtcgcgcgctcgaacatgctggccctcaaagccctgggttgcccggacatccgcgtgatcgcaccaaaaaccctgctgccaatcggcatcgagcagtacggcgtgaaggtctacaccgacatgaccgaaggcctcaaggacgtcgacgtggtgatcatgctgcgcctgcaacgcgagcgcatggccggtggcctgctgccgagcgaaggtgagttctaccgcctgttcggcctgaccaccgcgcgtttggccggcgccaagccggatgccatcgtcatgcacccaggcccgatcaaccgcggcgtggagattgagtcggcggtggcggacggcagccagtcggtgattctcaaccaggtgacctacggcatcgccgtgcgcatggcggtgttgtccatggccatgagcgggcaaaccgcgcaacgtcaattcgagcaggagaacgcccagtgaagctcagcattctcggcgcccgagtcatcgacccagccagtgggctggacaacattaccgaccttcatctggaagccggcaaaatcatcgccattggcgccgcgcctgcgggcttcagcgccagccagaccatcgacgcccaaggcctggtggccgcgccgggcctggtggacctgaacgtcgccctgcgcgagccgggttacagccgcaaaggcaccatcgccagtgaaacccgcgccgctgccgccggtggcgtgaccagcctgtgctgcccgccgcacaccaagcccatcctggacacgtcggcggtgaccgagctgatcctcgaccgcgcccgcgaagccggcaattgcaaagtgttccctatcggcgctttgagcaaaggcctggaaggcgaacagctcgccgagctgatcgccctgcgcgatgccggttgcgtggcgttcggcaacggcctggagagttttcgcagcacgcgcacgctgtgccgcgccctggaatacgcagccactttcgacctgacggtgatcttccattcccaggaccgcgacctggccgaaggcggcctggcccatgaaggcgccgtggccagtttcctcggcctgccgggcatcccggaaaccgctgaaaccgtggccctggcccgtgacctgctgctggtggaacaaagcggcgtgcgtgcgcacttcagccagctgaccagcgcgcgcggtgtggcgttgattgcccaggcgcaagcgcgcggcctgccggtgacggcggacgtggcgctgtatcagctgattttgaccgatgaagcgctgatcgacttctccagcctgtaccacgtgcagccgccgctgcgcaccctggccgaccgcgaaggtttgcgtgcggcggtgaagtcgggtgtggtgtcggcgatttccagccatcaccaaccccacgagcgcgacgccaagctggcgccattcggcgccacagagccgggcatcagcagtgttgagctgttgctgccgctggcgatgacgttggtggaagacggcctgctcgacctgccaacattgctggcgcgcctgagcgccggcccggccgaggccttgcgcctgccggcaggcaagttggcggtgggttcgccggcggatctggtgttgtttgacccggccagctccacggttgccggggagcactggctgtccaagggcgaaaactgcccgttcatcggccatagcctgccggcgacggtgcggtacaccttgatggatgggcggatcagttaccaggcgtaactccggcatggagtgagcacagtaaatgtgggagctggcttgcctgcgacgcaggcacctcggtcgttcagccagaccgaggtgatgctatcgcaggcaagccagctcccacacaagccagctcccgcacttgatgggttcaggctcagcgcccgctgttgcgctcggcattgcggatcgaaacctgcgtattcaacgtccagaagtcatacagcaccccaatcaggaacaaaccgccggtcaacaggtagatcaggccggtgatccatttaccctggtacatgcggtgcaaaccgaacacgcccaggaacgccaacagaatccaggccacgttgtattcgatcggcccggcggtaaaacgcaggtccgcttcacggtccatggccgggatgaggaacaagtcgatcagccaaccaataccgaaaagaccaaaggtgaaaaaccagatcgtcccggtcaccggcttgccgtaatagaagcggtgagccccggtaaaaccgaaaatccacagcaggtaaccgatcaccttgctgtgggtgtcctgctgcatcacatcctgtcgataggtgttcatggagtacctcttttgcctcgatagataaattttttcattttctttgtgacttttttacgggcgcccgacgcacggcaaatggtatcttccttcccgcaaagccttatgccacctgacctctgcaggacaatagcggcaattcgtcgcgtttttcctgaatttgaccccagggttcagtcgacaaacggcctaagaacgacacaaaaagctgttataaagttgcgcgcaaacctaaaagagccacgcctaatgcgaccatttttcaagacatggctaaccatctgcctattaatgccactggccgcccacgccaccaatcgtgagcaacgtcttcctaacgttaacggtttcacccctaaagttcacagcacgccaggcaccgccaaatcggtaaagctgaccgttaaccgcccgactcaactgagcaaggcccatcacggcaaagcaacgcccggcctgatggcagtcaacaccaagcaaagcagcaacgtcctcagccgcgccgtgaatgtactcggtacaccttatcgttggggcggcagcagcccaagtaaagggttcgactgcagcggtttggtgaaatatgcgtttaacgatgtaaaagcggtggatttgccacgcacctccaacgccatggccgctggccacgggctgaaggttgatcgcaaagacctcaagccgggcgacctgttgttcttcaaattgaagagccgccaggtcaaccacgttgccatctacctgggcaacgatcgctttatccacgcgccacgtcgtggcaagtcggtaagcatcgacacgctgaaaaagccgttctgggacaagaactacgtgattgccaagcgggttctgccgaaagagcagaacaacaacctgcgggttgttcagcgctgatccctagctgaaatgcagtaaaaaatgtggggcgggcttgctgtggcgagggagcttgctcccgctggagtgcgaagcgctcccaaaatcttggggccgcttcgcagcccagcgggagcaagctccctcgccacaaagccagctcccacagtgatctcagcgttcgttagatgtccccaggcaccctcgcctgcccccgcgccacctcccggctgatcaccccctcgccgaccaacgccttcaaactcatatccaacgtcttcatccccaacgccccgccggtctgaatcgccgagaccatttgcgccaccttgtcttcgcggatcaggttacgaatcgccggcgtgcccagcatgatctcgtgagccgccacccgcccgccgccgaccttcttcaccagcacttgcgacaccaccgcctgcaatgactccgaaagcatcgagcgcaccatggctttttcccctgccgggaacacgtccaccagccggtccacggtcttggctgccgacgtggtgtgcaaggtgccaaataccagatgcccggtctcagcggctgtcagggccaggcggatagtctccaggtcgcgcaactcgcccaccagaatcacatccgggtcttcgcgcagggccgaacgcagcgccgcggcgaagctgtgggtatcgcggtgcacctggcgctggttgatcaaggccattttcggcctgtggataaattcgatggggtcttccagggtgaggatgtgctggcgccgatgctcgttgaggtagtcgatcatcgccgccagcgtcgtggacttgccggacccggtcgggccggttaccagcaccaggccacgcggcagctgggcgatacgctggaacacctcgccgagcccgaggctttccaggctttgcacttgcgcgggaatggtacgaaacaccgcgcccatgccgcgatcctgctggaacacattcacccggaaccgcgccacactcggcagctcgaaggcaaaatccgtttcaagagatgtttcgaaatccttttgctggcatcggttgagcaaagggctcaataaatccgcaacttgcgggggcaaaagcgccgggccatccattggccacacctcgccatcgacgcgcagcatcggcgccaggccggcggacaaatgcaggtcggaggcgccacggcgcacgctggccgtcagcaattcagtgatatccatagggctttccatttccagtagaatgccgcggactccatatccacgggtgcatcttgaatgtcgacgatagcagacaacattggccaggttagcgagcggatccgtgccgcggcccacgccgtgcaacgcgacgaaagcagcatccacctgctggccgtgagcaagaccaaacctgcgcaagccgtgcgcgacgcctatgctgccgggatgcgcgattttggcgagaactatctgcaggaagccttgggcaaacaggccgaattaaccgacctgcccttgagttggcacttcatcggccccattcaatcgaacaagactcgtgcgatcgccgagaacttcgcgtgggtacattccgtggaccgcttgaaaattgctcaacgcttgtccgaacaacgcccggccgacctggcgccgctgaacatctgcatccaggtcaacgtcagtggcgaagccagcaagtccggctgtacgcccgccgacctgccggccctggccaatgcgatcagcgccttgccgcgcctgaaactgcgcggcttgatggcgatacccgagccgactgaagaccgagccgcacaagacgccgcgttcgccacggtgcgcgacctgcaagccagcttgaacctggggctcgacacactttccatgggcatgagccacgaccttgagtcggccattgcccaaggcgccacctgggtgcggatcggcaccgccctgtttggcgcccgcgactacggccagccgtgaaatggctgactttcctctgaataaggacctgtcatgagcaacacgcgtattgcctttatcggcgccggtaacatggcggccagcctgatcggcggcctgcgggccaaaggcctcgaagccagccagattcgcgccagcgacccaggcgccgacacccgtgcccgcatcagcgccgagcacggcattgaaaccttcgccgacaacgccgaggccatccagggcgtcgacgtgatcgtgctggcggtgaaacctcaagccatgaaagccgtgtgcgagagcctgcgaccaagcctgcagccgcaccagatggtggtctccatcgctgccgggatcacttgcgccagcatgaacaactggctgggtgcccaacccatcgtgcgctgcatgcccaacacaccggcgctgttgcgtcagggcgtaagcggcttgtacgccaccgccgaagtgaacgccgaacagcgcggccaggcccaggagctgctgtcagccgtgggccttgccgtgtggctggaacaagagcagcaactggacgcggtcaccgccgtttccggcagcggcccggcctacttcttcctgctgatcgaagccatgaccgccgccggcgtgaagcttgggttgccgcacgaggttgctgagcaactggccgagcaaaccgcgctgggcgctgcgaagatggccgtgggcagcgacgtggacgccgcagaactgcgccgccgtgtcacttcgccgggcggtactacccaagcggctatcgaatcgtttcaggccggaggctttgaggccctggtcgaaaaggccctcggcgctgcggcgcagcgttcggctgaaatggccgagcaactgggcaaatagtcgtcccctacatgcaactgggttagataggaatacaccatgctcggaatcaatgacgctgccattttcatcatccagaccctgggcagcctgtacctgctgatcgtgctgatgcgttttatcctgcaactggtgcgggcgaacttctacaacccgctctgccagttcgtggtgaaggccacccagccgctgctcaagccgttgcgccgcgtgatcccaagcctgttcgggctggacatgtcgtcgctggtgctggcgctgctgctgcagatcctgctgtttgtggtgatcctgatgctcaacggctatgcggcgttcaccgtgctgctgctgccatggggcctgatcggcatcttctcgctgtttttgaagatcatcttctggtcgatgatcatcagcgtgatcctgtcgtgggtcgcacccggcagccgcagcccgggcgctgagctggttacccagatcaccgagccggtgctggcgccgttccgtcgcttgatccccaacctgggcggcctggatatctcgccgatcttcgcgttcatcgcgatccagctgctgcaaagctgggtgattccgcgtctggcttactatgcgttcatgcccaaagagctgtttggcctgatctgaccgcatgatcgttcccacgctctgcgtgggaatgcctcttgggacgctctgcgtcccctcatgcaggatgcgacgcggagcgtcaccggctgcgttcccacgcggagcgtaggaacgatcatctggctcagggtttgcttgccgctggggtcaccgctctttagacttacgcctcatttaaacgagagcagggtcgatgccaactgccttcccccccgattctgttggactggtcgtgccccaagtggcgcacttcagcgaaccgctggccctggcctgcggccgttcgctgcctgcctatgacctgatctatgaaacctacggccagctgaacgccacggcgagcaacgccgtgctgatctgccacgccctgtccggccatcaccatgctgcaggtttccacagtgccgacgagcgcaagcccggctggtgggacagctgcatcgggccaggcaagcccatcgacaccaataaattctttgtggtcagcctgaataacctcggcggctgcaacggctccaccggcccgagcagcctcaacccggaaaccggcaagccattcggcgccgacttcccggtgctgaccgtggaagactgggtgcacagccaggcacgcctcgccgatctgctgggcatccagcaatgggccgccgtgatcggcggcagcctcggcggcatgcaagcgctgcagtggaccatcacctacccggaccgcgtgcgccactgcctggccatcgcctcggcccccaagctgtcggcgcagaacatcgccttcaacgaagtggcacgccaggcgatcctcaccgaccccgagttccacggcggttcgttccaggaagccggcgtaatccccaagcgcggcttgatgctcgcgcgcatggtcgggcacatcacctacctgtccgatgactccatgggcgagaaattcggccgtgggctcaagagtgaaaagctcaactacgacttccacagcgttgagttccaggtcgaaagctacctgcgttatcagggcgaggagttttccgggcgtttcgacgccaacacctacctgctgatgaccaaggcgctggactacttcgacccggccgccaacttcaacgacgacctggcgaaaaccttcgaaggtgccacggccaagttctgcgtgatgtcgttcaccaccgactggcggttctcgccggcgcgctcccgtgagctggtggacgccctgatggccgcgcgcaaagacgtctgctacctggagatcgacgctccgcaaggccatgacgcctttctgattccgatcccgcgttacctgcaggcgttcggcaattacatgaaccgaattactctgtgagaacgccatgagagccgacctggaaatcatccaagactggatccccgccggcagccgcgtgctcgaccttggctgcggtgatggcgaactgctgagttggctacgcgacaacaagcaagtcaccggctatggcctggaaaacgacccggacaacatcgcccagtgtgttgccaaaggcatcaacgtgatcgagcaggacctggacaagggcctgggcaactttgccagcaacagcttcgacatcgtggtgatgacccaggccttgcaagcggtgcactacccggaccgcatcctcgacgaaatgctgcgtgtaggccgccagtgcatcatcacgttccccaacttcggccactggcgctgccgctggtacctggcgaccaagggccgcatgccggtgtccgatttcctgccgtacacgtggtacaacacgccgaacatccacttctgcaccttcgaagacttcgaagccttgtgcggcgagcgtgaagccaaggtgatcaaccgccttgctgtcgatcaacagcaccgccacggctgggcgagtaagctatggcctaacctgttgggcgaaattggtatttaccgggtcagcagtcctggcctgaccgaccacaagattgccgtctaatcattttcaagagggacgctcatgagtcgtttggctgtttttttattgaccgcactgcttggcgccaacgctatggctgccgacgtaatcgaccctaaccgcaccaaggaatttggtgatatcaccgtacgctacaacacattcacctcaagcttcctgcaacccgaaacggcccaggccgttggcgtggtacgcagcaagaacaaggggctgatcaacgtatcggtgtttaaaggtgtgacaccggtagtggcgcaagtcaccggcaccatcaaggactcgctcggcaagagtgaagtactcacgttcaagcagatcaccgaaaaaggcgtgaccaattacctcgcgccctactccgtgccgcaacaggaattcaagaccttcaccatcaacgttgaaaccggcggcaaggcccacggcttcagttttgtccaagaacttttcccggccgaataatgaacctcacccaactcgtactggccagccataacgccggcaaactcaaagaactgcaggccatgctcggtgactccgtgcaactgcgctcgattggcgagttcagccaggtcgagccggaagaaaccggcctgtcgttcgtcgagaatgccattctcaaggcgcgcaatgccgcacgcatttccggcctgccggcgttggcggatgactcgggcctggccgtggatttcctcggcggcgcccctggcatttactcggcacgctacgccgatggcaagggtgacgcggcgaataacgccaagctgctggacgcgctcaaggatgtgccggacgcgatgcgcggcgcgcagttcgtctgcgtgctggcgctggtacggcatgccgatgacccgctgccgatcctctgcgaagggttatggcacgggcgcatcctgcatgcggccagcggcgagcatgggtttggctacgacccgttgttctgggtgccggagcgcaatgtctccagtgccgaactgagcccggccgacaagaaccagatcagccaccgcgcccgcgcaatggatttgctgcgccaacgcctgagcctgaaatgacccagaacacctccgcgcagccgctgatccacggcggcgcgcaaacacctcgggcggccttgcctcacctgccgcccctggcgctgtacattcacatcccgtggtgtgtgcgcaaatgcccttattgcgacttcaactcccacaccgccagcaaagtgttgccggaagaagagtacgtggacgcgctgctggctgaccttgatcaagacctgcacgcggtttatggccgtgaactcagctcgatctttttcggtggcggcacgccgagcctgttcagcgccgctgcgctgggccgcttgctcaagggcgtggaagcacgtatcccatttgccagcgatatcgagatcaccctggaagccaaccccgggaccttcgagcaagaaaagttcgtggcctatcgcaagctggggatcaatcgcctgtccattggcatccagagcttccagcagcaaaaacttgaggccttgggccgcattcacaacggcgacgaagccgtacgcgcggcgggcatggcacgccaggccgggttcgataacttcaacctggacttgatgcacggcttgcccgatcaatccctggacgatgccttgagcgacttgcgccaagccatcgccctgaagccgacgcacctgtcctggtatcagctgaccctggagcccaacactgtgttctggaaccagccgcccgcgctgccggaagacgacacgctgtgggacattcaggaagccggccaggcgctgctggccgaacacggttacgcgcaatatgaagtgtcggcctatgcccaagcgggccgcccggcacggcataacctcaattactggagcttcggcgactttatcggcatcggcgccggcgcccacggcaagctgagccacccggacgggcgcatcgtgcgcacgtggaagacgcgtgcaccgaaggactacctcaacccggccaaaagtttccaggccgggtcgaaagaactgaccaatgaagaactgccgttcgagttcctgatgaacgcgttgcgcctcaccgacggtgtcgacgccaggctctatgccgagcgcaccggcctcgacctggcgagcctggacgaaggccgcaaggaggcagaacaaagtggcttaatgcaggtcgaaccgtcacgcctggcggcgaccgaccgcgggcaactctttctcaatgacctgttgcagaagtttttgagctgatcgctcttaaggaaatcgaatggatttggtactcgacctgctcgccaccgtatcccgctggagccgtagcaacctgtcggaaatctccctggcgcttgtcggctgcttgctggtgctgttcggcgccgatatcaaaggctggatcgaagcccgcctgggcagcatcgccggggcgttgcgcgtaccgttgatggcgctggtgtgcatgatcggcagcggcgcggcgctgatctacgccacgccgtggattgtgcgggggttgagccagttcaataactacagcctggcgccggtgttggtggtggtgctggtgttgattggcgtagtcgctgaccgccgctgaattccggcacaccacaaaaccaatgtgggagctggcttgcctgcgatgcagacacctcggtgtatcagggatacccaggtgatgctatcgcgggcaagccagctcccacagttgattgcatttcagttttctagctgtttaagccagcttctcgaacttcaaatcccacaccccatgccccaaccgctcgccgcggcgttcgaacttggtgatcggacgctcagccgggcgtggcacgcatttgccgtcttcggccaggttgcggtagccaggggcgacgttcatcacttcaagcatgtattcggcatacggttcccagtcggtggccatgtgcaggatgccgccgactttgagcttgctgcgcaccagctccgcgaaggacgcctggacgatacggcgcttgtggtgacgggctttgtgccatgggtctgggaagaacagcatcaggcggtcgaggctgttgtcggcgatgcagcggttgagaacttcgatcgcgtcgcagtcgtagacgcgcaggttcgtcaggccttgggtcagcacgccattgagcaacgcgccgacgcctgggcggtgcacttccacaccaatgaaatcctgctccggcgacgccgcagccatttccagcagggagtggcccatgccaaaaccgatttccagggaacgcggggccgaacggccaaacacctggtcgtagtccaccggcgcatcggccagcggcaacacgaacagcggcgtaccttgttccaggcccttttgctggccttcggtcatgcgacccgcgcgcatcacaaaactcttgatgcggcggtgcttggactcgtcgccttcttccacggtgttcggcgtttcgtttgattcagtcatcaatggctcttacttgatcagaccatccagcggcgaagaggcgctggcgtagagttttttcggcatgcggccggcgaggtaggccaggcggcccgcgacgatggcgtggttcatggcttcggccatcatgatcggctgctgggcatgggcgatggccgagttcatcagcaccgcgtcgcagcccagttccatcgcaatagtggcgtcggaggcagtaccgacaccggcgtccaccagcacagggattttggcttcttcaaggatgatctgcaggttatacgggttgcagatgcccaggccggaaccgatcaagccggccagcggcatcaccgcgatgcagccgatttccgccaattgacgggcaatgatcgggtcatcactggtgtagaccatcacgtcgaagccttccttgaccagcgtttcggcggccttgagggtttcgatcacgttggggaacaaggttttctggtcggccagcacttccagcttcaccaggttgtggccgtcgagcagctcacgggccaggcggcaggtgcgcacggcttcgatggcgtcgtagcaaccggcagtgttcggcaagaaggtgtagcgatccggcgacagcacttcgagcaggttcggctccccttcgatctggccaaggttggtgcggcgtacggcaaaggtgacgatctcggcccccgaggcctcgatggccaggcgggtttcttccatgtcgcggtacttgccggtgccgaccagcaaacgggactggtaggtacgaccggccaatacgaagggcttgtcgctacgaacgatgctcatggaaaatcctcgagttggggtgaggttctgcagaatgcgggttggcgcccttgagcgccggatggctagccgccgccgatggcgtggaccacttcgacctggtcaccttcggtaagcgcggtgtcggcatgttggctacgcgggacgatatccaggttgagttccactgcgacgcgacgcccggtcaagtccagacgggtcagcagggccgcaacggtttcaccgtcgggcagttcaaaggggtcgccgttcaactgaatgcgcatgccacaggccgccatcgtttttaggggccagcattctagcccgattggcgttgtcggcccaagcccctcggtcagatgacctgcaggcgccaggcggtgagccccagaaagaaccagccgagcaggaacgccagcccgccaaacggcgtgatgatgccgagcttgctgatgccggtcagggtcagcgcatacaagctgccggaaaacagcaggatgccgacggtaaacgaaatgcccgcccagctgaccagccggccaggaatatgcgccgccagcagcgccacgccgaacaacgccagggcgtgcaccagctggtaggtcacgccggtgtggaagatcgccaggtactcggcgctcaggcggtttttcaagccatgagcagcaaaggcgccgagggcgacaccggtgaagccgaaaaaggcagccagcatcagaaagctacgcagcatgaggaactccagtcagactcaaagggccgggtctgtataatggcccgctcaacgggttcggccaagccatctctatgctgcgtctcttcttcaagcgttttctcaaagtcgtgaaatggtttgccatcggcagtgtgctgctggtgctgctgtttcgtgtcgtcccgccaccgttcaccgcgttgatggtggagcgcaaggttgaatcctgggtcgacggcgagccgattgacctgcaacgcacgtgggtgccgtgggatgagatcgccgatgacctcaaagtggcggtgatggccggtgaagaccagcgcttcccgcagcactggggctttgattttggcgcgattcaggcggcattgctgcacaacgagcgcggcggctcgattcgcggcgccagcacgttgagccagcaggtgtcgaaaaacctgttcctgtggaccggccgcagctacttgcgcaaagggctggaggcctggtttaccgggttgatcgagatattttggcccaagcagcggattcttgaggtgtacctcaacagcgtggaatgggatgaaggcgtgtttggtgccgaagcggcggcgcggcatcactttggggtgagtgccaaggggctttcgcgccagcaggccagctatttggcggctgttctgcctaatccgcgggtgtggagtgccagccatccgacggcctatgtggcacgccgggctgcgtggattcgtcagcagatgagccagctgggtggagatggttacttggttgagttgaataactcccgcaaagccccttggtccgactgacagggcctcatcgcaggcaagccagctcccacactgaaccgaactggatttgaaacttcttaaaaactaccgcaatacgcgttgatctgactgacagcacacagaaacaaatgtgggagcgggcttgctcgcgaatgcgatgtttcaatcaacatttccgttgactgacactccgctttcgcgagcaagcccgctcccacattcgatcgcgttgttttcgaactctgcgctttaggcggcgatcgacaacttcagcttgttcatcgcgcttttctcaagctgacgaatccgctcggccgacacgttgtacttttgcgccaggtcgtgcagcgtggccttttcttctgccagccagcgctggtagaggatgtcacggctgcggtcgtccagcacttccagcgcttcgtgcaggttgtgattggagttgtcgctccagtcggcgtcttccagttgacgcgccgggtcgtaccggtggtcttccaggtagttggccggcgattggaaggcgctgtcgtcgtccgcttcagcggccgggtcgaaggccatgtcatggccggtcaggcggctttccatctcgcgcacttcacgcggctccaccccgaggctttcagccacgcggtggacttcctcgttgttcagccacgccaggcgtttcttctggctgcgcaggttgaagaacagcttgcgctgagccttggtggtcgcgactttcacaatgcgccagttgcgcaggatgaactcgtgaatttccgccttgatccagtgcacagcaaacgacaccaggcgcacacccatttccgggttgaagcgctttacagccttcatcaggccaacattgccttcctgaatcaggtcggcctgggccagaccgtagccgctatagctacgggcgatatgtacgacaaaacgcaggtgggcgagcaccatctgccgagccgcccccaaatcctgctcatagtagagactctcggccagttcacgctcctgctcgggcgtcagcaatggaatgctgttaaccgtgtgcacataggcttccaggttcgcacccgggaccaaggcataagcaggttgcaaagaagtggtcatacgaaaaaacctccgactcacataactcgtgcagttcagcactgcgaaaattgaccgggaaccgtaggacaagttccctaaaccactgatacggtcaatacaaacgaaaccacattaccctgacattaactacttgggcgccagctcacgtaaatgccgtgcgaccgcaatccaagcaccgatataccccaacaagaccgcgccaagcaagagtgacagaccatcggcaaccggcacgccagccaaagcgaaatcactgccgtacaagccggcaagcccaaccaccgcgtcgttcagccagtccaggccaaacgccagcacgccccaggacaaaatcccggcaccgaagccataaagcgcgcccatgtacagaaagggacgacgcacatagctgtctgtgccgccgaccagtttaatcacttctatctcggtgcgacggttttcaatatgaagacgaatggtattacctatcaccaaaagtaatgcagacaccaataacaccgtcagaccgaacacaaagcggtcgcccagcttcagaatcgccgccaggcgctctacccagactagatcaagctgcgcctgttgtaccttgggcatccctgcgagtttttgtcgcagggcctcaagggcggccttgtcgacttcgttcggcgtcaccagcaccacgcccggcagcgggttctgcggcagctccttgagcgcctcgcccaggccggattgctgctggaactcctcaagcgcctggtcgcggctgatgtactcggcatccgccacgcctggcaggttcttgatgtcatcgcgcaagttttcgccgtctttggcgctggcgtcgaggttcaggtacagggaaatctgtgccgcgcgctgccatgaaccgcccaggcgctcgacattattaagcaacagcgacaaacccatcggcaggctcagcgccaccgccatcaccaggcaggtgaaaaagctgccgaccggctgcttgcccaggcggcgcaggctgtcgagcaggctggcgcgatggctttcgatccaggcgcgcagcagcgtgccgaagtccgggccgtcgtcttcgtcgcgttttttcttctgcggttgcgggtcggcggctttcggcgccacacgctcggagactttagggctgcgtgttgcactcatacgccagcctccccgtcaccgatcaggcggccgcgttgcagcgtcagcatgcgatggcgcatgcgtgcgatcagcgccaggtcgtgactggcgatcagcacgctggtgcccaggcggttgatgtcttcaaacacgcccatgatctcggccgccaaacgcgggtcgaggttaccggtaggttcgtccgccaacagcaaggccgggcggtggacgatggcgcgggcaataccgacgcgctgttgctggccggtggacaggtcgccggggtacagatcggttttatccgacagcgccacacgctccagggccgaatccacacgcttgacgatctcagccttggacagcccgaggatctgcaacggcaaggcaatgttgttgaacacggtgcgatcaaacagcaactggtggttctggaacaccacgccgatctggcggcgcaggaacggaatctgtgcattgctgatggtggccaaatcctggcccgccaacagcaacttgccggtggtaggacgctccatggccagcagcagccgcaacaaggtacttttgcccgcgcccgagtgaccggtcacgaacaagaattcgccgcgacgcactcgaaagctcagctcatgcaagcccacatgcccgttggcgtagcgtttaccgacctgttcgaatcgaatcatgaacgctcccgctcggcaaagagtgcctgtacaaagggttcggcttcaaaggtgcgcaggtcgtcgatgccctcaccgacgccgatataacgaatcggcaacccgaactgtttggccagggcaaagatcacgccgcccttggccgtgccgtcgagcttagtcaatgccaggccggtgagttgcaccgtctggttgaattgtttggcctgactgatggcgttctggccggtgccggcgtcgagcaccagcaagacttcgtgcggcgcatctgcgtcgagcttgccgatcacgcggcggactttcttcagctcttccatcaaattgtctttggtgtgcaggcgaccggcggtatcggcgatcagtacgtcgatgttacgtgccttggcggcttgcacggcatcgaagatcactgaggcggagtcggcaccggtgtgctgggcgatgaccgggatcttgttacgctcaccccagacctgcaactgctccacggcagccgcgcggaaggtgtcgccggcggcgagcatgacttttttgccttccgactgcagctttttcgccagcttgccgatggtggtggttttgccggcgccgttgacgccaacaaccaggatcacgaacggttttttcggcgtgattaccagtggcgcctcgacgggcttgagcatggcagccagctcggcctgcagggacttgtagagagcgtccgcatcggtcagctgcttgcgggcgaccttttgggtcaggctctgaatgatgacagcggtggcttcaacgcccacatcagcggtcagcaggcgggtttcgatgtcttccagcaattcgtcatcgatgactttcttgcccaggaacaggctggccatgccttcgccgatgctggcgctggttttgctcaggccttgcttgagacgggcgaagaagccggttttgctggtttcagccggcgcagcaacaggcgcttgcgcgacaggcggctcgatcacggcaggagcggcaaccacgactggcgctggtgttggctcgacaactaccggagcaggcgtttcgatgacgggcggggcttcaaccacaacggccacgggctcaaccacgaccggaatcggcggcgccacgtgctcggcctgcacatcttcaaccagtgccacgggttcctctgccaccggcagctcgagccatggcgtttgctcgggctcagtttccggctcgacctcagcctccggctgcaacaccggttcagccatcggcaaaatcaccggcgccggggtttcagcaaccggcacggcttctactattggctcggggataggttcaggctgaacctgcggctgttcgacgacggtttcctgcggctttttgcgcagccatccgaacaggccttttttctcgccagccgcagctgggctcttcttgtcgtcgttggaaccaaacatggaggacggctatctcaaagtagcgatgcgccagggcgcctcggtaaataaattcgatgcagaacagactgctttaacgctcgcttgttcatgcgcaacattttgtaaggcgtaaataaaggcctcaacaaatcgtttcaataaaggactgaagcgataacatcggcgaaaagtggaagattgtcggggaaaaacaccctgtattccaacattcctacgactggatccggaacgatatggcggccacagtggccgaccctaagtcggatcagtatcctagcacctcctcgcccgccgacgctaagaccaagcgggcagcccaacaggtttaaaaacgaatgaatgctctagcccgccgcgctgcaggcctgctgctcagcacagtttgtctgcccctttcagctttggctgccgacccacaacccacccacgaattcaccctggataacggccttaaagtggttgtgcgcgaagaccatcgcgcgccagtggtggtttcccaggtctggtacaaggtgggttcgagctacgaaaccccgggccagaccggtttgtcccacgccctggaacacatgatgttcaagggcagcgccaaggtcggccccggcgaggcctcgctgatcctgcgcgacctgggcgccgaagaaaatgcgttcaccagcgatgactacaccgcttactaccaagtgctcgcacgtgaccgcctgggcgtggcctttgagctggaagccgaccgcatggccagcctgcgcctgccggccgacgagttcagccgcgagatcgaagtgatcaaggaggagcgccgcctgcgcaccgacgataacccgatgtccaaggcctacgagcgtttcaaggcgatggcctacccggccagcggctaccacacgccgaccatcggctggatggccgaccttgagcgcatgaaagtcgaagagctgcgccactggtatcaatcctggtacgtgccgaacaacgccaccctggtggtagtcggcgacgtcaccccggacgaggtgaaaaacctcgcccagcgctacttcggcccgatccccaagcgtgacgtaccgccagcgaagatcccgctggaactcgccgagcccggcgagcgcctgctgaccatgcacgtgcagacccaactgccaagcgtgatccttggcttcaacgtgcccggcctggccaccgccgaagacaaacgctcggtacaggccttgcgcctgctctcggcgctgctcgatggcggttacagcgcgcgtatttcggagcagttggaacggggtgaagagctggtttccgccgcctccaccagctacgacgcctacacccgtggtgacagcctgttcaccctgacggccacaccgaatcagcagaagaaaaagaccattgcccaagccgaagccgggctgtggcgcctgctcgatgaattgaaggccaagccgcccaccaccgaagaactggagcgcatccgcgcccaggtgattgccggcgtggtctaccagcgtgattccatcaccagccaggccacagccatcggctccctggaaaccgtcgggctgtcctggaaactgatggacaccgaactggccgacctgcaaagcgtgaccccggaagatatccagaaagccgcacgtacttatttcacccgcgaacgtttgagcgtcgcccatgttttgcctgaggagaccgctcatgagtgatcgtaaaagcagccgcctgatcttccctggcctggtcgtcgttaccctgatcgccgccagtgccgtgtacttgctgcgcccaagcgaatctgtcgccagccaggcgttggataaagctgaatcggccaacaagctgcaatccctggcagagctggacggcaaggcgccgaccaaccgcaagctcgacgtgcagacctggaccaccgccgaaggcgccaaggtgctgttcgttgaagcccatgaattgcccatgttcgacatgcgcatcctgttcgccgctggcagcagccaggacggcaacacccccggcgtggcgctgctgaccaacgccatgctcaacgaaggcgtgccgggcaaggatgtcagccagatcgccagcggctttgaaggcctgggcgccgacttcggcaatggcgcttaccgcgacatggcgctggtgtccctgcgcggcctgagcgacagcgataaacgcgacgcggccttggcgctgtttgacgacgtgatcggcaagccgaccttcccggccgactccctggcgcggatcaagaaccagatcctcgccggcttcgagtaccagaagcagaacccggccaagctggccagccttgagctgttcaagcgcctgtacggcgaccacccttacgctcacccgagcgaaggcacgcctgaaagcgtaccgaagattaccctcgcgcagctgcaggcgttccacgccaaggcgtatgccgcaggcaacgcggtgattgccgtggtcggcgacctgacgcgcgccgaagccgaggccatgaccgccaaggtgtcggcatcgctgcccaaaggcccggcgctggcgaaaatcgcccagccgaccgaaccgaaagctggcctgagccatatcgagttcccgtccaagcagacgcacttgctgttcgcccaattgggtatcgaccgtgccgaccccgactacgcagccttgtcactgggtaaccagatcctcggcggcggtggctttggcacccgtttgatgagcgaagtacgtgaaaagcgcggcctgacttacggcgtgtattccggcttctcgccgatgcaggtacgtggcccgttcatgatcaacctgcaaacccgcgccgaaatgagtggcggcaccttgcgcctggttgaagatgtgctggccgactacctcaagaccggcccgacgcaaaaggaactggacgacgccaagcgtgagctggccggcagcttcccgctgtccaccgccagtaacgccgatatcgtcgggcagctgggcgccatgggtttctacaacctgccgctgagctatctggaagatttcatgaaacaatcccaggccctgaccgtagagcaggtcaaggctgcaatgaacaaacacttgagcgccgacaagatggtcatcgtgaccgccggcccgacgattgcgcaaaagccactaccgccccccactgataaacctgccgagcagccgctcggggttccggagcattaatggccagttcatctcgcccgaaaaaacccgtccacaacgtgcataacggtgtgggccaactgcgcatcattggcggtgaatggggcagccgcaagctgagcttccccgacgtcgtaggcctgcgcccgacgccggaccgcgtgcgtgaaaccctgttcaactggctcgcgccttacatcggcggggccaaggtactggacccgttcgccggcagcggcgcgctgttcctggaggcgctgtcccgtggcgcggcccagggccaggcgctggatgccagcaacgtggcggtgtccagcctcaaggaacacctgggcacactgcgttgcaccaccggccaggttcagaccgccgatgcgctgcgctatctggaaacccaggcagccaccgaatacgacgtggtgtttctcgatccgccgttcaaccagaacctgttgccgaccgtgtgtgcattgctggaagaccgccaatggctggcaccggatgcctggatctacactgaaagcgagaccgcgccgtctaccctcggcctgccgggcgcctggcgtttgcaccgggagcagaagtccgggcgggtgtattacgcgctgtggcatcggttggtcgaaggcgttgcctgatctgtagtgagtgagcttgttgtggtgacaggacttgctgtggcgagcgggcttgctgtggcgagcgggcttgccccgcgttgggctgcgaagcagccccaataaagtcaccgcattctttcagtcggaccgcggggcttggaccagggccgctacgcagcccaacgcggggcaagcccgctcgccacaacagcgcgctcaccacacagagtcgttcgccacagagattcccatgacacctccctcagacctcttcaaacccgccttcggcctcggcaacccccacttgcaaacactgtgggggccgttgtggcgccccaccacccatatcgaacgccaacgcgaacgcctgtggctggacgacggtgactttctcgaccttgactggcacggcccccatgacgcgcaagcgccgctggtgctggtgctgcacggtttgacgggctcgtccaattccccctacgtagccggcctgcaaaaagtcctcgccacccaaggctgggctagcgcagccttgaactggcgaggctgctcgggcgagccgaacctgctggcgcgcagttaccactcgggcgccagcgaagacctggcggcggcgattgcccatctgcgtgccaagcggccgttggcgccgctgtatgccgtgggctattcattgggcggcaacgtgctgctcaagcacttgggggaaaccggcgcggcctccgggctgcaaggcgcagcggcggtgtcggtgccgttccggctggaccaatgtgccgaccgcatcggcctggggttttcgcgggtttatcaaaagcacttcatgcgcgagatgctggcgtatatccgcgtcaagcaaagccgctttttgctggacggtcgtgcggacgggctgaaaaccctggagtcactgggttctctggagaagatgcgcacgttctgggatttcgacgggcgggtgaccgcgccgctgcacggtttcctcagcgccgaggactattaccgtcgcgcgtcgagccggtattacttgggtgacattcgcacacccacgctgatcatccacgccgccgatgacccgtttgtgttcgcccacagcctgccggaggccagcgaactgtcggactgcaccgagttcgagttgctggccaagggtgggcatgtggggtttgtcgatggttctctcaggcgcccgagctactacctcgaacgccgaatcccacaatggctactgtcacaacgcggttaaaaatgtgggagctggcttgcctgcgataacggtgggtcagccaattatcagctgactgacacgccctcatcgcaggcaagccagctcccacagtttgattgggtttgcagggctggcggctcagtcgcccgtcgcaatgccccgcgccggatcggtaatccactcactccacgaccccgcatacagcttgcccagcgggtaacccgccaggctcagggcgaacaggttatggcacgccgtcacacccgaaccgcaatacgccaccagctcatccggcgaacggccttgcaactgcgcggcaaaacgctgtttgagctgctcagccggcaggaagcggccatcactgccgaggttttcgttgaacgccgcacattgcgcgccgggaatatgcccggcaatcgggtcgatgggctccacgtcaccccggaaacgcggctgggcgcgagcgtcgatcaaggtcatgcccggttcgcccaggcgtttttgcaggtgttcggcgtccagcagcaggtgattgtccggcgtgccggtaaaccttcccggctcaaccaccggcccgtccaggctcaaggggaaaccggcggcgtgccaggccttgaggccaccgtcgagaataaacacgccatcacgtttgcccagccaggccagcaaccaccacgcgcgggcggcataggcgccggggccatcgtcatacagcacgatgtcggtgtcggcattgatgccccaggctcgcaactgcgcaatgaacgtgtccgcatcaggcaatgggtgtcggccagtcacgcctttggtcaccgggccgctgaggtggcgttccaggtcagcgtactgcgcgccttcgatatgcccttcggcatagctgcaaagcccgtagtccgggtcttccagggcaaagcggcaatccaggatcaccagcctgccggccttctggcgctcggcgagttgctgggggctgatcagttgggcaagcggcatgacggactcctgtaaacagattcgggaaaggtcctacttcacttcttccagtgcctggttcaacggcacataaaactctttaaacaaagcatccaccgcctctttcgcctgcggcgtgacaaaccccgcctccagcaccagcacctgatacaccccgcgcttgatcgcctcggcgctcaagtgggtggagttttcattggtggtgcacaggaaacgcacccacgaggtgaggatgatccaggcattgagcgtcagggcttcggtttgcaccgggtccatcgtgagaatgcccgcgtcgacaaacccttggtaaatggcgttgccctgggtcaggcagcgctgggaaaaacgccggtagccggtggccagttccgggtcgctttccagcaggtgttcgaggtcgcggtgcaggaagcggtaacgccacatgccggccagtacagcctgcaggtagaagcgcttgtcttcgacggtgacggcgcggccttggggcgggcgcaggaaactgtccaccagggcttcatattcgcgaaacagcacggcgatgatcgcctgcttattggggaagtggtagtacaggttgcccggggaaatttccatatgggcggcaatgtggttggtgctgacactgcgctcgccctgctggttaaaaagctccaggctggtttgcacaatgcgctcgctggtctttactcgtggtgccataggggatcagcttctatacacgtgatggggcatcttacggcctatccttgtttggataaaaccgcatgttgctgcaatgacatttgacaatttagagtaatgactctaaaaatccaggcagacctataacaattgggaactgcgccatgtctgccaccattgcctacctgcaagattcccaggcgctggatcacctccaggacctgttcgacgcccaacgccgcgcctatgccgccaacccaatgccaccggcggcgcagcgccagcaatggctcaaggccttgcgcgatgtgctcagcgacgaacgccaggccctgatcaacgcgatcagccaggacttcagccaccgcagcgcagacgaaaccctgttcgccgaactgatgcccagcctgcatggcattcactacgccagcaaacacctcaaaggctggatgaaaccttcccgtcgcgccgtaggcattgccttccagccggcgtcggccaaagtcatctatcaaccactgggcgtggtcggggtgatcgtgccgtggaactacccgttgtatttggctattggcccgttggtcggtgcgttggcggccggcaaccgggtgatgctcaaactcagcgagtccacgcccgccacgggtgaattgctcaagacactcttggcgaaaatcttccccgaagacctggtgtgcgtggtgctgggtgaagccgaagtgggcatggcgttttccaagttgcgcttcgatcacttgctgtttaccggcgccaccagcatcggcaagcacgtaatgcgtgcggcggccgaacatctcacgccggtaacgctggagctgggcggcaaatcaccggccatcgtttccgccgacgtaccgctcaaggacgccgccgaacgcatcgccttcggcaaatgcctgaatgccgggcaaacctgcgtggcaccggactacgtgctggtgcccgaagatcgcgttgaaggcttcgtcgaggcctacagcaaggcggttcgcgggctctatccgactctggccgacaacccggactacaccgccatcatcaacgagcggcaacaggcccggctgaatgcctacgtcaaggacgcaaccgacaaaggcgccacgctgattccgctgtacgaccagggccaggcacggcgcatggcccacagcctgctgctcaatgtcagcgatgaaatgaccgtgatgcaggacgaaatcttcggcccggtgctgccgatcgtgccgtatcgcggcatcgatcaggcctttgcctacatcaaccaacgccctcgcccactggccctgtattacttcggctacaacaagagcgagcaaaaccgcgtactccacgaaacccactccggcggcgtgtgcctgaatgacaccctgctgcacgtggcccaggacgatatgcccttcggcggcatcggcccttcaggcatgggccactaccacggccacgaaggcttcctcacgttcagcaaggccaagggcgtgctggtgaaacagcgcctgaacgcggcgaagttgatctacccgccctatggcaaatcgatccagaagttgattcaaaagttgtttgttcgctgattccgccactcacgggataacaataacaatgaaccccagcctgactgaaacacccgaattgtcgcggcgcagcgtcctgaaaatcggcctgtgcgccagcgccttcctggccactgccgggctgggcgccagcctcagcggctgctccagcagcacctcggccagcggctttgcgatgctgcgcagcagtgacttgccgttcttgcgcgcggtgatcccggtgctgctcgaaggcgcggccagcgcccaggacgtggtcgccggcattgaagacaccctgaaaaagctcgattacagcctgcagcacctgtcgccggagatgttcaagctcacccagcaactgttcgatgtgctcggcatggggattacgcgcgggccgttgaccggcatctggggcagttgggaaaacgccagcagcgatcagatccgcaacttcctgcaccgctgggaaaacagttacctgaacctgctgcgcatgggccagggctcgctgctcaagctggtgatcatggcctggtacttccgcccgcagtcctgggcccattgcggctaccccggcccgccgaagatctagccccgacaacccgattggaaaatgtgggagctggcttgcctgcgatggcggtgcatcagcgatgaattgatcggcaggcaaaccgctatcgcaggcaagccagctcccacattggttgtaacttcgtacagaaaaataagagtgcactcctatgcccgtacccgatctgttccgcgacggcctggcccgcggctggaaaacccacaatggcgccgcgctcgacagcgacctgatcctggaagccgacgtggcgatcatcggcagcggtgccggtggcggcaccaccgccgaaatcctcagcgctgcgggctacaaagtgctgctgatcgaagaaggcccgctcaagaccagcagcgacttcaagctgctcgaggacgaggcctacgccagcttgtaccaggaaggcatcggccgcatgagcaaggacggcgcgatcaccatcctgcagggccgagccgtgggcggcaccacgttgatcaactggacgtcgagttttcgcacgcccgacgccacgctttcccactgggccagtgagtacgcggtgaaaggccacagcagcgccgagatggcgccgtggttcgagaagatggaacagcgcctgggcatcgcgccgtgggccatcccaccgaatgccaataacgatgtgatccgcaaaggctgcgaaaagctcggttacagctggcacgttatcccgcgcaacgtacgcggctgcttcaacctgggctattgcggcatgggctgcccggtcaacgccaagcaatcgatgctggtgaccaccatcccgtccacgttggaaaaaggcggcgagctgctgtacctggcccgcgccgaacgcttgaaatacagcggcgataccatcagcagcctcgaatgtgtggcaatggacgaacgctgcgtggcacccaccgggcgcaagatcacggtcaaggcccggcattacgtgctggcgggcggcggcatcaacagcccggcgctgttgctgcgctcggacgcgcccgacccgcattcgcgcgtgggcaagcgcacgttcctgcacttggtgaacttctccgccgggcagttcgatgaggtgatcaacccgttctacggcgccccgcagtcgatctattccgaccacttccaatggcaggacggcaccaccggcaaaatgtcctacaagctggaggcaccgcccttacacccaggattggccagcaccttgttcggcggctacggcaccgggaacgcgctggacatgagccaactgccccacacccacgccatgcttgcgctgctgcgcgacggcttccaccccgacagccccggcggcaccgtggacttgcgcggggacggcacgccggtgctggattatcaggtgtcaccttacgcgtgggatggcctgcgccgtgccttccacagcatggccgagattcagttcgccgcgggcgccaagtcggtcaagccgctgcaccacgatgcccgctacgtgaacaccctggccgaagcgcgcagcctgattgacggcctgagcctggaattgcaccgcaccacgctgggcagcgcccatgtgatgggcggttgtgccatgggtgaagacccgaaaaacgcagtggccgacagcctgggtcgccatcaccaattgcgcaatctgtcgatccacgacggctcgttattccccaccagtattggggctaatccgcaattgtcggtgtatgggttaaccgcgcaattggcgacagccttggccgaacgtctgaaaacagcgtgaaaaaacaggttattcgcggtgtctatagtgctttcttatgcataagttgacttggccgaccgggatggctgcgataccatccggttccccaacggactccgccaggacgacgcgatgaaccgagtgttgtacccaggtactttcgacccgattaccaaaggccatggcgatttggtcgaacgcgcctctcgcttgttcgaccatgtgatcatcgcggtcgctgccagccccaagaaaaacccgctgtttcccctggaacagcgcgtggagctggcgcgtgaagtcaccaagcacctgcccaacgtagaagtggtaggtttctcgaccttgctggcgcactttgccaaagagcagaacgccaatgtgttcctgcgtggcctgcgtgcagtgtcggacttcgagtacgagttccagctggccaacatgaaccgccaactggcgccggacgtggaaagcctgttcctcacgccgtcggagcgttactcgttcatttcctcgacgttggtgcgtgaaatcgccgctttgggcggggatatcaccaagttcgtgcacccggctgtcgcggatgcgctgacgctgcgcttcaagaagtaaattctgatgagtgggctgtaaacctgacttgtggtgagtgggctgccggtggcgagcgggcttgacccgcgttggcctgcgaagcggccccaataaagccaacgcgcagtttcaggcagaacaccgccgcctgatttcagggccgcttcgcgccccaacgcggggcaagcccgctcgccacagcaagcccagcgcttaccactactcgcactgcgggcgccaatgcggcacaattgcgcgcattagttttcagatgccctggctgacggccctggcaggagtttccatgtccctgatcatcaccgacgattgcatcaactgcgacgtctgcgaacccgagtgcccgaacgctgcgatttcccagggcgaagagatctacgtgatcgaccccaacctgtgcacccagtgcgtcggccactacgacgagcctcagtgccagcaagtgtgcccggtggattgcattccgctggatgaagctcatcctgagacgcaagagcagttgatggagaagtaccggttgattaccggtaaagcctgagactttgtggcgcccatcagggcctcatcgcaggcaagccagctcccacctttggatgtgtgaatacagtcgagtgtgggagctggcttgcctgcgatggctatatcagccatcacacacactcagctctggcacttagggcaaaacacactcgcccgctgccccaacaccacattgcgcaactcgctgccgcacaccttgcacgcctcgccgccccgcccgtaggcgaacagctcctgctggaaataccccggctgcccatcaccgccgataaaatcacgcaaggtggtgccgccacgctcgatggccgccgccaacacacgcttgatctcaatcgccagcttcaggtaacgcccgcgtgaaataccgccagcggcccgacgcggatcaatcccggcggcaaacaacgcttccgtcgcatagatattgcccacgcccaccaccaccgcgttgtccatgatgaacggcttcaccgccatcgacttgccacgggacagttgaaacagccgctcaccgtcaaacaggtcggtcaacggctccgggcccaggcgaatcagcagctcatgattgtgcgggtcctggctccacagcatcgcgccgaagcgccgtgggtcggtgtagcgcagggccatgccggattccagctctatgtccacatgctcatgcttggccgccggcaggccgacttccaccagacgcaaattacccgacatgcccaagtggctgatcagcgtgccgacttcggcattgatcaacaggtacttggctcgccgttccaccaacacgatgcgctgcccggacaggcgcacatcgaggtcttccgggatcggccagcgcaggcgccgctcacgcacgaccacacggctgacgcgctggccttccaggtgcggcgcaatcccgcgccgggtggtttcgacttctggtaactcgggcatgtgtacctcgtgaagaaagggtcagtgcgcgcccagttcgcggatcgacaacttcatgctttcgaagtcgtagtccgacaggcccacgtaatccagcaccagatggctgatggcattccactcatggtccacggtctggttgcccagcacgcgataggaagagcagatatgctcggccatcttcaggatcgccagcaggtttttcagctgcggattgcgtgccgattcatcactgaaaatcgccagggcgttgtggtggttggcgatggcgtcggtcacatgctccggcaggcgccaggatttggccgtgtaataacccaccacggcgtggttggtgttgaacgcgttgttctcggtgtcgaccacacggcagtcggggccggcattcgcgtaggcttcttccagcaccgccatgtaattggggaagcgcttgagcatcaacggcacaccgcaatcatggaacaggcccagggcatacgcctcgtcgacggcttgcgaaccggtgcgcttggccagggtcaggcaggtcatggccacgtcctgggcggtgtcccagaagcggttgagggtgacgatggtgtcgtcgctcatttcgcctttgatcgactgcgcgttgatcaggttgatgatcgaacggctgcccagcaggttcaccgcgcgctggatcgaggcaatcttgttgctcaggccgtaatacggcgagttgacgattttcagcagggcaccggacaggcctgggtcctgggagatcagccgcgcgatcacttccaggtccgggtcgggcatgtactgctccatctgcaaatccaccatgatttgcggttgaggcggcacgctgatgccttgcagggcctgttggatctgctcggcggaaagctcttgggacataagtacacactctgggctaggcggggattctaacctctaagcaaagctgactgacacctcaaaaacccgaattgaaacccgatcaaatgtgggagctggcttgcctgcgattgcaccaccgccgtacgtcagatacaccgcgccgtctgcatcgcaggcaagccagctcccacatgaaccggtgcgcaacaggtatactcccgctcttttttccggagcgacgtcatgtccctgccaagcctgcgtctcaaagccaacgccgatcgtcgtttgcgcaacggccacctgtgggtctacagcaacgaaatcgacgtggccgccaccccacttcacggcttccaggcaggcgaccaggctatcctggaagcggccggcggcaagaccctgggcatcgtggccatgagcccgaacaacctgatctgcgcacgcctgctgtcgcgcgacatcaagttgccgctggacaagtcgctgctggtgcaccgcatcaacgttgcgctgtccctgcgtgatcgcctgttcgacaagccgttctaccgcctggtctacggcgattccgacctgctgccgggcctggtggtcgaccgtttcggcgacatcctggtggtgcagatcgcttcggcgaccatggaagcgcacaaagaagacgtgatcgccgccctgacccaagtgctcaagccgagcggcatcctgttcaagaacgactccgccgcacgtgacgccgaaggcctcaaccgctacgtcgaaaccgtattcggcctggtgccggaatgggtcgcgctggaagaaaacggcgtgaaattcgaagccccggtgatccagggccagaagaccggctggttctacgaccaccgcatgaaccgcgcccgcctggccccgtacgccaaaggcaaacgcgtactcgacctttacagctacatcggcggctggggtgtgcaagctgccgcctttggcgccagtgaagtgttctgcgtcgacgcctccgccttcgccctcgacggcgtggagcgcaacgcggcgctgaacggcgttgccgaaaagatgacctgcatcgaaggcgacgtgttcgaagccctgaaagaactgaaagccagtgaagaacgcttcgacgtgatcgtcgccgacccaccggccttcatcaaacgcaaaaaagacatgaaaaacggcgaaggcgcctaccgccgcctcaacgagcaagccatgcgcctgctcagcaaggacggcatcctggtcagcgcttcgtgctcgatgcacttgccggaagacgacctgcaaaacatcctgctgaccagcgcccgtcacctggaccgcaatatccagatgctcgaacgcggcggccagggcccggatcacccggtgcacccggcgattgcagagacgcgttacatcaagagcattacgtgccggctgctgcccaatagctaagtaacaagcgcagatcaaaatgtgggagcgggcttgcccgcgatagcggtgtatcaggtacagatgtttaacctgttgcaccgctatcgcaggcaagccagcccccactttttttatgctgtgtcaggagtattgccgcgcgccaggcaacgccctcgacggttttgattgaattccccatttcgcagactagtatcggtttctggaattactccggaaaacaaaaacaatgtctgagtcctacgcccagcccagcggcgacgttaaacgccaacaactctcgcgctttgtcctcatcacctgcatttcactgatcagcttcttcccgatcaatattctgctgccctcgttcccggcgctcgccgcccggttcgacacgcccactgccgaaatcgcgctctccatcagcttattcaccttggtcttttcgatctcgcaactgatcgccggcccgctgtcggataaatgggggcgcaaagaggtgctgctcggctgcatcacgctgtcgatcattggcgcgattggctgcgcgctggcgccggactacctgaccttcctgctgtttcgcagcgtccaggccatgggttgcggtttctttgtgctgggccatgccttggtagaggacttgttcgaagaagaggaccgagcccgtgtgcgcctctattacatgaccttgagcggctcgtttgtcgcgctctcgccgctgataggctcctggctgcaaaccaccttcgactggcaaggcagcttctacggctttgcgttgatggcgctgggcatgttgattcatgcgtcctgcatcctggcgtccaaatccgccagcccgcaccgtgcgcaggtgtcggttatcggcacgctgaaagctgtcgccagtaaccgagattttctgcgctattggtggatcgccgcgctggtgttcgcctgctatttcgccttgatcagcgtgacgccgctgatcttcatggacaccttaaagctgtccgaataccaatacgccctggtgctgatggtgtacggcgtggcctatttgctcggtggcgtggcggcgtcgtatttgcaaaagcgcatctcactggcccggcagatcaatatcggccttggcttgctcagtgtttccggcgtgctgttggcgctgatcatccactacgaggccataaccaccattagcctgctgattcccatgctgatcagtgccctggccgtcacgctggtgcggccggccgcgatttccgccgcgatgttgctgttttcaagcagcgccggcacggccgcctcggccggcaacagcatcatgttcatcaccgccgccgtcagcagtgcggcactggcccagaccggcggtcacttgctgatgaccattgccctgagcttcatcgggctgagcctgtgggggttgctgaccaacagcaggatcgggcgccgctaaggctcccggatcacgggggtcagcagcatatcgcgggtctgcagctgccggtatcgcggcttgaccaacgctatgttgccctcgcggatgtcgtggatcagcatctcggtgtccacgtgaccgctgggcagttgtgtccatagcagcgggccgcgatcgtcccactggcctttttcatccagggcataaatgcgcggacccttgtactcgttgcgaaaactggtgaggggcaccaccagcacctcgctttggccgtccccgtcgaggtcgactgcccacagcacgcagccggactcgcaaggtgagtctgcaatctcactcatatccacaaactgctcgctgcctttgggtttggggccgatccattccagctcgggcttgggcgccagagcccgctccttggccagctgctcgtcaaaactcagcgacgtgtcgtccattctctcgcgcagggcgcggcgcgattccgggttcagaatgcgctcctgatccacgtccatctgcaactgggcataagcctgctcgccggccttccccaagccgaagcgcaggtaatgggcatcaaacgcttcagggttagtgcgcccatcgagcaaacgccgcacctgatcgtcggcgctgagccgtatcgggttgagtaccggcgtgttgaccaataccaacaacacgcaaaacagcaacgccagtaccgggttggtcacgcgcaggttgcttagccaggccggcgaacgcaaggccactgcccacaccgccgccaggccatacaaactgcacagcagagccagcgccagcgcgatgaagcgttgcggcgacaaggcatattgctcgacgcgcagccaactggagtagaacgccagcgccgcgagaatcggtaggcacaccacgctgaactcaacaaagcgcatcagccatttggggtatggccgaggttgcccgccctcttgaaagacgccattgagcaagaacagctgggcaccggccaacaccagcaatatcggcgtggagtagcccgtcgcccaaatccggtcgagcccggtgaagggcaatgtgagggtaaacagcacactgatcagggcgattaacggcaacaacagcccacaggcgccaaacagcatgccacgcatctgcccgataaccttttcactgcgccccgccatgtacatgcccagcgcgaacaccagcggcacgctgaaacacatgaacgtctggctccagaagtgcagctcaaagaattcgatgcccagcatcaggaacagacggctccacagcttgagcaacaacaggaaaagaccgacgagcatcagggcgtacagcacgatgaacacactgttccaggcttgctgaaacaggttctcataccgccagcgctgccccttcgcggcgggccaggcgcacagaaagctggcgccgatgtagctcagcagcaccaggctgaggcaccaggcgtccacctcacgtcggctaatcacgaggtgttcttctcggtaaaagacccacaccgtcatgccgctcatcagcaaagtgaacgccagcgtaggcagcaaagcgcgccattgccgggctttttcccccagcagctgcaacgtcgtcccgcccaccaaggccacgaccataacgccggtaaacagcgcctggttcgaattgaagaaccggtcggcgtaattaaacaccacgccctgaagcaggccgatcagcaggtaaaacccaagaaaacgattaaggccaggcattccaattcctttggagtggggtgaaggcaaagggccgcaagtctaaacaaagcccgtgcccttgggtaatacgccttcacatcccccgttccctcccgccgccagcggtgtagaatcgaccctattcatcgccagtcatcccccggcgggtttatgagctcgaggcccaagcaagcggcgatcccgcgacgcgagtggcaacttttggacacgcggccattttctgagtgttccagacgtcaatagaagctcactccccattagtacctgattagaagtacctgattagccgcccggagtgctccatgccagattaccgctcgaaaacatccacccacggccgcaacatggccggcgcgcgcgcactgtggcgtgccacggggatgaaagatgacgacttcaagaagccgatcatcgcgattgccaactcgttcacccaattcgtacccggccacgtccacctcaaggacctgggccagctggtcgcccgcgagatcgaacgtgccggtggcgtggccaaggaattcaacaccatcgccgtggatgacggcatcgccatgggccatgacggcatgctgtattccctgccgagccgcgagatcatcgccgactccgtggaatacatggtcaacgcccactgcgccgacgccatcgtgtgcatttccaactgcgacaagatcacccccggcatgctgatggccgccctgcgcctgaacatcccggtgatcttcgtctccggcggcccgatggaagccggcaagaccaagctcgcttcccacggcctcgacctggtagacgccatggtgatcgccgccgattccagcgcgtctgacgagaaggtcgcggaatacgagcgcagcgcctgcccgacctgcggttcgtgctccggcatgttcaccgccaactcgatgaactgcctggtggaagccctgggcctggccttgccgggcaacggttcgacgctggccacccacagcgaccgcgagcagctgttcctgcaggccggccgcaccatcgtcgagctgtgcaagcgttactacaccgagaacgatgagtcggtgttgccacgcaacatcgccaacttcaaggcgttcgaaaacgccatgaccctggacatcgccatgggcggttccaccaacaccatcctgcacttgctggccgccgcgcaggaagccgagatcgacttcgacctgcgcgacatcgaccgcctgtcccgtcacgtgccgcagctgtgcaaagtcgcgccgaacatccagaagtaccacatggaagacgtgcaccgcgccggcgggatcttctcgatcctcggttcgctggcccgtggcggcctgctgcacaccgacctgccgaccgtgcacagcaaatccatcgccgaaggcatcgccaagtgggacatcacccagaccgacgacgaagccgtgcacaccttcttcaaggcaggcccggccggcattccgacgcaaaccgcgttcagccagtcgacccgctgggacaccctggacgacgaccgtgaaaacggctgcatccgcagtgtcgagcacgcctactcgcaagaaggcggcctggctgtgctgtacggcaacatcgcgctggatggctgcgtggtgaaaaccgccggtgtggatgagtcgatccatgtgttcgaaggcaacgccaagatcttcgaaagccaggacagcgccgtgcgcggcatccttgctgacgaagtgaaagaaggcgacatcgtcatcatccgttacgaaggcccgaaaggcggcccgggcatgcaagagatgctctacccgacgtcgtacctgaaatccaaaggcctgggcaaagcctgcgccttgctgaccgacggccgtttctccggcggtacttcgggcctgtccatcggccacgcttcgccagaagctgctgccggtggcgcgattggcctggtgcaggatggcgataaagtgctgatcgacattccgaaccgctcgatcaacctgttgatcagcgatgaagaactggccgcgcgccgggtcgagcaggacaagaaaggctggaagccggtcgagaagcgcccgcgcaaagtcaccaccgcgttgaaggcttacgcgttgctggccaccagtgccgacaaaggcgcggtgcgtaacaaggcaatgctcgacggcctgtaaaccccgcccataaaaatgccccgccatgtgcggggcatttttttgcctggctaacgctccaaccgatcgttcccacgctccgcgtggaaatgcctccggtgacgctccgcgtcacgcagtcaagggcggacgcagagcgtccagggctgcattcccacgcagagcgtgggaatgatcagtacggtcttactgaatctcgtccggcttgacgatcacccagttcttatccgccgtcaccggcagcccttccttggcttgtgcggcagcgtgcttggccatcatgccgttgagttgggtcatgtacttgtccttgcggttgatccacaggtggatgccgcccttggccacgtccacatcgtggaacagcatgtagccgtcactggtcggtgtatcaccacccacgatcaccggttttttccactcgtcgatgtaggtcaggatggccgcgtgtttgccagccatccaggttgccggggtccacaggtacggggtcagctccaggccgaggttggccttctcgtcatatttaccggcggcgatctgtttgcgcgcagtggtcagctcgccggtcttgcggtccttgagcagcgtgctcacgccgatgacgttttcgggtttgacgttgtagccgtacttcggatcggcagcgaccatgcgtaccagctcctcggacgcggcggtcatcacatacacctcaatgccgttctccatcagcttgttgaacagctcagcctggccggtgaagactttcggcggctgcacctccatgtttttcaccacgtcaccgtcgtaataggtgaccggcaccggcttgcccgacgccatcatctcgtcgacgtagcccttgagttccttgagcgtgaaaccggagaaaatctgcgcgacccacgggtagcagaccatgtcgtcgacttcgcagaggcggtagtaatagctgaacaggctttccttgtggtcggcggtgtccttgaacgggatcagcttcagggacgggtccatcgtgtcgcgggtgatcaggcccttgttttccaggtacggcagcaaggactcttcgaggtcgtagcggtagctggtgttgtccatgtcgaacaccgcgaagttacctttgttggcattcgcggcgatcatcttgttcagttgctcggcggcaggcgccggccagtgtttcaactcggtggcggcgaatgcctggctggcgaggccgaagcagaaggcagcggcaagtagtgttggcgcgagcttcataagcgttttctccctgagtgaaagacatcgacgctaacaaatctgtgtgacagttatcgcccgagcgcgaccgcttgcgtcgtgattgcgccaaaggcatgtgcctgagcgtcaaacgcttattccaaaaacgacagtcaccattccatatcggtattaaatcaatatatttcaagctgttagcatttccggttcgcaatcgcaggctcacgcgattggctgccttctcaacggagcttcaatgaatctgcccctgattctcaacttactggtgttcgttgccctgcttttgggcctggcacaaacgcgccgcacaaactggagcctcgccaaaaaggtgctgttcgcgctggtgctcggcgtgctgttcggtgcggcgttgcacactatttatggcgacggcaacccggtgctcaaagcctcgatcagctggtttgatctggtcggcaacggttatgtgcaactgctgcaaatgatcgtgatcccgctggtgttcgcctcgatcctcagtgccgtggcgcgcctgcataacgcctcgtccctgggcaagatcagcttcctgaccatcggcacgctgctgttcaccaccgccattgcggcgctgatcggtatcggcctgaccaacctgttcggcctcaccgccgaaggcctggtggccggcacccaggaaatggcgcgcctgcaggtgatccagagtgattacgcaggcaaggtcgccgacctgaatatcccgcagttgctgctgtcgttcgtgccggccaaccccttcgccgacctggcccgcgccaagccgacgtcgatcatcagcgtggtgattttcgccgcattcctgggggttgccgcgctgcagctgctcaaggatgacgtggaaaaaggccagaaagtgctcaacgccatcgacaccctgcaagcctgggtgatgcgcctggtgcgcctggtgatgaagctgacgccctacggcgtgctggcgctgatgaccaaagtggtcgccggttccaacctgcaagacatcatcaagctcggcagttttgtggtggtgtcgtacctggcgctgggtttgatgtttgtggtgcacggcctgctgctgtcgctggccggggtcaacccgctgcgtttcttccgcaaggtctggccggtgctgacctttgccttcaccagccgctccagcgcagcggcgatcccgctgagcattgaagcgcagacccgccgcctgggcatcccgcaatccatcgccggtttcgccgcctcgtttggcgcgacgattggccagaacggttgcgccggtctctacccggccatgctggcggtgatggttgcaccgaccgtaggcatcaacccgctggacccgctgtggatcgcgaccctggtagcaattgtgaccttgagttcagccggtgtggccggtgtgggcggcggtgcgacctttgccgcgctgatcgtgctgccggcgatgggcttgccggtgtcactggtggcgctgctgatttccgttgagccgttgatcgacatgggccgtacggcactgaacgtgaacggttcgatgacggcgggcgcgattaccagccagatcatggggcagacggataaggcgttgttggatgccgatgagcatgctgagttagcgcaggtctgatagaccgctatcgcgggcaagcccgctcccacatttgaaggtattcgcgcattcaaaatgtgggagctggcttgcctgcgatgctcttaggctttttcccaaacttcaaagttgtacgcgggcttatcaccttcagccgcattctcgacattcgacaccagcgtccactggttcatatcaaactcgggaaaccacgcatccccttccgggctcaacgcaacccgcgtcaaatacaggcgatccgcctgctccagcccctgcgcatacaactgtgcaccgccgatcagcatcagctcatccacgccctgctcctgcgcccacgcctctgcgcgttcgactgctgcgtccagtgacggaaaaacttccgcaccttcaagcgccaaatcggtctgacggctgaccacaatgttcaagcgccccggcaacggtcggcccagggaatcccaggttttgcgccccatgatgatcggcttgccgagcgtggtggctttgaaatatttgaaatcccccggcaaatgccagggcatgctgttgtcgacgccgatcacacggttttcaccgagggctgcgatcaggcttaaagggagagtttttttcatggcgacgagaataccagagccgcgagtctgcggttatgctccaagctcactggctcaacaggacgacgcgtgactgcactgaccccgctgcacaaactctggctgacggaaaccgtgcgcctgcgtgaagaacacgccggtcccctggaagacctggaagccaaccgcctggcccgcaccgccggtggcgacttgccgacgcgcatccaacagcgcgccctgcagttggccgaacgcgatggcttgaccgccgccctcacccgctggctgcaaggcgcacgcctggcacttgtgttgttggccatcgtcgccgtgatcagcggcgccggcctggcctttgccgcactgggcaacggtttgaccccggttaatgtgttctgggccttgggcagcctgctcggtttgaacctgattctgctgttgagctgggccttgggcttgctgtttgccggcgagcacagcgccagcctcggccgcctgtggctgtggctcagcgaaaaactcgcgcgtgacgccaaggccgcacagctggcacctgctttactgctattgctgcaacgccagaaactcaatcgctgggccgtcggtgtgctggtcaacagcctgtggttgctggcgttgctcagcgccatggcgattttgctaacactgctggccacgcggcgctacggctttgtgtgggaaaccaccatccttggcgccgacacgtttgtcgccgtcacccaagccctcggcagcctgcccgcgctgctgggcttcaacgtgccgacggtcgaaatgatccgtgccagcggcgattcggcgctgaatatcgaaagcgcccgccaagcctgggccgcctggctggtaggcgtgctgctggtctatggcctgctgccgcggctgatcctcgcgctgctatgcctgtggcgctggaaacgtgggcgcgcggcgctgcgtctggacctgaacttgcccggctacagtcaactgcgcgagcggttgatgccgagcagcgaacgccttggcgtcaacgacgccgcccccgaacagttgcacgccgttaccggcggcgtcagcgaattggaaagcgacggcgccttgctggtggccatcgaactggatgaccaacacgcctggccgcccacactgccggccagcgttaaaaacgccggcgtcctcgacagccgtgaatcgcgcaacaagctgctggaacaactcacgcgttttccgcccgcgcgcctggccattgcctgcgacccccgccgctcgcccgaccgtggcagcctggcgttgatcgccgagctggcccgcagcgctaccgccacccgcgtgtggctgctgcaagccccgcccggccaggcgctggacgccgaacgcctgggcgattggcatgcggcgctgcaacagcttgaggtgcccttcgccgactgcgcaccgctgacgtggctggagactggtcatgactaagccgctgaaactcgccgtggtcggccacaccaatgtcggcaagacttcgctgctgcgcacgctgacccgtgacgtgggttttggcgaggtttcccatcgccccagcaccacgcggcatgtggaaggcgcgcgcttgtcagtcgacggcgaagccttgctggagctgtacgacacgcccggcctcgaagacgccatcgccctgctcgattacctggagcgcctggaccgccccggcgaacgcctcgacggcccggcacgtctggcgcgctttctggacggcagcgaagcgcgccagcgtttcgagcaggaagccaaagtgctgcgccagttgctggcctcggacgccggcctgtatgtgatcgacgcccgcgagccggttttggccaaataccgcgacgagctgcaagtgctggccagttgcggcaagccgttgctgccagtcctcaattttgtcagtagcagcgaccaccgcgagccggactggcgcgaagccctggcccgcctgggcctgcatgcgctggtgcgcttcgacagtgtggcgccaccggaagacggcgagcggcgcttatatgaaagcctggccctgctgctggaaaacgcgcggccgcaattggagcgcttgatactcgaccagcaagcccagcgcgtcgcacgccagcaaagcgcggcgcagctgatcgccgagctgctgatcgactgcgccgcgtgccggcgcagcgtggtcactgagcaggagcagcaagccatcagcgacttgcgcaaggccgtgcgccagcgcgagcaaaagtgtgtggaagccctgctcaaactgttcggcttccgcccacaagacgccgccgccagcgatttacccttgctggacgggcgctggggcgatgacctgttcaaccccgaaaccctcaagcaactcggcgtgcgcgtcggcggtgggattgccgcaggcgcggccgccggggccggtgtcgacctgctggtcggcggcctgaccctaggcgccgctgcaattgccggtgcgattgccggcggcgcgctgcaaaccgcacgcagctacggcagccgcctgctgggcaagatcaagggccaacgcgagctgaccgtcgacgacagcgtgctgcgcctgctcgccttgcgccaacgccagttgctcaaggccctgaacctgcgcggccatgcggcgatgcacagcatcaagctcgacacgccccaggacaagacctggcgcgaaggcaagttgccggaggccctgcacaaagcccgtgctcaccctcaatggtcgtcgctcaacccgcacgccaaattgagccaggctgagcgccaggaacaggtcgaggcactggcaacccgcctggacgacgcgtaacgccgttaaacctcataccacgccaaggccaggaatgcggtgcagagcgagcggatcaattccttatcggcttggtcagccaccccgttgcggtcgacatcactgctggtaaacgactccaacaccccatcgccatcgccgtcataggcggcggctttgtagatcagcgacgctctgcctcttggcgcaatgctttcataaaagtcgagctttaccgcgttcggcctttgggttttgctgaaatgatcgacatagagggtcagcgcgcgctgcgaatggccctttgagttaaaccagttgagcttgaagaagctgttggcgaaggcctcaagctgacgtttatccacgtccaacgcttcagggtgggcatcgggtttcggatctgccagccgcaaaaaatctacctcacccttacccgtcgtatccacaccgatgaactcgtggatcatttcatccgggcagtcagcatgatgctggtaaaactgcaaaataaccgtatcagcagggccgtggcagcccttgccgtgggcggtggctttcaagtaacgcatcagcgttgctccttagagttaagaagcaagcaccttagtgatctgccaaccctggctctaggcgctgcgtctgcgtgttgcgtaaggcttgtctacactgccagtagccgcgaagccttggccctgagcagttgcaagtccagcaccggcacgtgcatttccttggcttgctcatcccagtggcgcatgcgcaggctgacctggcagagcgggtcttgctcaaaagcctgggcctcttcagcgctcatcacaccgccctggtaacccagggtgcgacggctggcttcactcaaccgagcgtaatactccggctggctgaaggtcaggtaacgcttggcttgcacgtgatactccaccagcttggccatgcgctcgctgaagcctgcgcggcgcaagtaatccgcgcctaaccgttcgtggctgaccacgccataaccgcccatgttctccccgccctgaccgcagaggtggccgatgtcgtggaaaaacgccgccagcaccacttcatcatcaaagccttcagccatcgccagctgtgcggcctgggacatgtgttcgatctgcgacaccggctcgccgatgtaatccgccgtgccgtgctgctcatacaaaccgaagatttcggctatcgcctgttccggggtcatgtttgcgcgccccacaatgcgctgatatttcgctcggccagtgccggccccacactcatgcctacaccactgtgcatcaatgctgcgctcacgcccggcgccgcacgcaggaatgaaaacggcgccggcccgcgtgagccgtacacgccttgccagcgctctaccacctggatcttgcagcccagggtttgctcggccagttcgatcaaccagtcatcaatctgctcggcgttgaacggcgaggcatcgctgccgtagtcgtgggagtcgccgatgatcagttcgccatggggcgtcgggctgatcagcaggtgaatgccgtgttcatgcaagtgcggcgcttcacgcaggatctgcgcctgcaccggcgcagcttccggcatgtcggcaaaggcgccgtaatgcacgcaactcaagcccgtgagcaaagcgtgttgcaggttcagattgatcgcgggccgcgcgcgcagcatttgcaggcggcagatactcgggttgagtgcggcaatcgattcggccagcagggtttggtaatcatggccggagcacacaatgatctgctcgccacgaaagctgcctgccgtgctgtgcagttggcccggttcgacgtcgcgtaccaacgtggagaagtgaaactccaccttcaattcgcggcgaaggtagttgatcagcgccgggattgcttcgcgcgaatacagctgttgatcgtccttgccgtgcagcgccgcgcggtgatgacggaactggccgccatacaagtctcgcagcgcagcgccttgcagcagctcgacgttatagccgtgcgcctgggcgcgaccggcgcaaaaagcctccaacagatgttcttccgcctcagtacgcgcaaacaggtacgagccattgcgcttgagctgcaagccggctacttgcgcccagtcccgccagatatcacggctttcccgggccaggtcgagcatcggccctggcggttggccggtgaccagtgcctggccaaagttgcgcaccgaggcgccgagtggcgtggcgctgcgctcgaagactttgaccttgaggccgcgtttggcggcggcgtaggcgtgggacaggccgaggatgccggcgccgatgactaacagatcactactcatgcgttcctctcgttcccacgctccgcgtgggaatgcatccggtgacgctctgcgtcacgacgttcaagagcggacgcggagcgtccagggcggcattcccacgcggagcgcgggaacgatcaatcactgtttttccgacttaccgtcatagcgcttgcgccactcggtcaggatgctgtcgcggtttttcgaggcccaggcgaagtcgttcttgatcaggcgctgctcgtagtcggccggcaattcagtctgcggcttggcgatacccggctgcgcgagcacggcgaagttgtctttgtagaggtccatcgccgcagcgctggcggagaaatcagcgagctttttagccgcgtcggcgtgggcagtgcccttgatcactgctgtcgcttcgatgtcccagcccaggccttctttgggcaggatgatgtccagcggcgcgccctggcgtttcagctgaaccgccgggtactcgaaggaaataccaatcgggaattcacccgaagccgccagcttgcacggcttggagccggagtgaacgtactggccgatgttctggtgcaggtcgtccatgtactgccagccctgcttctcgccaaaggtttgcaaccaggcgctgacatccaggaaaccggtgccggacgacgccgggttgggcatcacgattttgcccttgtactcaggcttggtcaggtcctgccagctcaccggcttggtcaggccttgtttctcggcttcgacggtgttgaagcagatggtcgcggcccatacgtccatgccgacccacgccggagggttggcggcgtcgcggtagtttttgccgatcttgtccaggtccttcggcgcgtagttttccagcatgccttgctgatcgagaatcgccaggctcgaggcggccaggccccacacgacgtcagcttgcgggcgatctttctcggccagcagcttggccgtgatgatgccggtggagtcgcgaacccatttgatctccacatcggggttggctttctcgaaagcctgtttataagtcttcaactgctcggcttcgagggccgtgtacacggtcagctcggtcttggcgaaggcattcaggctgaatgcagtgagtaccgcagcgaccagcgccaggggcttgaacatgaaacacctcctacaaggatgattattggccgggcgcggtctggcgccaggcttgggagcggcgcaacgcgccacgtgaggcccacgccagcagcagcgagacgccggctgaggtgaacaggatcagggtcgacatggccgccgcaccgcccacattgccggcgtcgtccatgttcaacacggcgacggcggcgaggatggtgtcggggctgtagaggaagatcgcggcggacacggtggtcatcgccgacacaaacaggtagcgcacgatgtccagcagcgcgggcaggcaaatcggcactgtcacgcgcaagtaatggcgatacagcggcgccttgagggacagcgcggcggcttcgaattcactgtccagctggcgcagcgccgtggtcgcggtcatctgcgcagtggtcaaatagtgcgcaatggtgcacaccaccagcaacgtcatggttccgtagaacacgtgcagcgggttgccgttgaggttgaaaaagaacacgtagcccaggcccagcaccaagcccggcacggccatcggcacaaagctgagcatgcgcagcgccaggttcaggcccttctgggtcttggtcttttccatcagataggcgccggtgaagatcagcacgctgccgatcagtgccgtgcacagggccatggtcaagctgttgcgataggccagccaaccgccgcccgccgtgtcttcgaattgatagtggttgagcgacagcgacaggttgtacggccagaacttcaccagcgacgagtacaccgccatgccgaacaccagcagcaacactgcgcaaatcagcagcacgatggccaggtagcagccatcacgcagtcgcgacggtgccggttgaaatacctgggcgcggccgctcatcgaatcaccgtgacggcgacgcaaccacgcatcgacgccgaagctgaacagcgccggcagcagcaggaccatgccgatcaacgcgccgcgaccgaactgctgctggccgaccaccgccttgtaggcttccagcgccaacacttggtaatcgccaccgaccaccacgggcacgccgaagtcggtgatggtcaaggtgaacaccaggcaaaacgcggcgaacacggcttggcgcgttgcgggccaggtgatgctgcgaaacgctcgcgcagggctggcgcccatgctcgatgccgcatcgaacagtcgcgcatccgccagcgacagcgccgacagcagaatcatcaacgcgtgtgggaaggtgtagatcacctcgcccagaacaatgccccagaagccgtaaatattgtccgagagcaacccgcgcagcatgccttgattaccaaacaggtacaccagtgcaatgcctggcagcatcgacggggccatcaatggcaacagtgacaggccgcgccagatcgccttgccgggaatcagcgtgcgttgcagggcgtaggcaaacaggtaggccagcggtacgacaatggccgccacgctgagggaaactttcaggctattacccagcagccagtggaagttggcactggtcagcagttctcgcgccgcgaccagcccaccgccctgcccggcctcgctgctgaaaccacgccagaagatcgccagcaacggcagcaatacggcaatgcccaacagcaccagccacagcagtttgccgccgagcacaaaaaggcggtcgccgtgctcggcgcgggagacttggcgcggcaatgtcatcacagccgccatctcaggcaaacacctgcagactgcgcggcggcaaggccacccagatatcctgggctcccaggcgcggcatggcttccggggccaattcggccagcagcggatggccgggcagttgctccagttcaaagctcatgcggcagcggttgcccaggaacgtgatctcgcggactttggccgggaacaggttttcttcatgcaccggcgggttgacgctgatggcttccgggcggcagaacaggcgcccggatttggccacgccggcatcgtcggccaagcgcatgttcatgccgccgacctgggcatggctggcgctgttgcggctgaacggtagccaattgccctggccgacaaactccgccacaaagggcgtggccgggcggtcatagatttcctggggcgtagcgtattgctcgaccttgccgttgttcatcacggcaatacggtcggccatcaacatggcctcgtcctggttgtgggtgaccatcagcgtggtgatgcccaggcgccgctgcagctggcgcagctcggtacaaaggtgctcgcggacgcgggcgtcgagggccgacatgggttcgtcgaggagtaacagcgaaggcgccggggccagggcgcgagccagggcaacgcgctgttgttggccgccggagagctggccggggaatttcttttcgctgccaaccaggccgaccagttcgagcatctggccaacacgcttgcgcacctcatcgcggccactgccggtgaggccgtagccgatgttggcttcaacggtcaggttgggaaacagcgcgtaggactggaacagaatgccgtagtcccgcgcctggggcggcagtagggaaacgtcgcgattaccgaggcgcagctcaccgctgtcctggcgttccaggccggcgatacagcgcagcaaggtggttttgccgcaaccggacgggcccagcaggcacaccagctcgccggcggcgacgtccagggacacattgtccagcgcggtaaaggcgccgaagcgtttctggataccgcgcaccgtcatcggcgcgccggggttggtcagggctgtgttcatggaggcacctcatcaaactgatgaaggccatgctaggggggcaatgcttcccggatgtggcaggaaggcaaaaggcagtgatagtggtattggtggatttgtgtaggaacggctccccttgtggcgagggagcttgctcccgctggagtgcgcagcgctcccaagctttttggggccgctacgcagcccaacgggagcaagctccctcgccacaggtgccgcgacacactcagaggggcgacatttcctgcgccagcccgagaaaagcggccggcaggcgcgcgccttttctctccttgaggcagtacaagtactccgcaatctgcggcgcattctcgatggtcagcacccgcaactgcgggtcatggggcacttcctggcgggcaatgatgctgatgccgatgttgcgcagcaccgcttcgcgaatcgactcacggctgccgatctccagcagcggcccataactcacaccagcgccctgcagcatttcttcggtcagccgccgggtggtggaacccacttcacgcatcaacaacgtgtgcccggccaacgcattgagcggtacgtgatcgagcttggccaatgggtgattacggtgcaccgccagcaccagcggatcggtgccgagtacgcggcgaatcaagcgcgggtcttcgagcagttgcgaggacgcggcaacatcgacgcggtaatcgtccagcgcttcaagcacctgctgggagttgccgatttccaccgacacgtccacttgaggcagacgttcgcggaaggctttgaccaggtcgaggatgtaataaggcgccgttgcggcaatcctcaaagcaccttggacctggccgttgttgcgcaggaaaaactcgatatcggcttcctgctgcaacagcgccttgaccatcggcagcaggcgcgcgccgtcgtcgctgacggtgaggcggcgcccgccacggtagaacaactcaacgccgtactggctttccaggttgcgaatctgggtggtgaccgtgggctggctcaggccgagcttcttcgccgcctgggtaatgctgcccaggcgggcgaccataaaaaacgccttcagctcggcactcagcacaccaccctctcatcatctatttgcgcaacaggcgcaggccattgaacaccaccagcaggctcacgcccatgtcagcgaacaccgccatccacatggtcgccatacccaggaaagtgaccgcgaggaagatcgctttgatcaccagcgccaaggcgatgttctgcttgaggatactcgacgtttgccgcgacagacgaatgaatgccggaatcttgcgtaagtcatcgtccatcagcgccacgtcggcggtctcgatggcggtgtcggtgccggcggcagccatggcaaaaccaatctcggcgcgagccagggccggcgcgtcgttgatgccgtcgccgaccatgcccacgcggtggccttggccgtagagggtttcgatggcttgcagtttgtcggtgggcaacaagtcgccctgggcctggtcgatgccgacctgggccgcaatcgcctgggcggtgtgggtgttgtcgccggtgagcatcagggttttgatgcccagctcgtgcagctgctggatggcgtcgcggctgctgtctttgaccgtgtcggccacggcgaacagtgccagcgggccggatttatcgagcagcaacaccacggacttgccttgtttctccagggcgaagagtttttcttccagctcgggcgagcacaggccgaggtcttccaccaggcggtggttgcccaagtggtaggtttcgccgttgatatcgccgcgcacaccccgaccggccaatgcctcgaagttatccacaacgtggcttggcaggtttttatccacagctgcattggcaatggccagcgataccgggtggtcggaccgcccggccaggctggcggccagggccggcgcgctgtcttgaacggtcgggaacagcgccaggtaatcggtttgcaccggcttgccgtgggtgatggtgccggttttgtcgagggccaggtaatcgagtttatagccgccttcgaggtacacgccgcccttgatcaggatgcctttgcgcgccgctgcggccaggccgctgacgatggtcaccggagtggagatcaccaaggcacacgggcatgcgaccaccagcagcaccagcgcgcggtagatccagtcgaaccaggcgccggccatgaacagcggcggaatcaacgccacgccgagggcaaacaggaacacggccggggtgtagattttcgagaagctgtcgacaaagcgctgagtcggtgcgcgggcgccttgggcctgttcgacggcgtgaatgatgcgcgccagggtcgagttgttcgccgcggcggtgactttgtattccagggaaccggcctggttgatggtgccggcgaagactttatcgcccacacctttttcaatcggcaggctttcaccggtgatcggtgcctggtcgatggtggattggccagcggtcacttcaccgtccaggccaatgcgctcgccgggcttaactcgcacgatatcgcccagctcgatgcttttaacttctttttcgacccagctgccgtcggcttgctgcaccgtggcttgctccggggtcatctgcatcaaaccgctgatggcattacgtgcacggtccagggacttggcttcgatcaactcggccacggtgaacaggaacatcaccatcgccgcttccggccactggccaatcagcaccgcaccggtcaccgcgatgctcatcagcgcgttgatgttcaggttgaggtttttcagggcgatccagccctttttataggtggtgaggccaccgctgaggatcgacaccagcgctaccagcgcaatgacccaggtcggggctacgccggtgaaatgcaggacttcagcacctaaagcgccgacaccagacagcgccaacggccaccagtgtttcttggcaggcggcgcagcggctgggctgccttcttcgatggggtcggcctgcatgccgatggatttgatcgcctcgatgatcggcgcggtgctcggcaagtcatgggtgacgccgaggatgcggttgatcaggttgaattccagctgctgcacaccggcgagcttgcccagtttgttctggatcagcgtctgctcggtggggcagtccatggcttcgatgcggaaggtgctgagacgcgagccggcggtcggcgcttcgctcagcgtgaccacggcaggcgcaaccttgctggaacagcaggagtcgccatgactgccatggtcgtgctgcttgaccggcgtcagtttggcgccgtggtcgtggctatggtcgtggtcgtggtcgtggtcgtggtcgtggtcatgatcatgcttgtgatcatgcttttttggggtgtggatggaatcgctcattctgtcgcgtccgtaaaggtgcctgttgccaagtaaagaccctgtagccactatagggtcaagcacccatttggagattgctgcgatgaagatcggcgaattggccaaattgaccgactgtcaggtcgaaaccatccgttattacgagaaggaaggcttgctgccgcctccggcacgcaccgacgccaactaccgcgtgtacacccaggcgcacaccgagcggctgatctttatccgcaactgccgcagcctcgacatgacgctggaggaaatccgcagcctgctcgggctacgcgacagcccccaggaccagtgcgaaagtgtgaatgcgttgatcgacgagcatatccaccacgtaaaagcgcggatcgacgggttgttggcgttgcaggagcaactgctcgacctgcgccagcgctgcggcggtgcgccggggatggatcagtgcgggattttgcagcggctggagctcagcgggagtgtggcggccagtgaggcggagccttcgcatgtgggcagaagccacgggcattaatgtctacacacgacacatgtgggagcgggcttgctcgcgaaggcggtagatcagtcaacatttccggcgactgacacactgccttcgcgagcaagcccgctcccacattttgaccgagtccgacttttaaatggcgacgtcggctttaatacttggatcagcgtcatagccgacaatttcaaagtcttcgaacttgtagtcatagatcgacgcgggtttgcgcttgatcaccagttccggcagcttcttcggcgtacgcgccagttgggtgcggatctgttccatgtggttgctgtaggcgtgggtgtcgccggtggtgacgatgatctcgtgggggatcaggtcgcactgctgggccagcatgtgcgtcagcaacgccagcgcggcggtgttgtacggcaggccgaggaatacatcggagctgcggatgtacaactgcatcgacaggtgaccgtcatgcacaaacgcctggtacagcaggtggcacggcggcagggcttgcttgccgttgcgggcgttttcctgcgggctcttggtttcgtccggcaggtattcgacgttccagccgtggaacaggatgcgacggctgttggggttgttcttcaacgtgtcgaccatgtagtcgatctggttgatcttgccgccgtccttggtcggccaggcggtccactgctcgccgtacaccgggcccaggtcaccgtcttcggtggcccattcgtcccagatttttacgccgttttcgttcagccacttgatgttggtgttgccgctcaacatccagatcaattcgttggcgatgcttttgaaatgaagcttcttggtggtcagcagcggaaagccgtcggccaagttatgccgatactgacgggcaaacacggccttggtgccggtgccggtgcgatcgcccttggtcaatccattggtcacgacgtcgttcagcagttcgagatattgcttcattttagtacccgtatcgttgaagccggggctacgcaaaagccccggcattcgaatttaaagcgcggtgttcttgatgccttgcgggcgattgtacgcccaccacagcaggcccaggcccgccaggatcatcggcatgctgaggatctgacccatggtcaaccagccccacgccaggtagcccagctgtgcatccggcacgcgcacgaattcgacgataaagcggaagatcccgtagaacaacgcgaacatccccgacacggccatggttgggcgtggcttgcgcgagaagatgtacagaatcaggaacagcgccacaccttccagggcgaactggtagagctgcgacggatggcgcggcaattgcgccgggtcgctgaacggcgggaacaccatggcccacggcacgtcggttggcttgccccacaactcggcgttgatgaagttaccgatacgcccggcgcccaggccaatcggcacgaacggtgcgacaaagtccatcagttggaagaacgacttgccgttgcggcggccgaaccaccacgcggcgatcatcacgccgacaaagccgccgtgaaacgccatgccgcccttccacacttcaaagatcagcgtcgggttggcgatataggccggcaggtcgtagaacagcacataccccagacgtccgccgacaatgacgcccatcgacatccagaacaccatgtcggagagcttctccttggtccaggtcgggtcgaaacggttcaggcgccgggaagccagcagccaggcaccgccgatgccgatcaggtacatcaacccgtaccaatggatttgcagcggaccgatggccacggccaccgggttgatctgcgggtaaggcagcattgcgactcctcgttaaatcaatagtcatggcgcaccggaccatgccggtgtgggattaagcctgcgttacagccgcaatttcaaattaagaagttcagacgcgcccaatagcccggcatgttaacggatggaaggcgctcggcccaccttcgatagatggatagccatgcgttgtatgggtagagtgagggaaaacacaaaagggatcgcctgatgtgcctgattgttttcgcctggcggccgggccatgcccaaccgctgatcgtcgcggccaaccgtgatgaattctacgcccgccccagcctgccgctgggccaatggccggatgcgccgcacatctacgccggccgcgaccaggaagcaggcggcacctggcttggcgtaaacgccgatgggcggtttgcggccctgaccaacatccgcgatccacaccagccaccggcacgcaagtcgcgcggggagttggtggcgcgttttctcagcggctcactgccgattgacgactacttagccgacgttaatggccgttcgattgaatatgccggatttaacctgctagtgggcacgcgggatgagctgtggcattacaacgccaatcagactgagccgacgcggctggaggctggggtttatgggttatccaatgccgggctggatacgccgtggcccaaattgctcaaggccaaggcggcgttgagtgagttgctggagaacccacaaccacaggccttgctggatattttgagcgacccacagaccgcgccgtttgccgacttgccggacacaggcgtgggcttggcgaccgaaagtctgctgtcgagcgtgtttatcgccagccccagttatggaacgcgggcgagtacggcgttgattgtgaatgccgacgggacgcggcggatggtggagcgcagtttcgggccgctgggtgggcggttgggtgaggtagaactgagcatttagcggtgatgttgatcgttcccacgctctgcgtgggaatgcatccagtgacgctccgcgtcacgccttcaagagcggacgcagagcgtccaggcggcattcccacgcagagcgtgggaacgatcagttagagcgtcttcgccgaagccgggttgatcatccgcgtcagccccaggttcttcagcgccaactgcagcgagctgtggataacttgcgggttgtcgatggtcatcaactcggccagcaaatccttggccatgctcagctcaacctggcgcagcatccacttcaccttcggcaagttggtggcgttcatcgacaggctgtcaaagcccatcgccatcaacagcaccgccgccgccgggtcgccggccatttcaccgcagatgctcaccggcttgccttcggcatgggcgtcgcgcaccacgtgttgcagggcttgcaggacggccgggtgcaggtagtcgtaaaggtcggctacgcgtgggttgttgcggtccacggccaacaggtattgggtcaagtcgttggagccgaccgaaaggaagtccacctgccgcgccagctctttagcctggtacaccgccgccggaatttcgatcatcaccccaatcggcggcatcggcacatcggcgccttcgtcgcggacttcgccccaggcgcggtgaatcaaatgcagggcttcttccagctcatgggtgccggagatcatcggcagcaggatgcgcaggttgttcaggccttcgctggccttgagcatggcgcgagtctgcacgaggaagatttcagggtggtcaagggtcacgcgaatgccgcgccagccaaggaaggggttgtcttccttgatcgggaagtaggacagtgacttatcgccgccgatgtccaggctgcgcatcgtcaccggcaacgggtggaaggcggacagttgctcgcgataaatcgccagctgctccttctcactcggaaaccgttggttgatcataaatggcacttcggtgcggtacagccccacaccttccgcgccgcgctgttgcgcgcgggctacatcggcgagcaggccagtgttgaccagcagcggcacgcggtggccgtcgagggtcacgcacggcagctcgcgcagcgaatcgaggcccagcgccagctgtttctcttcttccaccacctcggcgtattgcttgcgcagtacttcgctggggttggtaaagacttcgccgcgatgcccatcgacgatcatgtcgatgccgtcgaccttggaatacggcaggtccaccagacccatcaccgtcggaatgcccatggcacgggccaggatcgcgacatgggagttgcccgaacccagtaccgagaccaaacccaccaatttgccttccggcacttcgccgagcatggtggcggtcagctcttcactgatcaggatggtgttgtcggggtagaccaggttggtggtgcggtcttcctgcaggtaggccagcagacggcgaccgaggtcacgcacatccgaagcccgctcgcgcaggtaggcgtcgtccatcaattcaaaacggttgacgtgatcggtgaccacctggcgcaacgcgccctgggcccactggccggtcttgatcacggttttgacttcgttacccagggacgcgtcgtcgagcatcatctggtacacgtcgaacagcgcgcgctcttcggggcgcagttgcgtggccagcttggtcgacaggttgcgcatgtcggcgcgtacgccttccagggcggtcttgaacagtttgatttcggcgtcgatgtcgttgacggtcttgtccggcaccacatcgaggtcggccggtggcagcatgaccacggccgtaccgacggcagcgcctggcgaacccggtacgccgacgaacttggcttcctgaatgcccttgccctgacggcccaggccgcgaatcgagcccgtggcttcggcgtgggcaataaccccggcaagctgcgcgctcatggtcacgaggaaggcttcttcaccttcgtcgaactggcggcgctctttttgctggatgaccaacacgccgacaacgcggcggtggtgaatgatcggtgcgccgaggaacgaggcgtagcgctcttcgccggtttcggcaaagtagcgataacgcgggtgatcggccgcgttttcgaggttcaggggttcttcacgcgtccccaccaggcccaccagaccttcattgggcgccatgctgaccttgccgatggagcgcttgttcaggccctcggtggccatcagcacaaaacggttggtctcggggtccagcaggtaaaccgagcagacctggctgcccatggcttccttgacgcgcaacacaataatccccaacgccgccttgagatccttggcggagttaacttcctggacgatcttgcgcagcgtattgagcatggctcggggtcgaactccgtcgtcagtcgcgcgctaaaaggcgcggggcaagctctttgagagcgcgacgataaacctcgcgcttgaatgtcaccacctggcccaacggataccaataactgacccagcgccagccatcgaactccggtttaccggtcaaatccatccgcacccgctgctcgttggagatcaggcgcaggagaaaccatttctgcttctggccgatgcacagcggttggctgtgggtacgcaccaggcgttgcggcaaacgatagcgcaaccagccgcgggtacaggccagaatttgcacatcttcacgctcaaggccgacttcttcgttcaactcacggtacaaggcgtcttcaggggtttcgtcggggttgattccaccttgaggaaactgccaggcatcttggttgattcggcgagcccatagcacctgtccggcatcattcgtaagaataatcccgacattaggacggaaaccatcggggtcgatcacggcaacaacctcgcaaacgcatgtcgccgcattgttccacaaaggttgttccagcggcaacgaggcttcttaccttatgtgcactcttgtgaaaagaccgtattctggacgcctttttacagacttttcagcgagtaactgcaatgcgcctggctttattcgacttggacaacacgcttctgggcggtgacagcgatcacgcctggggcgattacctctgcgaacgcgggattctcgacgcggtggcctacaaagcccgcaacgatgagttttaccaggactacctggccggcaagctggataacgccgagtacctgaacttttgcctggaaatccttggccgcaccgagatggcccagctggatgaatggcaccgcgactatatgcgcgactgcatcgagccaatcgtgctgccccaggcgctggagttgctggccaagcaccgcgccgccggcgacaagctggtgatcatcaccgccaccaaccgcttcgtcaccgcgccgattgccgcgcgcctgggcgttgaaaccctgatcgccaccgagtgcgaaatgaaaaatggccgctacaccgggcgcagcaccgatgtgccgtgcttccgtgaaggcaaggtgacgcgcttgaatcgctggctggaagagaccgggtacagcctggaggacagctacttttacagtgattcgatgaatgatttgccgttgctggagcaggtgacgcacgcggtggcggtggatccggatccgaatttgcgggctgaggctgaaaagcgtggctggccggtgattacactgcgaagctgatggccccatcgcaggcaagccagctcccacatttgaatgctttcacccatctaaatgtgggagctggcttgcctgcgatgaagtcaccccggtcccaagccctacatcggcttagccaccatcaaatagaaaatcaccataaacgccagaaacgctggccagcccaggccaaaccaccagcgcatataggtcgccgccttgatcggcatcgccgtgccatcgcgtaacgcctgctccgccatcttgtgcacacgaatctgcagccacaccaccggcagccagcaaatccccgccaggcaatacaggccgacggtccattgcagccagctttgctgcatcgaccaacccgccaagtgcatcaagccaatgccactcaagggctggaacactgcggtggtcgcggtaaaggcccagtcggcgaacaccagatgcttgaacgtcaccgcgatgacttcaaccttgccgctgcgccaggcgcgcaaggcgtagtaggccgagcccgcgcccagcccgaacaggatggtcgacgacagaatatgcagggttttcagcagcaggtaagcgctcatcgccggggctcagtcaaaaaaggttcagtccagaacagccaaagggtcgcgaccatcagcaccaggttcttggcgacggcggcgtagggatcaaaccagtaatggggcaggactatgctgataaccaccgtatacccgcccatcagcagcagttgcaggatcaacgcccgcctgcgccagcgcctgactaacagccccaggcccagcagaccatcgcacacggcaccggcgatcacggccagcgtcgcccacgcaccttgcacgccagcctcggcgaggatgcgcaggccccagtcgtagcccgggccgaggcacaccgccgccgtgcccagccaaatcagcaccaacaccgccaacatcagcgggcggatcatggcctggatgctctgggcaggcgtcggccagtcttgtagtcgcgcggccaacggcgcggcggtgtatccacagaccgaggccaacacgtcggggtcggccacattgtcctgttgcgccagggcgatgctttgtcgattcaacgcccgccagcccagaagatcgcccaaccctccgcccaagcccagcagcggcgcttgcaggtagcgtccagggccccagccctgagcggcgcgcaggtgatcgatcagctgcgagagcctcatcggctcaggccccaccagcggcaagaccatcgattcggccggccactggcgcatcaaggcgagtaccgcgccgaccacatcgtcgatatgcaccggctgcgcctgcgcagtgaggttcagtaatggaatgagcggcagaggcgaaagcccgaccaaccagccactgctggcaccgcccgcgcccaccaccaatgaaggccgcagcaccactgcgcttatgccaaggccgagcaggtagtcatccgccaagcctttgctggccagaaacggcaggtcggagtgcgccgaagcgcccagggcggaaatctgcaacacccgcacaccacgctgggcggccagatcaaacagcacgcgcgcgccttgatcctgcacccggctcaactcagccgcatccacactcagcaggccggccgcattgatcaataaatcaacagtcgcgggaaacacgaaatgttcgggatcggcagccagctggcctaaatccagcgcacgccactccacgcctggaaaatccagatgttgaggttttcgagaggtggcaatcacgcgatgccctgcttgctgcaaggcgcgcaacagatggcggcccacaaaccctgtggcgccgaccagaagtacgttcatgaagctcctttagaccggcttggcgcccatcagcccggcaatcgccacaaaccccaccaggctgacgactgccagcaccaaggtgaaattcaggctgccgccaccgcccagtcgcaggcgattaagccgcgccaccagccagaaccaggccagcgccgccacggtatagaggatgctggaacccagaatccaggtttgccccagcggccagccggtcagatgcaccagccaccagccggtaaacggcatgctgaccacgcaaattcccatcagcaaccacacaaacgcccacgggcgttgcacggtaaccgttggccctgcgctgcgtttgcgccaggccagcaccgccaggccgaggccgctgagcaacagcaacacggtggcggtgatgtggataaccttgagggtggtcagcgtttccatggtctcgattccttgataggccgctcagtcagcgtagtcgctcaaccgaggaacagctggtaggccgggttttcgctctcatcccaatacgggtagccgatttctgccaacgcggccggcaccaggtggcgctcgtccgccggcacttgcaggccggcgaccacacggccgtcggccgcaccgtggttgcgatagtggaacatcgagatgttccagcgcccgcccaacttgttaagaaagttgaacagcgcgcccggacgctccggaaactcgaagcggaacaccagctcgtcgctgactttcgccgcatgcccgccaaccatatggcgaatgtgcaacttggccagttcgttctcggtcaggtccagcaccgggaagccctggcgggtgaggctggcgatcagcgcgctgcgcgggtcgttttccgggtgggtctgcacgccgacgaagatgtgcgcctcgcggccggagtggtagcggtagttgaattcggtgatctggcgcttgcccacggcctcgcagaacgccttgaagctgcccggcttttcgggaatggtcacggcgataatggcttcgcggccttcacccagctcggcgcgctcggccacatggcgcaggcggtcgaagttgacgttggcgccggaatcgatggccaccagggtttgcccggtgatgccacgggtttccacgtatttcttgatgccagccacgcccagcgcaccggccggctcggtgatcgagcgggtgtcgtcgtagatgtccttgatcgccgcgcagatctcatcggtactgacggtgatcacttcgtccacatagtctttgcagatatcgaaggtgtgctggccgatctgcgccaccgccacgccatcggcaaagataccgacagtcggcaacaccacacgctcgccggcagccatggcggcttgcaggcagttggagtcgtccggctcgacgccgatgatcttgatttccgggcgcaggtatttcacgtacgccgcgataccggcaatcagcccgccgccgcccaccggtacgaaaatcgcgtccagcggcccagggtgctggcgcagaatctccattgccacggtgccctgcccggcaatggtgtgcggatcatcgtaggggtgaatgtagacgtagcctttttcgtcgaccagcttcagcgagtaggccagggcttccgggaaggaatcaccgtgcaacaccactttgccgccacgtgagcgcacgccttcgaccttgatttccggggtggtcttgggcatcacaatcgtcgccttgacccccagcaccttggccgccagggccaggccctgggcgtggttgccggcagacgcggtgaccacgccgcgcgcacgttcctcgctgctcagttgggtcagcttgttgtaggcgccgcgaatcttgaacgagaacaccggttgcaagtcttcacgcttgagccagaccttgttgcccagccgctcggagagctggcgagcggtctgcaagggagtttcgacggcaacgtcgtaaacgcgcgaggtgaggatctttttgacgtactgttcaagcatcggcgggcatcactgagcaggttgggcagggccaaggagtctaacccagcgtttggccgggcgaccacacgaatcccgaggttttgttgggttatactcgccgccctcgataactccccgcccgttccggagcccgcatgacccaggatcaactcaaacaggcagtggcccaagccgccgtcgatttaatccttcctaaactcgacgacaagagcatcgtcggtgtcggcaccggctccaccgccaactgctttatcgacgcgctggccctgcacaagggcgcgttcgacggcgccgtggccagctccgaagccaccgccgcacgcctcaagggccatggcattccggtgtatgagctcaacaccgtgagcgacctggagttttacgtcgacggcgccgatgaaagcgacgcgcacctgaacctgatcaaaggcggcggcgccgccctgacccgcgagaagatcgtcgcggccgtggccaagacctttatctgcatcgccgacgccagcaaattggtgcccgtactcggcgcgttcccgctgccggtggaagtgatcccgatggcccgcagccacgtggcccgcgagctggtgaaactgggcggcgacccggtgtaccgcgaaggtgtgctgaccgacaacggcaatatcatcattgatgtgttcaacatgcagatcaccaacccggtggaactggagacgcagatcaatgcgatcgtgggtgtggtgaccaatggcttgttcgccgcgcgcccggcggatgtgttgttgctgggcacttctgaaggcgtgaaaaccctcaaggcctaaagctcacggctttgctttctgtgggagctggcttgcctgcgatgcgaacaactcggtctttgagcaagattgagctgctgccatcgcaggcaagccagctcccacaggtgatctcaccgttcagaaggtccatgtaacaaaaacgctacctttcgctgcacccctcgccaaaatcgtgcgctacctcacggcatgtcacgcctgcattagtatcaaacctgttacaaattacagccaagcgacccacgcgtttaacaatgcgccacttcgcaatcgcccagggaataaggcgcgcattgtgcaatgggtctggactcgaacctccctatcacctcaaggacgaccttgtgataaagcccctagccctcgccatcagcgttgtcggcagcctgctgtcgacgcaaacccaggcctacgattacggccagcacgccaacaccaccctggaaaagctgatcaacgactaccccggccggtatcgcggcaccgccaactttgccggggctgccgactggatgcagagccagatgggttcggcctacagcctcagtcgccagaacttcacctggaacaacggcagtcgcgcctcgcaaaacgtggtggcctacgccgccggcaccaaaccgcagtacgtggtgattggcgcgcatttcgacacctacttcggccgcccgaccctgcaaggcctggacgacaacggctccggcgccagcgtgctgaccgaagtggcgaagaacctcggcggcctgccattggagaacggcctgcagatcgtcggctttggcgcggaagaagaaggcctgcgcggctccaaggcatttgtcgactcactgagcgccagccaacgcgcaaacatgctggcgatgatcaacctcgacagcctgatcaccggcgacatgatgtacgcccacgccggccagaacagcaccgccaacccggccttggcgtcattgcgcgagcacgctttccagattgccaaggagttgaatatcccactgttcaccaacccgggcctggacccgcaataccccaagggcaccggctgctgcagcgatggcgagccttttgagccgctgaagatcccgattctgtacatagaagccaccaactgggagctgggcgacctcgacggttacacccagaccaacaacccgaaaatccccggcggttccacctggcacgacccggccgaggacaacaaagccgtactcaccgacgccttcggccaggcgcgcatcgaccagcgcctgcgcgattattcgcgcctgctcagccgcctggtgctggagctgaccaacgccgacctgatggcctccactgcttcgggcggcgcggttgcgcgcaatatgcaggacaacttgcagcgccagcaccaggccatggtgcgcctgcatgatcgccgctggctgacgttgcaggcggccagccgcgaggtgggcagcttcgatggagaagtcggcgtggacggtgaattcaccccggaaagcggcttcgacagcccgctgaaccgcgacgcccgccgcctgggcgtgcatgccctcggcgactatcaactcacttccagcctgaacatcggcgcgagcctgagctacctcaacggccgcgacaaactcgaacaccgcggcaaactcgacagcgacacttggcaggccgcggcctacgccttgctcaacgacggcgggccgagctggctggccggtgacctgagcgtcggccatacgcggttcgacgccaagcgcaacctgctgatccaggccaacggcggcccggtgctgctcaaccagcaactgagcggcaacaccgatgccctgacgttaggcgcgcgggtattgggtggttatgacttcgacttcggcgcgatcaagagcgggccgtttgccgggctggattacagccactcgcgcatcgataaattccacgaaaaacaaaacctgcgcacagcgctggagtacgaagagcagtctttcgactccgtggaagccagcctcggttggcgtgtgcgcggcgcggtcgcactgccctatggcttgagcctgatgccttacggcgatatcgcctgggtcagggagctggccgacgggcgcctcgacgacctgcaattgaccgcccacgccgatggccaggcacgcaccgccaaattgggctctgtggacaagaactttggccgcgcacaagtcggcagccagctggcgatcaccccgcagttgggcgtttacgccgaggtgaacagccgccttgggcacaccgaaggcagccagaccggctattcactgggcgtgcaatggatgttctgatcagggcttcttgaacacgtaaaacaggttcggctcgctgaccacgtacagcgaaccttcgtcatccatggcgatgccttcggcctggggcacgcgtttttgcagaccatggcgcccgttgagcagagaaagactgctcaatgggcgaccgtcgatgtccagttccagcaccagaaacgactcatccgacagcgccagcaaatgcccgctgcgctcgtcgtattgcaggctcgacaggtcgcgcacaaacagcccggcatcgcgcttggggttgttgattacgtgcaccgagtaggttttttccggcttgaagtgggggaaaccgtggacctcgtagatcagcatcgggtcgcgctccttggccacgaacaggcgcttgcccaccgagtcgtaggccaggccctcaaagcccttgttgccaccgatgtgcacgcccagcgtcatctgctccgcgtcggcggcgtcgaggaactgggtgtcgtcattcacatgcactttgatcagccgctgctgggcttcatcgctgatcacgtagatgttgtcgctgatgaactccaccgcttccgcatcaccaaaacccaccaggggaatgcgccgcagaatcctgccgtccagggacagttcgatcagctcggcgtttttgttggtgacggtaaacaggcttttgcgaatcgggtcgtaggtgagggccgagacatcatcgtcgaggccgtcgatcaccttggcctccaggctgacgcggtaatcggccaagccaatcgagcgctcgtcggcgggctggcgccaggcctgccagttaaaccacgcgcgctcgaacaggcgaaattgctgtgcgaccaccccggcagccaccagggcgatcagcaacacaatgaaaaacgcgggtttggggcgggcaaatcgacgcatcagggcagctcgaagtcaaaaagtggcgaatgaatatcacgcctgtctgaatttaaacttaaacgctgccggatgtgtggcgaatgccgctattggagaaatactcgacgtaaacctgggttatttctgtttttcgaaacggtaaaacaggttcggctcactgaccatgtacaacgtgccgtcctcatccatggtcacgccttcagcgcgcggaatggtgtgcttgaggccgttgaagccgccgagcagggtcatgaagctgacttgctcgcccttttcatccagctccagcaacaggtgggagtcggctgacaacaccagcaagtgcccggtgcgcgggtcgacggccagggccgagaggttgcgcatgtccagctcggtgctggcgactttttgcttgtcgcccgtcagcgtggcgccatcgcttttccaggtgaacagcgccggtgggcgctcttcgccgagcacgatctgttggttgcgcttgtcccaggtcacgccttcgaaggctttgttctggtccttggaggggcccaggtcatagcttttgaagtcggcgatattcagttgttgggtgtttgcgtcgactttcaccacggtcagggtgtgcatgcgctcatcgacgatggccatcaggccgttctccatcaccgtcacgccttccgcgttgttccagccgttgaggggcattttgcgcagcacgtcaccttgcaggttcagctcaaccaggaaagggtttttgcccatgacggaaaacagggttttggtctgcgggttgtaggacaggtcggaagcctcgtccttctccatgcccggcagcaacttggcgtcgatgacgacgtggtagttcggcagccacacgctggcttgtcgctcggccggcgattcaaagcgctccgccacccacagcgcgccacggtcgtcccaatgcatcagccaggcaacgccatacacaatcgcaccggccaggaacagccaggaataccagcgcaaggcaaagcgtgaacggggcttgggagtaacggagggcaaagtcacggccattgagcgcttttccgggaagtcagcgttaggtgatagcacaggatcaacgggcccgcgcgcaggaggctgaggattatccggatggcgtgtgaaaaaaatgcaaaagcagggattagctgatgtacacactcacatgtgggagctggcttgcctgcgatgcagacacctcggtgatcagtaacactgaggtgatgcgatcgcaggcaagccagctcccacacttgaactgtatacagcctttagcgaacgctgctttcgaagcggctcacgcccgccaattccagcaccagctcatcacccacattcaacggcccaacaccggccggtgtgccggtgaggatcacgtcgccagcctgcagcgagaagcagccggccatgtgctggatcatcgggatgatcgggttgagcatctgtgagctgttgccgtcctggcgcacttcgccgttgatggtcaggcgaatgccgatgtcggtcacgtcggcaaacgtgctgctgaccacaaacggtgcaatcaccgccgcgccgtcgaaggacttggcgatttcccacggcaggcctttggctttcagctcggcctgcttgtcgcgcagggtcaggtccagggccggggcgaagccggagatggcgtccagcacttcttcacggctgggcttggtcgacaacggcttgccgatcaacaccgcgatttccgcctcgtagtgcaccgaaccgcgctcggttgggatggcaaaaccgccttccagcgcgaccacgcaactgcccggcttgatgaacagcaacggttcggtcggcaccgggttgtccagttccttggcatgttcggcgtagttacgcccgatgcacaccactttgcccaagggaaagtggatgttggtgccgtcgacgtacttgtgctggtagctcatgaaacgactccttcagggcggttaaacagcgaagatcttgccagggttcatgatcccgttcgggtcgaacaccgccttcactgccttcatgtattcgatttcaaccggcgagcggctgtaggtcaggtaatcgcgcttggtcatgcccacgccgtgttcggcggagatcgagccgttgtacttctcgacggtttcaaacacccacttgttcacagtggcgcacttggcgaagaactcgtccttgctcaggttttccggcttgaggatgttcaagtgcaggttgccgtcgccgatgtggccgaaccagacaatttcgaaatccgggtagtgttcgccgacgatcgcgtcaatttccttcaagaacgctggcactttggagacagtcaccgagatgtcgttcttgtagggcgtccagtgggaaatggtctcggagatgtactcgcgcagtttccacaggttgtgcagttgggtttcgctctggctcatcacgccgtccagcacccagccctgctccacgcagtgctcgaaggtttccagggcgtggttggcgacttcttcggtggtggcttcgaattccagcagtgcgtagaacgggcactcggtttcgaacggcgccggtacgtcgccacggcccatcactttggccagggctttatcggagaagaattcgaaggcggtcaggtcgagcttgctctggaacgcgtgcagcaccggcatgatcgagtcgaagtcggtagtaccgagcaccatcgcggtgaggtttttcggcgcccggtccaggcgcatggtggcttcgaccacaaagcccagcgtgccttcggcgccgataaacagctggcgcatgtcgtagccggtggcgttcttgatcaggtcgcggttcagttccagcacgtcacctttgccggtgaccaccttcataccggctacccaattgcgggtcatgccgtagcgaatcaccttgatcccgccggcattggtgccgatattgccgccaatctggctcgaacccgacgacgcgaagtccaccgggtagtacaggcctttttcttcggcgacgttctgcaattgcttggtaaccacacccggctggcacacggcggtgcggtcggtgaggttcacgtcgagaatctggttcatgtagtcgaacgacaccaccacttcgccatttgccgccacagcagcggccgacaggccagtacggccaccggatggcaccagcgcgaccttgtgttcattggcccaacgcacgatggcttgcacctgctcggtggtcttggggaacacgatggcactcggcgcgggtgcgaagtgcttggtccaatccttgccgtaagcctccagggagtctgcatcggtcagcactttaccgggctcaaccagggtctttagctcatcaatcagggcaggatgggtcatcgacagaactctcgaacaattcatggtcatcctgagaacgcttcacgtcgcaggaataggtgtttagcggggcgcgtatgctagcataccgcccccgcaggacagagcccaagggcgttctgcggtgacggctttcctgccgtccgggtcagcttaagcgatccgattccctgccatttttctccgggatacaggtttacgcagatgagcaagacttctctcgataagagcaagatcaagttccttcttctggaaggcgtccacccatcggctgtcgacgtactgaaagccgctgggtactccagcattgagtacatcaccagttctctgccggaagcccagttaaaggaaaagatcgccgacgcgcactttatcggcattcgctcccgcactcagctgaccgaagagatcttcgaccacgccaagaaactcgtggctgtcggctgtttctgcatcggcaccaaccaggtcgacctcaacgcagcgcgcgagcgcggcatcgcggtgttcaacgcaccgtactccaacacccgttccgttgcggagctggtattggccgaggccatcctgttgctgcgcggcatccctgagaagaacgcttcctgccaccgtggcggctggatcaaaagcgcggccaactccttcgaaatccgcggcaagaagctgggtatcgtcggttacggctcgatcggcacgcagttgtccgtcctggccgaaggcctgggcatgcaggtgtttttctacgacaccctgaccaagctgccattgggcaacgccactcaagtgtcgagcctgaccgagctgctgggcatgtccgacatcgtcaccctgcacgtgccggaaaccgctgagacccagtggatgatcggcgagaaggaaatccgcgccatcaagaaaggcggcatcctgatcaacgcggcacgcggcactgtggttgagctggacgccctggccgacgcgatcaaggacaagcacctgatcggcgccgccatcgacgtgttcccggttgagccacgctccaacgacgacatcttcgaaagcccgctgcgtggcctggacaacgtgatcctgaccccgcacatcggcggttccaccgctgaagcccaagccaacattggcctggaagtgtcggagaagctggtcaagtacagcgacaacggtacgtcggtgtcctcggtcaacttcccggaagtggcgctgccggctcaccctggcaagcaccgtttgctgcatatccaccagaacattcctggcgtgatgatggagatcaacaaggtcttcgcggaaaacggcatcaacatctccggtcagttcctgcagaccaacgagaaggttggctacgtggtaatcgacgtcgacgccgagtactcggacctggcgcaagagaagctgcagcacatcaacggcacgattcgtagccgcgtgttgttctaaggctttaacgctgcacaaaaaagggagcccttagggctccctttttttcgtctcgacaacgcttacttgacggtaaccgtgatgactttcgaggctacggtcgggttgaactgcatgtgcagcttgtcgcccgcgaccagttgcagcgtgtgcttgcctggggtgagggtcagctcggtttcggtctgggccttgccgtagtggatcacggtgtcggtggccgggatcggtacgctggcgtcaggcagctctttctggtcgatcagcaggtgatggtggccggtgcctgggtcctggctggtagccggggccagtttgaggccttccatgccgaatttgacggtgaaggttttatccacggtggcgccatcttttggcgacacgataaagactttggcaccttcaggtggcgcgctgcgcggaataccgtcagcagcagtggccaacatcgaggcacccagcagcaggctggcaatcgttgcacgggacaatagagctttcattcacttctccagtttctgcaggaaatctgttgggttatgacaacttcgcgacaaattgctgtccaaggcactcaacaccatagcaaagcgatgctgaatggcgcctcgcattacgaattctttaggagtgaccatgcgcttttcgcctggccttgtactgttgctaccccttctgagtcctttggctcacgccgaattgatcgatgatgtgtttgatcgcggcgagctgcgcattgccctggaagccaacacgccgccgttcaacttcaaggacggcgacaagctcaccgggtttgaagtggaactgggcgagcaactggcgaaggaaatggatgtgcgcccctcgttcatcaccaccgatgacaccgatttgctgccaggcgttgaaaccggcaaatacgacgtagccatcaaccatatcgctatgactgccgagctacgggatcgtttcgatttcagtgcgccctataaggaaacacctgaggtggcgattccattccaaaagggtaacccggcgttcaaaagtagcctggacaaggcgttgcagcacatcaaggccgatggccgactgaaggcgttgacgcagaagtggttcgagtctgagtaaatgcggtcaatgtgggagctggcttgcctgcgataaccgtgtgtcagccacccatcaggatgctgacccaccgcaatcgcaggcaagccagctcccacactcgattcaggttcggccagagagttgcgccagcgcctgcaccgcctcgggcagctccagctcactgaacaccaacaccccatgacgcttgagcaacgccgccgtcaccccttcgccgctgaccttcaccccgctgaaggtgccgtcataggtcagcacgttgccgcaggacgggctattggccttgagaatggcaatgcggatgccgtggcgctgcaccaacgccaatgcctggcgcgcgccgtcgagaaagacagcactgaagtcttcgccctcggccgtcagcacctgggcacggccttcccacacatcaataccctgcccgccgggaatctcggcggagggccgcggcgttggtaaaccgcccgacacttccgggcagatcgcaaccacacggccttcagcctgccacgccgccagttggtcgaacgggccgctggccccgccgtcgtagcgcactttgtgcccgagcagacagcggctgatcaaaatcttttccatgtttaaaacggctcgttaccccgccggcgaaaccagccggtcaaggacaggcgttcgcgcgtggcgggcaggacttcgtggggcacttcacccgacaggaacaccaccaggcaaccgcccgtgggcaccacatcgtattcgacgccgcctttgaggtacatgcgcagttggccgccgtgttcgggcagccacgcgtcattcaggtacaccaccgccgagaccatgcggcggtcatcgtcgcgaaaacggtccacgtgcttgaggtaaaacgcacccggcgggtacatcgcaaagtggctttcaaagtcttccaggccgaggaacaagccacgattcatcgcctggcgcaggctgtccatcacgcccatgtaggtctcgcagacggccgcatcgccttcttccagccactggatatggtcaccgcgaatgccctcgcggatctcctgggccgggccgcgtcctacagcagcaggtgccaattccccctgcgccgcacgtttacggcactcagccgccagttccagggtcagagcctggggcaggaagccgttctgctgcgaccaacctttttcggccaggtcgtcgacaatgcgttgcagcagaggatgatcgaggggtatttgcatggcgcgcatagtatccatacgcctgtaaatccgacagagccgccgagcgtctgaatacactttagtcaggtgaccgataggatttctcgacaaatcctacgcccgacacggacaatagtggccgactgacaggagtccatatgcgtcgtttgtttttttccatgctgatgttctgcgttttgcccgcttgggcagacggccatgaccagttgtacaaggtcgccggctgggccgaacaacgtgcgcatttcaatgacgccctcactgccgcccagcaacgctaccgcaatagcctgccgccggcggtgtatcaggcgctggtcgacaacagcaataaacgcttcgccgcccaagccgtggaccagcgcgccgaggcgcaattgcgcaagaacctcgcagacccgaaacccgccctggcgtttttccagtcgccgctgggccgcaagattgtcgccgccgagttgctggccacacgccgcgaccagttggcgaaaaacgcccaaggcctgcctcacatcgaggccgacgccacccgcagcctgatcatcggccacctggcacaggcgctgcctgcgcgtgaagccggtgcggaagtcagcctggcgattgccggcgtggccgccgacagcttgagccagatgattcccggcctgttgggcggcggtcaggcgcaaggtatgttgaatggtcagcgtgagcggctgatgcagcagattggcaatgacctgaataacacgctgctgtacgtctatcgggatttgtctgacccggaactggaggaattcgccacgtttgcggagtcgccggacggtcgggcgtattacaaggcggcgctggcagcgattcgcgcaggccttgccgtcggccaaagcacctcaagcctgtcgcagtaaccaatgtgggagctggcttgcctgcgatagcggtgggacagcacctcaaaggctaactggcataccgttatcgcaggcaagccagctcccacagttgaagcgtgcttacttcagatggtcggtgaggtacttgaaatactcctggcgaatatccgcaatctcattcgccaaatgatgcctgccacgcgggatcatcaacacctcgggctgatcaaacttgccccgcagcacctgcaagttgtgctgccagtccaccgtcatgtcttcctcaccctgcacaatcagcggccgccgcgggctgcgcggtgcggcttcgatgcgcttgatccagcgcgccagcgcacccacccaggccgtgggcagttggcgcggctgcaacgggtcggcttccaggaacggcttgaacgtggggtcgtgggtgttctcgctgaaacgtcgcgcgatgcctttgacgaacggccgcagcaagtaatagctgacctgcgaccaaccccacgcacgcgggcgcaccaacggtgacaacaggaaggtctggccctgtgccgggctgtcggcgccgtgatggagcaaatggtccaccaccactgcgccgccggtgctttgcccgaacaggtgccagggttgcggcagttgcagcgccttggcttgcgcaaacagcgcctgcaccacgtgctgatacaccgcaaaatcgtcgatgctggcgcgcgcgccgctggacaggccatgacccggcaaatcgcaggcaatcaccacaaagttctggtccagcgcccagtccaccacgttacggtacaggcccatgtggtcgtagaagccgtggaacatgaacagcgtcgccacaggcgcaggcggccaccacacctgggcgaccacgtggaagccatccacctcaaagcgccccagacggctcacggcaggtactttgcgcgcggccaggtccagcccgtagaaacgctggtagacccgcgcctcggcgctgagcggttgcgcatccacaagtggccgcaagctgtcgcgcagatgatcggggtcaaagctcacaggcataaagggttccagactgacggtgaagatgaatatcgagcggtgatattcatctgtcagggcaagcatggcaagctacgcgaccttcgaggattgatctgaatgcgacagccctaccgttccgccctgttcgccagcctgatcctggtcatctgcgccggcgtgctgtgggcggcgtacgactggttccagggccgctacttgcgcgcattcagcgaacacacggcggtgttctccggcgatgccctgcgcctgcccgccgaactcgccggccccggcccgatccgcctggtgcacttctgggacccggcctgcccgtgcaacgtcggcaaccagcaacacctgggcgagctgatcgagcattacgcgccccaaggcgtcgagttctacgccctgcaaaaggccggcagccacggccaactgcccgacaacctgcgcaaaatgaaaacccttaataccctgttcggtgccgaccacgtgccggcgaccccagctgtcgggatctgggaccgcaagggcaaactggcgtatttcgggccctacagcgaagggctcacatgtaactccggcaacagttttatcgaaccgatcctgcaagccctcgaggccgggcgcgaggtcgatgccactcatacgctggcggtgggctgctattgcgagtggagcaaggcaccaaactgaacacagcctgttcaaccggcaaactccaatcacccgagcattgggctgctgtatcgtacgttttcagcaagattgtaagcgtaggaatacatgagccagttaaccatcatcctctggatgctcaacgttatcgttgatacgtccggccagttggcttttaaagccgccgcctcggccagcgccgagcatgatggcatcgcccactggaagcacatgctcaagcggccgtggatctggctgggggtaatctgctacgtcttcgaattcgtgttgtggctggcgttcctgaccctggtgccgctgtcggtgggcgtgatgctgggctcgatcaatattgtcgtgatcatgattgccggacggttcctgttcaaagagagcctgagcaaatggcgcctgatcggcatcatgctgatcgcctgtggtgtgactgtcgtagggtttgaatgatgaaacgcttttacatcctgggttttctcgcgctgatcattttcgacaccctggcgcaggtcagcttcaagttcgcctcggtgcatgccgagccgctgaccatggacgccgcctggctggttcgcgtatttggcgcgccgtggatctacggcgcctttgtcggctatatcggcgccttcttcacctggatgacgctgctcaaatacgccccggtgggcccggcgtttgcggcctcgcacttggagctgatcagtgtgacgctgatctctgtctggctgttcgatgacaccttgaccctgcctaaaatcatcggtggcgcactgattatcgcgggcattctgtgcctggcacgcagcgaagacaaagagagcaaaccggccgaggtcgaaccgttgcaggccccggtgtcatgacacgccgatgggaaattccgccgaccgcagggctgcctttgcgctggcgggatttgctcggtagctcagcagacctggccgattcgctggcccgccaattctcgattccaacgccggcgctgccctgctccggcacggcggcgctggtcatcgcgctgcgcaccttgcagcagcgcatgcccggccgcacccaactcatcgtgcccgcctacacctgccccttggtggcattggccgcgcattactgcccgccgttgcgggtggtgccctgtgacctgcaaccgggcggcattgacctggacgaacaacacctcaagcagctgtgcgatgaaagcacactggccgtggtggtcacccacttggcggggcgcgtggcagatgtcgacaccgccaaacgtattgctgactcagtcggcgcggcggtcatcgaggacgccgcgcaagccatgggcgcactcgacgatggccacagcgtcgggctcaaaggcgatgtaggttttttcagcatggcgctgggcaaaggcctgacgacggccgaaggcggcgtgctgttcagccgcgacccggtgttgcatcaggcattgcaccgccagtgccgccacgacctgcccttcagcgtgcgctgggagctgcaacgcagcgcacaattgtggggttacgctctggcctaccagccgcgcggtttgcattacgtgtatgggattgcgctgcgtaaggcgctggcccaaggcgatgaagtggcggccgtgggcgacgatttttcggtcaatgacatcccgctacaccgcctcggcgcctatcgccagaaggtcggcgccgccgcgctggcgcgcttgcccgatcacttgcagcaaggccgcaaccgggcactgcgccgcgccgcacgcttgaatgcattgcctggtgtatcagtggtgatggaccggccggggcagcaaggcacctggccgtttctgatggtgataatgccgtcggcaccgatgcgtgatgcagcaatggcgcagctgtggacctcggggctgggcgtgacccgcctgtttatccacaccttgccggactacccggccgtggccccgctgttgcagactggcagcaacataatccaggcccaggccttcgccacgcgcacgctgtcgatcagcaacagccattggctgacggacgctctcttcgagcaaatactggcccggctaaaagctatcgtcgccagccctcgttgattcgcgccaccaaccggctgttcagctcattctgctgctgttgccagatctgcacttgtgcctcaggcagttcctcctggccatcggaggcactcaaccagcgcttgaacttgctttcatagtggtacgccgatacgtcaccggtgacatccgcgccgatgatctggccctggcaggcattgatcaaatcattcaaatgctgctcgaggaattcaccctggtcccaattggtgttgaccacttcggggctcaacacgtctttgtcgatggacaggtacaccggcagcgaacggtctaactgcgccaggaacgcgcgcatcagctcatccgggtggctgaacgcgcggttgctgcggccggcgccgatccagttcatccagcgcgtgtcgaccttgacgctccagtaggtcagcttgcgcttgagcagcggcgaccagtgattctcccaggcgtggcccaggccgatgtcctgcgagccgatgcccagcacatgcacgtgctcgacctgcggcaaacggctggcccaatagacccacgagccgcaatgaatgccgaacgggtagcgcatgttgtcggggtggttgtcgcaaatgatcagctggaacttctgctggctgggcagtcggttcaacagcagttggctgaggtggtgatagtcgccgctgccggtaaacacacagccgtagtcgctgggcatttgcgcgtgcagtgcgctctccagttctttgaactgcgcccagcggcagccgaagcggattttttcctgccaggcctgcaacggcaaggtgatcgcgccgggaatgtcgctgacggcgccatcgaaatccagaatcagcggtgctcgatcctggctcatgacgcctgctcctgttgccactgggcatcgctttcaaagtgatgacggaatcgattgcccagcttgcgcaacagcgggttgcgcacccagaccagatggcgggtgaaggtaaagtcagcgccgaggctggccttgacctgcgggtcggtccaaccggccacgtaaaacttcaggccgttggcgacggcgtactccaggtttacaaaccaactgacgaagtacaggttgaactccagcgcctgcgggtaattcaggccgatgtacttgtcgagcagcttgtcgccctccacgtagcagaggttgtagccgatcaattcatcgcagtgccagtagcaaaacacccgccctttgctggcggcgtccctcaataggccgctgaaaaactccggcgtgagcaggtcaaaatggatctcgctctggtcgtagacggcccggtacagcgcgtacaagtgcgccagccaggcgtcatcgttgaagcgtgcgtcgccggtgcccaggacttccacacgcaatgcctcgcgactgcgcaatttgcgtcggatattgcgccgacggctgtgggacaaacgcgccaggtactcgtcgatggtggtgaagttgatcggcacatacgccagcgcctggccttccaggctgatgaagccgcgccgggtgcagtcatcgatcaggtcttgcgcatagcggttgtcggcgtcgctgagcagcggcgagttgcacggcacgtctttgatcacagtgagtttgcgctgcggcgcacattcatattgcagccattgggcgaggtcctgcgacgacacgccttggggcaacggcgagtattcgctgacggtggtgccgacaaaacagctgtcgatgcgcagccacgtatgccagaaacgataccccggccaaccccgcacacgcttttcgaactcatcgtcggcggtggtcagcaggtcgaagggcgtgaagaagtacggcaggccctgttcggacagctgcacgtcgaaacccaccggcgggtgctgcaaaaagcgctcgatcagcgattgcgcctccaggcagcacgcgtaggtagcctcggggcggctggagtctggcagtggttgcgtggcgcaagtcatgacaaaaagctcaaagatgacaggtggaataatactgcctatggggtgttctccacttgaacctcggctgtcgacaaggcacatcagcatttcactcagccctcgtcaaaaacctattagactccgctgacttgaaaggtgaatgaccaaggaccgtccatgaaacgcagcctgaccgtgctcgctatcctgattgccgccctcatggccggcgccggctggtatgtctacagcaagcaacccactcgacagggcactgaaacactggccaacctgcagggcacggtcacggtgcgttatgacgaccgtggcgtgccgcatatccgcgccgagaacgagaccgacctgtaccgcgccttgggctacgtgcacgcccaagaccggctgttccagatggagatcatgcggcgcctggcccgtggcgaactcgccgaggtgctggggccaaaagtgctggagaccgacaagctgttccgcagcctgcgcatccgtgaacgcgccttgagttacgtggaacacattgaccacgactccaaggcctggaaagccttgcaagcctacctggacggcatcaaccaatatcaggacagccacgccagccccatggagttcgacgtgctgggcatccccaagcggccgtttaccgccgaggacaccatcagcgtcgccgggtacatggcctatagctttgctgccgcgtttcgtaccgagccgctgctgacgtacgtccgcgaccagttgggcagcgattacctgaaagtctttgacctggattggcaacccaagggcgcgctgaatctggcggccagcgactggcaaaccctcggcgccatcgcctccttgagcgatcaggccttggccgacaacggtctgccgcagttcgaaggcagcaacgcctgggccatcagcggcagccgcaccaaaagtggcaagccgttgctggcgggcgacccgcatatccgcttctcggtgccctcggtgtggtacgaagcgcagctctcggcgccgggctttgagctctacggttatcacaacgcgctggtgccggtggcgttcctgggccacaacctggatttcggctggagcctgaccatgttccagaacgatgacctcgacctgatcgccgaaaaggtcaacccggacaaccccaaccaggtctggtatcacggccagtgggtcgatatgaccagcagcgagcagcagattgcggtcaaaggccaagacccggtgatactcaccctgcgtcgctcgccccacggcccgatcatcaatgacgtgctcggcgagagcgccggcaagacaccgattgcgatgtggtgggcgttcctcgacaccgaaaacccgatcctcgaaggtttctaccaactcaaccgcgccgacaccctggccaaggcacgcgcggcggcggccatggtgtcggcgccggggctgaatatcgtgtgggcgaacgccaagggtgatatcggctggtgggcggccgcgcagttgccgatccgcccggctggggtgaaccccggttttatcctcgacggcagcaccgcccaggccgacaagctcggcttctacccgttcagcgccaacccgcaggaagaaaacccggcgcgcggttatgtggtgtcggcgaatgcccagcccgtgtcgcccaccggcatggaaattcccggttattacaacctggcagaccgtggccagcagttgaacacgcagttgagcgacaaaagcgtgaagtgggatgtgaacaacagccaggccctgcaactgggcaccaccaccgcctatggcccgcgcttgctggcgccgctgttgccggtgctgcgtgaggtggtcaaagacccggcacagctgaaactggtggagcagcttgccgcctggaaaggcgactacccactggattccaccagcgccacagtgttcaaccagttcctgttcaacctcaccgacgcgacctttcacccgaaattgggcgacgcgatgttcaagaccctgctcaccacacgagtgatcgatgcagcgctgccgcgtctggcggcctcagcggactcgccgtggtgggacggcaagcgcgccgacacggtcaagctcgcgtgggacaacagcctggcgcatctgaaagccaccttcggcgacgacccgacccagtggcaatggggcaaggcgcacaccctgacccacggccacccgctgggcatgcagaagccgctggacaagctcttcaacgtcggccccttccccgcccctggcacccacgaggtgccgaacaaccagtccgccatgatcggccccgcgccgtggccggtgacgtacgggtcatcgacgcgccggctgatcgacttcgccgacccggcccacgccctgaccattaacccggtggggcaaagcggcgtgccgtttgattcgcactacggcgaccaggcggaaacctacatcgaaggcgggtatgagcaggcgcacttcagtgatgaggaagtgacggcgaatacgcggggtacgttgaagctgttgccggcgcggtaaacccgatcactgtgggagcgggcctttgtgggagctggcttgtgggggatctggcttgtgcgggagctggcttgtgtgggagctggcttgcctgcgatgcgagcgcctcggtattactgaaagactgcggtgacgctatcgcaggcaagccagctcccacatgagcctgcgcactcatttagtctgcgcgtgtgcgcattcgccccggcgcctcgccataggtttccttgaacttcttgctgaacgccgcctgggactggtaacccacttgggcggcgatatccagcaggctcaggcgcgactggcgcagcaggttgaacgcccgctccatgcgcagctgggtcagcagcacccatggcgacacacccgccactttcacaaacgcgcgcatgaaggtcgcccgcgacatgctcgccgcagctgccaggctgtcgatggtccactcgtggccgggctcggccagcatcgcctgccaggccttgctcaggcgcttgtcggcgagcaaggcgaaggtgcctgccacgggcgcctgacaggtcagccaagtgcgcaggataagggtgaacaaggccgacgacagcgcgtcgataaacgagcgcgcgcccagttgctcgccgtccgcctcgctgcgcaacagcgcgatcagcgccgccagttgcccgtcgccctgccattggcggctggacaccaccaggtactccggcaacgcgccgaacagcagcgactggcggttgtagtgaaagctgccgcagagcatgtccacttccactcgctcgccgcccaggcgatgtatcggcagcacaccaccttcgatcaccgttggctgcatcggccggatacgcgcgccctggctgcgcaacaaatgcgtggcgccaccgggcatcagcaggatatcgcccgcctccagcgtcacctgctgcccgcccgacagctcggcgcggcacgtgccgctgagcacgatgtggtacggcgccacgccgaggtgctctggcgcgtggtccagcgcccagtcgccctggaactggcaacgcaaatccagactgccgcgcaggttggccagcgcaataagggtgtcaatcgaattcatttgcgagcatcggtcaaaaagatgagcggattgaacaataacgccaacaccgaacagcagacactggcttcacaccctacttgttcaggagttaccgcaatgttcaataactggtccgacttgctgcctaccgtgaaaaaagcctttggcgcgctgggcaagagcaacccgaagctggtcaaagcctacatggcgttggacgaggctgccgaagaaaacaacgtactcgacgccaagacccgcgagctgatttccatcgccgtggccatcaccacgcgttgcgacggttgcatcggcgtacatgccgacgcggcgatcaaggccggcgcgacccgcgaagaagtggcggcaacgctggccacggcaatctcgatgaatgccggcgccgcgtacatctactcgctgcgcgcgctggaagcctacgacacgctcaaaccggcgccgcaaagttaagccggaactgttgcggcgtcacgcccagccggcggttgaacacactgcgcatgtgctgggcgtcgcgaaagccgcattgataggccacggtcttgagcggtgcggggctgctttcgagcatcacccgcgccgcatccacccgcgcccgctcgacaaactccgccggcgtgatgcgcgcttcacgggcaaacacccgggagaaattgcgcgcgctcatgttggccgccttggccaggtcggcgatggtcaaatccccggtcaggttcgccaacacgtacaactgcaccaacgccaccgccgaggtgctttcggcgtggggcgtaagaaacgggctgaactgcgactgcccgcccgaacgctgggtaaataccaccaggcgcttggccacgctcagcgcgacttccgggccgtggtcctgggccagcaggtacagcgacaagtcgatacccgcggtgaccccagccgaggtgtagaggttgccgtcctgcacgtaaaggcggtcggcgtcgacctgggccgaggggcacaagcgcgccaggtcggcggcgtcgttccaatgggtggtgacggttttgccatccagcaagccggcgcgggccagcataaaggcgccgttgcagatcgagccgaagcgtcgcgcgcgggcggcggcggcgcgcagccaatcatcaaattgcgcgccgaaatcttcgaagggcagttgcgggccaccggcgaccaacagcaggtcgtaggcttgcagggcttcgctgtaatgtttgtgggcctgcaacgacaagccgttggaggccgccatgctgccgtggcccaggccaagtacttcaagctggtaatggtcgtgcggcggcaaaaaacggttggcctcgcagaacacgtccatggggccggtcacgtccagtgactggacgccggggaagatcaggatggcgacggttctatgcatggcgaaaccttatgtctgacaggcacgaaaccctgtgggagctggcttgcctgcgatgcaggcaccttggtgtatcaggtataccgaggtgatgctatcgcaggcaagccagctcctacagttgaccctgtacaaccttggcgcgatatcgcgccacattggccgacatcgcaccctcgccgcgatagccccgtcgcgggcgcgcgaccagactggactcatcggcgccacccccggcgctttgttgaggagaacgaccatgagcaccaccatcgccggcatccagatcccggacagcgccttggccaaggccaccaccgaatacatccgtgacgtcgaatccgacctgctttaccaccactcccgccgggtattcctgttcggcgcgttgagcggtgagcgcaagcaactggcctacaacccggagctgctgtacgtcggcgcgatgttccatgacctcggcctggtcgaaggccatcgcagtgataacgagcgtttcgaagtggacggcgccaacgccgcggcggcgttcctcaagccttacgggctgagcgatgacgatatcgaacaagtgtggctgtccatcgccctgcacaccacgccgggcgtgccgcagcacctgcgcccgaccgtggcgctggtgactgccggcgtggaaatggacgtgctgggcatggactacgcggcgttttccagcgtgcagcgcgaagccgtggtgcatgcgcacccacgcggtgaaggcttcaaggaatgcatcatctgcgcgtttgccgacggcttgcgccatcgcccgcagaccacgtttggcaacgtgaagacggatgtgctggtggatcaggagccggggttcaagccgatgaactttgtcgaggtgattcgcaagtcgccttgggcctgaccagatcgttcccacgctctgcgtgggaatgcagccctggacgctctgcgtccgctcttggaagcatgacgcggagcgtcacaggaggcattcccacgcggagcgtgggaacgatcagagcgggttagaccggtgcaggctcccggcgcttgtctggctgttgccagccatccgcagcggcttcttcaatcgcttgctggatggctttcttgcggtgttcttcggcacgacggctgaagaaccacaccaggaaagtcaccagcgacaccgccaacagaatcaggctggccacggcgttgatctcaggtttaaccccaagacgcacggccgagaatacttccatcggcaaggtcgtcgagcccgggccggacacgaagctggccagtaccaggtcatccagcgacagcgcgaacgacatcatgccgcccgccgccaacgacggtgcgatcatcgggatagtgatcaggaagaacaccttccacggccgcgcgcccaagtccatcgccgcttcttcgatcgacaggtccagctcacgcaagcgcgccgacaccaccaccgccacatacgccgcacagaatgtggtgtgggcgatccagatggtgacaatgccacgctcctggggccaaccgatcatctgcgccatggccacgaacagcagcaacagcgacagaccggtgatcacttcaggcattaccagcggcgccgtcaccaggccgccgaaaagcgtgcggcccttgaactggctgatacgcgtcagcacgaacgccgccaacgtacccaacgcaactgcggccaccgccgtgtagcaggcgatttccagggaacgtgccaccgagcccatcaactgggtgttgtccaacaggcccacgtaccacttgatcgaccaaccgccccacaccgtcaccagtttggattcgttgaacgagtagatcaccaggatcagcatcggcaggtagatgaacaacaaccccgccaccagcataaaactcgagaaactgaagcgcttcatatcttgccctccatctctttggcttggctgcggttgaacaggatgatcggcacgatcaggatcgccagcatcaccaccgccagggcagacgccaccggccagtcacggttgttgaagaactcttgccacaacactttaccgatcatcagggtttccgggccgccgagcagttccgggatcacgaactcgcccaccactggaatgaacaccagcatgcagccggcgatgatgccgttcttggacagcggcacggtgattttccagaagctgttgaaggtgctcgagcccaggtcggacgcggcttccagcaggctttgatcgtgcttcaccaggttggcgtacagcggcaggatcatgaacggcaggtacgaatagaccacgccgatgtacaccgcgatgttggtgttgaggatctgcagcggctcgttgatcaaccccatggacatcaggaagccgttgagcaagccgttgttgctgaggatgcccatccacgcatacacgcggatcaggatcgcggtccaggtcggcatcatgatcagcagcaccagcacggtctgcatctctttgcgcgcgctggcaatcgcgtaggccatcggatagccgatcaacaggcacaggatcgtgctgaaaaacgccatcttcagcgagcccaggtacgcggcgatgtacaactcgtcgtcgccgagcatcgcgtagttgcccaggttgagcaccaattgcagcttttgctcaacgaaggtgtagatctcggtgtaaggcgggatcgcgacgtcggcttcggcgaagctgatcttcaagacgatgaagaacggcagtgcgaaaaacaggaacagccagaggaaagggatcccgatgaccacatgccggccaccgggtgttattcgttgcagctggcgtttgaacttcttcatgttcatgagcgaagtaccacgccgctgtcgtcttcccaccacacatacacctggtcaccccaggttgggcgctggccacggcgttcggcgttggcgacgaaggactgcaccagcttgccgctgggcagttccacgtagaacaccgaatggccgccgaggtaggcgatgtcgtgcaccttgccgctggaccagttgtgctcgcaggtcggcatttcggtggtcaccagcagcttttccgggcggatcgcgtaggtcaccgacttgtcttccaccgaggtggcgatgccgtagcccacgtagatgtcgcggtccaggtccgggcacttgagcaccgcgtggccttcggcgtcgtctaccacttgggtgtcgaagatgttcacgttgccgatgaactcgcacaccaggcggctggttggcgtttcgtagatgtcgatcgggctgccgatctgggcgatccagcccaggtgcatgatcgcgatgcgctcggccatggtcatggcctcttcctggtcgtgggtcaccatcacgcaggtcacgcccacgcgctcgatgatctccaccagttccagttgcatctgcgaacgcagcttcttgtcgagggcgcccatcggctcatcgagcagcagcagtttcgggcgcttggccagggagcgcgccagcgccacacgctgacgttgaccgcccgacagttgatgcggcttgcgcttggcgtactggctcatctgcaccagcttgagcatctcggccacgcgggcgtcgacctcggccttggggatcttgtcctgttgcaagccgaaggcgatgttctgcgccacggtcatgtgcgggaacaaggcgtaggactggaacatcatgttgatcggccgctcgtagggcggcatgtcggtgatgtccacaccgtcgaggtaaatgcgaccttcggttgggcgctcgaagcctgcgagcatgcgcagcaaagtggatttgcccgaacccgaaccgccgagcaaggcgaagatctcgcctttcttgatttccagggacacgtcgtccacggcaatcgtctcgtcgaacttcttcgtgacccggtcgattttgaccaacacctttttcggtgtctggtcgccctcgagggctttcttataggcgccggaggcaactgccatttacgaaactcccaacaaaatttgaggttcgcccaatacaggcgaaaccttggatagtttgagccttaagccttacttgcccgtcttgaccttggtccagctacgggtcattaaacgttgcacgttcgggggtaactcgaagttgacaaacgtccggtcgagaaccgcctgcggtgggtaaaccgctgcgtcggtgcgtatcgattgctccatcagtttgtccgcccctgggttagggttggcgtaaccgacgtaatcactgacctgagcgatcacctcaggttgcagtaaatagttgatgaaggcgtgcgcctctttgacgttggccgcgtctgccgggatggccagcacgtcaaaccacaaattgccgccttctttcggaatcgtataggcgatgttcacgcccttgcccgcctcggccgcacgggccttggcctggaacacatccccggaaaagcctgctgctacgcagatgttgccgttggccaggtccgagatgtacttggaagaatggaagtaggtcacataaggacgcactttcagcagtttctcttcggcttttttgtagtcagccgggttggtgctgttggggttcaggcccatgtagttgagcactgccggcagcatttcatccgccgagtccatgaacgagacaccgcaggtcgccagcttcttcatgttctccggctcgaacagcacggcccaggaatcgatatggtcgacgcccagcacttctttgaccttgtcgacgttgtaaccgataccgttggtgccccacaggtacggcaccgcgtactggttacccgggtcgttcttttccaggcgtttgagcagcgccgggtcaaggttcgaataattcgtcagcaatgacttgtcgagcttctggaacgccccggccttgatctgcttgccgagaaaatggttggacggcacgaccacgtcgtagccggtatgcccggcgagcaacttgccttccagggtttcattggagtcaaacacgtcatacaccggcttgatgccgctggccttttcgaagttggccagggtctcggggccgatgtaatccgaccagttataaatatgcacagtcggcgcggcctgcacgctgacagccagcgtgatacctgcacccaccagcaccgctttgcgaaataaagaaattggcaagtggaggtcctcttaaatagttgggccttaaagttgttgcccggcaacaaaaccggcgcgcaacttaccctcgataaaccgatccggcaaaactttctgtcatttaatttgtgggagcgagcttgctcgcgatagcggagtatcagtcacccgatgtatcgactggtctaccgtcttcgcgggcaagcccgctcccacaggttttaaggcttatttgcccgatttgattttggtccagctgcgggtcatttcacgctgggttgcagccggcaagtcagcaatggcgtagagcttggcttgtacatcggcggacgggtagatgcccgggtcgctggtgatgtctttgtcgaccaatggggtcgccttctcgttaccgttcgggaaccgtacgctgttggtgatggccgccatgacttttggctccagcaggtagttcatgaacttgtaggcagcatcgacgttttcggcatctttagggatagcgaccatgtcatagaagctgccggcgccttctttcggaatgtcgtaggcaaccttgaccttgccaccggcttcagccgcgcgggatttggcctgctggatgtcacccgagtaacccacggcgacgcagatgttgccgttggccaggtccgagatgtacttggacgagtggaagtagccgatcgatgggcgcagcttgaggaacaggtcctcggcttgcttcaggtcagccttcttctgggtgtcggtcggcaggcccaggtaatgcagcgccaccggcagcatttcggttggcgaatcgaggaagctcacgccgcagcttttcagcttggcgaggttttccggcttgaggatcgtgtcccaggattcgatcttgtcgatgcccagtgcggccttgaccttctccgggttgtagccgatgccgatggaaccccacatgtacgggaacgcgtgcttgttgtccgggtcgctgaccgacacggctttaagcagggatttgttcaggttgtcgtagttcgacagcttggacttgtccagctcctgatagacacccgccttgatttgcttggccaggaagttgttcgacggtacaacgatgtcgtaaccggatttgcctgccagcaacttggcttcgagggtctcgttgctgtcgaaaacgtcgtacaccactttaatgcccgactctttttcaaagttggcgatggtgtccggagcaatgtagtcggaccagttatagacatgcagcactttgctgtctgcctgggccgcgcccgccattgcgcccatcagggacaaggcgaggagtgtcttgccagcgttcttcaaacctaatgccttcatttggtgatgctccaattttttcttttttgggccacgttctttagtcgtctcacggcccttccaaagggcaacaaaacagggcgacagtctggcaagttcaggggccggctttcaaccaaagccccctttaatactgctatttgtaactgtccagacgcagcgcccgaagccgctgcgcactgagcctagcacttagccctgcaatgccgccaaagtcaggtccaggcactggcgagccttggtcaccagctcgtcgatttccgccttgctgatcaccagcgacggcgaaatgatcatggtgtcgcccacggcgcgcatgatcaggccattctcgaagcagaacgtgcggcagatcatgcccacaccacggccttcgtaacgcttgcgcgtggccttgtcctgcaccagctcaatcgcaccgagcatgcccacaccgcgcacttcacccaccaacggatgatcagccagttccctcagacgtttctgcaaatacggtgccgtttcgtcgtgcacacgcttaacgattttttcatcgcgcatgatacggatgttttccagggctaccgctgccgcaaccgggtgaccggaataggtgaagccgtggttgaaatcgccaccttcgttgagcaccgcgaccacgtcgtcgtgcacgatcaggccgcccatcgggatgtagcccgaggtcaggcctttggcgatggtcatcatgtggggcttgaggccgtagaagtcgctaccgaaccactcaccggtacggccgaaaccgcagatcacttcgtcggcgacgaacagaatgtcgtacttggcgaggatttccttgattcgcggccagtaggtctcaggcggcacgatcacgccaccggcgccctggatcggctcggcaataaaggcaccgacgttgtccacgcccagttccagaatcttctcttccaactggttggcggcccacaccccgaactcttccgggctcatgtcgccgccttcgccataccagtacggctgggcgatgtgggtgatgcccgggatcggcaagtcaccctgttcgtgcatataagtcatgccgcccaggctggcgccggccacggtggaaccgtggtagccattcttgcgactgatgatggttttcttgttcggctggcccttgatcgcccagtagtggcggaccatacgcagcatggtgtcgttgccttccgagcccgaaccagtgaagaacacatggttcatgccggccggcgcgatgtcggagatgaccttggccagttccagcaccggcgggtgcgcggtctggaagaacaggttgtagtacggcagttctttcatctgcttggcggcggcgtcagccagttcatcgcgaccgtaaccgatcgccacgcaccacaggccggccatgccgtcgaggatcttgttgccttcgctgtcccacaggtaaacgccgtgggctttggtgatgatccgtgggcctttcactttcaattgcttgaagtcgctgaacggcgccagatggtgatcattgctcaaggcttgccattcacgggtttgcgggttgttgctggacataccaatctcctagacttttcaggtgggggcgcgcctttcctacggcgcgcccggcgcatcagacggcgaagagcaggaattcccgctcccacgaactgatcacgcgcttgaagttttcatgctcggcccgcttgaccgcgacgtagcccgtgatgaatttttgccccaggtatttctcgatggtcttgctgttctccatccgctccagggcgtcttcgatggtcaacggcaggcgcaggttgcggcgctcataacctcggcccaccaccggcgcgctcgggttatggccttcgaccatgccgatgtagccgcacaacaggctggcggcaatcgccaggtacgggttggcgtcggcgcccggcaggcggttttccacgcggcggttctgcgggccggcatccggtacgcgcaggccgacggtgcggttctcttcgccccactccacgtttaccggcgccgaggtgtcgggcaggaagcggcggaacgagttcacgttaggcgcaaacagcggcagcaattcagggatgaatttctgcaggccaccaatgtggttgaggaacagctggctcatggtcccgtcttcattggagaagacgttcttgccggtggcgatgtcgatgatgctctggtgcaagtgcatcgcactgccgggctcgccggtcatcggcttggccataaaggtggcggccacgttgtgcttgagcgcggcctcacgcatggtgcgcttgaacaccaggatctggtcggccagggacagggcatcgccgtgacggaagttgatttccatctgcgccgtgccgtcctcgtggatcagcgtgtcgaggtccagctcctgcagttcgcaccagtcgtagacgtcttcaaacaatgggtcgaattcgttggcggcttctatagagaaggactggcgaccggtttccgggcggccggaacggccaatcggtggttgcagcgggaagtccgggtcttcgcagcgcttggtcaggtaaaactccatctccggcgccacgatgggctgccagcctttgtcggaatagagtttcagaaccttcttgagcacgttgcgcggcgacagctcaatcgggttgccttgcttgtcgtaggtgtcgtggatcacctgggcggtgggctcgatggcccatggcaccaggaacaccgcgttctggtcggggcggcagatcatgtcgatgtcggccgggtcgagcaattcgtaatagatgtcgtcttcgacatagtcgccggtcacggtctgcaacagaacgctctcgggcaggcgcatgcctttttcggcgatgaacttgttggtcggcgagatcttgccccgggtgatgccggtgaggtcgccaatcatgcattcgacttctgtgatcttgtggtctttcaaccaatcggtgagctggtcgaggttgttactcataaatgcctctgggctgggtttcctggcatccgttaaaggccaggcgttggtggacgcagcatccgcgtcgtcttttcgttcagggtaggagcttacctgccatttgctgctgcgttgcattcctcacgccaaagtcgtgcagaatcatgagcagcaccccgcacgggagccgctcagtgacaggcacgaaggaaatgagtgagcagaaaagaggtcagccgaggcgtcaagaatattggccggggcgcggtcattcacgcgggaaaattgaacgggtgacaagacttgtctgaaacaggttaaagcgccgagtagcggcaggcgagacatgaagcaccccggtattattgctgttatgggtttgaatcgagcttagccttgttcatttttttacacaacacccccgtaaaaaatacaacacggcccgctcaagcctgctagtcccaagcccttcaaacccaaaaaaccgccccaaaaagccccaaaaaaggcctcacggcgcttttttagggcaaaaaagccctcgcttgacttcggcatgccgttcgggttgactgaaaccagaaaagatcaatgattgatatttttaacaacaaaggtgttgcatcatgtcggtacccccgcgtgccgttcagcttaacgaagcgaacgcgttccttaaggatcatcctgaggttctgtacgtagaccttctaattgcggatatgaatggtgtggtgcgcggcaagcgcatcgaacgcaccagcctccacaaggtttacgagaagggcattaacctgcctgcctctttatttgccctggatatcaacggctcgacggtggaaagcaccggcctgggtctggacatcggtgatgctgaccgaatctgttatccaatccccgataccctgtgcaatgaaccctggcaaaagcgcccaaccgcgcaactgctgatgaccatgcacgaacttgaaggtgaacctttcttcgccgatcctcgcgaagtgctccgccaagttgtaagcaaatttgacgacctcggtctgaccatctgcgccgccttcgagcttgagttctacctgatcgaccaggagaacgtgaacggccgcccacaaccgccccgctcgccgatctccggcaaacgcccgcactcgacacaggtctacctgatcgacgacctcgacgaatacgtcgactgcctccaggacattctggaaggggccaaagagcaaggcatcccggctgacgccatcgtcaaggaaagtgccccggcgcagttcgaagtgaacctgcaccacgtggccgacccgatcaaggcctgcgactacgcggtactgctcaagcgcctgatcaagaacatcgcctacgaccatgagatggacaccaccttcatggccaagccttacccaggccaggcaggcaatggtttgcacgtacacatttcgatcctggacaaagacggcaagaacatctttgccagcgaggatcccgagcagaacgccgcattgcgtcacgcgatcggcggtgtgctcgagaccctacccgcccaaatggcgttcctgtgccccaacgtcaactcctaccgccgtttcggcgcacagttctacgtgccgaactcgccgtgctggggcctggacaaccgcaccgttgcgattcgcgtaccgaccggctcgtccgatgccgttcgtatcgaacaccgcgtggccggcgccgacgccaacccttacctgctgatggcttcggtcctggcaggcgtgcaccacggtctgaccaacaagatcgaaccgaacgcaccggtggaaggcaacagctacgagcagaacgaacagagcctgccgaacaacctgcgcgatgccttgcgcgagttggacgacagcgaggtgatggccaagtacatcgatcccaagtacatcgatatcttcgtcgcctgtaaggaaagtgagctggaggagttcgaacactccatctccgaccttgagtacaactggtatctgcatactgtgtaagcagttgctgctttaaaaaatgccgcaggcttaatggcctgcggcatttttttgcgctgcaatctcgttcccacgctctgcgtgggaatgctgccagggacgctctgcgtcccaagagcggacgcggagcgtccagtaaggcgttcccacgcagagcgtgggaacgatcataaggtcgcgtacaatgcgctctgccttgcaggagacttccatgaccacccgccccgccgcccctcgcaaaccccgcgcccgcagccaggcccggatcgatacgatcctcgacgccgcccgtaccttgctggcgaccgaaggcgtggccagtttgtcgatctacagcgtggccgagcgcgcgcagattccgccgtcatcggtgtatcactttttcgccagcgtgccggccttgctggaagcgctgactgccgatgtgcacgcggctttccgcgctgcgattcaggcgcccatcgaccatgagtcactcaagcactggcgcgacctgtcctacatcgtcgagcagcgcatgctgagcatctacagcaacgacgcggccgcgcggcagttgatcctggcgcagcatggccttaccgaagtgacccaggcggaccgtcagcatgatctggagttgggggatttgatgctcgaagtgttcagccgccatttcgacgtgccaacgctgccaacggatgtggatgtgtttgccttggcgctggagttgagcgaccgcgtgtacgcgcgctcagtgcatcagcacgggcagattacgccgcgcatggcggaggaaggcatgcgggtgtttgatgcgtatgtggggctttatttgccggcgtatttgcctaagcgctgatcgttcccacgctctgaactgaccccacaaagctggacgattacatgcctatgcctgaacggcctgagttctatatgcaacagggctcaggccgtttagcttcagcttgatacgcgagtgattgtaatact

SEQ ID NO: 41 - DNA, 117263 bp, Pseudomonas poae FL10F
gggcattcagcttgccactcaccgctctcaacctcagtttaaacctggctcaagacacaagcgggcttgctcgcgaatgcggtgggtcagccatgcatctggcgactgacacactgcattcgcgagcaagcccgctcccacattttgatctccagcgtcagggagtaagcatgagctccaccaaagacccctgcatcagcatctgcaaattcagcgatgacatttgcgtcggctgtggccgcagcaagcgcgaaatccgcgcctggaagaaactcgacaaagtcgacaaacgtactgttttggccgaagccgagctgagattgctggccttgggcgccaccggtcggcggaaaagcaaatgactggggccttatcgactagtctgtgatgcgcaacgcgcgccatacgcgtatgattcgcgaccctttggcgacctattcgcccaaagcccagctttcaacattcttcaggccacgcctgaatcgacccaccgggaggtgcttaagatgaacgaccaagaccagaacgacagccaggaaatcggcccagcaggtgaaaaactgcaaaaggtgctggcgcgtatcggcgtgggctcgcgccgcgacgtcgaagcctggatcacccagaagcgcatcaaggtcaacggcgttgaagccacccttggccagcgcgtcgacctgcacgatgcaatcaccattgatggcaaggtcatcaagcgtgaagaggccgccgaatcggtgcgccgcgtgatcatgtacaacaagcccgacggcgagatctgcacccgtgacgacccggaaggccgtccgaccgtgttcgacaagatgcccaagcccaaagaaggccgctggatcaacatcggtcgtctggacatcaacaccaccggcttgctgatgttcaccaccgacggtgaattggccaaccgcctgatgcacccgtcctacgagatggaccgcgaatacgccgtgcgtgtacgcggtgaagtcgacgacgagatgatcgagcgcttgaaagccggcgtggtccttgaagacggcccggccaagttcaccgacatcaagcaggcacccggcggcgaaggtttcaaccactggtatcactgcgtggtgatggaaggccgtaaccgtgaagtacgtcgcctgtgggaatcccagggcctggtggtcagccgcctgaagcgcgtgcgtttcggcccggtgttcctgaactccgacctgccgatgggccgctggcgcgaaatgagccagtacgaagtcgacatcctcagcgccgaagtgggcctgacgccagtcgcgatgccgcagatgaacgccaagagcaaagacaaacttgagcgtatgcagcgtaaatcgtcgcgccctgtggcccgcaccgaacgtgtggcccgcaccctgcgcccggcgctgaatgcaccggcgaccggtggtcgtatttcccgtgagccgcacatcgaaggcgagcgccgcccaacagcgccgtcgcgtcaggaaggtgagcgtgcgccacgcacgccgcgccctgcacgcggtgacgcgccagccggtggtcgcggcaatcgtggtgaaggccgtggtgctccggcatccgatcgcccagccgataacgccagcaccaagcgcccggccaagcctgcggcgaataagcgccctggcccgaaactggtcgccgacgagccgtcgggcaagcgccgcggcgccccggccggttccggtcagcgtcctggttttggtcgcaaaaagccgcagtgatacgctaagcgctgcacaaaaacgccaaccctagggttggcgttttttttggctctcaatctggtaacccaatcaactgtaggagctggtttgtgtgggagctggcttgcctgcgatgcaggcacctcggtatgtcaggcaaaccacagtgaggctatcgcaggcaagccagctcccacatgggggcttcagtgtttttggcaactgggttctaaaaggcaaacgtcccatcaaacactggcttgtcatccagcgccaacacaccgctggcaaagatcaaatccaggtgatggctgcctttctgcccgccacccaggcccaggtgcaaaccgcaatggcgctcctcgaacccggcgttgcgcgcatacaaatccttgaccccttcattggtgccaatccccaattcctccacacggcggttggacgggttggcattcaggtatttgttgaagtcatccgccagccccggtacgtcgctggccacgctgcaaatggtcgagttctcgatccacagttccaacggtgattgcagcacgccgtatttgcgcgcaaacgggatggtgctgagaaaggtgccgacaaaccttacctggccattgatggcctcgctgtgggtagcgatttcgcccggcgccaggtcgtggttgccgacgccgttgatgttggtccacttcttgatgctgctcatcggtgcttccaggcgcgagccgtgtttgtcggtaaagctcaacacgttggcttgggacatgcgccggatcaaggtggcgttgaggtcggcaatgcgctgcggctcgacgctgaaggtgtcgtagaagtagtcgccataatccttgaacagcagggatttcttccagtgctcggccatcacgccttgcagtgcgcggataaagtccgggccttcggcacgtgggttgggcagggtcgaggaatcgtagagaaacaggtacaggtcgcaggcttcgatggcgtgggccagggtgtcgctggcggccaggtccaggcgctgcacctggaaattgaaacgggcggcgctgccgtgggtgattgcctgggcgatggcgtcgtagcgctcggtgtggcccagcagcacggtagggcggctcaggccgctgagggccgggtggtgagcgaggtaatagagaaagtgttcgacggcgcgggccttgtccatgacgtgtgtccttctgtgccttgggtaagggggcaggtgccgtgcacagcacctgccggatgcctgccgggtgttagaaaggccacatcgcggtgccgaacggcacaacggcatcggcttgcatcatttcaacggcggcctcatgggtcggcgcttcaaaccaatcgtcgagttgcagttcggtttccaggtcgttttccagtgcttgcatggtgtatctcctagaggacgttgtttgagaacggcttgccagcgggcttcgctgggcaagctcaagaacctaggcgagagtgtttcagaatgcaaaaaatttattgacacggtttcatttggattttttcttctgtttttttcggtttgatttttttcagaaaaaacagtgagctggctgaaacgattgatcaggtattggtaaccgacaattttctggtgaatgagagtttgagctgtctgtaacgctggttttacgcggtgtaacgacaactttacgcgttggtccaggccttgctgggtgttgtctggctgtaaggaatctctgacagatcgtcgcggacgctttgcgggggcggccagaagctgttgagcgatgtacaatgcgccgcgttttactgtgaccccccttgcgtatccacgcaaaaggccaagacccagggtttaccgaccctgatcactccgtccgaccacgagccgggcgggttcgatttcgtcacagataaaaacaaacaggtgacgcatgaccgttagaaaaacgctgtactcctggtgcctgcgctggggtttgagcggcgctgcttgagtcgagattcaagacagcaacgtgcattcaacatcatcaaaccttgcgtgagacccttttcatgagtggaccccattcctcttcaggcgagctgaaacgcggcctgaaaaatcggcatatccagttgatcgccctcggtggcgccatcggcaccggcctgttcctgggctcggccggggtgctcaaatccgccggcccgtcgatgatcctgggctacgccatctgcggctttatcgccttcatgatcatgcgccagctcggcgaaatgatcgtcgaagagccggtcgccggctccttcagtcattttgcccacaagtactggggcggtttcgccggcttcctgtcgggctggaactgctggattttgtacatcctggtgggcatgtccgagctgaccgcggtcggcaaatatgtgcactactggtggccggagatcccgacctgggtctcggcggcggcgttcttcgtgctgatcaacctgatcaacctggccaacgtcaaagtcttcggtgaggccgagttctggtttgcgattatcaaggtggtcgccatcgtcggcatgattgctctgggcagctacttgctggtcagcggcaacggcggcccacaagcctcggtgagcaacctgtgggaccacggcggtttcttcccccatggcgtgggcggattggtgatggccatggcgatcatcatgttttcattcggcggcctggaaatgctcggctttaccgccgccgaagccgaccagcctcgcaccgtgatcccaaaagcgatcaatcaggtgatctaccgcatcctgattttctacatcggcgccctgatggtgttgttgtcgctgacgccgtgggacagtctgctggcgaccctcaacgcgtccggcgatgcctacagcggcagcccgttcgtgcaggtgttctcgatgctgggcagcaacactgccgcgcatatcctcaacttcgtggtgctcaccgcggcgctgtcggtgtacaacagcggcacctactgcaacagccgtatgttgctgggtatggctgagcagggcgatgcgccgaaggccttggcgaagatcgacaaacgcggcgtgccggtgcgttcgatcctcgcgtcggcggcgatcaccctggtggcggtgctgatgaactacctgatcccgcaacacgcgctggaactgctgatgtcgctggtcgtggccacgctggtgatcaactgggcgatgatcagcttctcgcacttcaaattccgccagcacatgaaccgcaccggccaggtgccgttgttcaaggcgctgtggtatccctatggcaactacgtctgcctggcgtttgtcgcgttcatcctggtcatcatgttgatgattccggggattcaagtgtcggtgtacgcaatcccggtgtgggtggcgttcatggggctgtgctactggatcaagaacaagaaggcgcaagcggctttgggcacaaagaggacggttctggagtaggacgcttcccgtaaacaagaaacccggcgccgtgccgggttttttgtgggcgcgagcaggttagactcgccccctcatttttcatcgatacctgcccggaggccccatgcagcataccgatatcgacggcggcagcttgcaacgcgacgcgctggaagacctgatcgaccagcacaacgggccattgcgcctgattggcgtcgacttgagtggggccgatctgtcgcggatggtgctggaccactgggtgttcgagcgttgcatcctggtgcagacctcgtttctcggatcgcgccttgaaggcactcagtggaacagttgccgcgccgcccacgccatattcgaggcggcaaacctgctggaagcgcagttccacagctgcgacctgaacaacacccgctggcagcgcagcaaactgtcccaggccggttttgcccactgcaagctgaccggcgccaacttcacccattgtgcgtcgctgggcttgagcttcagcgaaacccggctcaacagcgcatttttgtccggcctgtcgtttgcccgcaccgtgctgaacaacctggatttctccgacagcgacttgtcggatgccgactttcgcaaggccgaattgatcgattgcagcctcgcccatgcgcgcatcaacggcgccaatttcgccggggccgacctgcggggtgcggatttgagcggttttcgcctcaatgatgccaaactgttcaaaggcgccgtgatttccaaagcccaagcgtcgatgttgttgtccgagttgggcttgtccgttgcctaaggtttttcagtgatgctggttatttccaacaatgtgcacctgcccgatgccgagatcgagctgaccgccattcgcgctcagggcgccggtgggcagaacgtcaacaaggtgtcgagcgcggtgcacctgcggtttgatattccggcgtcgtcgttgccggacttctacaaggagcggctgctggcgctgcgtgacagccggatcaccagtgaaggcgtgctggtgctcaaggcccagcaataccggacccaggagcagaatcgcgcggatgcgctggaacgtttggtggagttgatcctcagcgccaccaaggtcgagaagaagcgccgaccgaccaaaccgacgctgggttctaaaaagcgtcggctcgaatccaagaccaagcgcggcagcatcaaggctgggcgcggcaaggtcgacttctaggcgtcgcgcgcctcgcgtgccttgggtgcttgccggtacaggtacaggctcagcagcaggccgccggcggcggcgagggcggcgaacaggaagatcgaggcaaagccgaagcctgccgccaccgcaccggccagcgggccggtgatgcccagcgacaggtcgataaacagtgaatacgcccccaccgccgaaccacggctggacgctggcaccaggttgaccgcctccacccccagcgccggaaacaccagggaaaagccaaacccgctcaacgccgcaccggcgagtgccaggtgtgcatccggcgccagccacagcaacagcaggccgaggatttccaccgacaggcaggcaatcgccacgcgaaagccgccgatacggttgatcaaattgccgaacagcaggcgtgcaccgataaagctggcgccgaacaggctcagggcccataccgcgttgtcccagtgctgggtggtgtaatacagggtgataaatgtggcgatggtgccaaagccgatcgagcccagcgccagcgcgcagccgtggggcaatacgcggcccagcacgttcatgaacggcaggcgcacaccggccacaatcggcgccgcgactttgttccaggccaacagcacgcccagcaccgccagcaaaatgatgctgacgcccatgctccacagcccgaagtggctgaccagcaccaccccaagcggtgcaccgacggccaacgcgccgtaactggcgatgccgttccacgagatgaccttggccgtattggctgcgccgacccggccaatgccccagccgatggcgcctgaacctaccaggctttccgcgctgcccaggaccagtcggccaatcagcaggctgaccaggctgacggccggcaggctggaaaaccacgccgccagcagcatgaacacgccactcaggccgcagccgaccaggccgatcaacactgcgcgcttgctgcccaggttatcgatgatcttgccggcatacgggcggctgagcagcgtggccaggtattgcacgctgatcaccaggccggcgatgaccgcgccgtagcccagttcactgtggacatagcccggcaacacagccaggggaatgccgatattcaggtaaccgataaaggtgaacagcacgatggaaacgacttgcagcgtgaccgccatggggcgctgggtatctggcatgggagaggtccactgtcgcagcaggtaaagataggctgctaatgataccggcgcgagggccgggtggggcggcaaaccagcaaaaacttcagtttaggtacagatcagggtttggttggcgcgagcatttgcgtagtgaccaaggcggccagggcgttttcctgggtgccgaagcgcttgagcagcaaggcttgtttgtcggcgctgaggcggttccagacttcgatcatctgcaaggcagcgtcgagtacagcggcgtcgggggtgtcgtggagggtgtcagtcatggcgggtatctcgggtgattcaggcagtgtggaaagcgctcaatggtgcgctttccacacggtctggtacggcgtcagtcctggcgtttgctgtcgactggttgtgcttctttggtctcaggctgtttgctactggcctgctgcggtgttggctgctcagttgggtgcaggcttgggaaggggagattaggtatctcgtgcatcgtcgtcgctcctcgcaagatctgtttatcaatcgcagtgtgattgcgcgctctcaaaaagccttggcaggatacagcactgaaaatgacaaaaagaattttatgtcgacggatgtacgaattttcattctttaagcaagtgacaagaggtcacaggctaaaaaggcggcctagaacggcaccttgcccaaaatcatgtcgcggtacatcacaaaatcgcccaacaagctgtagaacgggtgttgaaacgtcgccgggcggttcttttcgaagaagaagtgcccgatccaggcaaagctgtagccggcgactggcaaggccagcaacaggcccaacgaccctctgccgatcgcataggccagaataccgatcaccaacgtggtgccgataaaatggaggcgccggcaagtgctgttgccgtgctcgctcaggtagtaagggtagaactcggcgaagctattgaattgtttgatattttccacggtagccggcccttgggtggtgatgccgcccaacagatgttcggcggggagcttatttgagtctagagtgatcagtggtaacagccagtgacaatagatgccactttagtatccttggcttcctggctgccgtttgagcctgcttttttcaagaagacgccatgagcgaacgaacaacttctgcaagctgggcgatggggatagtcaaggcgctggaaatggacggcctggattgccgcgtcttgttcaagcaactgggcctggactacgccgccctcagtgatcccgacgcgcgttttccgcaggactccatgacaaggttgtggcagcgggcggtggagttgtcgggcaaccccgcaattggcttgaacatgggcaaagtggtgcgcccggcgtcgtttcatgtggccggttacgcgctgatgtccagcaacaccctggcggaaggctttatgcgcctggtgcgctaccagcgcatcattgccgaaagcgccgacctgagttttcgcctgctgcccgaaggctatgcgctgattctgacggtgcatggcgaccacctgccgccgacccggcaaagcgccgaagcgtcgctggcgagtgccttggcgctgtgtggctggttgaccgggcgcaccctgcaaccgcgcaaagtcgtgttgcaaggtgatcaaccggcggacctcgcgccttacaaacaagccttccatgcgccgctggaattcaatgcgccgtatgacgcgctgattttcgagcaggctgacatggaggcgccgctgcccacggccaacgaggccatggcgctgttgcatgatcggtttgccggtgaatacctggcgcggttttccgagagccgcgtgacccacaaggcgcgccaggtgctgtgccgcctgctgccccagggcgagcccaagcgcgaagtggtcgcccagaccttgcacctgtcccagcgcaccttgcagcggcgtttacaggaggagggcaccagtttccagaccttgctcgacgacacccgccgcgaactcgccgagcagtacctggcgcagccgagcatgacgttgctggaaattgcctacctgttggggtttgccgacccgagcaatttcttccgcgcattccgccgttggttcgatgccacgcccggcgaataccgggcgcggttgctcgaagcgtcgacggtcagtggcgccaaaacgccggaatgcacagaacaaagactgtaatgatctccagccggcccagcagcatgccgaacgacaggatccacttggccgcatccggcaagctggcgaagttgccggccgggccgatggtttcgcccagccccgggcccacgcccgagacggtgctggcggcgccggtcaacgcggtcatccagtccagcccgagcagcgacagggccagggcgatggcgcagatggtgatggcgaagaaaaacgaaaaggtcagaatcgagcgcacgatctcttcgtcgaggcggtggccgttgtacttctgcttgatcaccgcgcgtgggtgaatcagctggttcaagttggccttgagcaggatataggcgacctggaaacggaagatcttgatcccgcccgccgtggagcccgagcagccgccgacaaagcccaggtagaagaacagcatcagtgagaagttaccccagatgctgtagtccccaagcgcaaaaccggtggtggtcaccacggaggtgacgtttaccgccacatgacgcagcgcgtccagccaatgcagatcggtcgtccaccagtaccaggtgccgagcaccagccaggtcaccagcaataaacccagcaaaccttgcacctgctgatccttgatcagcgcccggcgattgccgcgcaacgtggccacatacaaggtgaacggcaagctgccgaggatcatcaccaccaccgccacccagtgcacggccggttgtttccagtgggccagggattcatccgaggtggaaaaaccgccggtggagatcgccgacatcgcgtggttgatcgcgtcgaacaagcccatcccggcccaccagaacgccaggctgccgaggatggtaatgcccacgtaggccgccacgataagccgcgccaccatgtgtgaacgcggcatgaccttttccgaacggtccgaggactcggtctggaacaggcgcatgccaccaatgcgcagcaacggcaggatcgccaccgccatgccgataaagccgataccaccgagccagtgcagcaacgagcgccacatcaggatgcccggtgacatgctgtccagcccgctcaataccgtggagccggtggcggtgatgccggacatgctttcgaagaaagagtcggtgtagctgatgtgctgggtcagcaaaaacggcagcgcggcgaacacgcacaccaccacccagctgctgacggtgagcaagtacatgtcgcgggggcgcaagtgcacgtgttcggggcggccggggatcaccagcgccaggccggcgagaaaggtaatcatgctggcccagaggaacgagggcaggtcgctggtgcgttcgaagatcaccagcgtggccatcgggacgaccatggcgatcgcgagggtgatcaggaagatgccgatgatgaaaccgatgatgcgtagggtcggcaacgccatgaagtgtgctcggtgatagggctgaggcgccattctacccagggtgcagagcatgtaaaccgagggcttgaggttgatgacgatcaactgtgggagctggcttgcctgcgatggcgatatacccttcagctacccagttaactgacccaccgccatcgcaggcaagccagctcccacaagggttgtggggtggcgggcaacgcgcacaaaaaaggcgacccgaaggtcgcctcattcaacgcggcacggatcagaattcgtgatcagcgttgtccgggttcaagtcgctgatgcccagtttgcctgcagccgcttcgatcgaaccggtctgcttgaccagcgcagcgatggcgtcacgcacgatctggttgcccgcatcgttgcccgcagcgatcagttggtcgtagtgctcaccgttgttggcgtgatcaaccatgacctggatcttcgcttcggtcgacgccaggtcggccttcagtgcgctgtcggcagccgggtcagccttggccaccagcgacgacaagctcgcgccggtcatcttggtgccgtcgacgcgggtgtactcgcccaggtaaacgttacgaatacccttggcatcgtagaaatgcgagttgtgggtgttgtcgctgaagcagtcctgctcgtcttccggcgagttggcttcgagggaaaccttcatgcgctcaccggccagttcgccgagggacaggctgcccatgccgaacagcattttgcgcaagccgtcggtagccggttcggcttccagggtggcgcggtagttgtcttcgacgttgggtttccagttgccgaccatttcttccaggtcgctgaccagcagttgggtcacggcgcgcaggtaagtgcggcggcgttcgttgtggccaccggtggcgccgtcgcctgtcaggtagtcggaggcagggcggttgcccgcacctgggccggtgccgttgaggtcttggccccacagcaggaattcaatggcgtggtagccggtggcgacgttggcttcggaaccgcccagctcgttgaggctggcgagtttttccggggtgatctctttaacgtcgaccttgtcttcgccgacctggatctcggtgttggcgatgatgttggcggtggcgcctgggttacccagggcgtgctcgtaggatttgtcgacgtagtcgatcaggccttcgtccaggggccaggcgttcacttggccttcccagtcgtcgatgatggtgttgccgaaacggaacacttcgctctgcaggtacggtacgcgagcggcaacccaagcggtgcgggccgctttcagggtttggtcgttcgggttggcgaggaaggtgtcgaccgcggtttgcagggttttcgccgtcgattcggcatcgctgtacaccgcgaacaccatgtcagcgtaatgcgcgaccacggccttggcggccgcttcgtcgacctggccggcaggggtggcagccgccggagcggtggtgctggcagccggggtcggcgcctggtttgctgcggccttgtcgtctttaccttcgccgcaaccggcgagagaaatggcaatggccagcagactggcggtggccaggggcatacgaatcatggcgaacatcctgcttcggttgttgatagggcgcgcgggggagcgcaaaaaagctgcgacataatgcgaaagatttgcattttgtgtaaagggttatacgcgggaaatatttagtatcgttttgctatttcagagaatcgccgcgttattgcgctcggactgtttcaaaaacgccgccagttcccgggccggcagcggtttgctgtagtggtagccctggccctcgtggcagccttcggaaatgatgtaggcctcctgctcggcggtttccacgccctcggcgatcacctgcatgcccaggcttttgcccagttggatgatggcgcgcacgatggttgcatcgtcgtcgtcatcgagcaggtcctggacgaagcttttatcgatcttgatcttgtccagcggcaggcttttcaaatagctcaaggacgaatagccggtgccgaaatcatcaatcgcgatcaacgccccggaacgccgcaggctgagcaagtgttgggcggcggtgctgatgtcttccatcaggccggtctcggtcacttccaattcaaggctgcgcggcggcaggcggtaaatctgcatcaggttgttgaccacgcgcggcaactcggtgtggtgcagttgcacggtcgacaggttgaccgccatgcgcaaggtggtgaagcccaggtcatgccattcgcgcagttgccggcaggcctggtccagcacccattcgccaatcggaataatcgtgccgttctgttccgccaacgggataaacaggtcgggcggcaccaggccgtgctccgggtgctgccagcggatcagcgcttccacaccgaccacgcgatggtcgcgatagctgatctgcggttggtagaccagatgcaactggtcacggctgagggcatcgcgcaggtctttttccagttcgcggcgccgacgcatttcactgtcaacgctggcgatatagaactgatagcggttgcgcgagcggctcttggccagggtcatggtctgttcggctttttgcagcagcttctcggtgctgtcgccgtcctccgggaacagcgtgatgccgatggtggcgcgcaggcgaatctgctcgtgttcaagggcgaattcggcttccaggtcgtccaggatgctttgtgccaattcggcggcttcgtaaggctggtcgatgtcggcctgcaccagcgcaaactgatcgccacccagccgggccagggcgccgaggcggccgctgtgggcgcgcaaacggtcggccagggccagcagcagtttgtcgccggcctgataagtgaactgttcgttgacgcttttgaagtcatccaggcctacgcacagcaccgcgactcggcgctgtcggcggccggcgtcgatgaggatcttgtccagctgttcctgcaatttctggcggttgggcaggccggtgagaaagtcgtactgggccatgcgcagcaggctggattcggcctcgtgccgcaagtgcgtattgcgttcgatggattcaagcaactggttggcggtgttgatccacagccccaactcgttgcgttcgtggcctttgagctgggggatcttgtgttcactgggccggtccgggttgatcgacgtcaggtgctcgatgatccgcgacaacggtttggtcagcagccagtgatagaccaggtacaacaccaggcccatcgccagggcgcgcagcacgccggaaataaagatgatcaccgagctgaccagaaagcctttgccgtagttggccgtgtcgagggtgatgctcaagtcgccgtagtactcgctatacgggcccttgccgaccagcgcagtggtaaacgtgcgttcctggccaagaatcaggtcggtcaaccagcgggtcggggattgctgcaagtcgcggcttttttccgcgagcatggtttcgttggggtggccgatggaggccatgcgcacggcgtcgtcctgaaacaggccttcgatcacctgcatacccatctcgcggtcaaggctgtagacagcctgggtcgaggggtcgcgaaacatgtcgaggatgcgctgggcatcaccggccacggcctggcgcgtcttgtaggcatcgaaaacaatctgcgccgcgctcagcgccacgcccacgatcaatgccgacagcagcacaacccgtagcaacttcaccgacaagctgtttttgagttccagcttcaaaggggcattccttgttccatgcgggtggcctcaatatgccatgagtattggcaatctggggatggcagtcaaaggaacattagggcatcggcgggtttggcagtgagcttgtggggcgtaggggcaggcggactcgcatccgcctgcccgaagtgactctgcaggtgaggggcgcctgggtttacgagatgttgacgctgacgctcttgtttccagagtttggttgcgaataattcatggagtggtggttgctgtgagtgtctgcgttcgcgatctgacccccgcgccggttttgagaattggccatgtcgcctaccgtcttggcgagtgaagtgacagcgttcatggcctggccagccaagggcgcgagtgcgccaacaagtgggattgctgctgctaatgcggtaatggacattgtaatttctccgacagttaagagaggcgaattcctcacattgaatgcgtggcacaatctccactccgagttccaaagccccggccaatttttcatcgcccataaaaaagcccggcaattgccgggctctttttactgcaagcgttgcttaggcagtgaaggttttgccttcgaactgctcagccacgaacttccagttgaccaggttccagaacgcttccacatactttggacgcacgttgcggtagtcgatgtagtaagcgtgttcccagacgtcgcaggtcagcagcggggtgtcgccactggtcagcgggttgccggcgccgatggtgctggccagggccagggaaccgtcagcttttttcaccagccagccccaaccggaaccgaaggtgccgacggacgtcttggtgaactcttccttgaacttgtcgaacgaaccgaacgcagcgttgatggcctcagccagtgcgccggtaggttggccgccggcgtttggcgccaggcagttccagtagaaggtgtggttccagacctgagcggcgttgttgaagatgccgcccgaagaagacttgacgatttcttccagggtcttgccttcgaactcggtgcctggcaccaggttgttcaggttcacgacataggtgttgtggtgcttgtcgtggtggtattccaaggtttccttggaaatgtgcggctgcagggcatcgtgtgcgtagggcagcggcggcaattcgaaagccatgatgattctcctaatcaggtcagttgcggtgagcgcaaggccgatcacgggcggccaaacaagcgccggggagtttgtactctttgcggcgcaggggctggatcatagcaccggggttgcggcataaccacgcaacaactgtgtgggatagaggttccagagcgttttggaatattcctcacgcactgatcaattggtaggccacgctgaacatcatcgccgccaccaggaagtccagcagccgccaggtcgccgggcgcgccagccagggggccagccacgcggcgccgagtgccaacgtggcaaaccacaggaacgaggcgctggcggcaccggccacataggcgccgggttcggtttgttgagcgcccaatgagccaatcagcagcacggtatccaggtacacatgcggattgagcagtgtcaccgccagggcactgagcagcacggcgcgcaaggagcgtaccttgaagttttcgccttgttccaggctctgcctggaaaacgcccggcgcagcgccagggtgccgtaccacaacaggaacgccgcgccgccccagcgggcaatcgccagcaacagtgggttctgtgccagcaccgtggccaggccgaacaccccggccgccaccaaaattgcatcacacacgatgcacagcgccgccacgggcaaatggtgttcacgtcgcaggctttgcgccagcacaaaagcattctgggtgccgatcgccatgatcaggccgagggccaccaacagaccgttcacatagctttgccacataatttttactccgcgtttgctgccaattgacgcaatacatccatggctcgctcggcatcgctgcggccgacaaacaggtggtcgtggtagtaaccggcgatcacgttgcaactgataccggctttgcccagggcactggcgaacgccgcagtcaggcccacggcttccagggccgaatgcacattcaaagtgatccacgcggcgacgtagtcaaaggccagccccgcttgctccgcctgctgacgctctagaatcagcgtcagcccttcctgttcgcgaaagctgccgatgacgtcgcaaccgtcggggatacgattgtcgggcagggtgcagaacacataatcgccgtcattcaactgcgggctcatgctgcgcagcagggttgccagggcggtttcgccagccatgtgaagttccttgatagagagaagcgatgctggtcattcttacgggctaagctgtataagaaaaaccaatattcctgatcgcccattagagaaactgatgttcgactataaattgctttctgccctggcagcggtggtggaacaagccggcttcgagcgcggcgcccaggtgctggggttgtcgcaatcggcgatctcccagcgcatcaagttgctcgaagcgcgcatcggccagccggtactggtgcgggcctcgccgccgacgcccactgacatcggccggcgcctgctcaaccatgtgcaacaagttcgtctgcttgagcgcgacctgcaaagccaggtgccggcgctggatgaagaaggcatgcccgagcgcctgcgcatcgcgctgaatgccgacagccttgccacttggtgggccgaggccgtcagtgacttttgcgccgagcagcatttgttgctggacttggtggtagaggaccagaccgtcggcctcaagcgcatgcgcgcgggtgaagtggcggcctgtatctgcgccagcgagcgcccggtggcgggcgctcgcagcctgctgctcggcgccatgcgctaccgggcgctggccagcccggcctttattgcccggcatttccctggcggcgtgcgtgccgatcaactggcgcgcacgccggcactggtgtttggcccggatgatttcctgcaacaccgttacctggcttccctcggcgtggacggcggtttcgaacaccatttatgcccatcctccgaaggctttatccgcttgacggaagccggcctgggctggggcctggtcccggaattacaggtgcgcgaccagctggaaagcggcgtattggtcgagttgttgccagataagccaatcgacgtgccgctgtactggcatcattggcgcagtggcgggcagctattgggcttgttgaccgatcatctggcccaggcgtgtggccaatggttggtgccgttggaatgatggcgggcgtcaacgcaacagcgatgaaaaacgaaagaacacggggtaatacatgaaaattctggtcaccggcgcaagcggcttcatcggcgggcgctttgcgcgtttcgccctggagcagggcctggacgtgcgggtcaacgggcggcgtgccgaaggtgtggaacatctggtacggcgcggcgccgagtttatccagggtgatttgaatgacgccgacctggtgcgcgacctgtgccgcgatgtcgaagcggtggtgcattgcgctggcgctgtcgggctctggggcaagtatcaggactttcatcagggcaacgtgctggtcaccgaaaacgttgtcgaagcctgcctcaagcagcgcgtcgggcgcctggtgcacctgtcgtcgccgtcgatctacttcgatgggcgcgaccacctcgggttaaccgaagagcaagtccccaagcgcttcaagcacccgtacgcggccaccaagtacctggcggagcaaaaggtgttcggtgcccaggaattcggcctggaagtgctggccctgcgcccgcgtttcgtcaccggtgccggtgacatgagcatcttcccgcgcctgttgaaaatgcagcgcaagaaccgcctggcgatcgtcggcgacggcctgaacaaggtcgacttcaccagcgtgcacaacctcaacgaagcactgttgagcagtttgctcgcgaccggctcggcgttgggcaaggcctacaacatcagcaacggcgcgccggtgccggtgtgggatgtggtcaactacgtgatgcgccagatggacatgcctcaagtcacgcgttatcgctcttacggtttgtcctacagcgtggcggcgttgaacgaagcattctgcgccatgtggccagggcgcccggagccggcgttgtcacgcttgggcatgcaggtgatgaacaaagatttcaccctcgacatcagccgggcgaggcattatctggactacgagcccaaggtcagcctgtggactgcgctcgatgagttttgcagttggtggcgcgcccaggatccggggcgccagtaagctcacacccagcaacacttcgggaaccgaatccgcggttccgggtcgatcagtgcggcgcaggcgcggtttatactgcggtcgctcggcttttttaaggtagccatctcaccgattcagggttgattcatgcgtaacgatgctaaagacgacttcgacaacgttcccagcctgcgggccgacatcggggacgatgatgatttcgagccaagcccggccacgtcggtgcgctcgcgcaatatgcctgtggtcaaggtcaagagcgccagcaccggcccgttgtgggcgttggtcggtgcgctgctgatcgcctttgcgggccttgcctggtggagcttccagcagatttccctgatgggccagcaattggtcgccacccaggaaagttttgcgcgcatcagcgaggaagcggcggggcgcctgcaggacatttccggcaaggtggtggccagcgaagccaacgtgaacaacggcagtgaagcgctgaaattacagatcaagcagttggaagcgcagttgcaggagcaaggcaagcagcaggtcggcgtcgccggccaagccaccgaactggaccagcgcctggcacaaatgaccgccagcaccaccgacctgtcgaacgccaacagcaagctgcaaggccaggtgcaggcgctgaccgaggcggtggcaacgctcaaggcggcgcaaggtgaggtcaaggatctgtccgccgacgtggccgcgctgaagaaacagggcaacccaagcgccgcgattgcccgtatcgagcaagacctggtggtgctcaaaagcgcgcaggacagccagccggttaacagcgatgcgccgaccaataaagagttcgacgtgttccgcatccagaccacgcgcaatatcaccaccttgcagagccaggtgcagaacctgcaacaacaactcaacgcgcccgcgaagatcaggccgctggggcagtagtacacggacctgatcattcccacgctctgcgtgggaatgcatcccgtgacgctctgcgtcacccttgcgtggagcttaagccattcgtcgttttggtaaatgtcaccgcccagtgacatttcccatccccttcgttacttgcccccaacgcgcccttgtttagactcctgtcatcccataaaaaataataagggctacttatgaccacgcaaccactgcctgccagcagttggctgaacgcacctgcccatcacacctggcttgccaccgaaggccagcgcctgctggcattcgccaaggcctcgcgcctgccagacggctttggcaacctcgatgacaacggccaactcccggccgacgcccacgccgaaaccatgaacaccgcccgcatgacccacagcttcgccatggcccacgccatggggctgcccggttatgccgagctggtggcgcacggcgttgcggcgctcagtggcccgttgcgcgacagcgagcacggtggctggtttgctgcgcctcacgcgcttgatggcaaccgtggcaaggcggcttacctgcacgcattcgtcgccttggcggccagctcggccgtggtggccggcgcgcccggtgcgcaaaatctgttgaacgacgccgtgcacatcatcgaccagtttttctggagcgaggaagagggcgtcatgctcgaatcctttgcccaggactggacgggtatggaggcttatcgcggcgccaacagcaacatgcacgccaccgaggcgttcctggcgctggcggatgtcaccggtgatacgcgctggctggaccgcgcgctgcgtatcgtcgagcgggttatccacagccacgcagccggcaaccagtttatggttatcgagcatttcgacgcccactggaaaccgctgctcagctacaacgaagacaaccccgccgatggcttccgtccgtatggcatcacccccggccacggctttgagtgggcgcggctggtgctgcacctggaagccgcacgcctgcaagccgggctggccacgccggactggctggtaaccgacgcccaaggcttgttcgccagtgcctgcgaatacgcctgggcggtggacggtgctcccggcattgtctacaccctggactggaaccaccgcccggtggtgcgcgaacgcctgcattggacccacgccgaagcctgcgcggctgcccaggccttgctcaagcgtaccggtgagctgcattacgaaacctggtatcggcgcttctgggagttttgcgaaacccacttcatcgaccgtatccacggcagttggcatcacgaactcagcccgcacaaccagcccagcagcaagatctggggcggtaaaccggacctttatcacgcctggcaagcggtggtgctgcctgcgctacccttgtcacccagcatgaccagtgcgttaggtcggggcctttatgtcaccaagtggtgacatttgtacgtccctttgttacctgcgcccggaaaatccctgtttaaactccgtgcagcgcaagctctagacttgcatgcataacaacaagaaaaggtactcagatgaacgcgattaatcgcctcgccgtcgctatttccattgcctcgttgtttcccctcagtgcatttgccgccgactcgaaagggacggttgaagttgtgcattggtggacctccggcggtgaaaaagcggctgtagatgtcctgaaggcccaagttgagaaagacggcttcacctggaaagacggtgccgtcgcaggtggcggtggtgccacggccatgactgtgctgaaaagccgcgcagttgccggtaacccaccgggcgtggcccagatcaaaggccccgacatccaggagtgggcatcgactggcttgctcgacaccgacgtcctgaaacaagtgtccaaggacgagaagtgggactccctgctcgacaagaaagtctccgacaccgtgaagtacgaaggtgactacgtcgccgtaccggtcaatatccaccgcgtgaactggctgtggatcaacccggaagtcttcaagaaagccggtatcaccaaaaacccgaccaccctcgaagaattctacgcagccggcgacaagctgaaagccgcgggcttcattgcgctcgcccacggtggccagccttggcaggacagcaccgtattcgaagcggtggttctgtcggtaatgggcgccgatggctacaagaaagccctggtcgacctggataacggcgcgctgaccggcccggaaatggtcaaggccctgactgagctgaagaaagtcgcgacctacatggacgtcgacggcaaaggccaggactggaacctcgaagcaggcaaggtcatcaacggcaaggccggcatgcagatcatgggtgactgggccaagtccgaatggaccgccgccaagaaagtcgccggcaaggactacgagtgcgtagccttcccaggcaccgacaaagctttcacctacaacatcgactccctggcggtgttcaagcagaaagacaaaggcactgctgccggtcagcaggacatcgccaaagtcgtgctgggtgagaacttccagaaagtcttcagcatcaacaaaggctcgatcccggttcgtaccgacatgctcaatgaaatggacaagctcggtttcgattcctgtgcccagactgctgccaaggacttcctggctgacgccaagaccggcggcctgcagccaagcatggcgcacaacatggccaccaccctggctgtgcaaggtgcgttctttgatgtcgtgaccaactacatcaacgacccgaaagccgacccggccgacaccgccaagaaactcggcgctgcgatcaagtctgcgaagtaacggttagcacggctgatccttgtgaggggaaaccccctgacccctcacaaggtttgttcctgtagtcctttttccctgtactggattttcccatgagttctgttgctgtgttcagcaaggcctcgccgttcgatgcactgcagcgctggctccctaaactggtgctggcgcccagcatgttcatcgtgctggtgggcttctacggttacatcctgtggacgttcgttctgtcgttcaccaattccacgttcctgccaagctacaaatgggccggtcttgcgcaatatgcgcggttgttcgacaacgaccgctggtgggtagcgagcaagaacctggcggtttttggcgggatgtttatcggcatcaccctggtgattggcgtgaccctggcgatctttctcgaccagaaaatccgccgcgaaggctttatccgcaccatttacctgtacccgatggcgctctcgatgatcgttaccggtacggcctggaaatggctgctcaacccgggcatgggcctggacaaacttctgcgtgactggggctgggaaggcttccgcctcgactggctgatcgacccggaccgcgtggtgtactgcctggtgattgccgctgtgtggcaagcctcgggcttcatcatggcgatgttcctcgccggcctgcgtggcgttgatcaatcgatcattcgtgccgcccagatcgacggcgccagcctgccgcgcatctactggagcgtggtgctgccaagcctgcgtccggtgttcttcagtgcggtgatgatcctcgcgcacattgcgatcaagagcttcgacctggtcgcggcaatgaccgccggcggcccgggctactcctccgacctgcccgcgatgttcatgtactcgttcaccttcagtcgtggccagatgggcatgggctcggccagtgcaatcctgatgctcggcgcgatcctcgcgatcatcgtgccttacctgtactccgagctgaggaccaagcgtaatgactagtctcgcttccaaaccttccatcagcctgagtcgcgtcgcgatctacgcggtgctgatcctcgctgtgctgttgtacctggtgccgctggtggtgatgctgctgaccagctttaaaacaccggaagacatcagcaccggcaacctgctcagctggccgaccgtggtcaccggcatcggttgggtcaaggcctgggccactgttgacggttacttctggaactcgatcaagatcaccgttccggccgtgctgatctccaccgccatcggcgcgctgaacggctacgtgctgtcgttctggcgcttcaaaggctcgcagttgttcttcggcctgctgttgttcggctgcttcctgccgttccagacggtgttgctgccagcctcgttcaccctcggcaagatgggcctggccagcaccaccacgggcctggtgtttgtgcacgtggtctacgggttggcgtttactacactgttcttccgtaactactacgtgagcattcctgacgcgctgatcaaggcggcacgactggatggtgcaggctttttcaccatcttccgtcagatcattctgccgatgtcgaccccgatcatcatggtctgcctgatctggcagttcactcagatctggaacgacttcctgttcggtgtggtgttctccagcggcgactcgcagcccatcacggtggcgctgaacaacctggtcaacaccagcaccggggccaaggaatataacgtggatatggcggcggcgatgatcgccgggctgccgaccctgctggtctatgtgatcgcaggcaagtatttcgtgcgcggcctcacggccggcgcggtcaaggggtaatcatggctacgcttgaacttcgcaatgtaaacaagacctatggcgccggccttcccgacaccttgaagaacatcgaactgtcgatcaaagaaggcgagttcctgattctggtcggcccttcggggtgcggtaaatccacgctgatgaactgcatcgccgggcttgagaccatcaccggcggcgcgatcatgatcggcgaccaggacgtgagcggcatgagccccaaggaccgtgacatcgccatggtgttccagtcctacgcgctgtacccgaccatgagcgtgcgcgagaacatcgagttcggcctgaaaatccgcaagatggctcaggctgacatcgacgccgaagtggcgcgcgtggccaagctgctgcagatcgaacacctgctcaaccgcaagccgggccagctctccggtggccagcaacagcgtgtggcaatgggccgtgccctggcgcgtcggccgaagatctacctgttcgacgaaccgctgtccaacctcgacgccaagctgcgcgtcgagatgcgcaccgaaatgaagttgatgcatcagcgcctgaaaaccaccaccgtctacgtcacccacgatcagatcgaagcgatgaccctgggcgataaagtggcggtgatgaaggacggcattatccagcagttcggcacgccgaaagagatctacaacaacccggccaaccaattcgtggcgagctttatcggttcgccgccgatgaacttcgtgccgctgcgcctgcaacgcaaggacggtcgcctggtggcgctgctcgacagtggccaggcccgttgcgagctggcgcttaacgtgtcggacgccggccttgaggaccgcgacgtgatcctgggcctgcgcccggagcaaatcatgctggcggcgggtgaaggcgacagcgcgtcgagcattcgcgctgaggtgcaggtgaccgagccgaccggcccggacaccctggtgtttgtgcaactcaatgacaccaaggtctgctgccgcctggcacccgacgtggcaccgcaggtgggcgagaccctgaccctgcaattcgacccggccaaggtattgctgttcgacgccaaaaccggcgaacgcttgggcactgctgcatcattgcctgcacacgggcatgccgacaacgtggcccaattcaaaggccgctgaagcaggtaacctgttgttttagataaaaatgtaacccgcgttagataaaaacagtttaataacaataaagacgaggatgtagggatgaaaaagcaacacaacaacacccggctgctctgccaactgtcagcagcagcagccctggtattgtccgccaatgcgatggcggccgatgcattcagctccgattccaagtggatgacgggcgattggggcggcgagcggaccaagctcattgagcaaggtatcgacatcaaggctgactacgttggggaagtgggcgccaaccttcgcggcggctacaacgacgacaaaactgcccgttacgctgaccagtttggtctgggcgtagcactggatctgcaaaagctgtttggctgggataacacccaggccaagatccaactgaccaaccgtaatggcgcgaacatctccaatgaccgtattggtgacccgcgtgccagcaccttgagttcgtctcaagaagttgatggccgtggccacatggtgcgtctgacccagttctggatccagcaccagatgttcgacaacaaaatggacgtgaaactcggttacttcggtgaaggcgaagacttcaacaccttcccatgcgacttccagaacctgtcgttctgcggttcgcaagtgggtaactatgtaaacacctggtacaactggcctgtcagccaggcggcgatccgcgtgaagtacaacatcacgcctgagctgtacgcgcaaatcggtgcgtacaaccagaacccatcgcagctggagcacggcaacggcttcaagcttagcggcagcggcaccaagggcaccgtattgccggtggaattggtctggtcgccgaaggtcaatggcctgccgggcgaataccgtgtgggttactacaaaagtactgccgatgccaccgacgtacgtgaagacgtcaatggcggtgatgctggcaccaccggcgcagccttccgcgttcgcagcagcaaaagcggctactggggtgttctgcaacaacaactcaccacgcacaatggcgacgcttcccgcggtctgaacatcgcggccaacgtgaccttccacgacaaagacaccaacctggtcgacaactaccagtcgttgatgcttgtgtacaaagggccattcgacgcgcgtaccaaggatgacgtcggtatcggtgtgtcgcgtatccacgccaacagtgacgtgaagaaaaccgctgagttgctgaacgaggctaaaggtttcaccgattacgaccagtccggttatgcaccgctgcgtaacacggaatacaacgttgaactcaactacggcatccacgtcaccaattggctgaccgtgcgtcctaacctgcaatacatcgccaacccaggtggtgtgaaacaagtcgacaacgcggtagtggcgggcctgaaaattcagtctacgttctaacgctgttgcgataagctccttctctctgtgcgcattttgcgggtagccatggctatccgcttttttttgggtcgcgctgcactacccctgtgggagctggcttgcctgcgatgcgaacgatgcggtctgcctggatggccgaggcgatgccatcgcaggcaagccagctcccacagggtaaccaagcttgagcaacactgaatttcaggaccgtggcacatgcatgagcatccgctgcaacgctttttcaaatccctgcgcgagcaaccggtgttcgcctgggagcgctttcagatgcgtgacgtgttggtgattgaccatccgttgtgccaggcggtgttcagtcgccagggcgcgcaattgctgcactttcaaccgcgtggccagaaaccctggctgtggtgtgcggccaagtggccgcaagtcggcgccatccgtggtggtgtgccggtgtgctggccgtggtatgggcgccacccgagcgaaaacgcatggccgtcccatggctgggcgcggctgatcgactggaagctgctcgacagcagcgccgacgacgatggcgtacgcctgcactggcaattgcagctgtgcgactggcaggtcgacctgcacgcacaccttggcgaaaccctggaactgcgcctgtgcaccgagcatcaggacgagttgccgtgccagttgagtcatgctttgcacgcctattggcgtatcggcaatgtcggtgagatagcgctgtctgggctcgacggcgcgcaaggttatgaccagctcaatcgccaggtttgccagcaggaaggcgagctccgcgtggatggcggctgccagcgggtgttccagcatgacggggaattacaccttaaggatcatgcctggcagcgcgagctgtgcatcgacaccggtgacagcgccgacaccgtggtgtggcacccgggcagccgacctttgttgggcgtgagctttaacgaggcggcggggtttgtgtgcgtggagtcggcgatggccggggccagcttggcgccgggggagagggcgcatctgagtttgcaggcgagggctggggcatgatcgttcccacgctccgctgatcgttcccacgctccgcgtgggaatgccgccttggacgctctgcgtccgctcgtgacgcggagcgtcacaggatgcattcccacgcagagcgtgggaacgatctggaactagttaaactcatccccaaccggataccggctgtcattcaaactctctttgatcttgcgcaaatgcggctggaaatccacgccacggcgcaaggtcatgccggtggccagcacatccagcaccgtcagctggatgatccgcgacgtcatcggcatgtagatgtcggtgtcttccggcaacggaatgttcaagctcaccgtactggccttggccaatggcgaattctcggcagtcacgcccagcacagatgcaccgttttcccgcgctatacgcgccacttccaccagctcgcgggtacgcccggtgtaggaaataatcacgaacagctcgccggtgtgcgccaccgacgcgatcatgcgctgcatcagcacgtcggcatgggcggtgaccgccaggttgaagcggaagaacttgtgcagcgcatccatggccaccggcgccgaagcacccaggccgaagaagtggatctgccgcgcctggatcaacaggtccacggccttgctgatcagggccgggtccagggcctggcaggcgctgtccagcgaggcaatggcgctgccgaagatcttctgcgtgtacgcctcggggttatcatcggcttccacggcacggctgacatacgccgcaccactggccaaactttgcgccagctgcaatttaagttcagggtagccactgacgccgaatgaacggcagaagcggttgaccgtcggttcactgaccgaggcggcttgggcgagggcggcgatagagaagcgggtcgcctgctgtgggttgagcaggatgacctcggcgacttttttctcggccttgttcaattcttcgaggcggttccggatttgttccagaagatttcgcacgcggtccattcagtctttccttcgggcgacgatgcaaattaagggcggtagccaatcgacgagtggccctttgcggtggcctatcctactgagggtagctgaacaccaccactcggaatgcatattttgggaaaatgttgtggttattactacatttttccttgagtgatgccttgaaaaaaggtatttgtagcttaacttgataaaagaacaaacatcatgccttcgataaccgtagaaccctgcacctttgccctgtttggcgcgttgggtgatctggcgctgcgcaagttatttcctgccctctatcaactggacggcgcagggctcctgcacgacgacacgcgcatcctggccctggcccgtgaagccggttccgagcagcagcacctggcgcatatcgaaaaagaactgcgtaaatacgtcggcaaggaactcgacgaagccatcgcccagcgtttcctggcgcgcctgacctatgtacacgtcgacttcatgaaggctgacgactacgtggccctggctgaaatcgccggcaccgagcaacgcctgattgcctacttcgccaccccggcagcggtgtacggtgcgatctgcgagaacctgtccaaggtcggcctggcggaaaacacccgcgtcgtgctggaaaagccgattggctcggacctggaatcctcgcgcaaggtcaacgacgccgtggcgcagtttttcccggaaaaccgcacctaccgcatcgaccactacctgggcaaagagacggtccagaaccttattgcgctgcgtttcgccaacagcctgttcgaaacccagtggaaccagaattacatttcccacgtggaaatcaccgtggccgagcaggtcggtatcgaaggccgttggggttacttcgacaaggccggccagctgcgcgacatgatccagaaccacctgttgcagctgctttgcctgatcgccatggacccgccggccgacttgtccgccgacagcatccgtgacgagaaggtcaaggtgctcaaggccctggcgccgatcagcccggacggcctgaccacgcaagtggtgcgtggccagtacatcgccggttacagcgccggcaaggcagtgccgggttacctggaagaagagaattccaacacccagagcgacaccgaaaccttcgtcgccctgcgtgccgatattcgcaactggcgttgggccggggtgccgttctacctgcggaccggcaagcgcatgccgcaaaagctgtcgcagatcgtcatccacttcaaggagccgtcccactacatcttcgcccccgagcagcgcctgcagatcagcaacaaactgatcatccgcctgcagccggacgaaggtatttccttgcgcgtgatgaccaaggagcagggcctggacaagggcatgcaactgcgcagcggcccgctgcaactgaatttttccgacacctaccgcagcgcacgcatcccggatgcctacgagcggttgttgctggaagtgatgcgcggcaatcagaacctgtttgttcgcaaagatgaaatcgaagccgcgtggaagtggtgtgaccagttgatcgccgggtggaaaaaatccggtgatgcgcccaagccgtacgcggccgggtcgtgggggccgatgagctcgattgcactgatcacgcgggatgggaggtcgtggtatggcgatatctgaattgaaactgcctcagggcgtcactgcccatgagtaccgcacgcctgtgctgctggccgacggcctggccaatgacgtggccgagcaactgcgcgcggccatcagtgcacgcggcgaagcgaccctggtggtgtccggtggccgtagccccgtggcatttttccagaacctggccaagcaaggcctggactggtccaaggtcaccatcaccctcgccgacgagcgctgggtgccggtggaacacgccgacagcaatgccggcctgttgaagaagtacttgctgcaaggcccggccgccaaggccaagttcctcagcctgtacaacgttgccgcgaatcttgaagacgccgccgaactggccgatcgccagttggcagagttgcccgccattgatgtgctggtactcggcatgggcgatgacggccacaccgcatcgctgttccccaacagccccaacctgggcgaggcactgaaggccgacggcacccgccgttgctggccgatgctggcgccgaccgtgccgcaccagcgcctgaccatgagtcgcgcgttgctggccacggcccactacaccgtgctgtcgatttccggcagctcgaaattgaccaccttgagcgccgcgctggccagtgacgacgttgctgccatgccgattcgcgcgtttttgcaacctactttagagatttactggtgcccatgagccaaggatcagccgctatgaaaagccctcaaccgaccgtgtccatggcggataaagttgccctgatcgacagcctctgcgccaaggcgcggatcctgccggtcatcaccattgctcgcgaacaggacatcctgccgctggccgatgccctggcagcgggcggtttgaccgcattggaagtgaccctgcgttccgagttcggcctcaaggccattcaggtcctgcgtgagcagcgccctgaactgtgcaccggtgccggcaccgtgctcgaccgtcacatgctcgaagcggccgaagtggccggctcgcaattcatcgtcacccccggcattacccgcgacctgctggaagcctcggtgcacagcccgatccccctgctgccaggcatcagcaatgcctccggcatcatggaaggctacggcctgggctatcgccgcttcaagctgttcccggcggaagtgagcggcggcgtcgcggcgatcaaggcccttggcggcccgttcggcgaagtcaaattctgcccaaccggcggcgttggcccggccaacatcaagagctacatggcgttgaaaaacgtgatgtgcgtgggcggtagctggatgctagacccggaatgggtcaagaacggcgactgggcccgcatccaggaagtcaccgcacaggcgctggcgctgctggactgagctgatttatcgaatcgttgttgctgtgcttaacggcatttttgcggtgcacttggtcggtgtaccgcttttttttgcctgtaaaaaaccacacatccaaagctgggaaacggcttgtgtgggagctggcttgcctgcgatggcggtgggtcagcctgggatgtagttactgatacaccgctatcgcaggcaagccagctcccacagttttaatcgttgttcagttcggttatagcgttgaccagcacatcgatatccgccgccgatgtcaccagccccggcgtcacccgaatacaggtgccaaacgccgcacccgttcgcgtggtggtaaacaggccgtaatcctcgagcaaccgatccgccatcacctgctgatcgcgcccaacaaacttgaacgccgtaatcccgcaatacaggcgtggatcgtccggggtgagtacttctattcccggcatctgccgcacccggctcacccacagatcgcgcaggtaattgacccgcgcgcctttggcggccgagccacccaaggcgcgatgttcttccagcaccagcggcaaggtcatcagcgccggaaagttcggcgtgctatagggcgtgcgtgcgcgtacgtcggtggctgggtagtgaaactcgcccatgtccgggtcgatatccgcaaggcgctccggggcgatgtacaaaaagcccagcgtcagcggcgcaccgatccatttatgcaggttgaagcccgcaaactgaatgcccagctgcgcgaggttgaattcgatctggcccagggcgtgggcgccatcgaggatcacatcaacgccatgctcgcgcgcggccttggcaatcgcctcaaccggcatcaccaagcctgtgcgatgggtcacatgggtcagggccatcagcttgaggcgtgggtactgggcgaatgtattgcgataagtctgcagcaggctgtcgaaactggccgggtgagtgtgggaaatctcaataacctcaacaccgcgacagcccgccaaccagcgcatcgcgcctttgaccgtgtcgtactccaggtcgctgatcagcacctgatggccgggttgcaggcaattgtagttacggatgagtgattgcaaagcctcggtggcgttgcgggtgaaggcgatcgcttcggggtcggcatcaatcagggccgccagttggcgacgaatctcgacgttttcaccctgctcaaagcgctggcgcacatacagcgagttgctgcggttgataaacgcaacatgctccaggtactgcgcacggaccgcgcggctcatgcgcccgaaatagccgttttccaggttgaccggcccgggctccaactcatagcgctgggcaatggcttgccagtgattttcgttatcagcattccttggcatggcgtgggctcttaatggcgaggggcgggtttgccgtgtttggcgcgcagtggttccagcagttcggacaggccgttgtggtcgatttcctgcatcaacgccagcaacccgcccagctcgccgtgggggaaaccttcacgggcaaaccaattcaggtaagggccgggcaggtcggcgatgatccgccccttgtatttgccgaaaggcatttcgcgggtgatcagcagttcgagtttttcggggttcatggcgcttcagtgaggtaagtcgaggtcttcgaaaatacaggcattctgcatgaaggccaaatgacagatcatgcaaataacgtacatacagatggttcaatattttataagtcattgaaaaataacgaatagtttgtttttcaaaacttggcacgggcgctgcaatcattaaggtaagtttcttaacccgcacaaggaattgaaaaatgactgacatcaataaagaatcgatctccgtacttaacgacctgatcgagaccagcaaagacggccagaaaggcttcgccacgtgtgctgaagacatcaagcacccagagctgaaagccctgttcgtaaaacgctccaccgactgcgctaccgcagctgccgaactgcaaactgcagtgagagcgctgggcggcgatccggaagaatccggttcggttgcgggtgcgctgcaccgtggctgggtcgacgtgaagtcgctggttaccggcaaagatgaagaggccgtgttgaacgaagccgagcgcggtgaagaccacgcactgaaggcttacaaagaagcgatcgagaagatcaacaagcacaacctgctgggtattcgtgacctggttgagcgtcagttccacggcgcacagcgcaaccacgaccaggtgaaagccctgcgtaaccaggctcgcgctcagtcgtaagacctgctgtgtaacaaatgtgggagcgggcttgcccgcgaagacagtgtgtcagccaacctccatggtggctgttacaccgctttcgcgggcaagcccgctcccacattttgcgttgtgcagaatttgagatctgatcagccgatgctgataggtggcagctcagtcagcgtcaccacttgctgcttgcgtggcgccagaatttccgcctcgccatccaccaccaactcgtcgcgctgattgaacacacgtgtggcaatacgcacgcgaaacttcggcagcttctcgagaatttccagacgcacggtcagcgtgtcgccgatttttaccggcttctggaagctcatctgctggccgatatagatagtgcccggcccaggcaattcgcaggcaacggccgcgctgatcagggcgccgctgaacatgccgtgggcgatacgctccttgaacatggtcgccttggcgtactcggcatccaggtgcaccgggttgtggtcgccggacatggcggcgaacaactggatatcgcgctcctcaacggtcttgctgtagctggcggtctggccgacttcgagggcttcgtacggggtgttggtaacctgagtcatctaaaggtgcatcctgtggctaatcggtaattaattaactatctgattctaaacgaaaaattactcgcagcgagtcggcctgcgcaatgtcaaagcctgctcgagccacgccagtacatcggcggtgacttcatcacgattggtctcgttgaacacttcatggcgtgcttgcgggtagatattcaattgcaggtgctggcagccggcctcacgtaatgcgtgggccaggcttttgagacgcttgccttcactcaccggatcacattccccgcccatcactaaaatcggcaggcccgggtcgatctgcgcgagattggacgctttactgatttgctgcaagccgcccagcaggtcgacccacagctggttggtgcaacggaaaccgcagagtgggtcgttgatgtagtggtcgacctcatccgggtcgcggctgagccagtcaaacgcggtgcgattgggtttgaatgccttgttgaacgagccgaacgataaaaaatcgatcagcgcactgcgcccgcgcagcccctggcgtgcgcgttcgatccgcgcaatcagcgcggcggcgcggtacagcgcaatcggctggaaattcgagccactgagaatcgcgccattcaagctggcgctgtggtgcagcaggtaggcctgggcgatgtagctgcccatgctgtggcccagcagaatgatcggcagccccggttgctgctggccgatgtgctggttgaggctggccaggtcgccgaccactttgttccagccatctttttcggcgtacagccccagcgtcccttcgtcagccgttcggccgtggccgcgctggtccagcgcgtacaggccgtagccggctgcgcacagggcttcagccaggcgcgcatagcggccactgtgctcggccatgccgtgggacaacatgatcatggccttggcctggccttccggcagccattgattgacgtacaggcggctgcggtcattcgcggtcagccagaaggtgctgtggttcatggcgcttcctttgctcagggtcgttgcagtgtatagctcatctgccaggggctggtgtatctgcctacacgttaggggcaagattcatacaataaatgacacagttggatgtatttgcctgtttggccatagctgctaacgtccccaaagctccgctttttatagatgcgtttttataactgcagcggtcggacatactcaggtaagaggacaagaataatgcaacctgatttctggaatgacaaacgcgcggcgggcgttcccaatgacatcgacctcaccacgtacaagtcggtgatcgaagtcttcgaacggtcctgcaaggcctttgccgaccgtccggcgttcagcaacatgggcatcaccctgacctacgccgagcttgagcgccaaagtgcggcgttcgccggttacctgcagcagcacaccgacctaaagccgggcgagcgcatcgcggtgcagatgcccaacgtgctgcattacccgattgcggtgttcggcgctctgcgcgccgggctcatcgtggtcaacaccaacccgctgtacaccccgcgcgagatgcgccaccaattcaaggatgccggcattcgcgcgctggtctacctcaacctgttcggttcgcgggtgcaggaagtgtgcgccgacaccgagatcgactacctgatcgaagccaggatgggcgacttcatgcccgccgccaaaggctggctgatcaacaccgtggtcgacaaagtcaagaagatggtcccggcctacagcctgccacgtgctgtgtcgttcaaacgcgccttgcgcatgggcgcggggcagggcctgacccggcatccggtgacactggacgatatcgccgtgctgcaatacaccggcggcaccaccggcctggccaagggcgcgatgctcacccacggtaacctggtcgccaatatgcagcaggcgcgggcgtgcatgtcccaggtcagcgacaccggccagccgctgataaaggaagggcaggaggtgatgatcgcgccactgccgctgtaccacatctatgccttcacggcgaactgcatgtgcatgatggtgaccggcaaccacaacgtgctgatcaccaacccgcgcgacatcggcggctttatcaaagagctgaaaaagtggcggttctcctgcctgctggggttgaacacgttgttcgtggcgctgatggaccacccggatttcaagaccctggatttttcccacctcaagatcaccaactccggcggcacagcgctgatcaaggccacggccgagcgctggaaggccttgaccggttgctccatcggcgagggctatggcctgaccgaaacctcgccggtggccagcaccaacccgtacggcagccagtcgcggttgggcaccgtcggtattccggtgccgggcaccgcgatgaaagtcatcgatgatgaagggcgtgagttgcccttgggcgagcgcggcgagctgtgcatcaaaggcccgcaggtcatgaagggctactggcagcagccggtcgcgactgccgagaccctggacgccgaaggctggctgaaaaccggcgacatcgcggtgatcgacaccgatggctttgtgagcattgtcgatcgcaagaaagacctgatcatcgtctctggctttaacgtgtaccccaacgagatcgaagacgtggtgatggcgcacccggcggtggccaactgcgccgtgatcggcgtgccggatgagcgcaccggggaggcggtgaagctgtttgtggtagcgcgcacgcaaggtgtgagccttgaagagctgaaggcgtactgcaagaccaacttcaccggctacaaggtgcccaagcacattgtgttgcgtgattcgttgccgatgacgccggtgggcaagattctgcgcagggagcttcgcgacatcgcctgataggaaatacgcttaaaaaatgtgggagctggcttgcctgcgatagcgatgttccagtcactggatgtattgactgttagaacgcaatcgcaggcaagccagctcccacattgttgtctgttgatctgtaaggcccattccagagcgttttgctgggggattttaccctggtttaaagtgtgaccaaatattgtaggacagtcatgattatgactgtagggccctcttttggctctaggcggcccttggcaaagctgctactctcggcgcgctttgtgacttctcggcctgcttgaaagcgccagactcacctaaaaaaacatacaccaataataatcgcatcaaatgcgatgatgaattcgcgtcgctgaggagtgggcttccatgaacgaagacttttggaaggataagtaccccgccgggattgctgcagacatcaatccagacgagtatcagaatattcaggcggtactgaaacagtcctgccagcgcttcgccgacaaaccggctttcagcaacctgggcaaaaccatcacctacggtgagctgtacgaattgtccggcgccttcgccgcctacctgcaacaacataccgacttgaagcctggcgatcgaatcgccgtgcaactgcccaacgtcctgcaatacccggttgccgtgttcggcgccatccgtgcgggcctgatcgtggtcaacaccaacccgctgtacaccgcgcgggaaatggaacaccaattcaatgattccggggccaaggccctggtttgcctggcgaacatggcgcacctggctgaaaaagtcgtgcccaagaccgccgtcaagcacgtgatcgtcaccgaagtcgctgacctgttgtcgccgttcaagcgcctgctgatcaacagcgtcatcaagtacgtgaagaagatggtcccggcgtatcacttgcccaaggcgatcaagttcaacgacgtgctggccaaggggcacggccaaccggtcaacgatgccagcccggccagcggcgatgtcgccgtgctgcaatacaccggcggcaccaccggcgtggccaagggcgcgatgctcacccaccgcaacctggtcgccaacatgctgcagtgcaaggcgctgatgggctccaacctcaatgaaggttgcgagatcctgatcacgccgctgccgctgtaccacatctatgccttcacctttcattgcatggcgatgatgctgatcggcaaccacaacatcctgatcagcaacccgcgcgacttgccggcgatggtcaaggaactgtcgaagtggaagttcagcggctttgtcggcttgaacacattgttcgtggcgctgtgcaacaacgaaggcttccgcaagctggacttctccgcactgaaggtcaccctgtcgggcggcatggcgttgcagttggcagccgccgagcgttggaaagacgtgaccggctgcaacatctgcgaaggctacggcatgaccgaaaccagcccggtggcgacggtcaacccgatccagaatatccagatcggcaccatcggcattccggtgccgtcgaccgtgtgcaaagtcatcaccgatgacggcgtcgagctggccctgggcgagatcggcgagctgtgcgtcaaaggcccgcaagtgatgaaaggctactggcagcgcgaagacgccaccgccgagatcctcgacagcgaaggctggttgaagaccggtgacatcgcgatcatccagcccgacggctacatgcgcattgtcgaccgcaagaaagacatgattctggtctccggtttcaacgtttaccccaacgaactggaagacgtgctggcgggcctgccgggcgtgctgcaatgtgcggccatcggcgtgccggatgacaaatccggggagcacatcaagctcttcatcgtggtcaagccaggcgcaaccctgaccaaggaccaggtgatggaacacatgcgcgccaacgtcaccggctacaaggtgcccaaggccgttgagttccgcgatgcgctgccgaccaccaacgtgggcaagatcctgcggcgtgagttgcgcgatgaagaattgaagaagttgggcctgaaaaagtaacccataaaaaaccccgcgagtgcggggttttttaatgcctgtcgctggcgaaacactgccttctgtgggagcgggcttgcctgcgatagcggtgtaccagttacagttgtgcaagctgacccaccgctatcgcaggcaagccagctcccaccttttttaatcgcgttgttacagggcaaactgcgcgaagctcaccccggcacccgtcgggcgcacatccttcaggaacgaatccttgtccgcactcaactccagggtgatctccggcttgcgcttgcccgcattacgcaccaccaagccttcgagtttttcacgcagataggccgtcggcaccttcaagtgcagcagctggtcggactcggcgttgtgcatcaacaggtgaatccactcgtactggcccacggcaatacggcccaccggcaggtcgaaccaccagatgttgcgcttgcggtccaggtcggtgaagtggcagttgttgacgccgagtacggcaccgcccagttccaggtttctgcgggcaatggcctgtgctttattgagtttcataaccttcctacgggatctgttattcagcgttatagcctgaatgtgccgggcattctcgtgggttggctgcaaaacataaagccaaacctgcagacggcgatgaaatgcccgctgaaaaataattgaaactctgccgaacggcctcgggtcaatctctacgtaatgaccaaaaacctcgattgttccaggagaaataccatgagcagcacatcggataaggcaaaaggtttgaaagacgagctcgttggcaacgtcaagcaaggtgttggcaaagtcaccggtaacgacaagctgcgcgctgaaggcgtagtgcaagagaagaaaggccaggttgaaaaagcagtaggcgataccaaggacgcggtaaagaaagcgaccaagtaagcctgcctgtgcgcagccaaacggccatccacggatggccgtttttatgtcgtagcttgcaactaaaatctggtaattgtttcaaagtcgccaagtaggctacttttgatgtagaaaacggcccctgagtcgcccacgacctcaacccttttgcggcgaaaggagacgctatgatttttccggtattgcaaggcttgccactgcacaaagtgctggtgcgcaccgtcacggaattcgtcgatgacgaaatgcctacctatgcctcggcactggcctaccagatgctgttctcgttgtttcccttcctgttgttccttattgccctgatcggttttctgcacctgccggacttctttacctggctgcgcatgcagtcggaactggtgttgccgccccaggcgctggagcaggtcaacccggtgatcgaccagttgcagcaatccaagggtggcttgctgtccgtcggtatcgtgattgcgttgtggaccgcctccgccggtgtacgcctgatgatgagcgcgatgaacgccgcgtatgacgtcgtcgaaggccggccaatctggaagcgcttcccgctgtcggtgttctacaccatcggcattgccggcatgctgctggccgccgccgcattgatggtgctcggcccgcaagtgatggaatggctcgccgggcagatcggcatgcaggaattcgtggtcaccttatggaccatcctgcgctggccgctgatcgtgattctgctgatgtttgccgtggccctcatgtactacgtgatgcctgatgtggagcagaaattccgcttcatcaccccaggctcggtactggccgtggtggtgtggatcatcgcctccctgggttttggctactacgtcaaaaccttcgccgactacaacgccatgtatggcagtatcggtgcgatcatcgtcctgctcctgtacttctatatttccgccgccgtattgctgctgggcgcggaaatgaatgccgtgatcgaacacatgtcggcggaaggcaaggacccaggggaaaaggagtttgacgagcattcggatacgaatgaaaaacagcacgtctcaggcctcggccgagaccactccaagcccttaactgacgaagtctgatcgatgatccgtgaaatcctgaaaatgggcgacgagcgcctgctgcgcattgcacccccggttccgcctgagatgttcgacagccctgagctgtggcaattgattgatgacatgttccagaccatggaacacgtcggcggcgtcggcctggccgcaccgcaaatcggtgttgacctgcaactggtgatctttggttttgaggccagtgaacgctacccggacgcgccgccggtgccgcagaccatcctgatcaacccgttgatcacgccgctcagcccggtgctggaagaaggctatgaaggctgcctgtccgtgcccggcctgcgtggcgcggtggaccgttatcagcagattcgctacgagggtttcgaccccaagggcgaaccgattgtgcgcatcgccgaaggcttccacgcgcgggtggtgcagcatgaatgcgatcacctgatcggccggttgtacccgtcgcggatcaccgacttcagcaagttcgggtttatcgaagtgatgtttccggacatggatccgaacgcggacgcatagtccccaggcacactggaattaacctgtgggagctggcttgcctgcgatagcggtgtaacagtcacagttgtgttggctgacccaccgctatcgcaggcaagccagctcccacatggtgtctgcgttaactcagactattttgccggtttaacaaaccgcaacgtcatccgatccgactccccaatcgccaaatacttggccttgtcctgctcacccaacttcaacgccggcggcaacgtccacaccccacccggataatccttggtgtccttcgggttggcgttcacctcgctttgccccgccagcttgaacccggcgtccgtcgccagcttcaccacctgcgcggtggtcaggtaaccactgtccttgatggcttgcagatccgccccgtccttggcgcggtgatcttcgacgcccagcaccccgccgggcttgagcaccgtgtagaacgcgctgaaggtcgccggtgcggtgcccgcgtcaacccagttatgcacattgcggaaggtcagcacgctgtccgccgaagccggtttgccgaacaccggagccttggggtcgaattccaccacttgagtcttggcataacgcgcagggtcggcggcgaatttctttttcaggttctgttcggacgtcgcggcgtaagcgctgctgctcgcggcctgcacggcggcgatgtaatgcccgtggtccttgagcagcggcgccagcacttcgctgtaccagccgccgcccggggtgatctcgatgaccgtctgcctggcgctcaaaccaaagaattccaacgtctgctgcgggtggcgatagccgtcacgcgcgctgttggccgggtcgcgccaactgccggcgagcacgctggcgtactgcttggcgctgatcggcgcgtcggctgcctggctgaacgtgggagcgaggagggcggtgagggacagagctgcaagcgtcgttttcatgatcatccggtaagaggccactgtgccgtcgaggctagcatgggcgttcgaccggccgatcacacattatccgaggtcgacctttgcgttggttataagccccatcgcaatcattggcttgttacgtttgtagcgcaccagccgttcgctgagggactgcggcagcaccgtgtcttgagtgaaccccatgcgctgatacaccgcttccaaatccggatggcacagcagccagaccgtcccttccacgtcagcgaccgcctgctgaatcaagcgcgccgccaacccttggccgcgatacgccgggtcgacaaacacaccggtcagccactgcccgcccaccaccgggctcaggcacaacccggccacaatctcgccgtcgcgcgccacccataaacgcccacctttgatggccttcatcgacgaatcatggctacgataaaacttgttcagcagcggccacagcggctctgccagcggttcgatgtgcagttcgggcatgctcttcaggccagcggtttcaagggccgagaattataagcgcgttgtgcggggcaataggtggtatacccagtgttacatccccttcagttgagcatgcatcatggccaaaggtatggattcaaagaaagccgcgaagaagaaaccggcaaaaaccgccgatgaaaaacgcgccgacaagaaagccaagaaaaccgagacaggcctgttcggtcactgagttacaagcttagaaccaaacgatctgcaagattttcgggtctcgctgcacagagcaggaaacacctgctctgagctgccgatggccaactaccttgatctgacccaacgccgggaaatcgaagccctggcgcacagttttactgccagaaccgaatggccgacctggctcctgctgatcggcgtgtatgccggctggttcagcgtgatgctcgccagccattggctgggcgtgtggttgagtacgctgttgctgattccgttggtgacgctgtggctgtcggtgcaacacgaattgctgcacggccatcccacccgctcccttctcgtaaacaaactgctcggctatgcaccgtttgccgtgtggtatccctacacgctgtaccgcgacagccatttgttgcaccacaacgatgaagacctgacgctgccgggcatcgacccggaaagccgctacctcaatcaatcccaatgggacaacagcgcgctgtttaaacgcggcgtgcattggctgaccaaaaccgtattgggccgcttcctgctggccgcgcctttggcgattggccgcctgacccgccatgagtttcgacgcctgccacaggtgtggccgatgtgggtgtgccacggcgccgtgaccctgctgatgctcagctttatcgcccactacagcgccttgccggtgtggcattacctgctgctggtcaccgcgccggccttgtccctggcgtcgatccgttcctactatgaacaccgcccgcacctgcagccggaacaacgcaccgtcctcaacgaagcgtcctggccgtggacctggctgttcctcaataacaacctgcacctggtgcaccacgacttgccgaaactgccctggtacttgctgcccacggtctaccacgcgcgccgcgaacaatgggtggcgcgcagcggtggtttcctggtgcagggttacggccagttgatcagccgccacggcctcaaggccatcgacagcccccggcacccttttgcatgagagacgaccatgagtgaacactacgccgagttgctgatgtacgtggcccccgaagcggtgcaacaggccaatcaacagtggctggcgcgtatcttcgagcgcttgaacttgacccgccgcaacgctgaccacctcgacctgcacggcctgtggctggcgcccgaactgctcgtcacgcaaacctgcggctacccgctgatgacccaactgcgcggccaggtgcgcgtgattggtcgcccacgctacgagctggcccacagcagcaacggcgagcattgcagcctgctgctgacccgcgacgacaacccgcgcgtcgccctggccgacttctacaacagccgcggcgtgatcaacggctacgactccaacagcggcatgaacctgctgcgcgaacgccttgcgccattgcagcgcgacgggcgtttcttcgccagcgtcggcagcagcggcgcccaccgcgaaagcctgcgctggctgcgcgaaaacctcgccgacctcgccgccatcgacagcgtcacctacgactacctcgcgcggttcgccccgcaggaaggggcggggctgcgcatcgtcacccacagcgcgccgagcccaaccttgccctacatcgggccgctgcagttgagcgacgaacaggtgctccggattcgtgaggcgatgaacctggcgttgcaggacttgccgcaggtcgtcgaaaccctgggtatccaggaagtcctgcccgccagcgaagacaactatcaggttctgctggcctaccagcaacacgccgccaacaccggctacgccgacctgcgctgatcgttcccacgctctgcgtggaaacgcctcccgtgacgctccgcgtcacgctttcaaacgctgacgcagagcgtcagggcctacattcccacgcagagcgtaggaatgatcggttatataaaaataccttttaaatattattaaagaataagcagccttgctaggatcgctccaccggaacaccggacataacgcgcaacctactcaaatggagccactatgtccggcgccgacacttctcacagcgattacgtgggcggactgttccgcagtcattacgactggctgtgcagccgtttgcaccgccacctcgattcgcgtgcacacgccgaagacatcgccgccgacaccttcgtccaactgctgagttcgccgggcgtgctgccgatccgtcagccccgtgccttgctcaccaccatcgcccaacgcctgatgtaccagctgtggcgccggcgtgacctggagcgtgcctacctcgacgccctggacaacgacgaaacctgcaccgcgccgtctcccgaggacctggcgcaaatgcttgaagcgctgcaggccatcgaccaactgctcgacggcttgccggccaaggtcaaggcgaccttcctgctgtcgcaactcaatggcctgacctaccccgagatcgccgccgaactggggatttcccagcggtcggtcagcgactacatggcccgcgccctcaaccgttgcctgcggctgtgcctggaatgaacgacgaactgatcaacagcgccacgcgctggtacgtgctgctgcgctcgggggacgccacggcggcggactggcagcgctatcaccaatggcgcgccgccgacccgcgtcatgacgccttgtgccagcaattggaaacgcgcctgggcgtgttccaggtgccactcggccagggcgtcagcggcaaagtcttgcagcaggcgctggatgcgcccgccagtcggcggcatgtgttgcagatcgcgttggcgggcgcgggcgtggccataggcgccgcgctgctgagcaaacctttgggcctcagcgagctgacggcggatatccgcaccggcaccggcgagcgtcgcaccgtcgcgctggccgatggcagcgagttgctgctcaacgcgcaaagcgcggcggatatccagttcgacccgcaacggcgcctggtgcgcctgcgcgaaggcgagttgctggccaaggttgccagtgatcgcaaccgaccctttttgatccagaccgaccaggcgcaattgcgcgcctacggcaaccgcttgctgctgcgcgaacgcgaagggcagggccaggtcgtcgcccttaatggcgctgtgcaaatcgacagccacggcggcgagcgcctgcaactcgccgccgggcatgcagtgcattacgaccgcgccgggttcggcccggtacaggccagctccgccagcgccaccgcgtgggtcgacggcttcctgcaagtgcgcgaccgcccgctggcggaagtcatcgacgcattgcggccctatcacagtggcgtattgcgcctggatccgtcagtcgccggcctgcgcgtcagcggcctgtatcggctggacaacccgcagcaaatcctcgacaccctggcgcgcaccttgccgatccacatcacccgccgcaccggcctgtgggtgacggtcagtgccacatgacttgtgcaactactcggtcaaatgtgggagcgggcttgctcgcgaaagcggcgtgccagcttgcacattcatcaatgacccaccgccttcgcgagcaagcccgctcccacactaattgggttaccactccaagatcaggagtgggttctaagtacataaccaaacgatctgcaagttttgcccccaccaacccacatcactcccgtaagcgctgcggggagcagcgttctcgagtttccttggggggagccaaagtgagtcagttcaaccgtgtgccgcttcgaacctttgccctggtgccgttggccagcctgtttttgtcgtttgccgccagcgccgaagacgcgcgccaggtctaccacatcgccccaggcccgctggatgaagtgctgctgaacatcagccgccaaagcggccaagtgatctcctttacgccgcaactgggcaattattcctcggccacagtcgacggttcgctgtcggcgcatcaggcggtggacgccgcgctcaagggtaccggcctgcaagtgcacgtcagcccggacggtgcgttcatcatcaaggaaggcgcagccaatggcgccaccagcagcgtcaaggcgcagaccagcgccgcgcaggcgccgaccctcgaccgcgtggtcgccatcggcacccggcgcagcaacgccaccgcgctgaccagcagcgccccggtcgacgtgatcaacgccgaagaactcaagcaaaccggcgccaccagcctcaaccaggcgttgttccagctgctgccgtcgttcaactttccgcagaacaacagcgccacccgtgggcaagatcccaagggcgcttcgttgcgtggcctgtcgcctgaccagacgctggtgctgatcaatggcaagcgccgccacacctcggcggtggtgaatatttccggcggtgtgccgtttattggcgcccagccggtcgacctcgacatgatccccatcagcgccatcgaccacgtcgaagtgctgcgtgatggcgcctcggcgcagtacggttccgacgcggtggccggggtggtcaacatcgtgctcaaggagcgcgacagcggtggcggcgtcaatacgcaactgggcaaatacgcccagggcgacggcttcagcaaaaccaccgatggctggtacggcattggcctgccgggcgacggcttcctgaccctgagcttcaacaccctgaacaacaagcccgacgacattggcgacacgtacgtcgccgacggccgcgtgcaagacccacgctggggcggcgccgggcgcgacaaatacaacctggcggccaacgccgagatcggccttaacgaccaatggcgcgtctacagcttcgccaccttcggccaggacacctcggtgaacaacacgccgccgctgctggccagcagcccgaacaacgtcgcgtcgatctaccccggcggcacgattcccaagtaccgctatcgctacgaagacggcgccattaccctcggcacacgctatgaagacgacagcattggccgcttcgacctgagcgccacctatggtcgcgacgagcacgacgagctggccttcaacacggtcaacccgagctacggcgccaacagcccgaccaagttcaacgtcgcgaccttggtcaacgaccagaccaacatcaccctcgattacgccaaggatttggacgtgaattggtccagccacccgctgaccgtctcggcgggcgtggcctatcggcacgagcaatatcgcctcgaagccggcgactacgactcctattcctacggcggtatcgatggcgtgcaggtcggcgcagtgcaagcctccggcctgaccccggacgatgccggtacgtttaaacgtgatgtgggcggcgtgtatttcggcctcgaaaaccaggtcaccgacaagctgcaagtcggcgtggccgggcgcaccgagcactactcggacttcggctcggccaccaccggcaagctctcggcgcggtatgacttcaccccgcaagtgggcgtgcgcgccacggtcaacaacgcgtatcacgcgccgagcctggggcagatcggcacctcgtggaccaccaccaccaacctcgatgccaacggcaacccggtgctgacgcgcatgctgccggccgacaacccggcggcgcgtgccctcggcgcgcaaccgctcaagccggagaagtcgaccaactactcgttgggcctagtgctgcgaccggccgaaaatgcctcgctgaccatcgacgcctatcaaatctcgattcgtgatcgcctgctgttcagcggcggcatctccgggccgctggccgagcagatcctcaccaatgccggctacggcctgtactcctgggcgcagttcatgaccaacgccgccgacacccgcacccgtggtgtcgacatcgtcggcaagtacaacctggacctcgcgcagttcggtgacctggcgctgtcggccggctataccaaggcgcgcaccacgattgagaaagtccacgaaaaccccaacggtttcgaagtgctgacccgcgaagcccgtggctttatcgagcacggctaccccgaggacaaactggtgttcggcgcggtgcacaggctcaaccaatggaccatcgccctcaaccaaacgcgctatggcaaataccgcaaatacgcggccagcgagaccaacgcgcagtacgaccaagtcttcagcgcgcaatggaccaccgacctcgacgtgaactacgccttcacccagcaactgcgcgtgtcggtgggcgtgaacaacctgttcgacagcaaacccgacgacttcaacagccgcctgcgccagacgccgggccagcaatacagctacctgtcaccgaccgcgccggaaggggcgttttactacacgcggctcagttatgacttttaacccgctcaccgatcgttcccgcgctctgcgtgggaatgcctcttgtgacgatctgcgtcacctgttggacgcagagcgtccggggctgcattcccacgcggagcgtgggaacgatcatcaccacgaggttctgcatgaaaacaattaaaaacctgctcggtggctcgctgctggcactcgctgtcctgacccagccaacccaggccgccgaagccgtcaaaccgatccacttcggcgacatcacctgggaaagcggcagcctgatcaccgaagtgctgcgcctgatcgtcgagaaaggctacggcctgcccaccgacaccttgcccggcagcaccgtgagcctggaagctgcgctggccaaggacgacatccaagtgatcggcgaagaatgggccgggcgcagtccggcgtgggtcaaggcggaaggcgaaggcaaagtgttcggcctgggcgacaccgtcaagggcgccaccgaaggctggtgggtgccggaatacgtgatcaagggcgacgccgagcgcggtatcaaacccctggcgccggaactcaaatcggtggccgacctgtcgcgctacaaggacgtgttccgcgaccccgaagacccaagcaaaggccgcttcctcaacagccccaccggctggacctcggaaatcgtcaacagccagaagctcaaggcctatggcctgaccgacaccttcgtcaacttccgcaccggctccggcgcggcgctggacgccgaagtggcctcgtcgatccgccgcggcaaaccggtgctgttctactactggtcgccgaccccgctgctcggccgcttcaagctgatcaaactggaagagccgccgttcaacgccgaagcctggaaaaccctggccgacgccaataacccgcaccccatcggcacccgctcgatgcccgcgcacttggcgattggcgtgtcggcgccgttcaaggcgcagtacccgcaactggtgactttctttgaaaaagtcgaccttccaatcgacctgctcaacggcatcctcgcgcagatgagcgagaagcgtgagcagccgcgccaagtcgcgctgtcgttcctcaaagagcagccgcaagtctggcagcaatgggtgccggcggacgtggcggccaaagtcaaagccgccctataaccgatcgttcccacgcgcagcaaaggaacgccacaagggacgctccgcgtcccgctctcacaggatgcatccccacgctgagcgtgggaacgatcagaggtgacacagatggttaagtttttcagcgtgatcctggcttcaatggtgttttcggcagcggtttcagccgccgaaccttccaccttgcgcatcggctaccagaaaagctcggtgagcatggtgctggcccgcgagcacaagttgttcgaagaggcgctgcccggcacccaagtgcaatggatcgaattcctcggtggcccaccgctgatcgaggcgctgaacggcggcagcctggacatcggcaatatcggcgacatcccgccgatcttcgcccaggctgccggcattgatttgcagtacttcgcggtcgagccgaatgagggcaagaccgaggcggtgctggtgcctaaagccagcccgatccagagcgtggccgaactcaagggcaagcgcgtcgcgctgctcaagggttccagcgcgcataacctgttcctcaagagcctgctgcgcgccggtttgcagtggaaggatgtcgacgtggtgtacctgtcgccgtccgacgggcgtgccgcgtttgagcagggcaaagtcgacgcgtgggtggtgtgggacccttactactcggcggccgtggtcgacggttctgcccgtgtactgggtgacggccaaggcctcaacccggcgggcagtttctttgtggtcagcagcccgtttgccaagcagcacccgcacgcggtcggcgcgatcatcaagaccctggccaaggcgcagcgcctgtccctggaccaacccgagcaaagcatcgccttgatggccaagaccctgggcctgccaccggcggtggtcaaaagctacttcgagcaccgctcaccggcgccgattcgcccgttggaggcagtggatattgccaaccagcaacgcaccgccgacctgttttttgccaatcgcctgatcccgaaaaaggtcgatgtgcagcagatcgtgttcaaggccccgtaggcacaacccctgtggagagcgggattgttgtggcgagcgggcttgccccgcgttgggctgcgcagcagccccaaaaccatccgctgcggtgtgtcagggggaacgcggtcgtctggaatggggccgcttcgcagcccaacgcggggcaagcccgctcgccacaggaagccccgctgtcacaagttacagcgtcccaccgactttaatcagtgagcagaccatgcaaccgatctacatcgactttctcaacggcctggacatcgacgaactcaacctttccaacgatgaaatcctcagcgccatcgaagccagcctgggcattcagggtcggggtgaggcggtgatcgagccgcgcacgcacctgatccctggcggtgagatcaatggccacttcaacgtgttgcgtggtgtgctcggtggcgctatcggctacgccggggtcaaggtggtgggcgactttgtcgacaactaccgcaagggcctgccttcggaattggcgattctcaacctgctggacccggccaccggcattcccaaggccatcctcgatgcctcggcgatcactgacatgcgcaccggcgccgtgactgccatcggcgccaaatacctggcccggcccgacagtaaagtgctggcgcatatcggcgcgcgcggcacggcgtactggaatgtgcggctgctcgaccacctgttcgacttcgaggaaatccgcgtgcattcgcgccgcagcgaaagccgcgaagccttcgccgaacgcctgcgtcgcgacttgggcaagccggtcatcgtcaccgacgactgggagtccaccgtgcgcggcgccgacatcgtggttgaggcctcgcgcctggatcagcccgaaccgttgttgcgcaccgactggatcaaacccggtgcctttgtggtgccttacggcaccatgagcgcggtggaattgtcgctcaccgacatcatgagcaaactagtggtggacgattggggccagtgcaaaggcggtatgtttggcgcactgcgcgcccatgtcgacgccggcaaactcagcgccgacaccctgcatgccgagcttgggcagattgtcgccggccttaagagcggccgtgaaaaccccgaagaaaccatcctgttctggcaccgtggcttgagcctcagcgacatcgccctgggccatgcgctgctggaaaaagccaagcgcctggggatcggccagcggctgcgctgggcgtgattctcatcgacccccaaggcctgacgttggcggatttactggcgattgcccggcacgacacgccagcgaatttcactgcgcaggcgcgtcagcgtattaacgaaggccaccagttgctgctgaaactcgcggccgagggcacgccgatttatggcgtgaccaccggtctcggagcggcagtggacacctcggtggcgccgttgcaggccaacattcccctgggccgtgcggtgggcgtcgggcgcctggccaatcggcaggagttgcgcgccatcaccgccacccgtttggccggcttggctcagggccgttcgggcatttcaccggcgacggcagaggcgctgctggcgttgcttaactccggcgtcgagcccgaggtgccgttgctcggctcgttgggcgagagcgacttggcgccgctggctcacctgagtttggcgcttacggtgccgttgaccggcaaggacggcctggcgctggtgtcggcgaatgcggcaagtgtcgggctgggggcgttgctggtggcgcaagtgcagcaggtgttgcaggccgtgttggcggcgctggcgttgtcgtgtgaaggctatcgggccaacctcagcccgttccagccatgggcttcacgcttgcgcccggcgccggggcaaagcgagcagtcggcggcgttgttgcacctgcttgaaggcggcgatttggcgggcagcccgcgccgcttgcaagacccgttgagctttcgctgtgccaccgttgtgcagggtgcagcgcagcaggcgctgcagcaactgcatgagctggtcgagctggaattgcgcagcggcgcggataacccggcgttgatcagcgaagcgtcgcgggtagtggccacggccaatttcgacagcacgcacttggccctggctgctgaaggcgtgggcttggcgctgagtcgcgtggcggcctgcagtgctgagcgcattgccaaattgctgtcaccggcgtccagcgacctgccgcgctttctgaccacgcagccggggcacgtcggcatggccgccttgcagcgcaccagctcggcgttggtcgcggagatcggccaccttgccaacccattgcctgctgtgagtgtgccggtggcggatcgggtggaagactatgccgggcaggcattggccgtggtcgacaaaacccgccgtttgaccgagcgggtgttgtggttggcgagcattgaactgatcgtcgccgcgcaagcggtggatttgcgtggcgatttgcgattggggcagggcgcgcagcagattcatgacgcggtgcgcagccaggtggcgcctctggatcaggatcggtcggggtcggtggatgtgttggcgttgagtgccttcatcaccgatggcaacttgaaaccctttctttgaaacgcagttgttcaactgtgggagctggcttgcctgcgatggcggtggtggcttcaacaccgctatcgcaggcaagccagctcccacaggttaaatcgcatttcaggtcatgcggcttcggcggccaatgcctcgatcacggcttgccgctcgccaacccgctgctgaaacgccgccaacgccggccactgctgcaaatcaatgtcgtgaaacccggcccaacgcagcaccacaaacaaatacgcatccgccaccgagtactgcgcgcccaacagaaagtcctgaccctccaacgtctgcaccagaatcgcaaagcgcttgtacaacgtggccaggaacatcgcgcgcacatcaccttgaatcgcaccattaaagaaaatcgccagcccgccatgaatctcgctggcgataaaattcagccattcctgcaagcgcacacgttcccagctgccattggccggggccaggttggcggcgggtttcaagtcggccaggtattgcaggatagcactggcttcggtcagcacctggccgttgtccagttgcagcgccgccacgtagcctttggggttgatctgcaggaagtcttcgccgtcggcgaaggttttagcctggttattcacctgcaccagttcgaacggcaaggccaattcacgcaggacgatatgtggcgcgagcgagcaggcattcgggaaaaaatacagtttcatctaaggcggctccgttggatttgcgccagtctcacgggcatggcaccgtgggtaaaattaaaccttcagccccctcccataaggacagctactgccatgatgaacctgatgcactggcgtttgctggtggccgtggccgatcacggcagcatcacggcggcagccgaacaggtcggcatgacccagtccgctgcgagccaggccatggcgtccatggaggcgacgctgggtgcgcagctgtttacccgtgaaccgcgcaagacgctgcccactgcgctggggctgagtgtgatcgagcaggcacgggtgatgatgggcgcgttgcaaaccatccgcacaacggtcgacgaagcacgcccgttgctgcgtgggaacattcgcatcgccagtttcccgaaggtgctggcgacgtttctgacgccgttgctgcagcgttttcgccagttgaacccgggtatcgaggtgaccaccctggatgtcacggacagcgaagtgcacaccttgctcgacgcgggcctgatcgacctgggcgtggtgctcaaccccaagcccgcgcacaacgccacggtgttgggccgcgacctgtggatggccgtgctgccgacggaccatgcactggcgcagcgcccggccgatgccagcgtgtcgcttgaagaattactcgaacaacccttcgtgctggccaccggcggctgtaccgcgaatgcccgcagcctggccgccgctgccgggctgagcctgggtgatatccgcgtggaagtgcgcgaatggagcagcgcctacagccttgtgcgcgaaggtgtgggtgtcacattggtgccggaaatggccttgccggcccagcgcaccggcctgcgcgtgatgccgctgacggtgccgttgcaccgtgagtttgctttagtgggttcgccaagccagccgccctcggcagcagtcattgcattgttaaaaatgctggctggctagggggcgttctcaattagtttccccggcgcggtggggaaactaattgagaacgccccctggtggccttgcatagcgccaagccctgtctatgctcacccagaaccgttgatgacgcttggcatataaagcgattcggatggttttttcccctgaaggtgtgccagcaatagccaactgaagaatggaatgcgcctgctcaggcgccgggaatctagggtgatccgatcatgttcaaccgccatcacaaatccgacctgcaagaaatcgaacgtttttcctgtgccctcaccgaagccaacgccaaactcgccgccatcagccgttccatggcgatgatcgagttcgaccgcaacggcgtgattctcgacgccaatgacagcttctgcaaaaccatgggttacaacgtcgaggagattcgcggcaaacatcaccgggtcttttgcgaagaggcctacacccacaccgaggcctacaccaagttgtggcgggatttggcgcgcggtgaagccctcagcggcacgttcatgcgcctcaacaagcggggtgaggaagtgtggctggaagccagttatatgccggtgctggacagcagcaaccaggtgcagagcgtgatcaaagtggcgtcggatatttccgcgcgggtccaccatgaacacgagaaccagagcctgatcgacgccatcagccgctccatggcggtgatcgaattcacgccccaaggccagatcatcaacgccaacgataatttcctgcgcaccgtgcagtattcgcgcgaagaaatcattggccagcaccacagcatgttctgccatcgcgccgaggttgaatcgccggcgtacaaggccttttgggcctcgctcaaccgtggcgaataccactcccatcgctttgagcgtaaaaacaaatacggcaaaaccctgtttctggaagcgtcctacaacccgattttcgacaccaacgggcgcctgtacaaagtggtgaagttcgccagtgacatcaccgatcaggtcacgaccctgcgcaccgccgccgattcggcccacgccacttcggtacaaaacgacgcctgcgcgcgcaaaggttcggaggtggttcagcaaacggtgcagatcatcgaagagatctcccacgacctgaaccaggcggcgcagagcatcgatgcggtgagcaagcagtcggacatcatcggcgccatcgtgcaaaccatccgcagcatcgccgagcaaaccaatatgctcgcgcttaacgcggccattgaagcggcgcgggccggcgagcatgggcgcgggtttgcagtggtggccgacgaagtgcgcagcctcgcggcacgcaccagccaggcgacggtggagattgtcgacgtggtgcgcaagaaccatgacctgtcgctgagcgcggtgtcgagcatgcaatcgagcttgagccgcaccgggctcggcgtggagctggccaatgaagcggggcaggtgatcctggaaattcaggaaggctcgcggcatgtggtggacgcgatcagccagttcaattcgacgctgcaactgcagtagacccgatcactgtgggagctggcttgcctgcgatgcagacaccccggtgtatcaggtacaccgaggtgatgcgatcgcaggcaagccagctcccacagttgaaaagcagtgtcgattaaatcgcggccagggtttctttcaccgactgcgccgggtcagtggccttcgccgcgacttgctgctcttgctgctgcttcacgcgatcagccacttgcttggcaatcgcgtcctgtttttcctgcggcatggcctgcacttgcgcttcggtcaaaccctgctccttgagcagttgttcgcgaatgcgttcggccggggatttgctcatgtagtcggtgaagtcggcacgcgcagtgctggtgatcgagccggccgccggtacatccgtcgacgccgtcggggctgcggtggtggcttgcaactgcacgcgggtcttggcgaaggcttcgtcgatacggtcgttggccttgtccaggtccttttgcgccgccggcacggtcacgctttgctgcgccgcttgcagggcgccgctgtacagcgtgctggcggcagcgttggccgggtccatgtcgggacgcttgagctgttgcacggtcgatacggcttgggtgttgttgttgatcagcatgattgctcacctgggatgtgttcggtgccacaggtggagcaaatagcatgccgcaggcgtcaggcccggatttattggggatgacgcgaccgttgcggcaaacattgtcctgccggcggccaagcgttgccgtcaggtggtgtacctactaggttattggcacgtccttgagttgcagctttccactgctcagtctgatcaagaagccagaagcgccacctgcgacgaagaaatccgcctccgccggaagcgttgccccgtcccagctgagggtcttggtgacattgagggatccttggtctatccgaacgcggaggatgggcggtttgctggtatcgacgtagtacatcgctatgtctgagctggttgggccaaacggataattacgcagctgaatgttggtggaggtgacaacctctatcgatatatatttatcgcgtctgaaaaaaaagcggtacttggcgccttcaactttaaactccatgcccgttgaggtgatgttgtagtaatcgtccctcgtcgccgcgtgcgctgtgaaatcaccagttagaactctcccgggctgtgtcatcacttcctccttttcgatcctgtatgagtcagaatcctgaagtctatttagtgatggatgaaacagaccgtctactgtcaattctcacaggttccagcgaaaatccgatcagtggattacgcatcagtgcgcaatattttccaacgccaaattgcgcgtacgcggcccgaaccaactgatggtgatcatcacgatcaacatgctgccggcaataaacgccaacacgcccggcgtgcccaggtgttcgagaatgaacccgatcaacaggctgctgaacaccgtggacaagcggctgaacgaatagcagaaccccaccgcccgcgcgcggatattggtggggaacaattcactttggtacgagtgataactgaagctcagccaggcgttgcagaaggtgatcatcaccccgcagatcaccaacccaacggccgtggtttgcagggcgaacaggctgccgaaaatcatcgcgcccatggccgagccgacgatctgccatttgttttcaaaacggttggccaccttcacaaacagcaacggccccagcgggtaggcgagggtgatgatgaacgcgtagagcaaactgtgggtcacgctcacgccttgaccggacagcagcgccggcaaccagttgccgaagccgaaaaagccgatggcctggaacacatggaacacaatcagcatcaacgcccggcgccggtacggcggctgccagatatcggcaaagcggccgttgccttgcacgctgacggcctcgggttcgggttcatccagtggtttgccgtgatctttctggcaacgtgcctccaggctgtgcatgatctgcccggcttcgtcgaagcggcctttctgcgccagccagcgcggtgattccggcaggcgtttgcgcagttgccagataaacagcgcaaacaccgcgctgctcaacaccaccaggcgccagccggagatcccgaacggcgcctgcggcaccagccaccacgacatcagcgccaccgccggcaccgacaaaaactggatgaaaaacgcaaaggcgaatgccgagctgcgcatgcgcttgggcaccagttccgagaggtaggcgtcgatggtcaccagttcgatgcccaggccaatacccaccagaaaacgcatgcagataatgcccagtgcggacgtctgaatacccatcagcacggtggcgacggtgtaccagatcaacgcaaaggtgaagatcgcccgccgcccgaagcggtcggcgatggggctgagcaggctggcgccgaggaacaggccgaggaaagtcgccgaggcgaacgcggcctggtcggagaaaccgaacacgcctgcgctgccggtgtggaaaatcccgtcgctgatcaaaccggggctgatataggcggtctggaacaggtcatacagctcgaaaaaaccgccgatcgacagcaacgccaccaggcgccagacggtggcgacggcgggcaagcggtcaatgcgcgcgctgatatgggcggcacggatcgggtcgatgccgtccgtggctgaggcggtgagtgtcgacatgggcagattccaggggcagtgacctggaatcttagcgggctaacggaaatcggtgtgtgtgaagttgcgtgcggcaggccacacattcgccgatttattgcgccatggcctcaggtttcgaggttttatgccgcagcggctcaataggtgatggggatctcgaaggtctggaacgcgtcatccaccggttggtaacccaacatgcgcgtggtttcactcaggtccaggcgcttgaaacggttattggaaatgccgtgggcgatcaggtgcttcacgccttctgcctccaccgagcgttgcagcaggtgcactgcgtcacgcgggctgagccaggcgctgaggtcgcgggcgttgttgaggtcgtgggtttcggggaattcgaaggcaccgatgcgcagggcaatggtcgacagtggcgtcttggctgcgtaatagccgcacagcgcctccccgtagcatttgctcacgccatacaggttggcgggtaacaccggcatgccgggggtgatctggcggtccaccgggtagccttcgatggtttgcgcgctgctggcgaacaccaaccgtttcacgccggcggccacggcggcttcgaacaagtaggtggtggcgaggatgttgttcggcagcaactcgtcgaacgaggcgctggcgtgggggatgcccgacaggtgcacgatcacgtcgatgccttcaagcagggcggccaagctggttttatcgctgaggtcggcgtggatgaaacggtgctcgccggttggaaattccggcgcgacgcggtcggtgagggtgaagcggtaacggtcttgggaggcttggaaaaacgtcttgccgattctgccgcaggcgccggtaagcagtacgttgagtcctttcacgggggtttccttgttttagttatggccgtcgagggcaaaggtcttgaagccctggcgctggctcaggcgttggtaataggccgcaatggcggggtagggcgggcgctgcatgggcgtgttctgccagcggtgcaccgagaggccgatcaggatatcggcgagggtgaattcatcgccggcgacataggcgccggttttcgccagctgttgttcgagcaggcccatcttgtcattccagcgctgcacggcggcggcaatttgcgccgcgtcgaggccgtccgggttgttgcgcaccagcgcggtgaaggcatcgccccaggcgcggttgagttccacggcttgccagtccacccattgctcgacccgtgcacgtggcgcgggctcggcgggcagcaggtcagtgcgttggtaaaggccgacgaggtagcggcagatggtgttggactcccacagcacgccgtggtcgtcgatcagcaccggtacttgggcattggggttcagggccaggaactcggcggactgggtgggtttgaagccgatgccccagtcttcgcgcacatagtcgatgcccagttcctggcaggtccagagcacttttcgcacgttgatggaggacgtgcggccgaggattttcagtgagtgtcccatggtgcttccctgtcgatggtgatgacccatgggaatctatcagtggtgccctgtcgacgctatgcagttgtgtctagcgtgggaacgagcaggcaaccccggccttaagtgggcacagttaatgtgggagcgggcttgctcgcgaatgcggtgggtcagttagccaatttgtagctgactcaccgccatcgcaggcaagccagctcccacatttttgatcgagcagggctttaggttcgcggtgtttgctggtccatggctttgcctaccatcagcactgatagctcgctcagttgatgaatcgccaatgcgacatcgcggtgtttgccggtgaggtcatcggacaggtccagcaacaaggtgctgacggaacacagggtttcgtagctgtttgtcagcagggattcggtgggggtatcggggatgagggtgaaaagaatggttggcggtttttcggtttcattgatcatttaagcgtcctggaaataggccgccgccggatcgctactaaacgagggtggcagctgtacgcaggttagtagaccggtggacacttaaagccggcgcacccgaagatgccctacgcacagccgccatcaaactcagatgaggctcatgcacaaaaagtgtccaaaagtagggctactaaacccgatcgccgagaaattcagcgaccggcaaaccttaaagacccccacctaagcgcacaagccggcggattctgacgtaagcgtaggcaaccgggcaaggcgcttacctcaatgtcagccgcgtcctacaggcgtcctacatctcaagtgggcacggtaaaaaatgtgggagctggcttgcctgcgatggcggtgaatcagtcggcacatcattgcctgacactccgccatcgcaggcaagccagctcccacagtttgatagtgtttgctgatcgttcccacgctcccgcgtgggaatgcagccctggacgctctgcgtccaaagcgtgacgcagagcgtcacaagaggcgttcccacgcagagcgtgggaacgagcaggcaaccccgccctcaaatcggcacagtcaatgtgggagcgggcttgctcgcgaatgcggtgggtcagttagccaatttgtagctgactcaccgccatcgcaggcaagccagctcccacagtttgattgtgtttggcctttagaaatcaggtgctttcgcgcacctgcaactcaaaccccatgtccaccaccggcttggcgattttgttgcccgccatgatggtcagcaaatgctccgccgagcgccggccaatggcttcacgcggtgtgctgatgctgctcaagcgcggcaccatgaaagacgaggcaggcaagtcgttaaagcccaatacggccacacgctccggcaccttgatgccatggcgcatggcctccagcagcgcgccttgggccaagtcatcgttaccaaagaagatcgcatccacatccggatgcgccgccagcatctgcaaaaacagctcgccccccaggcccacggaggaagggcgcggtgtcagcagttccagcgccgggtcgtacaggcccgcctgttgcagcgcgcggcggaaaccttcaccgcgcagcaacgtacgctgatccagctgcgcaccgatatacgccaggcgcttgcgcccccgtgagatcaaatgcgccgccgccgtttcgcccgcgctcagttgcgagaagcccacgcagttcacgccggcattcgggtccaggtccatcatgtacacgcacggcacattgctggcctcgaccatccgtcgcgcgctttcggtgcggtcaaacccggtcagcagcaaaccgcgtggctggtaggccatgtagttgcgcagcaggttttcttcttcatcgcgcgaatagtgggagttgccgatcagcacttcaaagcccttgggccgcagcactttgtggatggcttccagggtttcgataaacagcaggttggacagcgacggcacgatcaccaccaccgagtggctctgcgccgacgccagcgcacgggcggcggggttgaccacgtagttgagttcggcggcggcctgctgcactttttccaccagttcggtggccacggtgctgatgccgcgcagggcgcgggaggcggtaatcgggctgacgccggccaggcgggctacttcattgagggtcggacgaccggtggtgcgggtatttttatcgttcttggaggtcatcaggcggttgccaaacaaaaatcgaggcactaaggtagcgctgtctccaaaaggctgcaaattcttgaatcctgggttgcctgatccggttcaacggttttggagcggatgcacgcgtcactccataaaaatgacaagtcggcgcgggaaaagcctgtttttgcactagccttacagcgtgcgaaggtagcgctatctgcgtcctgaggtgtttcatgagtcaacctgttaccgccctggtcatcatgggtgtttccggctgtggcaagtccagcgtcagcgaagccctgtgccgcctgaacggcgccaccgccattgaaggcgacagctttcaccccgccgcgaacatcgagaagatgagcgccggccaccccctcaacgacgacgaccgcgccggctggctcgacatcctgtgcgatgaactgcgccgttcgctcaaagccggtgagcatccggtgctcacttgttcagccctgaagaaaaaataccgcgaccacctgcgcgaagccgcgccgggcctgggctttgtgttcctggagctgacccgcgccgtggccgccgaccgcgtgtcccatcgccccggccatttcatgcccgcgagcctgatcgacagccagttcgccacccttgaatcgcccgtgggcgagccgctgaccctggcgctgaacgccagcgaagacagcgtcgaggacctggccgagcaaaccaatgcctggtggctgcaacacggctttgaaccaacccattaattttttgccggaaaagatagcgctatccccggcgaaaaattcaacacccgctttaataacaacaacaaacaggagagaacccccatgtttggcatgtcccacgagtcctacctgctgctagatgcagtggtcactatcatcgggctgatctttttgatcaccaagttcaaggtgcacccgttcattgcactgatcatcgcggccggcttcctcggcctgacctcgggcatgcccgtggacaagatcatcaaggcgttccaggacggcttcggcggggtgctcggctttgtcggcatcatccttgcgctgggcaccatgctcggcaagatgatggccgagtccggcggcgccgatcagatcgcgcagaccttgatccgcgccttcggcaaagaaaaagtccagtgggccatgatgttcgccgcgttcctggtgggcatcccgctgttcttcgagatcggttttgtactgctgatcccgctggtattcatcgtcgcgcgccgcaccggcgtgtcgctgatcaaaatcggcatcccgctgctcgccggcctgtcggcggtgcacggcctggtgccaccgcaccctggcccgctgctggccatcggcgtgtttggcgcggacatcggcaagaccatcctgtacggcctgatcgtcgcgctgccgacggctatcatcgccgggccgattttcggtacgtttatcgccaagtacatcccgggcaacccgtcccaggaactggtcgaccaactggcgcgcgagccggaatccaaagacttgccgagcttcagcattaccctgatcaccgtgctgctgccggtgttcctgatgctgctcaaaaccttcgctgacgtcgcgttggccgacggccatgtcatccgcaactggatggacatgatcggtcacccgatcaccgcgctgctgctggcgttgctgctgtcgctctacacctttggccatcgccagggcattcactccaagcaaatcctcaagctgctcgacgccagcctggcgccgacggcggcgatcatcctgatcatcggcgccggcggtggtttcaagcagatgctggtgaccagcggcgtgggcgacgtgatcggccatatggcggtgaacgcacagatcaacccgattctgctggcgtggctggtggcggcggtgattcgtgtggccaccggttccgcgaccgtggcgaccattaccggcgcaggcattgtggtgccggtggtggggatgattccgggggttaaccgtgagctgctggtgctggcgacgggggcgggctcgctggtgttgtctcacgtcaacgatgcggggttctggctggtgaagcagtatttcaacatgaccgtggtcgagaccttcaagacctggacggcgatggagaccatcctgtcggtggtggcgctgatctttatcatgttgctgtcgttggtggtctgacagttgatcgttcccacgctccgcgtgggaatgcctcttgtgacgctccgcgtcacgctttgggacgcagagcgccccgtgctgcattcccacgcggagcgtgggaacgatcatgcgctgcgggaatcttcacccaggcatccatcgacgtctttggggtctttatcctaccttttcacttgtcggaactgtcaactttcacaggtaggcgtgatggtttcacgctgctaggttatttccaggttgccactgtcgtggcagcgttctggaggtatagggaaatggctgatttcagagtttttgttccggcatcaaacggttatgcatctgcttatgaaaatccaccccccggtcggtacaacgttgggggcgaaggtgaacggggcgctacggtttctattttaaacagtgcaggtgtgaaaatcgctggccccttttttgtaaacgacgctggccagtggagaggggatattgttatcgacaagtcgatgattcagccggcatccagtcccaatccctactcagcgacgggtatggtgcaccttaaggcggagtacaaaagccctacaggcaaagacgacgaatatggatggagtttttacgtttgataggccaccaggcgcgatcgaagaaacaggggctagccagctagcccctggcgattcaaacctcggttttgcgaattaaaccatccgcgcggaacatcccgcgaatcccgcgcaccgcctggcggatccggtcctggttctcgatcagcgcaaagcgcacatgatcatccccatactcaccaaagccaatccccggcgacacacacaccttcgcttccagcagcagtttcttggcaaattccagcgagcccatggccgcatactcctggggaatcttcgcccagacgtacatcgacgccttcgggttctcgaccatccagcccagctcatgcaggcccttgaccagcacgttacggcgctggcggtactgctcggcgatgtccttcacacattgctgatcgccttccagcgcggcaatcgccgccacttgcagcggggtgaaggtgccgtagtcgtggtaactcttgatccgcgccagggcattgaccagttccgggttgccgaccatgaaaccgatgcgccagccggccatgttgtagctcttggacagggtgaaaaactccaccgcaatgtccttggcgccgggcacttgcatgatcgacggggctttccagccgtcgtagacgatgtcggcgtaggccaggtcgtgcaccaccagcacgtcgtactgtttggcgagggctataacgcgctcgaagaaatccagctccacgcactgcgcggtcgggttggacgggaaacccaggatcatcattttcggcttggggatcgagccgcgaatcgccctttccagctcggcgaagaagtccacaccgggaatcagcggcaccgagcgcacctgggcgccggcaatcacggcaccgtagatgtgaatcgggtagctggggttgggcaccagcacggtgtcgccctggtccagggtagccagcatcaagtgcgccaggccttccttggaaccgatggtgacgatggcttccgactcggggtcgatatccacctcataacggtctttgtaccagcgcgaaatcgcccggcgcaggcgcggaatgcctttggaggtggagtagccgtgggtgtcttcacgctgggcgacggtgaccattttttccacgatgtgtggaggcgtggcgccgtcagggttacccatgctcaagtcgatgatgtcttcgccgcgccgacgcgcagccatcttcagctcggcagtgatattaaaaacgtaaggggggagtcgatctatgcgcgcaaagcggcgcggcgaaccttggtctgccattgttgcctcaagagtacgtaagcgcccggaaccgtccgagcgacgtcggccactgcggtggcctgcggggcagacaatacggtcgatgatggcccgctgtccagatggcgccggaaaaatttctgcgtggagtgcggcgtgtatatgcccctatactcgatgcgggtttgttccctcataagaaggagactgttcagatggatcagcagacaaaactaccgttggaaccgcgcatggaagccggtaaagccctggtgatcgcaggcgtccaagggcgttattcgaaggccactgtgggtgatatccccaaactgtgggagttgttcgatacatgcatcaaggacctcaagaagcgtgtcggtggcgtgacgtatggcgtttgccataaccccaagcacggcgaattcgactatctagccggtgctgaagtgccaaccaaaagcgacgtgccgagcaacttcgagtttgtcgaaattccaccgctcaactacgccgtgttccagcatgacgggccggtgcaggcacttgagcaaacgtacgagcgcatcatgttcgaatggctgccgcactcgggctataaggtgatgggggcggatttcgagcgttacagtgccgattttgatgtacgcaagggcacgggcaccgtggaaatctggttgccggttggcgaaagaggctgagtgcggccctgccggagccggtacgccggccccggcagtggatcaatacaacgtacttctgacccgctccggcatctcccggtcatacgcttcggcgtcaaattgcccgtcattgagccgcttgtgaaacgccccggccgacggcaatgccgagcggtccaggtgcttctcggggttccagcagtccgagcgtacaaacgctttggaacagtggaaatacgccgcctccacctgcaccagaatcactgaccgcgcaggtttgccattcaccgcaaaactctccaacagctcgggctcgatggaaatctgcgcccggccattcacgcgcaacgtttcgccgatgcccgggatgatgaacagcaacgcaatccgtgggtcgtgcagcagattacgcaaggtatccagacggttattgcccggccgatcgggaatcgccaacgtgcgctcatccacaatccgcacaaaccccggcacatcgccacgcggcgaaccgtcaatgccatccgccccggatgaactcaccaccaccaacggcgatgcgcgcaccatggcctggtaatcctcgttgagaaacgcaatttccttgcgcaccgcccgctcgtgggggagcccgtagagggtttcgagttgttcgagggttgtcagcatgtaatcaccttgtccttggatgaatgtgggggcgttcagccaccgaagctctgctggtagctgtgcgccgactgtcgaatcgctttcgcgacataaggggctagccggcagtaatcttcctcgcgtttaagcacgacttcgagggattgaagcagtgcctgaatacgcacctcggggttctcgatttcgcaggttcttgcaaactcaagaatgcccaaacgtgaggcaaacatcgatttgttgcctgacaggtccagcgcgagcgtgtcttcaggaatgtaggcggtggtattcacaatatcgtatgccggagccagccgcgtattcgcgtttactggatcgccgtagagcaggccaaaatttttcaggtgagcatcaccgttacccacaatacaactcagcgctacgctatcgaacaattggtccagtgagctgcgctggtttcccggtgagcagaacacgcgcacagccttggccatggctgcgtagcttttggtgtacttctgctcggcagagaggcccatcagtgtggtcatgtcttcgaagcccagcgggttgagctgctcgtctctatcgaagcgccgcatgatgaacagcttatggttctgcgacaggtaaaacggcggtacgggcagccctgcatcccgggcaatagacatgcacaggtattcattgatagctaaccctggaaactcttcgcgcccgctcttgataatcaggtcattggttttcgaagtgaatttctgttcgggcgtttgaggtttttccggcaccagcactttgggctgcacaccagaaatacctgctcgcaggatgtagcgatccactaattcggcgaacagattttctgcgccgtcccaggcgagaatttcgtcgagattttctccggctgcgggagggccgttgcgttggattaactcgtttacctgagccgaagacacaaacacccggccaatcggtgcactgctcccggataacgccagcagcagcatcgggtcgaccttcaccgttttggcaagacgattgcgcagctgctccagtacgtagccttccggcagattcatctggaagatggggtgcagttctcggcggcgatattcttctacgcgaaccggcatcgaaaggctgatcgcgcagtgggcctgtgccatggcgtcatagcgaaacaggtaatcctcagcgcccatcaacacgctgccgctgtcgccttgaggggtatgaacgtgaagagtagggttattcattgaacacgtcctccagctcttcaagcgtcggcagggtgaccggcactaatttgagttcgctgcctaatgcagcaattacgcgagcataggcattcatggaaaccgagaggcttcccttttcgatttcgatcagtttttgccgggtaacgcctgcaagtttcgccagctccgcttgtttatagccacgattgaggcgcatggcgcgaatctgatggccgagtcgtagggtgataattgaagtatccatgtcacgtatttattacttttgatcagttaagtcatatatacgttacatttttggactgtcaatgccgtcccgaccaaacacccaactcaaccggcgctcatacccaacccgtccccgatatgcctccccactgtcgacccacccggccgccagatacagccccatcgccgccacgttgtcggcgtccaccgacaactccagcccctggatctgcggccaggccagcaaggcggccgccggcagtgcgtgtaaacaggctttgccgaaaccacgcccttgctgggtgcggtccacttgcagcgcatgcagcgtggcgctgtgttcatcggcccagtgaggcaggcacggcgggcgtttgagcaggaggaaagcgacgggagcgtcatcggcgagcagggcaaagcctttgatcgcgccggggttggggttgaccagcaggctgttcagcgcgcagtagatgtcgccggagtacgccagttgctcgggatgcacttgcaggttatcgagctgctgtttttgcacaaggcttagcgtctcataggggacgaggcgggtttccatcgggggcgcatccgaaatcctacaaagaggcgtggattctagcgggtttgcgcgtggcgaaattatttttcagcgggtgtcgattgagccaagcgtcattcgactaagggtgtcctttgtgattttccaacccccaggagtatcgccatgagcactgcaatcaacaccttgatcgagcaatggaagcaggccgtgctggcccgtgatatcgatagcattgtcagcttttacgccgacgatatcgtctcgttcgacgccgttaccgcgctgcaattcaagggcaaggccgcctatcgcgcccattgggaggcgtgcatgaagcactgccccggccccggcatcttcgagtttcatgaactgcacatagtcgaagcccaagacagcgcgttcgcccattggctggcccattgcggcggtgccgggccggatggcgaagtgaaggcgtgctggatgcgggtgaccgccggttatcaacggatcgacggccaatggcgcgtggtgcatgagcactggtcggcgcctttcgatatggacagcggcacggcgctgttcgacctgaaaccctgaccgccacgaactatagtcagtagtccgaaaacggagacgcacatgaaatacctctgcctgatctacagcaacgaacaggtgctgcacacctcgcccgacagccctgaagacccggagtgtttcgcctacgccgaggcgatccaggccagcgggcgcatgctcgctgccgagccgctggagtcggtgagtagcgctaccaccgtgcgcatgcgcaatggcaagttgtcgatcaccgacgggccattcgccgaaaccaaggagcagctcgccgggttttacctgatcgaggccaaggacttgaacgaagcgatccaggtggccggtggcattccggcagccagggtcggcagtgtggaagtacgccctgtgcgtgaattgaatctctgaacacaacaatcaaaagactcaggaggtttatcccatgaccactcaacccgctgaatttgaactgtccatcagccgcttgatcgacgccccgcgcaaccgtgtgtttcgcgcctggaccgagcccgccttgctgcagcaatggtggggcccacacggcatgaccacgcccgaatgcgaaatgaacctgtgggtcggcggcctgtttcgcaccctgatgcgcgcgccggacggcgccgaatacccgacccaaggggttttcctggaaatccaggccccgagccggctggtgtttaccgacgcctacgcgccaggctggatcccgtcgggcaagccgttcatgaccgccgaagtaaccttcgaagacgtcgacggcaaaaccctctacaccgcccgcgccatgcactggaccgaggccgacaagcaggcccacgaagccatgggctttcatgatggctggggccaaagcctggaccgcctggtgacgctggtgaccgaaggcatgcgcgattgacgcctcagatcgaggccatttaccgcagcgaatcacgccgcgtactcgccacgctgatccgcctgctgggtgatttcgacctcgccgaagaagccttgcacgaggcgttcttcgtcgcggtcgagcgctggcagcaggacggcgtgccgagtaatccacgtgcctggctggtgtcgaccggccgtttcaaagccatcgatcgcctgcgccgccaggcccggtttaccccgttgttgcaggaacaggccgacgcgctggaagcggctgactggagtgagaatgacgtggaagacgaccgcctgcggctgatctttacttgctgccacccggcgctggcacccgacgcccaggcggcgctgaccttgcgtgagatctgtgacctcaccaccgaagaaatcgcccgcgcgtttctggccacgcccaccaccatcgcccaacgcatcgtgcgtgccaaaggcaagatccgtgaagcgaaaattccctaccaggtgccgtccctggacgagctgcccgaacggctcgacagcgtgttgcgcgtggtttatctggtgttcaacgagggctactcggcgtccatgggcgcaggcctcacccgcgaggagttgacccgcgaagccattcgcctgggccgcctgctgctggagttgctgccggagcctgaagtcgcgggcttgctggcgttgatgctgctgcacgagtcgcgccgagcggcgcggagtacggacaaaggcgagttggtgctgctggatgaacaggaccgcaggttgtgggacgctgccttgatcgctgaaggctgtgcgctggtggagcaggcactgagaacccggcgatttgggccgtattgcctgcaagccgcaattgcggcggtgcacgccgaagcgcccagcgcaggcgagacggattggctgcagattgtcgggctctatgacgtattgctcaggcaggtgccctcgccggtgatcgagctgaaccgcgcggtggccgtggcgatgcgcgatggcccgtcggccgggttgcagttggttgaggcgattctgtcgcgaggagaattgctggattaccacttggcgcattcggcgcgcggggagttttgccggcagttggggcgtaccgatgaggccaaggcagcctacgaaaaagccctgtcgttgacccagcaagctcccgaaaaacacttcttggcgcggcgcctggccgaactcaaatcctgcaaacagtgaagatcaaactgtgggagctggcttgcctgcgatagcggtatctcagtcaacacgtgtgtcgactgatgcggcgtaatcgcaggcaagccagctcccacattcaacagtggtgtttgtaagttttctgtttatggctgctgacgcgtcgccgccaacacaatctcgcgaatgcacacatgctgcggctgctgatacgcataggcaatcgccgaagccacatcattggcactcaacacggtgccgcccatgtcctgtttccaggcctggtaaccgctcttgatcgcctcatccgtggtgtggctgagcaactcggtctccaccgcacccggcgcaatggtgatcacccgcacattgctcggcgacaattcctcacgcagattctccgaaatcccatgcaccgcgaacttggtgcccacatacgccacatgattcgggaacgtcttgcgcccagccaccgaactcacgttgatgatcgtgccgcccttgcgcgcgaccatgctgccggccaccgcgtgaatgccgttgagcaggcctttgacgttaacgtcgagcatctgctcccattgctcgggggcttgctcgctgacggcgcccagcaacatcacgccggcattgttgatcagcgcatcggcggggccgaattgggcttcggcttccttcacggcggcaaccagcgcggcgcggtcggtgatgtccacgccccggctcaaggtgttgggcagggccagatcgttcaggcgatcaatacgccgcgccaacaacagcagcggatgcccggcggctgataacaggcgcgcggtggcttcgccaatgccggaactggcgccggtgatgatgatcagtggcttgctcataaatgcactcctggaataagaaaaatcgataacttaaagcgtgggcgcagtatatttacccgcgccgaggctgaaaaatgccttatttctctgtctgccatcggataaagctatggatgtgcgccacctcaaggcgtttctcgcggtgttcgaagagcgcaacatcaccgctgccgcccagcgtctgtttatcagccagccgaccttgtcggtcaccatcaagcagctggaagacgaactcggcgtggcgctgtttgtgcgtcagccgcgcggcgtggacgtcagcgccgaggcgcgcgtgctgtacccgcaggcgcggcgcatggtcgcggaagcggacgccttgagcggattatttcgcggacgcgaaaatcgcattgccctggaactgggcgtggaaggcgatattgccgacagccagatcgaaactttcctgcgcatggcgcaccaaggtctgccgggtttgctgctgaccttgcaggaaggctgcgaaggcgatgcgcgcctggcagtggaagaaatgtgctgtgaggacgagctgttcctgccgctttgggaagagtcttacgtaatggcgttgcccacggcgcacccgatggcgcaggccggcaaagagcaggcgtgggcgccgattgaagactggatcacctgcccactgcacgattcccaccagcgcttgatggcgctgtatggccgctcgccgcaagcggtggccgggcacgccggttcattgacccaggcgttgcacatggtcgcggcgggtgtgggcgtggcgatgttgccgcagtcgatggccgccgagcgggccggggtggtgattcgcgaatggcacctgccggcaccgatgcgccgggtggggttgtgctttgccgcgcaggcgttggagctgcccgcagtgcgcgccttgcatgaatatttccagaacaatcgcccgccgcagctctctgcggcgtgacacaaccccaaccaacacaacctaacccctgtgggagctggcttgcctgcgatggcggtatgtctgtttgcaaagatgcaagctgaaccaccgccatcgctggcaagccagctcccacaggttgggtctttattgccaggttgtatgagggggcggggttatcactccaacatctgccccaacatccaactccccgccggccccggcgggtgctggcgcgaccacagcgcatccaccgccaccgaacgtggccaactgcgcacctcaagttccaccagcccggcattcccaaagcgctccaccagccagcgcggcagcgccgcccagccgaaaccgagctgggccatttccatcagcattagaaaactcggcgccgaccacacacggccgctcgggcgggtttcgttggggttgatgatgctggccaggcgcagttcgcggtgttgctgcaaggcctgcgggtcaaggttttgcacgttggccaaagggtgagtgggcgccacgaacacggcgatttccgtacgctgcgccacgggcgcgcgggtcaggtcgggcgggtaaacctcctgggcttcgatcaaggcaatctgcgcgcggccgctttgcaccagggcgatcaggtcttcgcactcggcgatcagccattccagctccaggtccgggtagcgttgttcaaacgctttaagcgcgagctcgaaacgctccgactgatacgtatcggacatggcgatactcaacttcggctccaagcccattgccaactggctcgccgccagctccaggcggctgctggcctccagcacctgctcggcccgttgcaacaacacatggccggcgggcgtgagcgtcggcttgcggctgctgcgatcgaacagcaccacatccaggtcaatctccaaactcgccaccgccgcgctgacggtggactggctcttgcccaacttgcgcgccgccgcagaaaacgagccctgggtggccgcctggacaaacgcctgcagcacttcattagaggccatgtctatcgccttggtcgatggttattagttatgaagtatcgagtcaaagggtaatgatggcaaccatcgtcactcacggagccgggttatgaaccctaccaagtcgattactgaacgtgtttgccaagccattggttttgagggtttggcgctgttgatctgcaccccgttgctggcgtggatcatggataaacccgccctggaaatgggcatggtcaccctggcgatcagcctgatggcgctgacttggaacgtgattttcaacggcctgttcgaccgcctgaaagcacgctggcagctcgccaataacggctggacccgtgtgttgcacgcgttgatgtttgaaggtggcctgattttggtgtgcgtgccgttgatcgccgcgtggctgaatatcagcctgatgcaggcgtttattctcgacatcggcgtgttgctgttcttcctgccgtacacctatgtgtatcactggggctacgacgtgctgcgcgagaaaattgtgcagcagcgcgtggctagccaagtttgagcgaggcgacaaaatccagaaacgcccgcaccttggcggcgggcaaatgccgcgaagggtaataggcgtacaacggaaaacgctcgtccggccagtcaggaaacaggtccaccaggctgccggcctggagtgccggcgccaggcccaaatcgagcatttgcgccacagcgtgcccgtgttcacacacgctgtataacgtgctggcgtcgttgaccaccaagcggccattggtgcgcacgttgacttgttcgcctttgcggtggaattcccaggcaaacgggcgcccggtctgcgagtcgcgaaagtccaggcacatatgcccggtctccaggtcttgcgggatggccggtcggccgtattgttccaggtaagcgggggaggccagggtgagcacgcgcacttccatcaacttgcgcgcgatcagcgaggaggattgcgggatgccgaagcgaatcgccaggtcaaaaccgtcggccaccaagtcgccgagttggtcacgggtgtgcaggtccagctgcaattgcgggtaacggcgcatgaaatcgccgagcaccgggcccaataccaggcgcgagaagtatgggtcgatattcacccgcaaacgcccgcgcacggtcaatgcgctgtcggcggcggagctggcggcctcttcgagaccggccagcagcggggcgatttgctggtagaaccggcggccttcgtcggtcaattgcaccgagcgcgtggtgcggtcgaacaggcgaatgcccaggcgtttttccaaacgtgaaatcgcccggctgaccccggaaggcgtcatctccaggctgtcggcggcgcgggcaaaactgccgctgtcgaccacggccgccaatacgcccatgccgccggccaaacctggatcaaaactcatcggtgcctgcctgtcagtgatctgtaggcattaatgctagcgcagaatgcctacagaaacatgccgcccgaggcttcgatgcgctgcccggtgatccagttgctgccatcggccagcaaggtcgaaatcgccccgccaatatcgtccggcaaaccggcgcggcccagcgcggtgttgttggcgaccatcgcgttgactgccgggttatcgcgtaccgcaccgccgctgaaatcagtggcaattgcgcccggtgccagggtgttcacggtaattccgcgtgggccaagctccttggcctgatagcgcgacagcacttccaccgcacccttcatcgacgcatacgccgcataccctggcaggctgaaccgtgccaaaccgctggagatattgatgatgcgcccgccatcgctgatcagcggcagcaatttttgcgtgaggaaaaacggcgccttgaagtggatcgccaccaaccggtcgaactgttcttcagtggtttcggcgaagctggcatgcgcaccgataccggcgttgttgatcagaaagttgaagtgatcctgtgcgaaaacatccttgagtacggtggcgatttcgccaacgaaatcattgaacgtgccgctctggctgacatccagttgcagcatggcggcgcggccacccagggcttcaacttgttctaccaccgcttgggcctcggccgctgcgctgtgataagtgccaatgatgtcgacgccctgtgctgccaagtgcagcgcagcacttttgcccaggccgcggctggcgccagtgataagtgcgattttacgggtcatggtgcagtcctctgaggtgatcgtgggactgagtgtatttatccgtgcataacatgataaacagggtgatatcggaatcactggccggataaggcgaacaatcccatgaacaaacttgagctgttgcgcaccttcgtgcgggtcaccgaactgtcgagttttacccaggcgggcgagagcctggggttgccgcgctcgacggtgtccgagcatgtgcaggcgctcgaagaactgctcggcgcgcgcctgttgcagcgcaccacgcgcaaggtccaggccacccaggacggccgcgtgctgtatgagcgcagcaaggatttgctcgcgcacatggaggaacttgaaggcttgtttcgccaggatgaggcgcagctcagcgggcgtattcgcgtggacatgcccaacgtcatggcgcgggatttgatcctgccgcgcctgcccgacttcctgcacgcgcacccgttgatcgagctggaaatcagcaccaccgaccgtcaggtcgacctgctcgccgaaggtttcgactgcgtgttgcgcgtgggcgcgcagcccgaccagaccgtggtggcgcgcctgctgtgcagcttgccgatgatcaactgtgtcagcgccggttatgttcagcgttatggcgtgcccgaaaccttggccgacctggcgcatcaccaattggtgcattacgtgcggcccctgggctcacgctcagcggggttcgaataccagcagggcaacaaggtgcaccgcgtgccgatggccgggcgcgtcacggtcaacagcaccgacgcgtataaatccgcgtgcctgggcggcttcggtatcacgcaagtgccggccttggggattcgcgatttactcgacagcggtgagctggtggccgtgttgcccgattaccccgcaccggcgctggacgtgtcgctgctctacgccgggcaacggcatctgccacaacgggtgcgggtgtttatggattggctggccgccacgctgcaagcccacatctagcgtcgcgccgacaactgctgcggcgccaggaaggcgtcgtggaagtaatcccgaaacgcttgcatcgccggggtgaacgcacgctcgcggtgccaggccaggccgacgctcatgggcgtgaccgggtcggtcacggtcagcgtctcgatgcgtttgccttccagcgaccacggccggtgcaccaaatccgacagaattgccacgccgctgccattggcgaccatgctgcgcaccgcttccaccgaactggtgcgcagccgcaccttgggcgtttgcccggcctgttcccagtagcgcatggcgctgtgttcggcctcgtcgacggtgagcaggatgtaaggctcttgcgccacatcggccaggctcaccgcaccgcgttcgcacagcgggtggtggctgggcagccacagccggcgctccgaattgaacaggatttcggagacgatatccgcgtgagtgaggttggcggtgagcaccacggccatgtcgaattgaccgtcgagcaggccgtgttcgatggcctggcgctcctgctcgaagacctcgatggtcacgtccgggtgccagtgttccatgcgttgcaggtgatgcggcaggaagtaaccgagcaccgtgtaactggccgccacgcgcagcacgccactggcgcggtaatccggcagcgggctgttcagcgcgtcgtccacgctgcgcgcgatcacataggcgcggttgagaaaatgccgcccggcgtcggtgagattcatgccttgggccgaacgcacgaacaactgcacgccgagcatggcttccagttccttgatcgcggtggtcaccgccgactgggagatgttcaggtgaatcgccgcctgggaaatctggccgatttcggcggtggcgacgaagtagcggatttggcgaagggtcagggacatggcttatccgatcgttcccacgctccgcgtgggcatgcaggcagggacgctccgcgtccgcgtttaaaatcgtgacgcggagcgtcacaggaggcgtaaccacgcagagcgtgggtacgatctacgtgtatctgtttttcagaagataccctatctgataatagatcttcccaaggggtcaagcgtcagcctactttcagccatcaccttttggcggagcagctccgatgcaggcagtggatttcaattcagacatgggcgaaggctttggcccctggaccatcggcgatggcgtcgacgcggaactgatggcgtacatcagctcggccaatatcgccaccggctttcacgccggcgaccccggcaccatgcgccgcaccgtcgcgcgtgcgaagcaactcggcgtggccatcggcgcgcatccgggctttcgcgacctggtggggtttggccgtcggcatatcaacgcaccggcccaggagctggtggacgacatgctctatcagctcggcgccctgcgcgaaatcgcccgcgcccagggcgtgaccctgcaacatatcaagccccatggcgcgctctacatgcatttggcccgcgacgaagaagccgcgcggctgctggtgcaaaacctgcaaatcattgagccgacgctgttgctgtactgcatgcccaactcggtgatctggcgtgtcgccaacgagctcgggcagccggtagtgcgcgagttttacgccgaccgtgagtacgatctgagcggctccatcgtgtttacccgcaatgtgcgcgcgctggaccctgcaacggttgcggcgcgggtcctgcgtgcgtgtcagaccggtcgtgtacgcaccgtcgaaggcgaagacctgctgatcgaattcgattccatctgcctgcacagcgacacccctggcgccctggaattggtagaggcaacccgcgaagccttggaccaggcgggcattgaagtcagaaccccccaataagatcgaaccactactttttgcctgcctttctacaatgattccaagaggaacagacatggctgaaacgtcccccatccgctacagcttcggcggtgatgaacacctgtttgccgaggtcagcgacagcatgtctctgcaggcttttttcaagggcatggcggtgacccgcgccgtggagcgcctggcgctggaaggcgtgctggatgtgtgcctggccaatgcgtcgttccagattcgcttcgaccccgaccgcattgcgccgcatgtgctgctcgacgcggtgcaaagcgccgaagcccaggccgtggccgaacgcacgttgcacacgcgcatcatcgaaatcccggtgctctacaacgacccgtggacccatgaaaccctgatgcgttttcgcgaccgccatcaagaccccagcggcactgacctggaatatgccgcacgcatcaacggcctggccgatgtggacgcgtttatcgccgcccacagtggcgcgccgtggtttgtgtcgatggtcggttttgtcgcgggcctgccgttcatgttccagatggtcgagcgcgaacggcaattgcaggtgcccaagtacctgcgcccgcgcaccgacacgccgaaattgaccctcggccatggcggctgtttcggctgcatctactcggtacgcggcgccggtggttaccagatgttcggcgtgaccccggcgccgatctacgacccggcgcagcagttggcgtacctgaaggaacacatggtgttctttcgccctggcgacattgtgcagttcaagcctatcgaccgcgacgcctatgacttggcggtggccgaggtggacgccgggcgttttgacctgcgtatccgcccggtggaattttccctagacgcctttctcgccgaccccatcggctatccgaaaaccctgcaggaggcgctggcatgatcaaggtgctcaaacccggcctcgccacctccgtgcaggaccttggccgtgaaggttattaccacttgggcattccgccctcgggcgcgctggaccagtacgcgttgagcgcggccaaccatctggtgggcaacccgctcggtgcagcggggttggaatgcacgctgatcggccccgaattgttgtttcaacaggacgccctggtggcactcagcggtgcgctgatgtcgccgcgcctggacggtgaagtggtgcaccaggacaccgccttccaggtgcgcgccgggcaagtgctgcgctttgagtttcccaaggcgggcgcgcgtacgtacctggcggtggcgggcggcattgatgtgccgctggtgcttggcagccgctcgacttacaccctcggcgcgctgggtgggtttcaagggcggcgtttgcaggaaggcgacgaactgccgatcggcgaagccagtgggcagggccgtgcgggcaacagtttgccgatggcgctgcgccgttcggtcggcggtgatgtgaccttgcgcgtggtgccggggctgtattacgaccggctgacggacggcgcaaaaagcagctttttcgccgaaccgtggacggtgggttccgaggcggatcgtatcggctatcgcttcaagggcggcagtgcgctgagctttcagccgcgcgagcagccgtttggcgcggggtcggatccgtcgaacattgtcgacagttgctacccgattggctcgatccaggtgccggcggggttggagccgattgtgctgcaccgggatgcggtgtcgggcggtggctacgcgatgatcggcacggtgatcagtgcggacctggatttgattgggcagatgcagccgaatcaaagggcggggtttgtggcggtgacgctggaagaagcgttggaggcgcggcgggtgtacaagaagcggctgaaggccatggctggcctctttacttcctgacaccccctaaaacccctgtgggagctggcttgcctgcgatggcggcgggtcagcttacctatctgttggctggtacaccgctatcgcaggcaagccagctcccacagttttaacggtgttgtgtcagaacagttgggtgaacagccagtagaggctgcccgacagcaaaatcgccgccggcaatgtcagcacccacgccatcaacaaattgcggatggtcttcatctgcaacccaccgccattggccaccatggtcccggccacaccggacgagagcacatgggtggtcgacaccggcaacccatacatgtccgctgcgccgatggtcagcatcgcgaccatttcagccgatgcaccttgggcgtaggtcaggtgggtcttgccgatcttctcgccaaccgtcaccacgatgcgcttccaaccgaccatggtgcccagcccgagggcgatggccacggcgatcttcacccacagcggaataaagcgcgtggaattgtcgatctgttctttgaacagcttcagcttgccttgggtgtcggcatcgaagttgccgaccttgtccttgtccatcaggcgaatggtttcgctgctcaggtacatgtcgttacgcacgttgcctaccgcttcagcggggactttggccagggagccgtagccttttacttcgtcaccgatctggccggcgagggcggcgagggccggcaccagttccggggtggcttccttggtgcgcacgtaggtcgaaaggatcggccgcgggtcgcccggcagtacttgcggtgcgctttttaccagcgccacttgggtcacttcggccaccgccgcaaactgcagcgactgctcggcgggcatggtgcggttcagcgcataggccatcggcaaggtgccgaccaggatcaacatgatcaggcccatgcctttctggccatcgttggaaccgtgggcaaacgacacaccggtgcaggtcgcgatcagcatgccgcgaatccaccaaggtggcggggtgtcgccctttggcgctttgtacagcgagcggttttttacgaaggcgcgcagggccagcaacagcagggcggcgaaggcgaagccgatcagcggcgagagcagcaaggcataaccgatcttgatcgcctggctccagtccacaccgctggtgccgtcacgcccgtgcatcaaggcattcgccacgccgacgccgatgatcgagccgatcagggtgtgcgatgacgaggccggcaagcccagccaccaagtgccgaggttccacaggatcgcggcgatcagcagggcgaagatcatcgcgaaaccagccgatgagcccacctgcaaaatcagctcgaccggcagcagggcaatgatgccgaacgccactgcgccgctggacagcagcacaccgaggaagttgaaaaagcccgaccacaccaccgcaaagtgcggcggcagcgagttggtgtagatcaccgtcgccaccgcgttggcggtgtcgtggaaaccgttgacgaactcaaaacccagggcgatcaacagcgccacgccgagcagcaggaatggcgtccaggtggtcaccaccgtgcccagttcgtgcatgtcgtgcatcaggctgtaggcggtaaacagcaaacccatggcgagcacggcgaagaaaatgatcaccgtcaccaggccgggttttttatccaggcggggtttggggtcagcgtgtgacgcggtggaggaggcagtcagggaaggggtggccatgccggagcatccagtgtgaggaggatgtcgttgatgatcattgcagaatgttacagagatgctgcggtaagtcagtgtttaaggaattggctgtgccgctggtctacaaaccgacgcaaactaatgtcagagtgcgatcaatgtgggagctggcttgcctgcgatgcgggcatatcggtctttcagagacaccggggtgatgctatcgcaggcaagccagctcccacacaagccagctcccacagttgattgcatgaccaggtcagtagtctttgcgtttgcggaacgcccagcggccggcaatcaaggtaaacgtcgccaccagcgccaccagaatccagaacccctccgggtcggtggaaagcggcacaccacccacgttcatgccgaaaaaaccggcgatgatattgatcggcaacgccagcaccgtcaccacagtcagggtgaacagcgtgcggttgctttgctcgttgaggttggcggcgatttcttcctgtagcaacttgatgcgctcacccaacgccatcaggtcgttgatgatcagcgcaaattcctcggtggatttgcgcaactcctttacgtcttctttttgcagccactgcggcgggcggttgagcaggcgcagcaacgagcccggctccagcgccagcaggcgttgcaggcgcaccagcacgcggcgcgcggcacccagttcggcgcggttggtggacaggcgcgaggacagcaactggtcttcgatatggtcgacactgatgctggtcttgcgcacgatctgcgtcagcacttcgccctggtcgcgcagcaaatgcaccagcaattccagtggcgagcgaaagcgttcaccggctttcaccgatgagcgcaatttatccaccgaatgcagcggttgcaggcgcgcactcaccagcagacggctgcgggcgcacacccacaacgtggaaatgtccgacgagaccatgctgctgaagttgaacaccacgtcgttgaccaccgccagcaaggccgagtcgacgtgttcgatacgggtggagcgcgagccttcgtgcaaggcttcgaaaaactcatccggcagcgacaaatgcgtttgcatccagcgctcgcacgcggcgtgggccaggttcaggtgcaaccaaagaaattcttccgggtcttgcggcgcctgcaaggcggccagcgcggtggccgagtcgatctgctcgcctttttcaccgggtcgaaaacgaaaaccgtaaagcaggccaaacagatcgggatcctggtggccgtggtcgatgctgtggttcatggaggctcgcagagaaagcgcctgtaggacgtttcacaggttcgcgtgggcgaatcattgcaaggcgggatgacgattttgtgacggtttgaaaacttacctagcgggttttcagggtgaaggtgaacagcgtgcctgtttgcgcgcaggatgacacttcaagctggccgccgtgggcatcggcaatctgcttgacgatatacaaccccaggccgagaccggcttgcggcgtgtctttgaccggtcgcgagtagggctgaaatagtcgcggcagagcgagttcgtcgatctggccggggtttttcaccgtcagtgtgaactggtcatcctcaacccgcgcggtaacttccaccgggccgtcgtggctgccatggtggatggcattggctaccaggttggagagcaattgcgccagtcgatcgcggtcgccgtagacgccgctcaggtcgccgatatcggcctggatcaggcgttgcgggttcacactttgcacttccagcaccacatgctgcaaagcgtcctgcaaatcctggcagtcattcaggtgcagcgggatgccactgcccatgcggccgcgggcgaaatccagcacatcttcgaccagttgcgaggcgcgccgaccgctggtgaggatgtggcgcacaagggtgtcggttgcagggttcgggtgtttacgcagcaaccgctcggcgccgaagttgatggcgaacagcgggttgcgcaggtcatggccgagcacggcgatgaattgctcgcgcagttcggcagtgccgcgttcttcctgcaattgggcctgtgtattttgcagcgcctcttcggcttcaatctgcaacgacagcacccgggcgaacgattccatggtcgactggatcgtgctgctgcgcagcggcgcggggttggggtcgagcgcgcaaagggtgccgaagaagcgcccgtcagtgcggaacaccggcaccgagatgtagctttcaaagtggtacatgcgcggggtgtggtggtcgtggtagagcgggtcttcgctggccttgtcgatcaccacggacgcgtgggaaccgcgaatttcgtggcagattgtggtggtcaggtccagctcgccaccgacgccgaggccaaactccaactggtcgagcacggcgcaggcggtccaggtgtcgtcggtcacccgcgccacggcggcgaagcgcaggccggtcatgtcgctgatgactttgagcatcgcgggtacggcactgatacggccaatagtggcgatgtcgacggctttctgccccatgcagcgatctcgattccgaaggtggtgggcgttgtgcccgaaccaatgcagggattctagcgaccttacgggctgtgggtgtaatttcattaactatgtggatacttttcctacgcttggctgatgagcgagcaaaaaaaaccgcgctactttaaaaagtggcgcggtttttttggcggttgaatcaggtgtcttgtttgttttccagcacggcagcggttttggcgtcgagcttgacttcaaagcgtttgccggcggtgtcggtcacgtcaacttcgtaaaccagtacaccgtttttgtggtccagctcggtgtcggtgatgctggcaccagggtgagtggcgacggcagcggcgttgagtttctcgaaaggcatcaccgcgccggatttgagcaggccttcaatatgatccggacgaacatccgcctgggccagaccggcagtcagggtcagggcggtagcggcgaacaaagcagtcagggttttcatggtgtgtgtccttctgggtgagctgtttaagtggcgccagattaaccggcgcaacttaactcatccttaatggcgcactgacacctatgcggcttgacgcttagtagccattgtccttgagcagatcctgcacactcgacgacggccagcgcttgtagaacttcaacagttcggcggcgcggttggtgaagatgccatcgacgccggccttcatcactttctcgaagtccaccggctcatcgacggtgtagacgtgcaccagcaggcctttgtcgtgggtcagcttgttcatttcaggcttcaccaggtcggtgtagctctggtcgccatggttggtcagctcggccgatgggcccgtgccgatggcgccgaggctcttggcttcgtcgacccatttttcgaattcggctgcatccttcggctcttgcttggcgtagtaagcggctttggtcggctcgcccgactcggcgaaggtttgcgcggacttcggctcgatgctgcctgggccaacccacaacagcaggattttcggggtgttgggcatttctttttgcagctctttcaagctgtctttttcaaacgtctgcagcaccacgcggcccttgccctggccaacgccggtgttgctcttgcccagcttggagccggcggagctcaaccagcccttgtccagcagcttgtttttcaggtcggcttcgatgcccgggaactgcttgggttctttggtctcgatgtacaggccgggtttgtgctgcgggttgccttcggcgatcttgatgatttcatccaggctctggattttcaggccgacgaacgcagggcgcgcgcggtccgggtaggcggcgttgaaccagctgccggcgtccagggtgcgcaattcggcccaggtgaactcgttggccggggcgtctttacgttccgggaacttggtggccacgtcggtggtgcgctgcaggttgttgtcgtgcagagcgaacaacacgccgtccttgctgcgctgcaggtccatttccaggtagtcggcgcccaggtcgcgggccagcttgtaggacgcggcggtggattcgggggcgtcgtaggaagcgccacggtgggcgatgacggccgggtacggaatgcctgcgtttgtcgccaattcagccgggctgatcgggtcggcagcctgtgcctggccaaggccgagcatcagcgcgagcagcagggcgctcttggtaaacgtgacaggcatatgcgaagtcctttcgtggaggtaacttgagaaggtgtcctttttaacaattgattgcgaaaggcgctatcaccaaaccgacattaaggtgctcacgcggcatttttccgggtttttttgtgcggggttgcagtattcttggccgagctgccccgttagagggccgtaatttctgccacgcgtgtaaaccatctttccagtcccagtgggacttttcagtgaggtttaccatgcgcatcacgtccgaacttatctgccaggccgccgaccaactccacggttttgtcggcctgaaccgcaagactggccagtacatcgtacgtttcagcgaagattccttcggcatggacgtcgccgatgacggcatcatccccaccgccgagtttgtctggctgccagcccccgaccacgccatgaccttgtcgcgagagcgcattcaactgctgctggaccagaacatcgacgaccgcatcaacatcaccgagccgttgcgcgtgtatatgcgccgggtggaaatcccgcagatcagtgcgttgcgcagtttggtgagctagttcacacacgtttctgcaaggtggagatccaaatgtgggagctggctggtgtgggagctggcttgcctgcgatgcagacgacgcggtccctgagtaaaaccgagttgatgccatcgcaggcaagccagctcccacaggatcaggcatttcaattatggaaggtgtaggcccgttccaccttgcacacgcgtgtttgaaacgccgagtaccacgtggcgcgcccttgttcgcgcacttcgcgatgctcggcttgcctcttccaggccaggatcgccgcctcgtcctgccaatacgacacggtgatccccaagccgtcttcgcgtgccgactccacgcccagaaaccccggttgctcacgcgccagttcgagcatgcgcgtggcggccgcgccgtagccttggtcaccctcagtacgtaatgagctgaaaatcaccgcgtagtagggcggggcaggcgtgttggcgatcattgcgacacctgccggcaggccttgagcagggccagtgccaacggcggcgtaatgcccttaagtgcggcgcgttcgggttggaacagtgtggcgacgaaaaacgggtggtccagcagctcgatggcacgcaggtcgcccgccgaatcgtggccgctggcaatcaaatcgccttccagcagtgcctcggcgaattcggggttgaggccgtagctgcagcgataaccttcgtgcagctccaggtggccgtaggcgtcggcgatacgtgtgtagggcaccaggcgcacggtgtccgttgcctctaccagcgcgcagctcagcggcgtgatgaccgcgcgtttggcctgtggggccagttcaccgtgttctgcatcggcccagcccagtacgttgcgggcatattccagcacggcgtgttgaaaaccaccgcacgtgccgaggaacgggcgtttgcgttcgcgggcaaaacggatcgcccgcagtgcgccgtcgatgtcgcggtaggggctggcggggacgcaccagaagccgtcgaaggcgtgcagttcggtggtggctgtgatcgtgtcggtgtccagccattgcacgtggagtgtcaggcccaatgcgtcggacgcctgttgcagggcgacggggatggcctggtgcgcagtcacgtcggggttgtagtcgccgatcagggcgaggtgcagggcggtggctttcatcgtgtacgtcccatggcttgttgtgtcctgggacgcactatagattggcgctcacgcaatcaaaattggcgtttgcccatatgctcaatgcagccgcgcactatcaaattgattattcggacctggcgttgatcctcgccctggtgcgcggcggcaccctggcgcgggcggcggcgctattgcgggtggatgtgtccacggtattccgcgcggtgcgcaggctggaggcggccttgggccagactttgtttgaaaaaagccgcgccggttacctgcccaccagcttggccagcaacctggcgcaacaggccgaacgcgcggaacaggccctggaagccgcgcgcattggcgtggagcagggcggtgaagtgatcagcggcaccgtgcgcctgacctgtaccgactcggtcctgcaaggcttgctgctgccggcgctggcgcagttcatgcccgagtacccggcgctgaccctggagctgagcacctcgaatgatttcgccaacctcagccgccgcgatgcggatatcgccctgcgcctgaccaagacgccgccggagcatctggtcggccgttgcctgggcacggtggcctatcaggtgtgtgccagtgccggtttcgcccgtcagcatgcaggccgcgcgctggccgacctgccctggattgcgccggatgacttcctgcccgatcaccccaccgtggcctggcgccgcgagcacttgccgggcgtgcgccccagttatcgctgtaacagcatgttgtcggttaccgagctggtgcgcgcggggatgggcgtggcggcactgccggattttctcttgggtaatgggctgcaaccgctggggccggctttggctgggcgtgacacggcattgtggctgctgacgcgcccggattgccgggcgctgcgttcggtggtgacgctatttgatgagctggggcggcatgtacgattgccatgaacgacgccttttgtgactggcgggcttgctgtggcgagcgggacttgtcgtggcgagcgggcttgccccgcgttggggcgcgaagcggcccctgctccaggcactgcggtttgactggaaaaatgcagtgaccgtattggggctgcttcgcagcccaacgcggggcaagcccgctcgccacgacaggtcccgctcgccacgacaggctttctcaaggcaaccgctgcgccttcaaggtttacgcatgaactgctcatgcatttcgcaggtcagggtctcgatacgctcggtcagctgcttggtcatttccgtcaggcgggtgttttgctccagcagttccagcagctgtttggtggtctgttcggcctgggcctggcgctcggtattggcgatggccagggcttcgcggtgctgggcatcggcgtcggactgggctttatcgcgggcagcctggcgcgtctgggccagcaggatcagcggcgcggcgtacgccgattgcaggctgaaagccaggttgagcaggatgaacgggtacacgtcgaagtgcgtgacgccggtgatgttcagcaccacccacaacaccacgattgcggtttgtgcaccgagaaacgtcggcgtaccaaaaaagcgcgcgaacgcttcggccttgagggcgaaggtgtcattcccgaaggtcggcgccaggtgcgcgtggcctcggtgaaaacgcaggtggtcgacgggggcggcggctggcttgtctggggtcatggcgggctcgaatccttagcgtaaagactagtcagcactatagaccgagccctcggccagacacatgaagatcaggtcagttgttgccccgctcattggcaaacgcgctcacggcctgcacggcctcgccggtgccttcgcgaatctgcaggatcaccgtgccggcctggttggccaactccacacccagggcggcgcggtcgcgcgtgccttccatgctgtcgatggcttggcgggtttcctcctggatcatcgcgatcatgctggaaatttccgccgtcgagccgctggtacgggccgccagttgccttacttcgtcggcgaccaccgcaaagccacggccttgttcgcctgcacgcgcggcttcgatggcggcgttgagggctaacaggttggtctggtcggcgatgccgcgaatggtgttgacgatggcggtgatctgctgcgagcgctcgccgagcttggcgatcaactgcgacgagccatcaatgtcggcggcaatttcgcgcatgccagtggcggtttgctggatcacatcggcgcctttttcggcgatgtctcgggtattgcgggagatgtggtaggcctgggcggcgctggcggcgtcggccgcatgttgttgcaccctggcggtgacgtcggaggcgaacttcaccactttgcacaggcgcccgctggcgtcgtacaccgggttgtagttggcttcgagccagacggtctggccgtttttatcgatacgctcgaactggccattgaacagctcgccctggttcagacgtttccagaactcgctgtaggtcgcactgttagccagttccggcttgcagaacaggcggtgatgcttgccctggatctgcgccaggctgtagcccatgcgctgcaggaaattcgagttggcggtaatgatggtgccgtcgaggttgaactcgatcaccgccatggcgcggtcgatggcgcccagtttggcgttggcttcgctttcggcctgcaggcgtggggtgacgtccatcgcatacttcaccactttgatgacctggccggtgtcgtcgcgcaccgggttgtagctggcttccagccacaccgactgaccgtctccggccacccgttcaaaggtgcccgattggaattggccgttgcgcagttgcgtccacaactggttgtactcggcgctgcgggcgaacgcgggggtgcagaacgctcggtggggctggcccacgacctgttcggcgcgataactcatggtcttgaggaaattctcattggcccgcagcacggtgccctgcaggtcgaattcgatcactgccatggagcgctcgatggcatccagcatgctggcttgctgggcgttggtgtgctgcagggtactgatggtttttttatgggcgttgaatagcatgttcgaaggctcggggaagcacgcgtctgaggtatccatgaatttgcgcctgcccccgtagggccgcgggccttacggttgacttgctcattgtcagcttccttgtgctgacagaggggggttgaacaacggactcagagtgatcggcctgccaagaagttcgccaccacggcagcgttcttaatggctatgcgaccaatggcggcattatgctatcgctgcagggcagcggcagaagattcagacgagatgtcgtcggacgactcaggcggagtgggcgactacatagtcgctgacattgacccggttacgaccggtgtccttggccgcgtacagcgcgcgatccgcagcgttgagccacatcgcggcatcgctgaaggacgcctggaagtcggccaggccgatgctcaggcttacgcgcagctcagggatctgcgggttgcgatagttgctgaaggtttcgcgcatctgttccatgacctgtgcggcgtcttccaggggcatttgcggaagaatcacacagaactcatcgccgccgtaacggcccgccaggtcgttttcgcgcaacactcggcgcaattccaggctcaattgccgcagcacggcatccccgacgatatggccgtgggtgtcgttgatttgcttgaagtggtcgatatcaatcagggcaatggtcgcgtggctttgctgcagttggcatttgtggaatttcaggtgcagcaagtctttccaggagccgtggttgagcaggccggtcaggctgtcggtgcggctcagggcgctgagggcgcgtttgtgttccgacagtttgattgccagttggtagcagaccatgccgatcgccatcggatagagcgtcagcatcggcaggcaggtataaacctgggccaggctgacgttggggttgaattttatcccgaacaatacccaggcgatcccgatacccgcggcctgtgccagcagcccacgcaggaacaggcgcttgccaccggccgcgacgttattcatggtcatcatcgacaggatggtcacagccgtgagtggcgtgaactgcgttgcggcggcccagaacccgccgagcaacgagtcatagagcaggttgcgctgttcagcctggtagggaaactgcgagcgcgtggagagctggaacgccacatgcgcccaggcataaccattgaataacagcaacgcccagacccaacctggcatcgccaaagggtaaagggcgccgacgacactgatacaaccgatacccaggccgatgatccttggcttgtaaatacgcctggcaaatgaaagccctttgcctcgtctgttttccataatgttccgggtcagctcttttttttgcagatacgacagcgtgcgtcagcggctagaaccgttgatcggataatagttgtgaatattgtcagttattcgcgtgggaataatcagtgtccttccaagccatttgcacggcacagcgtgcgaataagctaaaaacgacccggaatgtcgttcatacaactgatttttactgcgggtggggagcgctgacttcgtagccggccaggaacaggtcgatggccgactcgataacgctggcctggctggcttcatcaagcgtaggttggcccagtgtgatttgcggccagaaggcgaacgccttgagcaggctttgaatctggtgcgccgcgaaggccgggtcggagcagcgcaggcgcccgtcttcctgggcggcgcgcacccattgggtgaaaccctcttcgcgcttgctcaggcggttgaccatgtcttgcgcgcgttccggcgagtgaatggtggcggcaatcgcgacgcgggccaggtcgaggaagttggcgtccgacatcatcttcatttttgcctgcagcaagccacgcaactgctcgcgcagcgggcgatcactggcgtagctcacgtccagctgggcgacgctgctggcccacagttggtggagaatttcggcaaataactcttccttgctggggaagtggttgtacaccgtgcgtttggaaacgcccgccgtggcggcgattttatccatgctggtgacctcgaacccgttcgcgcgaaactcggcgatggcggctgccacgatggcttcgcgtttgcggtcggtgaggcgttggggagcagtcatggagtgcgttcggctctaaagggaaattacactcggtagtttacttgctccgggttttgttgcaatctagaaactacactgtgcagtgtaattatagggcggaatgtaggagtcactcagtaatggccacgatttcaagccgactcgatccagcgccagcggcgcccaagactgccgagcaggagcaagggcatttcagcaacgatgcaccggtgcaacacggtggcttcggcaagacgttgcgtattttctggaacatgctttttaacaagccacgcagcacgcgccccgtgggcaacattccggtgcaaccgctgacgcgcgagcaactgttggcggctcctgatcacagcgtttttcgcttggggcattccaccgtactgctgaaaatgcgcggcaaattctgggtcaccgacccggtgttcgccgaacgtgcctcaccgttcagttgggccgggcccaaacgcttccaccagccgccgatcagcctggaagacctgccgccgctggaggcggtgattctttcgcacaatcattacgaccatcttgaccataaggccgtggtccaactggctgacaaaacccgttactttctcgcgccgctgggcgtgggcgacaccctgatcaaatggggcgttgatgccagcaaggttcggcaaatggattggtgggcaggcaccgaggtggacggcattcgttttgtcgccacaccggcccagcacttttccgggcgtggcctgtttgatggcaaccagaccctgtggtgttcctgggtgatgatcgacggcgcgcggcggatttttttcagcggcgacaccggttattttgacggcttcaaacgtatcggcgaactctacggcccgtttgatctgacgctgatggaaacaggtgcttacaacgtcgactggccccatgtgcacatgcaaccggagcaaaccctgcaagcacacatcgacctcaagggccgttggttgctgccgattcacaacggcactttcgacttggccttccacgcctggcatgaaccgttcgaccgcatcatggcgttggcctgggagcgcaatgtgtcgattaccacgccggcgatgggccaggcgttcagcttgaaccagcctgagcgtgggcatgcgtggtggctggaggtggaaactcaaggtgccaaagagcacgctgcaggctgacacgcgaggccgtggagaaatgagttttcagggtgtttcagccctgcgacaaacagcagatgagagtgcgatcatcccggcaacgtaattgtcgggagccgtttctgatggagaaaaattgttgggaacattggcgattgggtctgccctgtggccccgtgctctccatgccgggcgctggcgaagcggccggcacgcggccggccccggcgcagctgcaaaccgataaagcgagcccaggcggtatcgtcttcggcgccgagcagcctacggggcgcacgcttattcccggctataacgccatcgccccgccgatcatgcccctgcgagatcctgcattatccctcgtcgccttgagcggtatcgatcccgcagagcctgtgatggtggaagtccctctggtgatgaataacaccaccttcaccgcgaccaaggtgctgtacggctggcgcatcgggttcgctgagcggtatgtgcgcggggggcattacgaactcgtcgaacacagcgcggccttgcttcgagctttccacattctgcgccaggccggtgcgcaattggtgccagtggacgcgcgacgtgcggatccctcccttcaattcactctgcagcgcaatgaaatcgatgagcttgtgatcgagcatcgtcttgatgccttagtgtctgacggccagagtgcagcctttcatggcgcatgtgtcagtgggtacccctcgcattgcgaaccgttggcgggcggggcgaagctctggttttatggcgcacggtgttctcgcgacgcgttgcccacgttgctcctggcctatcgacagatcagcgctggcgtgtcagccggccaggggcgattacgaggcgcgctgattactcctactctgtaagtggttacggtcttaacgtgtgcagtgggccgggttcctagaatggcgaacggatcaacgttgatccttcatgttctcggaactcaggagagtccatatggttgccatcgcttatggcatgtattcgatcatccgacagagtgcgcagtcactggccgcaagccaaccagtagccgatgcgaaacctgtcccggcgggcaccgaatacgccagtgttcgcgaacttggcgagcaaatggcacggccaagcggactaacctcggtcgatttggtcagttacctgcaagcgcgtatccaccaactggacccgcaactgcgcgctatcattgaaaccaatcccgacgcattggcgagcgcgcacgcgttggatcgcgagcgtgccaatggcaacgtgcgtggcccgttgcatggcattcccgttttgctcaaggacaccatcgaaaccacgggcatgcaaaccagtgcaggtgcattcgggctggtgggtgagcctgccgataggaatgcgccaatcgtggattacctgctcaagcagggtgcggtgatcctggggaaaaccaatatgactgaactggccggttttcgtggtgggcccgatggcaagagcagccggggcgggcaaacccgcaacccgcatcagccggatgccgatgtcggcggctccagctcgggctcggcggcagcggtagcagccgggctggcacctttggccgtaggcgctgaaaccaatggttcgatcatcgtgccggcggcactcaacggtgtggtggggctcaagcccagcgtgggcttgttgaatcgcaacgggatcattcccgccagccagcggcaggacacacctggcccaatggctcgctcggtacatgacgtggcgttgatgctcaacgcgatgtcgggcagtgacccgcatgaccccgaaagcctgggagcgccgcaaggcatcgattacaccagcctgttggttccgggggccttgaagggcaagcgtatcggctaccccacgatgtttaccttggacggtgaacatctgccggtggaaaacagcccgcagtttcttaaaacactggaagtgcttcgcgaacagggcgccattatggtgccggtcaatttacgtctggctgacgactcacgctacgaggaactgctgctctcggatgtgaaggaggagctgaatgcctatttggccaatcgccccggactgccggtcaagtcattgaccgaattgatctcgttcaacgaaggccgcgatggcactgaggtcgagcaccagcccgtgctcaagcaagtcagcgcctcaaccctgacccctgagcagcgcaagacgctctgggacgcgcttatcgaagattttcgcaacacggtggataccccgatcagaacgcataacctggatgccatggtctcggatttcgcgaccaacagttactttggtaccgctgtcgccggttacccagggatcaccttgccttccggaaccgatgacgacggcctgccaaccggtgcctacttttttggcacccgttggtcagagcccacgttgttggccatcgcctatgggtatgagcaggcggcccaggcggcaacgaaaccgtttggctgactacacgccgtaacgtgccgccgggctgctatgtgagaggttagggcccagggccaggcgcgctgcttcgtaggcctcccaatccaggctgtcgggcagcgatgggatggtgaccttctcaccttgagcgagcccggccagggcagcatccaccagattcgcggcgctcatcaccatcgttccgggcaggttattcaccggcagccctgcgacatcccagaactcggtggcggtggccccaggcagcaccacttgaacgcgcacacccttgtcgctcagttcatgttcaagtgactcgctgaacgcctgcacaaatgccttggtgccaccgtacacaccgttcagcaattttggcgcgagcgctacgatggagccgatattgatcagggtgccgcgaccctgggcgacaaaactggtcgcggcggctttggccaggcgggtcagggccagcacgttgagcaggatcatcgcctccatcttgtctgcgtcggagtccagtaaggacgcggtggcgccgacaccggcattgttcaccagcaggctgatgcgcttgtcttcgtgcaggatctgttcgatacgtgccaggtcggccggcaggttgaggtcggcggcgaccacttggacatcccgttgggtgtcggctttgaggtgcgtcgccagttggtccagacgctgctggttgcgtgccaccagaatcaggtcgtaaccctggcgagccagacgatcggcataaagggcgccaatacccgaagaggcgccggtgatcagggcatagcctttggtttgagtcattgcagttgctccaggatggccgaggaaagttcggccttgttggaacccagattatgggtgtaacgtgatgtctgcaatgtcgtatatccctcctttagagacatgaggtttggccatggtgtctgtcggtattttgttgtttccagagtttcagatgctcaatttgagcacgacaacagtgttcgaatttgccaacctggaaatgccgcagcccttctatcgggtagacctggtgtccgagaagggtggcctcgtcaaaagctccatggggtttgccattgataccgtgccctttggtctgcgcccctacgacacgctgttagtggcgggggacaacgatgtgctggaagccagtccgggcatgctcgcttacttgcagcaagccatgctgaaatcgcgccgtgttacatccgcttgcacggggtctttccacctggcagcggccgggttgctggaagggcgtaaggccaccacgcactggtatcacgcccgcgcctttcgccaggcctacccgaatgtaaggttggaagaagaccgcatcttcacggtcgacggcccactctggacctccgccggcatgaccgcgtgcctcgacctggcactggccctggtcgaaaacgacctgggtgtggaggtggcccgcgaggtggcgcgcaaattggtgatctaccatcggcgtgcaggcggccagtcgcagttttctgcgttgctggagatcgaccccaagtccgaccgtgtgcaaaccgccctggcctacgctcgccagcacttgcaggaagagctgtcggtcgagcagttggccgaggtcgcccacctcagcccgcgccagttcagccgactgtttcgcagcgagaccgggcaaaccccagccaaggcaatcgaatgcctgcgcattgaagcggcgcggctgatgcttgaatccggcgaccacgccatcgacatcatcgcccgagagaccggcttcggtgaccccgagcgtatgcgccgcgccttcctgcgtgcctttggccaaccgccacaaatgatgcgccgcgcgctgcaattgcaagcctgatgcgtgaacagatgacactcaatgcacgggggacgccatgagctacaaaattcacatcctcggtgcggcgggtgcaggcaccaccaccttgggcaaagccctggcccaacgcctcaacgtggcttatttcgactccgacgacttctactggcagcaaacccctgagccctttaccgtcacccggctgcgagacgaacgcacccgtttattacaggaacagagtgccggcctcgaaggctgggtactctccggttctctgtgtggatggggtgacgccatgatcccgcagttcacccatgtggtgttcctgcgtgtggaccctcacgttcgccttcaccgcctgcagcttcgggaagtgcaacgctatggcgaccgggttctggagggcggcagccgccatgaaaacagcatcgcgtttctcgcctgggcggctcgctacgatggcggcaaccatagccttcgtagcctgcgtcggcatgaaagctggttgaaaccgctgacctgcccggtgattcggttggacgctacgcaccattcggttgaggcgttggtgaatcaattgatgccgctgttgagcccatcagccgcgaaatgatgccttgtgaggcgggctcggatggggcgctgtcaaacttgcgcacactcatcccccaccccggcgcaaaccccgggaaaaacaccagcccttcagcttccagccgaaaagccaacgccaagcgggtttcatcatccacatcgccctggctttcaaagcgctgtaccgcttccaccgccaacccggcttgtcgggccagttcttcgcggctccagccgagcatcgcgcgggcctgcacactgtgtttggtggtgaattgatgcaggacgatctgctgttctacgaaagagctcattgccagagaggacatggggtttctccaggattcgacgggggagggcaaactatactgtgtttttgtacagttgtttctaccgctcatcaactggatttttttgatggcaattcagccatcgactattccactcccggcgcctcccgaataatcaggtgatccaggttctcgatattcgcactgaataccccgaaggtctgctcggggttcttcttgctcggcacctgtttcaactccggcgttaccccatagaagaagcaatacaacgccttttcgctgcctgccgccgccctgatctgctccaggaaagccgtgcgcttgcggtagttctcgatgagttttttgctcaggtagacgttgaccgagtagggctttttgtcgagccataccttcttctcgaagtcgatgcgaacgctggcggtgtagtccttgatcgccttgattttgccccagtagataaggcccttgttgtcctgcaggtattcgatcttcttgaaaaacgtccagtaagtcgccgtgtgatcgccgatcttcaagggcatgcgcttgagcttgtccttgtcatcgatgttggacacgtagcattccaccggatgagcgaacacgctggttttgtctggggtggtatcgctggcgctgtgggacacggcgacgcgatttgacggtgctttcgcaggctcctgcggggctgaaccttcggtgccgggcaccggtgccttgcgttcgtactgacgtcgcgtcagtacgaattccgaggggaaattttcctcgcgctcgtcgtcaccttcaccggtcgcagtcttgtgcgtgctggcatagcggcagccgtcgatatgtcgggtgccggccttgttcttgaagtgcggcgtgcgctgatagttgacgtttttggcgttgaaggtactcagcgcattgcccgcatcgaacgctgcgcggcattcgtcgttggggcacaggaagctgtccttgtcggaatcgaaagggctggtttcgtcgaaattcaggtctcgtacgtcgtagatcgacagcttgtcatcgagactcaggctgtaggccgtgtcgaatttcatggggctcgggtccgtgagatgtatggctggatattacgcaaatagtagccgctactgagagcaaaaatgtgggagctggcttgccagctcccacattagataggcggtgttccagccacacgccgtccgcttaggaaacacaaggtgccgcctaccgcggtcaatgcgccgagggcatagaacatgctgactggggccgcattgatcaacaagtacccgcaaatcaccgggctcatcgccccgccaaacgccgccaggttttgcgcgccgtagtaactgccgcgcagcgcgtcgggggcgatggtgtcgataaacaggaactccgacgggtagataatcatctcgcccaaggtgaagacgaacatcgccaggcaccaggtgatcaggctgtgcgccaggctgaaaccgatcagcccggccataaacagtaaggtgcccagcacgatccagtagcgcagctgttcgcgcttgagaaagcggccgatctggtactgcatcaaaatcacggtgatggcattgcaggccagtaccgctgacagaatcttcagcgcctcggcgggcttgtaggccaccagcaaaaactgcgacagataaagggtgtagcgcccgtggacaatggtgctcaacaggctgccgctggtgaacaggatcagtgtgcggtcgctgcgcaacgtgcgcagggtactgaggaagctcaggggtttattgctgtcatcgcgttgcgtcggcgggatgccgatcatcaggaacacgctgccaaacgcaatggcgctggcgatcaggaagggcgccagttgcatatggccggcaatcaccacgccgatcatcgggccggtggcgtagccgacgttggtcagggtgtagcgcagggaaaatactttggcgcgatcacccaccggcaggttttcgctgatgatggccttggagccgatcaggaacagtgccgaggcggcttcagtgatcaccaacgtcagggtggtgaggtagagattgctggcaaaagtcagcaacaaaaaaccgatggagctggacagcatggccaggatcagcagcttgcgcttttccaggcggtcgatgacgtagccgccatagaggccgagcagtgtggcgataaagacggcaatgcccatgagcaggccgatgtcttgttgattgaggcccaggcgggtactcaagagcaaagcgagcagggggctggtcatggcgcggctgaccacgatggtcaccgagcagatcatcaggcggcggattaccagggagtaggtggccacggtgaggcgagcgtccttgttattgcttcaaaacaacacaatccaactgtgaacacagatcaactgtgggagccgggcttgcctgcgatggcggtgtgacaggcaatgtcggtgcaagccgacctaccgttatcgcaggcaagccagctcccacagttttttattgtgtttattggccggcgttgatgctgatcttttccaccgcaccctgctccagatcccacttcttcaggatcttgccgtacgtcccatcatcaatcatgccctgcagcgcttcactgatcgccgtgaccaactccgtgttgctcttctcaatccccagtcccgtgaactgcttggaaatcgccaggcccaccggcttgtacttgcccttgtccaacgacatcaaataaggaatcgtctcgctgccctgcatcgccgcatccagacggttctgctgcaactgcgcgcgcgcatccgccgagccttcagtgccgatcaccacgattgccggcttacccgccgcttcgcagttttccttgctccatgcggcaatttccgacggccaggtcgtccggcggctggtgccgacttttttaccgcacaggtcagtcaattccttgaggtcttcacgcttggccagggtgtaaaactgcgggccgctggtgaagtagtcgatgaaggtcacggccttctggcgctcggcggtgtcgctcatgcccgacaacacgatgtcgacgcgcttggtggtcaggccactgagcatctgctcgaagccggtttcctgccacttgatcttcacgcccaggcgctcggccagggcgttgccgaggtcgaagtccaggccggtgagtttgttggtggcggtgtccttgaaatccatcggcgggtagttcggcacgatggccgcgctgatctcacccttgtccttgattgccgccggcaatgccgcgaatacacacgaggaggccatcaggcctgcgagcaacgttgggataaacaattttttcatgggggcgttctcgttagttttttagttaagtgcgaacggcagaaataaagctttgggtacgcgggttttgtgggcttattagaatttcttccgggctgccggcttccacaatctggccggcatccataaacaccatgcggttggacacttcgcgggcgaagcccaactcatgggtgaccacgatcatggtcatgccggtggtggccaaatcacgcatcaccgacagcacttcgcctaccagctcggggtcgagggctgatgtgggttcgtcaaacaacatcaacttggggcgcatcgccaacgcacgggcaatcgccacgcgctgctgctggccaccggacaattccaccgggtaggcattgcgcttgtccgccaggccgacgcgggccagcagttccaacgcgtcttcgatggcttccttgggcgagcgcttgagcacttgcaccgggccttcgatgatgttttgcaacacggtcatgtgcgggaacaaattgaagcgctgaaacaccatgccggtcgccaggcgctggcgcgcaatctgcgattcattcatctcgtgcagcttgttgccgacgacgcggtaacccaccagttcgccgtcgacccacaggccgcccttgtcgattttttccagctgattcacacaccgcaacagcgtgcttttacccgagccggacgggccgatgatgcacatcacttcgccttgctcgacctcgatattgatgtcgcgcagcgcgtgatactggtcgtaatacttgttcaggttgacggccttgacgatgcttctcatggggcaaatctcctcaacccaaacttacgaacgcttgccggcgccgcgggcaaaacgacgctcaaggcggctttgaccaaatgaaagaacagtcaccaccgccaggtaccagatgccggccacaatcagcagctccatgacccgggcgttggcgtagtagatgttttgcgcgttgtgcagcagctccgagtactggatcacactggccaggctggtcattttcaccatgctgatgaactcgttgcctaccggcggaatgatcactcgcatggcctgcggcagaatcaccctacgcaacgcctgaaggctcggcatgccgatggacttggcggcttcgtactggccggtgtccaccgacagcaggccggcccgcaccacctcggcggtgtaggcgccctggttgatgctcaagcccagcagggcggccacgaacggtgtcatcaagtcgacggtgtcgatgctgaacaggccgggaatcgcgatcaccgggaaaatcagcgccaggttgaaccacagcaacagctgcaaaatcagcggcgtgccgcgaaacagccaggtgtaggtgatggccacgtagcgcaggatcgggttggccgacatgcgcatgattgcggtgatcacgccgatgaccacacccagtgccatcgccagaatcgacatgacgatggtgttcaccaggccccacaaaatggcctcagatgtgaggaactgcccgatgtaggaccattcgatctggccattggcaaaggcacgcagcaacgcggccaatgcgatcacgatcaacgtggcaaaaaacatccgcccgtaataacgacgcggcacgtgctcgtactgcgtgatatcgaactggttctcggacaacttgcgctcagcttccaagcgctccgccggggtttggttcatggtgactctccaaaaaaatacgtgttacctgatcgttcccacgctccgcgtgggaacgccgcctcggacgctccgcgtcccgctgttcatgcgtgacttggcgacgcggagcgtcacaggatgcattcccacgcagagcgtaggaacgatcgtcagatacgaaacccggtgtagctctcagcccacttctgctgctcagccaacgccaccttcaaccgcccaatctgctcccgaacccgctccggcgccgtcccgccccaaccactgcgcgccgcaatcgccgcctccagggtcaggcagtcccgcacctcaggcaacaaccgagcatccacctcggccaacatcgccggcgaggcttcccacaactcaatctcatgcttctcacaggcttgcaccaaggcgccggtaatctcatgcgcctctttaaacggcacaccgcgcgtagccagccaatccgccacctcagtcgccaaggtgaagcccatcggcgcttgcctgcgcagctcttccacctgcaccttcatggtcgcgaccatcccggccatcgccggcagtaccagcagcaaggtgtccacgctgtccaacacgctgtgcttgtcttcactcaaatcgcggttgtacgacagcggcaacgacttgagcgtcgacatcaacccggtcaggttgccaatcaagcgcccagccttgccccgcgccagttcggcaatgtccgggttctttttctgcggcatgatcgagctgccggtggcgtaggcatcgtccaacaccacccagcgaaactggcgcgacgaccacaggcaaaattcctccgacagccgcgaaatattcaccccgagcatgcccgccacaaacagaaactccgccacatggtcacggctggcgacagcgtcgatcgagttttcgcacggcccggtgtagcccatttccttggccgaatgctgcggctgccgcgcaatcgccgaacctgccatggcggctgcgcccaacggcgacaacgccgtgcgcgcatcccaatccaccaggcgctgcacatcgcgcagcatcgactgcgcgtgggccagcaaatggtgggcaaacacaatcggttgcgcctgctgcaagtgcgtgaagcctgggcaaatgctctccacatgctgctcggcctgctccaccaacgcttgctgcaaacccaacacctcagtggtgatggtgcgcgcatggtcacgtaggaaaaggcgcaggtcattggccgtttgatcgttacgcgaacgcccggcgcgcagcttgccgcccagggcgcccaggcgctcggtcaatacgcgttcgatgaaggtgtgtacgtcctcgtcatccagggttggatgcaggtggccggcggcgaagtcctcaccgatacggtccagggcttcgagggtgcgcaaggtctccgactcatccagcagaccggcgcgctgcaattcacgggcatgggcacgggagccggccaggtcgtagggcgtcaggcgaaaatagcgctcggggcaacgcgacaacgcggctaaagcagcagacgggccggtcttgaaacgagcgccccaaaggcggtcggtgggctgggacatcggtattcctcacgcttgtttttagaagagtcggaggcagtaaaaaactaaaaagacctgatcgtagtgtcaggtttttacgggtgttaaatcagcctctgcgtgctgttcaacccgctatattcaaggttgccaagggcggatgtttacggccattatcgccgcctggctatgttcaaggattgggttgaagcctgttgaatatggcacttgaggtcaacgcgtattatggaaaccccactttccacttctggaaacatgccgccaaaacccggcactcggccgccgctgcaactgagcgggctggacttcaaattactgcgcgtgttcatggccgtggtcgaagccggcggcttcagcgccgcgcaaaacgagctgaacgtgggcctggcggccatcagcaaacagatctccgaccttgagattcgcatcggcatgcgcctgtgtactcggggccgggaaggctttggcctgaccgaagaaggcaagttggtgtatcaggcgtccatcgagttatttacctcggtggacagtttcagagacaagcttagttcggcgcaaaacgagcttattggtgaccttagtgtcggcgtaattgataacaccgtctctgacgttaattcgccgctgattaccgccttgggtaaattacacagcgaatcaccgaaaattagattgcgcctgcatgcctcgcaactggacgaagttgaacgcggcgtagtggaaggacggctgatcgtcggcatcgtcccggtgtaccaacgccgcgaagaattcgactacttcccgttgtacgaagaaaaagctcacgcctactgcgccgcaggacacccgctgttcaacgcgagcgacatcacgccagacgtactgcgccaatacgaagtggtcaaccaccgctatgcgatccaccgcgacaaggccaacttcgtcacctacgacagccagtccgcctcggcctcacaagtggaagccgtcgccatcctgatcctcaccggccgcttcctgggcttcctgccgcaacactacgcagcgcccctggtaagggaagggcgcctgcgcgcactgtgcccggaacaggttcacctgagcaccgcgttcaacctgatcctgcgccacaacgcgccaagaagcccaatggtaaaagccttcgcaacagccctgggcgtagacctcaaagccgcgacataaaccccgccgaacaccgctcaacaagctcacgcagctcaaatgtgggagctgtcgagccccagcgaggctgcgaagggatcgcctcggtccacccgccgaactcgctatttgtatcgacccccagcaccccatgctagtgcgctgtccggcctgaaaccgatcaaaatgtgggagctctcgagccccagcgaggcagcgatgggatcacctcggtccacccgccgaccccacccacccgcatcaccgctgcaacttgccctgcttcttcttcgaatgaaaatgccgaaaatgcgcatcctgcgctgccgccaacaactcccgatcgccacgcgtatcgccccaagcccgcagccgatactcgcccaaatccccatacaccgcctcaagccgcagcaccttattctcacagcggcaattattccccgtgagcttgcccgtcaataccccgtcgaccacctcaagctcagtgccaatcaacttgatccccagccgattcgcaaacggctgcaacaccaacgccggcgacgccgaacacagcgtcaccaccgccccggagcccaactcctgctccaccgaaagcacccctgccgggcgcatcaagcgcgcccaattcttctggcaatactcctcggccttctgctgcacccacgccttctccacccccgtcataaaggtgcggatcaattgcgccttcaactcatcccggctgatctgccgcagcaaaaagcgtaagccaggcaccgccagcttgaccatccggccataaaactcgccggtgccaaaggcaaacttgaggaagggcacgaaactgtcgtgatgggtcagggtgccgtcgaagtcaaagacggagagtactttggcgtctacggggccggcttcgagcatgtctgggttcacgggttggcctcggtcctatctggtattttttgagcgttcatcaggtgtgacagcaggagtttactcgcgtgccaatcttccgatcttggcgtaaagcgactcggtgaaagcatcccggtcactcgaccggtgacaacgctgatggcaattggggcacaaggctacagcattggtcgtgcgatccgaacccttctgggcgaggtgcttgacgtgatgtacttcaagaaatggcaaaccatcgacctcgaaaggtgcgtttgaaccgcagccttcgcaaatgcccttggcttcttttagtacccacgcgcgtacctttgggtcgcggacaaaggcgctgctgacggtcgataccttctgcggctgggctatgccgtccggttgcctttggaaaggttgctgctgcagtttggatgcgcgacggataagcgtctgctcatctgccgtctgggcagcgtcttcggattcgaatacaccctgcgcggcaagtgcttggcggatgcgttgctcaacgcctgcgcctacgttccttgctggcttataaccttcaatacggtcccagcccatactgacgagcacggtggaaatattctgcatgcgaaattcaatagaccctttcgcacgacccgccaccgcgccctgacgcagaaggcggttttcgagggctttattgaaaggctggccgctcttttcccaggccaacatcttcaagtacgcctcgaccgccgctgccaactctgcatcgttccagtccgttttgtctttcgcaatatccatacagccgccgagggtagaaaacccttggacgatactgagtagccattatggcgtctacgaaatttcctacgagtcggtgggacttgccgttcgtttgcgtcagtatattcgctgcttcattcggaaaggttgggtgagctttcgccaccacggagtctttgctgactccctccgatagttccgattaaccagtaaatacggcatatcccgaagtcttatccagccttcatcttgccaatgcagcaggttcaacgacatctccggccaatccaacatgctcaacaacggtcgttccaccgttggtggctgacgctcgtccctcaacgttggaactacttcatgagtgagccaactacgcaaaaggcgattccctggtgtgtagtgatagaccagcagcgcgtaagcaccggattcgctgatcatcagcatttcttcgggctgaccgtggaacagcagttttagagtttttcgttggtcttcatcgagcttgcgagtcgcgcgctcatctaagaaccaccccatcaaacgtccaaggtcacgcgcacagaaccacgcttggttttctaggaggagggcgtgtaattgaagattatgacgagtaaaaacgaaggcaattgaaagctcggatgtgagcataccttcagcgttaggcaagttgagtagatattggctagacacttcctatgacctctacgtgatttacagaagggtggaaacccaacgtagagagcggattttaagaaactccaacttgcttggcctcgatacagcattcattccgcatgattggccatgcggtttcttgactgtgtgattgaggctagcagctacgttgggcgtttcttaggcaccgatagacgagactattcagcatcgaaattcgtatcaacctttctatggatgattttggtgtaagacggctcctatacagattaagggaggtataaaaaagccctgaacatgtcagggcttcttaatgttgcttggcttaggaatcaatcccagctcagcgcgccgccggtttgatactcgatcacgcgggtttcgaagaagtttttctctttcttcaaatccataatctcgctcatccaagggaacggattcgtcgtccctggatactcttccttcaacccaatctgcgacaaacgacggttcgcgatgaacttcagatagtcctccatcatcgccgcattcatgcccaacacgccgcgaggcatggtgtcacgtgcgtactcgatctccagctgagtcccttgcagaatcatctgggtcgcttcttccttcatttcagcatcccacaaatgcgggttttcgattttgatctggttgatcacatcgataccgaagttcaggtgcatcgattcatcccgcaggatgtactggaactgctcggccacgccggtcattttattgcgacggcccatggacagaatctgggtgaatccgcaatagaagaagatgccttcaaggacgcagtagtaggcgaccaggttgcgcagcagctctttatcagtctcaacggtgccggtttcgaacttcggatcggagatcgaacgggtgtacttcaagccccaggcagcctttttggcgaccgatggaatctcgtggtacatgttgaagatttcgccttcatccatggccaacgattcgatgcagtactgataggcgtgggtgtggatcgcttcttcgaaggcctggcgcaggatgtactggcggcactccgggttggtgatcaagcggtacacggccagcaccaggttgttggcaaccagggagtcggcggtggagaagaagccgaggttgcgcatgacgatgcggcgttcgtcgtcggtcaggccttcggggtttttccacagggcgatgtcggcggtcatgttgacctcttgcggcatccagtggttggcgcagccgtcgaggtacttttgccaggcccagtcgtacttgaaaggtacgagctggttgaggtcggcgcggcagttgatcatgcgtttttcgtcaacggcgacgcgggcggcggagccttcgagctcggcgaggccttcggcgacgtcgagtttgtcgagggcggccttggcgcgcacgatggcggcggagtcactggcggtgacggcgcgggcttcgatggcggcggcggcgccggcaccgtcgaggcggtccatgttggcttcggtggcgtggccggcgttggcgcctttagcggctacttcgccttcttcttctttgtcgaattcgtcccagctcagcatgacgtgtcgtctcctgcgtgagggctcaaaggtgcccgtgtgaaaccggatggttgggtgttcacacggccctgaggccgcggtggatcttaaggaatcgtttgttgcaacagctcgcgcaggcattaaacggaattgggtaacgggtgctctgcttgaggctgaggggcggagcgactggtgcatgctccagcgggaggcctcaggtctggctcttcatcccagtgtaaagggatattgcaggcccgatttacccgcgcattatagggaaaaattcgactttgtgttgcggcggatggtcacgattgagcgccaaaatggtgtggttttcggccaaggcgcgtgtttgcaaggctttgccggtatgggatttttttgacgggcggtgggatagtttttggcgggctgggggagg

SEQ ID NO: 42 - DNA, 113819 bp, Pseudomonas poae FL10F
tatcgcaggcaagccagctcccacatttgcattcgggttttgtcagtgaagtcgccgctgtcagcgccgacaatctgcggacctgtaacccgcaacaccgctgaacccctgtgggagcgggcttgcccgcgatagcgttccaacagtcagcacatctgtcgactgttacaccgctatcgcaggcaagccagctcccacatttgcattcgggttttgtcagtgaagtcgccgctgtcagcgccgacaatctgcggacctgtaacccgcaacaccgctgaacccctgtgggagcgggcttgcccgcgatagcgttccaacagtcagcacatctgtcgactgttacaccgctatcgcaggcaagccagctcccacatttgcattcgggttttgtcagtgaagtcgccgctgtcagcgccgacaatctgcggacctgtaatccgcaacaccgctgaacccctgtgggagcgggcttgctcgcgaaggcggagtatcagtcaactaagctatcgactgacccaccgaattcgcgagcaagcccgctcccacatttgctttcgggttttgtcagttacttttcacggttttcggcgccttgccttccttcatctgctgcagcaacggcgcgcactggttgggctcatcgccgcttggcgcgaccaaggccagcaacccagccgccgggccggcgatcacacccagcgcgaccatgcctgcaccgcgcaacatcagcggcaccgccttcacacccgcattcggcttgataaacggcccgttaacgtagagcggcgagcgcagcgagaacaggcggaagcctttcgattcaggcgtgatcgtgaggtccaactgctcggtggccatgttggccgtgccgtcgatgtagatgattgcgttctcggtatcgaacacaaacaggcgggtggtggccaggccggtcttgatgccgaagtccgccgccgcgcagttgatcttcacttccttgtcgccgaacaggcggcccaccacgtagttgcccacgttgagcccggcgatttccattaagccacggctgatcgcgccatcgttgatgagcattttcaggtcgccgttggaggtgcccagcagcgctgccacggaattaccgcgcccggaaatatccgcatcaccgttgagttcaccaaagctggttttcatcggttcgaaggtcgggaacagctgcttgagcttgaagttgcgcgcggtgagtttggcccgcccttccatcggcacggtgcggccgttcaggcgaatctgcgcatccagcttgccgcccgccacgccgaaacgcagcggctccaggctgagctcgccatcgttgagcaccaggtgggtgtaaagatcggtgaagggtaaatcggcactgtgcacgatgcgtttgccggtgaattcgacgtcggcgtccatgtcgcgccagcgttcggtgcggaactcttccaccggcagcaccttggttgccggttgcttgctttcaccgccacgggccttttgcttggcgttggagtcagcgccgatcagcggcgcaaggtcagtcatcagcagttggttggacaccagcgcgccgctgagcttggggcgtggttgactggcgacgtaactcaggttgccgtggatgtcgctgtcgccgattttgccgttgaagttttcataggtgaacgaggcaccgctggcttcatgcagcttggcgatcaggtgaccgtcagtggaataggcgggggaatcgggcagcgtcacgccggtcagcgggtatagattacccaggctgctgcctgccagtttcaggcgcaggtccagtgcgccgaggttcagcgggtcggtcagggtgccggccaacgcgatgcgggtgtcggcgattttcacctgagcttgcagcgggaacggcttggccgcgtcctgcaaggccagcaggccgccgatcttgccggtaccgtcgagtttctggccgtggtattggcctttgaccttcaggccgaaggcgtagtcctggggcgccgagcctttctccagggcctttttggcatccgcgtcgcccacgatttcaccgaaaggaatcggcttgcccagcgggtcgatgatcacgtcgagctgggtcttgagggtttggtcgtcgagggtcacgtggcccttgtcgaagccgatggcaccgatgtcgaccacccagctggaaggctcggcgttggggtctttggggtcgaatttgaaggtccagttggcacggccgtcggccaggcgctgcaagtcggcactcggttcagtgaggtcgatacgcgggatcaccacgcgttgcaccaacagcgccaacggtgaaatgcgcaattcaacgcgcttgagcgtgaccatttgcggtttcttcgaccagtcggggttgcccagcgtcaggtcttcggcgatcacgtgcggccatggcacccaggcgcgccaaccgccttcatccggctcacgtgcccacaccactgcaaggttgccattaatggcaaaggggcgatgcagctcttcggagaccttggcattgaggggcggcttgatgcggttccagtcgaaaaacaccagcaacaacaccaccacggcgattaacagaacgaagctggcgcagctccaagcgacaattttacgagtgcgcgtcattgcacaggactcctgattacgactgagggcgcgcgctgccgcgcaccttttgactacagcttataaggctacgactgacaaatggtctgggggtttacccggagttcgaattcatcgcaaaaaaagcgattcctcctacagctcaagtcgaccaaaccatcaacactgcaccggtgttacccacgaacgggtcgaaaatacccaccatggtgcaaaaccgcgggcttgagaggtgcgttctagagcctctgccgggaacaatcaattctgttgattattaccattgtgtttatgaacttttatatcgacttatcgagagtagcattagccctgtacccactttatcgccctcccaaggagcaaccatcatgaaacgccaaatactcgctaccgttctcctgtctgtcctggcttccagtgcttttgccctgccagccgctgaacaagctaccccacagaacaaagctcaagccgttcaggccagccaaaccctggctcgcagcggatcgcaagaagacgaaaaccgtgactacgccaaaggcgctgttgcagaaaacggttcggaacacgccaacaaacgcgcttacaccgaaggcgttgccgaaggtggccgtgatcgcctggaacagaaaggcctggtagaaggcggtgctgaacaagccaacgaccgcgcttacacccaaggtgttgccgaaggcggtgctgaccgtctgcaagaactgcatcaagcacagagctaagcccgtggtggccgagaaaaaagcccgatcagccgatcgggcttttgctttttgatagaccgcgttccgcctcaccccgccaagttcgacgccgacgaagcggttttgctagagtgcgtcgctgtacttgccgacaaagccaacccgccgatgctgccccgcgccgaacagaagcaacaaacccgcctcgccttgatggacgcagcccgccatctgatggagtgtggccgtgggttcggcagcctgagcctgcgcgaagtggccaagaccgccggcatcgtgccgaccgggttctaccgtcactttgacgacatggatcaacttggactggtcttggtcagtgaagtcggccagacctttcgcgccacgattcgcctggtacgccacaacgagttcgtgatgggcggcatcatcgatgcgtccgtgcggattttcctggatgtggtctcggccaaccgttcgcaattcctgttcctggcccgtgaacaatacggtggctgcctggccgtgcgccaggccatcggcgccctgcgcgaagacatcacccgcgacctcgccgccgacctcacgctgatgcccaaactccagcatctcgatcccgacggcttgcacgtgatggccgacctgatcgtcaagagtgtgttcgccaccctgcccgacatcatcgaccctcccgcccatgccctgcccgcccatctcacgccccaggcgaagatcacccagcaactgcgctttatctttatcggcctcaagcattggcaaggcctgggcagcaccgagtaagccgtcagccagccgggtgaaagcgcttggcggtggtgtagtgttttttccagtagtggctgttcaataaatcgatgcgaacgcgcttgccgctactgggcgagtggatgaatttgccctggcctatataaaggccgacatggctgacaccgctgcgcccattgcccttgaaaaacactgcatcgcccggtttgagcgactctcgcgggatcgtcctggcactggaccggtgcatggccgtcgttgtgcgcggcaaacgaatattggcttcggtcttgaacagataaaccaggaagccgctgcaatcaaacccctgatcaaccgagttcccactgccgttatagggcgtgccgagcaacgcttgggcgcgatcgatcatgttgtcgatagaggccgtagcagcggagttcgcaggcactttcaaattggccgaggcggggaagacggcacaggccagactgacaatgagtgaacataacaatactttgaacatgatggcgtcgctgtgaattgaatacggcgcacatcgtagtgaaacagcgcgtaactttttgagcgacaaatcccgctattgcgtaggacatatccgagaaaaatccaatgcgaattggatgaaagaaatttcacgcggtacacagcggatctcaacgcataacgcccacatctggtgctataaatccattaacgcaccatttggaggcgcagtaggaattgactgacgccctgttcggtggcgcgaccgtgcttgcctacagggaattcccattcgcgcgtgcggttggcaagccccttgctctagctcttttatcgctcatagctggaagcctcctgatgctggtgatccaccgccgaatcgccccccaagccctctgggccgctgaactgctgctgaatttcgaagcacgcagcaagagccggctgcgctgtttcagtgccgatggcgaagacgtcggcctgtttctggagcgcggccagccgccgttgcacgatggcgaatgcctacaggctgaagacggacgcgtcgtacgcgtcgtcgcccgccctgaacaactgctgcacgtcacctgcagcaatgcgtttgaactgacccgcgcggcctatcacctcggcaaccgccatgtggccctgcaagtcggcgacggctggctgcgcctgctcgatgactacgtgctcaaggccatgctcgaacaactgggcgcacacaccgaaaccatcgaagccccgttccaaccggaacacggcgcctatggcggtggccatcaccattcgcgccacggcgatgaagacttcaactacccgcccaagctgcaccagttcggcgtacgtctatgaacccagcctgggcgctgttgcgtctggccagtccgcaattgccgattggtggctacagctattcccagggcctggagatggccgtggaaaatggccgcgtcaatgatgccgcgagtgcccgacgctggatcagcgaccagttgctgctcaatcttgcccgcttcgaagcgccgctgctgcttgcccattgccgcgccgccgccgaacaggactggccgcgcctggcgcaatggtgcgaagagcaccgcgccagccgcgagacccgcgagctgtatcaagaaagccggcagatgggctactccctgcaacagctgctcaacggcttgccggaactggacgacgccgcgcgtgggtttctggcgcagtccgccgaaccgcacctggccctgggttgggccctggcggcgcgcgcctggcacatcagccctgacgacgccctcgccgcctggctgtggagctggctcgaaaaccaactcgccgtattgatgaaaaccctgccgttgggccagcaagccgcccaacgcctgaccagtgaactgctgccgttgctgcaacaggcccagcaggacgcagcccgtatcgaccccaaccatttcggcagcgccgcgttcggcctgtctctggcgtgcatggcccacgagcgccagtacagccgcttgttccgttcctaagcccttttactccagtggagaagcacatgaacacacaacccctgcgtgtcggcatcggcggcccggtaggttccggcaaaaccgcgctgaccctggcgctgtgcctggccctgcgtgaccgctacaacctggccgtggtcactaacgacatctatacccgcgaagacgctgactttctggtgcgcaaccaggccctggcgccggaacgcatcatcggcgtggaaaccggtggctgcccgcacacggcaattcgtgaagacgcctcgatcaacctcgaagccgtcgaccagctcaaccggcgctttcccggcctggacctgatcctggtggagtccggtggcgacaacctgtcggcaaccttcagcccggaactgtcggacctgaccatctacgtgatcgatgtgtcggccggcgacaagctgccacgcaaaggcgggcccggtatttgcaaatccgacttgctggtgatcaacaagatcgacctggccccgctggtgggcgcctcgctggaattgatgaacagcgacaccacgcgcatgcgcaacggcaagccctttgtgttcagcaaccagaaaaccggcgtcggcctggatgaaatcgtcgcctttatcgaacgtcagggcttgctcactgcggcctgatctcaccctgaaaggagcctgtacatgggtctcaacaaacttctcgcaaccgtcgccctgctgctcgccccggccctcgcctttgctcaccccgggcatggcgataacgggctggttgccggcatcagccacccactgggcggtatcgatcacttgctggccatggtcgcggtcggcctctgggccgcgcagcaaaaaggcaacgcgcgctgggcactgccttgcgcgtttgtcggcaccatgctgattggcggcttgctcggctttgaaggcctggaactgccggcgctggaaagcgggattgccgcctcggtactcgcgctgggcctggcggtggcgctggcggtgcggccgccgctgtttgttgcggtggctgccacggcgttgtttgcgctgttccatggcgtggcgcacggtttggagctgccggacatgtccagcccgtgggcgtacgcggccggttttgtcggcgcgacggcggtgttgcacgctgccgggtatgcggtggtgcgttttctgccggcggcggctgcaccgttggtgcgggtggccggggcggcgtcggcggcgaccggggtttggttgctggcaggctgaccttgatcgttcccacgctccgcgtgggaatgcagcccaggacgctccgcgtcccaaggcctgacgcagagcgtcagaaaatgcattcccacgcagagcgtgggaacgatcagcctgctaccatgcgcgcctacacccctgccgtgacgacgccagccgatgcccatcgcttctcaaacttccttgaacaccgtgctcacgcacttccacgacctgatcgtgccgctctggcaaggcccgggctggaatgccgagctggcgttgccctatgaggcgctggacgccgaccaccggccgttgcccccacaacgctaccgcgccatggcgtgtgcccggcagctgtacctgttcgccagccagatcggcgagcccggcgcggccttcgccgaagagcgcgcggcggcgctgttccgctccctgcagcggcacttccacgatgccgagcatggcggttggttctacagcatcgacgcccatggcaaaccgctggataagcgcaaagacctctacacccacgccttcatcatctttgcctgcgcccactactgggccaaggtccgcgagccactggtggaatcggtgctcgatgcggcgctcgaagttgtcgcccaacgcttcgccaccggcgacggcctgtacgaagcggtattggaacgcaactggtcatcgctcaagtccggcccgctgcagaacccgctgatgcatctggccgaaggctttctggccaccctggccgtgcgtgaagacgccgtcacgcaagatgcactgctggacctggccacggccatgcaaaagcgcttcatcgagcgccagcacggcgtgatgatggagaaaccgctgggcgctgtggacaactggtttgagccggggcaccagttcgaatggttctatttgctcgagtcttcagacgtactgcgcggcacgccgttgcacgcctcactaaagcgagcgtttgcctacgccgagctcaagggtgtggataaatcgagtggcgcggtcagcggcatgctcgccctggacggcacggtgcgcgacggcacgcaacgaatctgggcccaggctgaatacctgcgggcactgaccttgcggcctggcagtgaagcggtgttgcaacgccaattgctggcgctgcaagagcactttttgcatgacaaaggctggcatgaatgcctggatgccaagggcgccgtgagccgccgggacatgccgtcgactacgccgtatcacttggcgacctgttatcaggggttgatccagcatttgggctgacctccagggccctatcgcaggcaagccagctcccacactgaccgggttccaacctgagaatgcggtcaactgtgggagctggcttgcctgcgatagcctcacctcggtctaactgacctcacgcaatccacttgcgatccccagtaaaactgatcgtcaaccaccgcgccgcatccggcgtgccgagacctgtggatatctcttcgcgcagcccatcaagggtggcgacgttatccaccgggtaattcgccggcaacaccacatgaatctcgataaaccgcgcccgcccgtgcttttgcacgtaagacacgtagtcgtcgaagccatgcctggcctgggccgcgtccatcacttcgcgcaccttgtcgtccaagtgatccggggcaatcccgagcacttcgcgcaaggccgggcgcaggatcttgaacgccggcgccagcatgctcagggccagcagaatcaggatcaatgggtcgacatacaccgcccactcgccatagccctgggacttgagcaacagcgcggcaagaaagctgatcagcaagcccaccgacagcatcgcgtccaccagccaactgatgttgtcgaactggatcaatgaagatttcagcgtgcgattgcgataacgcacgtagaagaaataggcgaattcgacaacggtaaacaccgccgcgtagacgatcaccaaccccagctcaatttcacgcccgccattgataatgccgaacacgccgttgagaaacgcgtagatggcaatcagcagcagaaagctgccctcgatcagcagcaccatcggctccaggtgccaatagccgaactggaagcgctcgttgcttttcttggcgatcagcttggccgtgatcagcatcaacaccttgatggcggtggcgatcagcgagaaaaagccgtcgaatagaatggattgggcgccagaaatcacacccgtgacaatcccggcgatcgccacggcgaacatcaggatggtcgattgtttgagcagtgcctgctcacctcggttactcacatttcctcctgtcaaaacctttaaaccgcacagtgcggaggggttttcaggcgtggagtgtaccttatgtcgtgttttggccgatttgtcgccatcgcaggcaagccagctcccacattggatcgggttcacacggtcaaaatgtgggagctggcttgcctgcgatgcacgcgacgcggtcttgagtcttacttggccccacgctcaatcgcaaacccagcccaggtctggctcaccggcatcagctccaggcggttgatgttcacatgcgccggcgtgttcaacacccagaagatggtatcggcaatgtcctgcggctggatcggctcggcaccggcataggtcgcgtcataacgcgcctggtcgccaccaaagcgcaccagcgaaaactcgctctcacacagccctggctcgatgttggtgacgcgcacgccggtgccttgcaggtcgcagcgcaggttcagcgagaactgcttcacgaatgccttggagccgccatacacgtggctgcccgggtacgggtagctgccggcgatagagccgaggttgatgatcccggcgccacggccgtgagcgatcaggcgcggcagcagcaggctggtggtggtcagcaggcccttgatgttggtgtcgaccatggtttcccaatcgtcgaggctgcacttgggcgccgggtcagtgcccacggccaggccggcgttgttgatcaggccgcgcagtttggcgaacgagggcggcaggttggcgatggcgtcttccatgcccttgcggtcacgcacgtcgacgaccaaaccgtgcacttcggtctgcttggaaagctcttcgaccaaggcattcaaacgctcggcacgccggccggtgagcaccagtttccagccagcctcggcaaaacgacgggcgcaagcctcgccgaaacctgaggtggcgccagtaataaacagcgtgtcggacatggtgttctccttgcgggcatcgggaaaaaagttgccagcagaatgcccttacgccgcgattgcggcaaccgctaagcacacaccttcacgtacagctgatcattttttaatcatcgcgagcaaagccttatgccccgtggcctgtagccatatgcgcgcaggttatccacaactgcgcccacagtctttgggggcaagtgtgaaaagccaaaagccgctgtatacaaggcttgcagcccgttttagaaagttttttgcttgacctggcgcggggcatatgtaggcgcacgtaaagagggaaaatccgaacgatggctccaggccagtcattccggcctctgcggcactctttccagagtttagtcacagacttatccacaggcttggcggacatattccggtcacatacctgtgtctttaaacaggttgacaaaaggcttgtgtggtcacgaaaaacccgctgatcagaaaacaaccaccgcgctgcaagccacgcagttaaaggctttcagccagctactcccacgttacccacagccggttccacagcgaatggggacaagtcaaaactgtgacaaaacagggatttgcggcggctatatgtcgcgctttggagggtggctggatttgttttccacaatttcgctggaagcctgtggacaccctaaaaacaactgtgggaaccgggctttatgtgggagccgggcttgcccgcgatagcatcacctcggtttgccagacataccgaggtgtttgcatcgcaggcaagccagctcccgcataaagccggttcccacaggggttcctgcatcaagcctgcagatcagtgcccgccaaggtaggcgttgcgcacctcttcattcactaacagctctttaccggtgcccgtcaggcgaatctcgccgttgaccatcacataagcgcggtccgacaagcgcagcgcatggttggcgttctgctccaccaggaagatggtcatgccggtcgccgccaattcacgcaaggtggcgaaaatctgcttcaccacaatcggtgccaggcccaggctcggctcgtccagcagcaacagcttgggccggcacatcagcgcgcgggcgatggcgagcatttgctgttcaccaccggacatggtcatggcgcgttgagtgcggcgctccttgagccgcgggaacagctcgaacatgcgctgcatgtcttcctgcgcgtatttgtcgccaatcgggatggtgcccatcagcaggttttcctcgacggtcatgtcggggaatacccgccgcccttccggcgactgcgcaatgccgttggaggcgatgtagtgggacgacttgtgggtaatgtcgacgccgttatagagaatctgccccgattcggcgcgtggctggccgaagatcgacatcaacagcgtggatttgcccgcgccgttggagccgatcaggctcacggtttcgccttcgttgatgtgcagcgagacttttttcagggcctggatcgggccataaaacacgtccaggtccttcatttcgaggataggtgcactcataccagctcctcttcgtctgcgcccaggtaggcggcaatcactttcgggtcgttgcggatcgcgtccgggccgccttcggcgatcacgttgccgtggtcgagcaccacaatgtggtcggaaatactcatcaccatgcccatgtcgtgttcgatcagcaccaccgtgaggtcgtgttcgtcgcgcagcaggcgaatcatcgcgctgagcgcttcggtttcctgcgggttaaggccggctgccggttcgtccaggcagataatctgcggccgcgtgcacatggcgcgggcgatttccaggcggcgctgctggccgtaggaaagctcgccggccaggcggttggcacagtccaccaggtcgaccacttccagccagtagaaggcgtggtcgagagcgtcgctttcggccttgcgatagcctttggtgttgagaatgccggcgagcatgttgcggttgacccacatgtgctgggcgaccagcaggttttccagcaccgacatttccttgaacaggcgaatgttctggaaggttcgcgccaggcctgcgcggttgaccaagtgggtgccgccgaacatcttgtagtacacccggttgaggaagcttttcggcgatacgaagtcgacggctttgaaacgctcgccgagcagctggatcacgttggtctgcttgccccgcacgttgagttcgatcttgccgccactggccttgtagaagccggtaaggcagttgaacactgtggtcttgccggcgccgttggggccgatcaaggcgaagatcgagttgcgttctaccttgaggctcacatcgctcaaggccttgatgccaccgaagtgcatcatcaaatgttccacggagagcacgacttccttgctcatggcgctacccccttgcgtggcgtcacaccggtacggctgatccgaatcaggccgcgcggtcgccagatcatcatcaccaccatcaacacgccaaacagcagcacgcggtactccgagaagctgcgcagcaactctggcgcgacggtcaatacgaacgccgcaatcaccacgccgaccgtcgagcccatgccacccaacaccacgatggcgaggatcagcgccgactcgaagaaggtgaacgacgaagggttgacgaagccttggtagctggcaaagaacaccccggccagaccggccgtggacgcgccaatggtgaacgccgaaagcttgaccagcacgtggttcaggcccatggaacggcaggcgatttcatcttcgcgcaaggcttcccaggcgcggccgaccggcatgcgggtcaggcgatgcttgatgtagagcacggccaataccaccaggaacagcacgatgtagatgaacatgaacttgatgttggggttgtaatcgatgccgaagaattcgtggaacggaatcccgccgtccttggctttgcgcccgaactcaaggcccaggaaggtcggtgacggcactggcatgccgttcgggccaccggtaaacgacagccagttgttcagcaccaggcgaatgatttcaccaaagcccagggtcacgatggccaggtaatcgccatgcattcgtagcaccggaaacccgagtatgcaccccgccagcgccgcacagattgccgccaatggcagcaccgtccagaagcccaggccgaggtattgataacccagcgccagaccgtaagcgccgatggcgtagaacgctacgtaacccaggtcgagcaagccggccaggcccaccacgatgttcaggcccaggcccagcagcacgtagatcagcccgaggatgaccaccgtcagcaggtacttgttggcgaatatcgggaacacgatggcgatcacgatcagtgccgggatgatccagcgcaggcgcgacttgtagtccggcggcagcacgtgcacaccagagccactgctctcgaaaccctgcagaatcttcaggcccttgggggtttgcaggaacaggctcagggcaaagcgcccggccatgacgatggcgaccagcacggccacgcgcgccggttccaggttgaagctgtagccgtcgaggaccacgccgacgatcggaccgaacacgatcaacgaaatcagcccggcgaggaccgtatcgaccacacttttcttgatatcaatcgatttggcagcagacatgtttacaccttcgccacgagtgggcgaccaagcaggccctgaggacggaaaatcagaatcaccaccagcagggagaaactgaacacgtctttgtagtcagagttgatcaaccccgagaacagcgactcggagatacccaggatgatcccgccaagcatcgccccaggcagggagccgatgccgccgagtaccgctgcggtaaacgccttgatgccgatgatgaagccggcatagaagtcgaaggtgccgtaattgagggtgatcagcacgccggccagggcggccatggcggcaccgatgacgaacacgtaggagatcacgcggtcggtgttgatgcccaggatcgaggccatcttgcggtcttgctgggtcgcgcggcacatgcggccgagcttggtgtatttgatgatgtaggtcagcaaggccatgcctgcaaaggcggcgaccaggatgaagaccttggtgtacgtcaactgaacaaagccggtgccaatatcgacacgccaggccccggccagcagggttggaataccttgttgcttggcgccctgagcgatctgcgcatagttttgcaggatcagggaaataccgatggcgctgatcagcggtgccagtcgggtggagttgcgcagcggtttgtaggcgacacgctcgatgacccaaccgtaaacgccggtgacgaccacggtgaatatcaaagtgccgagaatgagcagcgggaaggattcgatgccgaagtaagccagcagtgccagactgatcgccgcgaggtaagcggaaatcatataaacctcgccgtgggcgaagttgatcatgccaatgatgccatagaccattgtgtagccgatggcgatcaggccatagaccgacccgagggtcaggccgttgaccagttgctgtaggaaaataccatccataacgcaatctcacgcggtgagcacctgcacaccgaggggtgtgcggcgcttctggaggaaaagacagatctgttgccgaacacgatggagcaggcaaccaggttccctgtgggagctggccttgtgtgggagctggcttgcctgcgatgcagacacctcgttacttcagcaatacccaggcgatgcaatcgcaggcaagccagctcccacacaagcccggctcccctggagttgaggggtgccggttagatcgcgctattacttctgcttttccagctggtggtacttaccgtctttgtcccactggtaaaccacgtagtcggagattttcaggtcacccttggtgtcccaggctttttcgcccatgacggttttcaccggatgagacttgagccacttggcggcgtcttcgcctttgttggacttcgaaccgttgaagccggcggccagggcctggatcgaggcgtaggcgtacagggtgtagccttcaggctcggtgccatttttgcggaactcttccaccacggtcttgctgtctggcagcaggcgcgggtcggcgccgaaggtcatgtacacgccatccacatactgcttgccgcctgcggtggcgaccagttcgtcggtgacaacgccgtcatcggacatgaacttgacgtctttgaggccggcttcacgaatctggcgaaccagtggaccggcttccgggtgcaggccgccgaagtacacaacgtcagcaccggtggagcggattttggtcaccagggcgctgaagtctttctcgccacgggtcaggccttcttccagcactggcttgacgccgcgcttggtcaactgtgcagcggtggcgtcggccaggcctttgccgtaggtgtccttgtcgttgataaccgcgactttcttgcccttgagcacgtcgacgatgtagtcgccggccacgatgccttgctgatcgtcacgcccgcacatacggaacactgcgcccaggccacgctcggtgacctgtgggttggtggagcccggggtgatcatgatgatgcctgcttcgtcgtaaacctcggaagccgggatggtgttggacgagcagaagtgcccgaccacgccgatcactttgtcctggtctgccaggcggttggcgaccgctacagcctgcttcggctcacaggcgtcgtcgccgggcaccagtttgatctgctcgccgttgatgccgccggccttgttgatcacatcggctgccgcttgggcacccttcatgtactgctcaccgaaagctgcgttggcgccagtcatcggccccgctacgccaatcttcacatcagcttgaacaaacgcagaaacacccagcgccgctgcaacggcgagggccagaaaacctttcttgtaaaacgtctgggacatgagtggtgctccgaggtttttgttaattggcactacgaattcacgacgaactttcacgggaaagcccagagcaaggcgcgtgccattagttttttattcttcaaaaagacacggtgtcattgttattacaggcgtttcgactccttttgccaggacgtgcaaccgtctagcatcgagaggtgcaaccgatggatccaataagtacaaccctggcaggtcgcacctgcaaccagacgaataaacgacagttcctgcacctgtaacaacgtgcgtaacggaactgcacatttacagtgcgtgattgctacgacttgcaccaatacagattagtagcctgctaagaaaatgcaggcttttgacaggtatttcgctgatcagatcacgatccgcaggcattgcccggcgtgatacagcgagaatccagcttcgtagaggcaactgcgcaggcccaccccggccagcggttgcatcggagcaaagggaatcggcaaggcctgggggttctggtgacacaaatagtcagcaaatgccttgcccaccacgctgccggtggtcacgccacgcccgttatagccggtgaccgccaccaggccgggcgccggttcgaacaggcgcatcaggtgatcaggtgtgaaggcaatgcagccggtccaggtgcattcccactgcaccgatttgaggtacgggaagtagtgctgctgcacccgatcggcccacgccttgaggaaccacgtgggtttctggttgccgttgcccaggctgccgagcaacaggcggccatcggcgtcgcggcggatgctgctgagtacctggcgcgtgtcccacgagccctgcccgcccggcaggatctgttcggcggccgcatccgtcagcggggccgacgcgacctggtagtaatagccggggaagaaattgcgccgcaattcggtccattcgccttcggtgtaggcgttggaggcgatcaccacttgtgcagcctgcacagcgccttgggcggtctgcactgaccattgcgcgccttggcgttccagctgggtgacgggggaatggtcgaacaactgcccgccaagcccggcggcggcgttcgccaaacctgtggtgtacgccattgggttcagcgtgccggcacgccggtccagcaacgcggcggcaatctttttggtcccggtggcgtgctcgcacgcctggccggtcagcaactccaccggcgcgccacggcgcttccattgttcttcacggctgcgcaaatccgcctcgccacgggcgttgtgcgccatgtgcaaggtgccctcgcggcgcaattggcaatcgatgttgtacttgtcgatcaggctgaacaccagtgacggcgccgcgcccaacatgcggttgagctggctgcccaccgcctcgccgaaaccggcttcgatctcgtccgggggaatccacatgccggcgttgaccaacccgacgttacgccccgaaccgccatggccggtgcgatgggcctccagcacggcgacgcttttaccttgctccagcaagtggatggcggccgacaagccggtgatcccggcgccgatcacgcacacatcgaccttgacctcgcccttgagcgcggcgcgatccggtcggccaggggtgagttgttcccacaaacatgtttcgcgtaatgccattgccagactccgatgagacctaacaaaccaccattattctgaattgcgaactcaatcaactgtgggagctggcttgcctgcgatagcggtgtatcagtcaccaccgctatcgcaggcaagccagctcccacatgacctcactgcggcctgaaagtcagtcgaaggtaataccctgcgccagcggcaattccagcgaatagttcacggtattggtctggcgacgcatgtaaccgcgccacgcatccgaacccgactcacgcccgccaccggtctctttctcaccgccaaacgcgccaccgatttcggcaccgctcgggccgatattgacgttggcgatgccgcaatcactgcccaccgccgacatgaactgctcggcttcacgcacatcggtagtgaatatgcacgacgacaggccttgcggcacggcgttgttcaaacgcagggcttcggcaaagtcgctgtagccgatcacatacagaatcggcgcgaaggtttcggtgcacaccacgtcgctttgctcgggcatttccacaatggccggcgacacgtagtaggcattcgggaatttatcttccaactgacgcttgccgccgaacaccttgccgccttcgctcaaggcttgttccagggcgtcctgcatgttgtcgaagccgtgcttgtcgatcagcgggccgatcaggttgccttccagcgggtgaccgatgcgcaccttggaataggccgccttgaggcgggtgacgatttcttccttgaccgattcatgggcgatcaggcggcgcaaggtggtgcaacgctggccggcggtgccgacggcactgaacaggatggcgcgtacggccatgtccaggtcggcgcttgggccgaggatcatcgcgttgttgccgcccagctcgaggatgctgcgggcgaaacgtgcggcgactttcggcgccacttcgcggcccatgcgggtgctgccggtagcgctgatcagcgccacacgcgggtcatccaccagcgcagcgccggcgtcacggccgccgatgattacttggctcaggtactgaggcgcgtccttgaagtttttcagaacgcgctcgaacagcgcctggcaggccagcgcggtgagcggggttttttccgagggtttccagatcactgcgttgccgcacaccagcgccagcgtggtgttccacgcccacacggccaccgggaagttgaaggcgctgatcacgccgaccacgcccagcgggtgccaggtttcacgcatatggtggcctgggcgctcggaggcgatggtcaaaccgtacagttggcgcgacaggccaacggcgaagtcgcagatgtcgatcatttcctgcacttcacccaggccttcctgagtgattttgccggcttcccacgacaccagctcgccgagatcggccttgtattcacgcaatacgtcgccgaactggcgtaccagctcgccgcgacgcggtgccggcactttgcgccaggcctcgaatgcatgctcggcgcgactgacctgctgctccacctcggcggcaccttcccagtgcacactgccaatacggctgccgtcgatcggcgaatgcacgggttgtttccccgactggtacagcgccgggttcaccccgagacggtcaagcaatgcggcaaccatgggtcactccttcaatctcaaacagaaaattcgcgccgccacagacacggcgatccaggccttatttgtagctggcccaagacttgccaacaaacgacgattaggcgagatatcattccgtttattcatgcaaagaataaaaagaggcgtgccgtgctgaacaaaagacatttgccctcgatcaccgccctgcagtgtttcgaagccgccacccgccacctgagcttcacccgcgccgccgaggaactgaacctcacccagagcgcggtgagtaaacaagtggcgcagctggaagaattgctgcaacacctgctgtttcgccgagtgcgccgtcgtttgcagatgaccccggcgggggatttgtatttggtggaagtgagaaaaatcctcacgcaggtggagatgtccacccattacctgcgttcctacggcggcgagaccgaagtgctgcgcgtttccacgccttacaccttcggcgcgcgctggctggtgccgcgtcttaaaggctggcgtttgcgtcacccgcagatccatttggacctgtgcaacgagcaggagccggacgaactgctgcaaggcaaggccgacatggccttctacttcggccagggctcgcgccccggcaccgagagtttgaagctgttcagcgaagagcttgtgccggtgtgcgcgccggaaagcctgcctgcgcagccgttcaccgacccgacgcaactgagtgacttggtgctattgcagaacgcctcgcggccgcagggctggcatgactggtttgccagccagggctttcacaccgagcacagctaccacgggccgcgtttcgacaccttttatatgtgcatccgcgcggcgcaggtgggctgtggcgtggcgctgctgccacggtttctggtggaagaagaactggccgagggcaagctggtgatcccctggcagcatgcgatgcccagccaggatgcgtattacctggcgtatccggagcattcggccgaagtgcccaaggtgcgggagtttgtgaagtggatgatggaacaggtttaggtttttttacctgcaccgccgccatcgcaggcaagccagctcccacatttggaatgcatttcaactgtgggagctggcttgcctgcgatagggccagtggccattccgaaaaaatcactggcaaaaccccacaggtctatgcgccactagcgccattccttaatagtgcgtaaaggtcggcgcccatcgccgacccgtctggagattcccgttatgagcgagagtgtgtttgccgatcgcatcgtgcagaacttgctcgacaccgacttctacaagctgaccatgatgcaggcggtgctgcacaactacccgaacgtggaagttgaatgggagtttcgttgccgcaacagtgaagacctgcgcccgtacctggcggaaatccgctaccagatcgaacgcctcgccgagctgagcctgagcccggaccagcttggttttcttgagcgcatcagcttcatgaagccggatttcctgcgcttcctcgggctgttccgcttcaacctgcgctatgtgcaaaccggcatcgagaacggcgagctgtttatccgcctgcgtgggccgtggctgcacgtgatcctgttagaagtgccgatgctggccatcgtcagcgaagtgcgtaaccgctaccgctaccagaccgtgatcctcgaacaggcccgcgagcagctgtaccgcaagttcgactggctgacggcgaatgccagcagcgacgagctgtcggagctgcaagtggccgacttcggcacgcgtcggcgcttctcgtaccgggtgcaggaagaagtggtgagcgtgctcaagcacgacttccccggccgtttcgtcggcaccagcaacgtgcacctggcccgcgagttcgatatgaagccgctgggcaccatggcccacgaatggatcatggcccaccagcaactcggcccgcgcctgatcgacagccagatcgccgcgctcgactgctgggtccgcgaataccgaggcctgctgggcatcgccctgaccgactgcatcaccaccgacgcgttcctcggcgacttcgacttgtacttcgccaagctcttcgacggcctgcgccacgactccggcgacccggtgcagtgggcggaaaaagccattgcccattaccacaagctcggtatcgagccgatgagcaagacgctggtgttctccgacagcctgtcgctgcccaaggccctggagattttccgggcgttgcgtggtcgcattaatgtgagcttcggcatcggcactaacctgacctgtgacattccaggtgtcgagccgatgagcatcgtgcttaaaatgaccgcctgcaatggccagcccgtcgctaaaatctccgatgaagcgggcaagacccactgtaccgatccgaattttgtcgcctatttgcgccacgttttcaaagtacctgccctacccagcaaggagtgaatcatgcaagccgtacagcgtgagattgcgcagcagctcaaggtccaagcaccgttcaacgaccaggccgcgcttgaagccgaagtggcccgccgcgtggcgtttatccaggattgcctgcgcaattccgggctcaagacgttggtgctgggcataagcggcggcgtcgactccctgactgcaggcctgttggcccaacgcgcaatgaaagaactgcgcgccagcagcggcgatgacgcctaccgttttatcgccgtgcgcctgccgtacgaaacccagttcgacgaacacgacgcccaggcttcggtggacttcatcgagccggacgagcgccacaccgtgaacatcggcccagcggtaaaatccctggccaatgaagtggcggcctttgaaggcaaggcggcggtgtcgcgtgatttcgtgctgggcaacaccaaggcgcgcatgcgcatggtggcgcagtacaccatcgccggcgcggccggtgggctggtgatcggcaccgaccatgcagcggaagcggtgatgggctttttcaccaagtttggtgatggcgcctgcgatttggcgccgctgagcgggctggtgaaaaaccaggtacgcgccattgcccggcactttggtgcgccggagtcgctggtggagaaggtcccgacggccgaccttgaagacctgtcgccgggcaagccggacgaagcctcccatggcgtgacctacgccgagatcgacgcctttctgcatggccagccggtgcgtgaggaagcgttcaagatcatttgcgatacgtatcgcaagactgagcataagcgggtcatgccatttgcgccgtgattagtgttgtttggcaggcggacttgttgtggcgagcgggcttgccccgcgttgggttgcgcagcagccccaaaacctgcaacccggtccgtctgaatgaccgcgtttgccttactggggctgctgcgccgcccaacgcggggcaagcccgctcgccacagctaccgaccgcccacaaaaaagcgccccgagaggcgcttttttttgcagctggtacctgattacttcagggtcacagtgcctttcatcatcgagttgtggcccgggaacgagcagaaaaacgcgtaatccgtacccgatgccagtttcgacacatcgaaggtcacggaatctttctcgccggcaccgatgatcttggtgtgggcgatgatgcgggtgtcgccgtctttgaggtagtttttgtcgataccagcggccatgccgtcgctggcaacgcccggcatgtcggcggccgagctcagcacccagttatggcccatgacgtttttcggcaagctgccggaatgggtcagatcaacggtgaacgtcttgcagcttttgtcgatttcaatggccttggtgttgaaggacatttggtcggtggagtcgacggtgaccttgcactctgcagcaagcaactggccgctcgccagagtcagcagggaaacagcaacgagtttggcaaacatgtgaatctccaaggcagggtttaataaacgcatattgcgacaagggtgcctcaagcaggcttgaattcttatgatctgcatcaacagattgtatacaactttaggctatcagactgatcaacacaatctaccagccaaagttcgcccgcctgtttatgatcggctcattacccctcggagcccgcgccatgcatctaaatcaactgttcaacggcctgctggctgcgtacgcctgcggtaagtgaaggccacgcgcggtgctaagctgctaccatagcgacccaaggcagctgcgcgccgcccaccctcaccttcgaccctagaggatcgcccatggccaaacctaattactccttcgccaaacgtcagagagacttggccaaggagcagaagaaagaggaaaagctgcaacgcaagaaagccgctgcagatgaagaagctggcgcactgaacccggatgctgaaggtgaagtggcgactgacgagaccgagacaccgaaagacccggcggaataaatgatcgttgatcgttcccacgctctgcgtgggaatgcagcctcggacgctccgcgtcccggcgcaccgcaaggttcgaagcctgtgcaagcgtgacgcagagcgtcacaacaggtattcccacgcagagcgtgggaacgagccttgaggttctattccagcggcatcaccgtcacccgcacctccgggtcatggcttcctccccccagaatcaccccccgcaacggcgacacatccgagaaatcacggccccaggccagggtgatgtgctccagtgccggctgcacattgttggtcggatcaaaatctacccagcccgacaccgggcaatacaccgaaacccacgcgtgggacgcatcggcgccgatcagccgtggctggccgggcggtggctgggtgagcaggtagccgctgatgtaacgcgccgccaaaccgcgcgagcgcaggcaggcgagcatcaggtgggcgaagtcctgacacacgccgcgccggcgctccagcacttccaccagcggcgtagccacctgggtggcttcggcatcaaaggtgaattcgctgaaaatcttctccatcaacgcctgcacgcccagcagcaatggctcgccgggtggaaagcagctttcggagaactcgacgaaggtttttttcaggtgtacgtagggcgattcgaaacgatagcggcaggcttcgatcagctcggcagacatgggcaggctgctgtaggtcaggctgtcgcgggtctggtcccaggcgggtgagagctgaaaatccagcgcaggccgcgccagcacttccacggtcagcccggcattgaccagcagctcgtcatggggccgctcgaacgccaggcgggtgatcgggttgccgaatacgtccagctcgtcacggcgcgcagtcggctcggggctgatttccagttgctgcgaactgcaacgctgccaggcgcacggccgtggccacaggtgcgccagctgctgggccagggacaccgggctgtcgtagtggtagtgggtatcgtggaaaatctggtagcgcgcactcatcacaccgacaccgtttgctggctgacatcatccacatgggcaaaatggcgcaaggccaggcgatccgacacttgcccactctcatcggcgaccgcttgcagcaggtcagccaggccatccagcgcagcacgcacgctggactcgccaaacaacgggttctccaggcagcccaggtcgaagcgcgccagacggtcgaccaacggcgccagcccggtttcccgtggcacaccaaagtcatcgttgaggcgtcgcaaggtgcggctgaccagtttcagctggaacagcaccgcgtgcgggttctgctcatccagcaacaacaggtcgagtaccgggatcaactgcggcacggccaagtaacgcgagcgataggtgatgctgctgttgcccagctccagcaaccactcaagcccggcctgatcaaacaccgccacgccgcgcaggaacgccgccaggctgctactgaggaattgcaggcgctcgatacgccggcccatcatcaagaagcgccagccttcgtcacgggtcatgtcgtccagggcaaagcctgacagtgccgccagggacatcaccaagcgattgaggaaatccagcagctcgccgaagtccgggctttcgcgttccagctccagggcttcgcgctgcagctcgaccagggcctgccagttttcccgggacaacttgccgcgcacctgcgacgccgcccactgcaagcgctgcaggttggcacgcaggctcgacggccagtcatcgccgagcaaggcagccagcagacgctcgggcaactcgccctcctccggcaacaagcgcaaggtctcgcccagctccacagcggcttgcaacgcccgcgggtcgtcgccgtcgacataccgcgcgagcacgatgcgcagccagcgcgcgctgtcatcacaacgttcgcagtagcggccaaaccagaacagattttccaccacgcgcgacggcagatacggatcgcggcgcaccaggtcgtgggcaccaatgggccgctgcgcacgccagtgttcgccaccggcagcgcgctcacccagcacccaggtgtctttgctcgcgccaccgcgctgcatcgacaccacctcggcatcggcctccgcggccacgcgggtcagaccgccaggcagcacgcgatagccttcatcgctggccacggcgtacacgcgcatgccgatggcgcggtgttgcaagtggtcctccacggtatgccacaccggcgcctgggacaattgcgccagctcctgagcgacatacgcataaggccgcgcgcgcatgcgttcggccagcgcctggcgttgttcgtcgttcaaatcacggccgaataccggcgtgaagctctgcgacggaaatgccggtttgatcagcaattccgggagtttttccagggcttcggcgagcaccggcgcctcaccgcaccaccacgtggcgatggacggcaggatcaattcttcgccaaacaggaactggttgatcttcggcaaaaagccgagcaaccccggcgattccagcacgccactgccaagcgcgttggccaccagcacattgccctggcgcacggcgtccagcaggccgggcacgccgagagccgagtcggtgcgcagctccagcgggtcgcagaagtcatcgtccaggcgacgcatgatcgcgtgcacccggcgcaggccactgagggttttcaggaacacggtgctgtcgcgcacggtgaggtcgccgccctccaccaacgggtagccgagctggcgcgcgaggtaaaggtgttcgaaatagctttcgttgaagcgccccggcgtgagcagcacgatcagcggcgactggtcatcactgggtgcctggcgggccagggtttcctgcagcgtgcggaagaaaccggtgaggtgctgcacttgcaggtcgcggtacaaatccgggaatgcgcgggacacgatggtgcggttttccaacgcgtaacctgcgcccgacggcgcttgggtccggtcggccgtgacccaccagcggccgtccggcgtgcgcgcgaggtccacggcatacaagtgtaggaacgcaccgtcgggcggctggataccctggcacggccacaggaagttgttgtggccgaacaccaattccgccggcaacaaaccttctttgatcaggcgttgcgggccgtacagatcagccaatacggcattgagcaggcgcgcacgctgggcgataccggctgacaggtgctgccactcttcaaaggccagcacatgcgggagcaaatccagctcccacgggcggtcggcgcctttggggtcggcgtagacgttgtaggtcacgccgttttcctggatctgccgggtcagcagcgcctggcgctgggccagttgtgcgggcgtgctgcgttgcaggtgatcgagcaaacgccgccaatgggcacgcaccgcgccactgtcgtccagcagttcgtgataagtgcccgcagtcagcgggtaacggtcgagcaagtcgggcatggaacgctcggcaggggcaagggagttcagtttaaatcaatttcaccgcaatctattgtgggagctggcttgcctgcgatagcggtttcgctgtcagcttgttggctgactgatacaccgttatcgcaggcaagccagctcccacattttggatcgcgttagtcttttttattggggaaacgccgcaaatccagggtcatgggtagttcatcattgatgactaaagggggcacggggagcttgcccgggctatgccccaagcggaaaaaccgcgccatgcgccgactctccgcctcattggcattcaccggcaagctgtcgtaattgcgcccgcccggatgggcgacatggtactggcaaccgcccagcgagcgctgcatccaggtatccagcaagtcgaacaccaacggcgcatgcaccgagatagtcggctgcaggcagttggcaggttgccaggcgcgataacgcacgccggcgacgaactcaccaatacgcccggtcggctgcaacggcaccgggatgccgttgcacgtcagcaaatagcgctgcggcggcagcccgctcaacttcacctgcaagcgctcaagggatgaatccacgtaacgcaccgtgccgcccaccgcgccttcctcgcccagcacgtgccagggttccagggcttggcgcagttccagttcgataccgctgacggcgtagtcgccgaccttggggaaacgaaactccaggtgcgccgcaaaccactcggcccgcagcgggtaaccggcggcattcagctcgacgatcacgtcggcaaagtcctgctcgataaaatgcggcaacaggaaccggtcatgcagctcggtgccccagcgcgccagtttcggcggcgcatacggctcacgccagaagcgcgcgaccaaggcgcgcagcagcagttgctgggtcaggctcatgcgcgcatggggtggcatttcaaacgcgcgcagttccagcaggcccagacggccggtggcgccgtcgggcgagtagagtttgtcgatgcagaattcggcgcggtgggtgttgcccgtcacgtcgatcagcaaattgcgcagcagacggtcgaccaaccacggcgggcactcttcgccgggttcgggcatttgcgcgaaggcaatttccagctcatacaacgcgtcgttacgcgcctcatccacccgtggtgcctgggaggtcgggccgataaacaacccggaaaacaggtacgacagcgacgggtggttatgccagtagctgatcaaactgcgcagcaaatcggggcggcgcaagaacggcgaatccttgggcgtcgcgccgccgagcacaaagtggtttccgccgccggtgccggtgtggcggccgtcgatcatgaatttttcagtggtcaggcgggtttgccgcgcctcttcgtagaggaattcggtgcgttcgaccaactcgtcccaggtcgcggacggctgcacgttgacctcaatcacgcccggatccggcgtgacgcggaagttgctcagacgcgtgtcgaacggcggctcataaccttccagcaacaccgggcaatgcaactcctcggcagtggcttcgatggcggccaccagctccaggtaatcctcgacgcgctccagcggcggcatgaacaggtagaggcgcccttcccgcgcttcggcacacaaggcggtgcgggtcagccagtcggcggactcgtcgacttttggcacgcgctcgtcgctcggcgcgggttcaccgtggctttgcagctgcgcggtggtcggcagctccggctgatcctggttcgggtcggtcggatgcacaaacggatactccgccgccgtcacccaaggctgcgaagccaagggcaggcgatagcccagcggcgagtcgcccggcaccaggcggcagtggttgtcgcgcaagtaccagcgcccgctctgccagcgatcattggcggcggtgcgtgccagcggcagcacttggccgatgattttatccaggccctggctgaacactttacgcaggcgttcgcgctccaggtcgtcactcaggcgcgggtcctgggcagtgacgttttgcggcagcgcaccttcgcgccacaggtagtagaagttgtcttcgaaggccgggaatacaaagcgcgcgggcagcttcaggcgctcggcgacactggccaggaagcgcccggccatctcgccgtcggcgccgtaatcttgctgctcatcggcgatcagcgcgctgttgtgccagatcggcaacccgtcgcggcgccagtagcagttgagcgaccagcgcggcagctgctcgccggggtaccacttgccctggccgaagtgcaccaggccttggggcgcatagtgtttacgcatgcgctggaacagctcggcggacaggcgacgcttgtccggccccagcgcggcggtgttccattcggcgccgtcggggtcgtcgatggagacgaaggtcggttcgccgcccatggtcaggcgtacatcgtctttaagcaggtcgccgtcgatctgccggccgagggcctggatcgccagccactgttcttcggtgtagggcttggtgacgcgcggcgcttcccaaatccgctcaaccgacatttcgtgggtaaattcgcactcgcagggttccaccaacccactgatcggcgcggcggacgatggatcaggactgcaggccaacgggatatgcccttcaccggcgaacagcccggaagtggcgtcgaggccgatccagccggcaccgggcaaatacacttcgcaccaggcgtgcaggtcggtgaaatccacgtcggtgccggacgggccgtctagggctttgacatcggcggtcagctggatcaggtagccggacacaaaacgcgcggccaacccgaggttgcgcagcaattgcaccagcagccaggccgaatcgcggcacgagccggacgcgttttccagggtgaattccggggtttgcacgcccggctccatgcggatcaggtagccgatatccgccgccaggcgctggttcagcccgaccaggaaatccaccgcaggcagtggcgtgcggtcaatgccagccaggtaggcggcaaacttcggcgtcagcggcaaggtttccaggtacggcgccagctcacgctgttcatcggcggcgtagctgaaggggattttttcggcgtagggctcaaggaaaaagtcgaatgggttgaacaccgccatctcagcgacgaggtcgacttcgatgcgcagttcgtcagtcttttccgggaacaccagacgcgccaggtaattgccctgggggtcttgctgccaattgatgaagtgctgctcgggcaacactttcagtgcgtaggacaaaatccgcgtgcggctatgggcggccgggcgcaaacgcacgatctgtgggccgagttcaacggcgcggtcgtagcggtaatgcgtaacgtggtgcaacgcgacatgaatcgacacggcggcctcctgcgagccagggcatggaaacaaagcgcgcaagacttatgccagtgcggccgtcattgcgctttatcgtaagacccggtgcagtacagcaccaaaagggcgccaccgtggggactgtggtgcaagcgttgcacatatttgtggcgtaagtgtgaggccaggtggcgaatctacccagtcagcgggctttgtgcctggcgatcatggcttcgcgcaggtggcgaacttcgagcaatttctggcgcatttcgcggtggcgtttgctgttgattaacaacaaacccaacaatgggaagagcatagctgagccataaaccagcttgtgtactgggtactggatcatcggcagcacaaacagcaggcaacatcccaagtagcccgccaccaggctcgtggcccacgcgcggccacgtgcaatcattacgttgccaaataccagcaccgccaccagcaccagaatcgccaggccggagtagtcggctttgagcgccggatccacgccacgcaaataggtcacgccggcgagcgatacagcggacgccccggacaagatcgccatgaagatcgtgcccatgaacaccggaaaatagcgggcgaggaaactgcccatgtcggggaagcctttcattccgtcaggtcctcatacaagccaatggcaatagtactggcgctgcccacgctgccggtgcggtagctgccccatatacccaatacgccgcccagcgcgtctttgatttgagtcaacgtcgcatgccggatttcagtggagctgtagcttttggtcagtttcccggcacgttgctgcaacttgagcagtttgggcgtgaggctagggtcgcgcaggctcagcaactccttagtcaactttttgcgttcctgccggctcaagcccttgagcagttcaaaccaacttttgcccagcgccgcggcctttttggctttcaagagttttatcgtggtcagcgcaccggttccaatccccaccaatgacgctgcatcaaggatcggtgagacagcgccataccattcggcgtcgtccatgcggtcatttgcatcagggtcaaggatctcgttgtaggtacgcgccacgccgaatccgcactgcgcactactggccaatgccgccgtcacgccaatacccactacaaacgcactggcacccgccgtaaagggcacggctacgctgccactgaacaccacaatccaaccgataatagcggcggtgcaagacagccccatatcaaatgcctctttcctcaggcgcccttcgcgagggtcggtcttcacttgttccacaaactgtgcaggcgaaatgtacttttgcgcttcacgaagaatgatgcgcttgggcttgatgctgcagaggggtttgaattcgcgcagggtgacgacgttgaagtcggcgtcgatgtaaaccacgcccgcgccgacaatgccggggtcggcatcaatggccgcaaacagccgtggcaggttaatctggctttcgatgcgctggcgcgccatgaattgggagcggttggagtccatgccaatgttgagcaaggggttgctcataagtgttcttccttgaaggtgatggtggccgggcgggcctcatcgcgagcaagcccgactcccacaggggagtgcattccaatgtaggagctggcttgcctgcgatggcgatctaatgggcgccaccttaacaaacaggctacccaccggctagaaagcaaaacgccagcacgaggctggcgttttgcatatcaggctgcgatcaacgcggcacgaccggcttacgggcgggcttgccgcccttgcccttggccgcatcggcgcgctccttggctgcctgcttgttgcgcgccatggccgcggccttggcttgttcgcgcttgtcccacgggttgctgccatcactgccacgcggcggcaggccggtgtgctgggtgaggatcctggtggtggtttccttggcgaccttgtggctgccggccggcgtcgagttcttgcgacgcgcgctctggtagctgtcggtggctggctgatgcagcgggatcagttggtccttgcccggcccgatcaggtcggcgcggcccatgcgggtcagcgcttcacgcagcatcggccagcctttcgggtcgtggtagcgcaggaacgccttgtgcagacggcgctgctcttcgctcttgacgatggtcaccgcgtcgctcttgtaggtgaccttgcgcagcgggttcttgcccgagtgatacatcgcggtagcagtggccatcggcgacgggtagaacgcctgcacctggtcggcgcggaagccgttgcccttgagccacagggccaggttcatcatgtcttcgtcggtggtgcccgggtgagcggcgatgaagtaaggaatcaggtactgctccttgcccgcttccttggtgtatttctcgaacatgcgcttgaacttgtcatagctaccaatgcccggcttcatcatctggttgagcggaccttcctcggtgtgttccggggcgatcttcaggtagccaccgacgtggtgggtgaccagctctttcacatactccggcgactcgacggcgaggtcgtagcgcaggccggaagcgatcaaaatcttcttcacacccggcaacgcacgggcgctgcggtacagctgaatcaacgacgagtggtcggtgttcaggttcgggcagatgccggggaacacgcacgatggcttgcggcacgcggattcgatttccgggctcttgcacgcgatgcggtacatgttcgcggtcgggccgccgagatcggagatcacgccggtgaagcctggcactttgtcgcggatctcttcgatttcgcgaatgatcgactcttcggaacggttctggatgatgcggccttcgtgctcggtgatcgagcagaaggtgcagccgccgaagcagccacgcatgatgttcaccgagaagcgaatcatgtcgtaggccgggatcttttccttgccgtacaccgggtgtggaacacgggcgtaaggcatgccaaacacgtagtccatttcttcggtggtcatcggaatcggcggcgggttgaaccacacgtcgacttcaccgtgcttctgcaccagggcgcgggcgttgcctgggttggtttccaggtgcaacacgcggttggcgtgggcatagagcaccgcgtcgccacggactttctccaccgacggcaggcggatcacggttttgtcacgggtcatcttcgggctggccaggatctgcacgaccttggcttcttccgggtcatccaccgggcctttctcttgctcgatagcgcaggcctgggtgtcctgggtgttcacgtacgggttgatgatcttgtcgatcttgcccggacggtcgatacgcgtggagtccacttcgtaccagcccgcaggcgtatcacggcgaatgaacgcggtgccgcgcacatcggtgatgtcttcgatcttgtggccccacgacaggcgctgggcgacctcgacgatggcccgctcggcgttgccgtacagcaggatatcggcggtggcgtcgatcaggatcgagttacgcacacggtcctgccagtagtcgtagtgggcgatgcggcgcagcgaggcttcgatgccgccgagcacgatcggcacgttcttgtaggcttccttacagcgctggctgtacaccaggctcgcgcggtccgggcgtttgccggccatgccgcctggggtgtaggcgtcgtcggaacggattttcttgtcggcggtgtagcggttgatcatcgagtccatgttgccggccgcgacgccgaagaacaggttcggctcgccgagcttcatgaagtcgtctttggactgccagttcggctgggcaatgatcccgacgcgaaagccctgggactccagcagccggccgatgattgccatgccgaacgacgggtgatccacgtacgcatcaccggtgacgatgatgatgtcgcaggaatcccagccaagctgatccatctcctccctgctcattggcaggaatggcgcaggaccgaaacattcggcccagtacttgggatagtcaaataacggcttggctgtttgcatgacggtgaccggtgttgagatgaaaaatcgcgggcgcggaatatagcacaaaatttgaccaattccgacggtaatggtcggaattgtgcggacgccatcgcaggcaagccagctcccacacgtgaactgtgaacaccttcaaatgtgggagctggcttgcctgcgatgaggccctaacaggcgctggggaattactcgtcgtcgtcgaagttatagctgcccggcgcgaggttctcgaagcgtgtgtacttaccaatgaatgccaggcggataaagccgatcggcccgttccgctgcttgccgatgatgatctcggcaatgcctttgtgttcggtctcggggtgatacacctcgtcgcggtacacgaacatgatcacgtcagcatcctgctcgatcgctccggattcccgcaagtcggagttcaccgggcgcttgttggggcgttgctccagggaacggttgagctgggacagcgccacgaccgggcagttgaattccttggccagggctttcagggaccgggaaatttcagaaatctcgttggtccggttgtcgccgctggaaccggggatctgcatcaactgcaggtagtcgatcatgatcagcgcgatatcaccgtgctcacgcaccagtcggcgagtacgcgcacgcatctccgacgggctgataccggcggtgtcatcgatgaacagcttgcggtcgttgagcaggttgacggccgaggtcaggcgcggccaatcgtcgtcttccaggcgaccggcacgcactttggtctggtcgatacggccgagcgaagaaagcatccgcatgatcagcgattcacctggcatctcgagggagtacaccagcaccgtcttgtcgctgcgcagcacggcgttttccaccaggttcatcgcaaaggtggttttacccatggatggacggccggcgacgatgatcaagtcggacggctgcaagccgctggtcttctcgtcgaggtcggtgtagccggtggaaatacccgtaatcgagttatcggtgttgaacagcgtgtcgatacggtcgatggccttggtcaacaaatcgttgacgctgaccgggccgccggttttcggccgggcctcggcaatctggaagatctggcgctcggcttcgtcgaggatttcggcggcggtgcggccttcggggttgaaggcgctgtcggcgatttcggtgctgatgccgatcaactggcgcagggtggcacgctcgcgaacgatctgggcataggccttgatgttggcgacggacggcgtatttttcgccagttcacccagatagcccaggccaccgacttgggaggtctggccttccttgtccaactgctcggccagggtcaccacgtcgatcggcgagttctggtcggccagcttggcgatggcgcggaagatcaggcggtggtcatggcgatagaaatcaccgtccgagacttgatccagcacgcgttcccaggcgttgttgtccagcatcaagccaccgagcacggcctgttcggcctcgatggaatgcggcggcaccttcagggcagcggtttgcagatcgtattgctcaggagctgaaatatcgttcatggccacttggaattagggggttgtagaaaaacaaaaggcacgacctgtaaacaggatcgtgcccgatgttaaccgcctggcacacggggtgccagtcagttagcttgctttaagctgctaccacaacaacgcgtacggtggcttcaacttcggcgtgcaggtgcacggctacgtcgaattcgcctacgttgcggatggtgccgttcggcagacgaacttcgctcttctgcacttcaacgccggaggcggtcagtgcatcagcgatgtcgtgggtgccgatcgaaccgaacagcttgccttcgtcaccggcggtggcagtgatagtcacttccagctcagccagttgggcagcgcgagtttcggccgaagcttttttgtctgctgctgctttttccagctcagcacgacgctcttcaaacgcagccaggttggcagcggttgcagcggtggctttgccgtatggcagcaggtagttacgaccgtagccggccttaacgttcactttgtcgcccaggttgcccaggttggcgactttttccagaaggatcagttgcatgtgaaaatcctctaacttttaaccttcaccgttcgcgctatcggcgtctttcgacgccagacgaccgcgaaaatcaatcaggccgtcgacaatggccaaaaccacgagtaacggatagatcagctgcatgaatatcaacagcactacgtacaaccccaccagccagaacgtggccaggcgctttcgcgccaccagcccatgaatcagggccagcccggcaaacaccagcggtacgctgcaaatcggcgccagcaaggccatctgtgggccgaagttcggcccgacaaccatgcacgccagcagcaacatcgccggccccgcagggattctggtactgcgaaactcgcgaccaaaaccacccgggttgtacaacaacgcttgccaataacgcccaagaatcaggctcagcacgctgaggatctgcaacaacgccgcaatcaggccggtcaggaccggagcaatcagtgacgccaaccgcgctcgctcatctaccgacaattgctggtagagatccccgagggccaatggcaggatcttgacgatttcctgcgacagcgcctcgatttgcgggcggaaagccgcgccaagcatcactgaatacaccaaccccagtgccacgctgaccagcagcgtgcggacccaggactcacttgcgcgtaaaaccaacgcaaggatcgatgaccccagcagtaccagaagtacccgtggatcacccaattgcagccaccagatcaaggccggcaacaatcccagggcaagaacgccaagggcgtccttcaaaccgcgccgcagcagcacaaggcaaaccgcagcagcacccaaccaataaagcaacggcaatgccacacatccagccactacgagagtggcttgcacgcgaccgcgcatgatgaactcagctaaggcgcgcatgcattcaatcccttactacttgtcgactgcccggtctcagcggccgtggctgtcggtgtaggccagcagggccaggaagcgggcgcgcttgatagcggtggccagctgacgctgataacgtgctttagtaccggtgatacggcttggaacgattttgccggtctcggatacgtaggctttcagagtgttgagatctttgtaatcgatctctttcacgtcttcagcggtgaagcggcagaatttacgacgacggaagaaacgtgccatttgataggctccttaaaaggtccgtggattactcgtcagcgttatcgctgttgtcgctgtcatcactatcagcgctttcagcgccttcgtgctcaggacggtcgcgacgctcacggcgctcactgcggttttcttcagccttgagcatctcggattggccggtaacggcttcttcgcgacggatgaccaggttacggatcactgcatcgttgtagcggaagttgtcttccagctcggccagggccttgccagtgcactcaacgttcagcatcacgtagtgagccttgtgaacattgttgattgcgtaggccagttgacgacggccccaatcttccagacggtggattttgccgccgtcttcttcgatcagcttggtgtaacgctcaaccatgccgccgacttgctcgctttgatccgggtggaccaaaaagatgatttcgtaatgacgcatgaatgctccttacgggttgtagcctgccgctcaaaaacggtcagacaaggagtgaatgacacttatggatcttgccgcagggaggcacatcggcgcctgccaggaaggcaaggggcgcaattgtagagaagggggagaaacggcgcaaggtgattggtgattatttgaacaatcaccacccgctcaggcgatcgcgtgacgcggagcgtcacaagaggcattcccacgcggagcgcgggaacgatcaacaccaaacaaatgtgggagctggcttgcctgcgatgacaatggcacaggcaacatttctgctgactgacacaccgccatcgcgggcaagcccagctcccacagggttaagccttacttcttggctttggccttggcaccacgctggcgctgggcctcaaacaggcagacgccagtggcaaccgacacgttgagactgctgacgctaccggccatcggcagatgcaccaggtaatcacaatgctcacgggtcaggcgacgcatgcctttgccttcggcgcccatgatcaggatggtcgggccggtgaggtcctggtcataaatgctgacctcagcctcgcccgccgtacccacgacccacaggccgcgctgctggagtttctccagcgtgcgcgccaggttggtcacggccaccagcggaatcacttccgccgcgccgcacgccactttacgcacgacgggcgtcaaggtggccgacttgtctttgggcacaatcaccgccagcgcgccggcagcatccgccgaacgcaggcaagcgcccaggttgtgcgggtcagtcacgccgtccagcaccagcagcaacggcgcgccttcggtgcgatcgagcaactcgtcgagcatcgcctcgccccagacctggctagggctcacgtccgccaccacgccctggtgaacgccttccacccacacgtccatttcgcggcgctcggcctggccgatggcaaccttgttttgggtggccaactcgaccagcgcctgaacgcgtggctcgctacggccttcggccaaccacacctgcttgacgcgcttggggtggtgacgcagcagtgcttctacggcgtgaacgccgtagattttttccagactcatgacttggccttaggtttgcgcgacccgccgcttttcgcgggagccgaacccgcttttggcgggcctttacggtgtttactcggtttgctcgacggcttttccgcctcgcgggactttcccccagacgccgctttaccaccgcttttagcttcgttgagcaactgctgcttcaactcgcgactgcggcgcagctcggcgtttttcgccgctgcatcgcttgggcggtacgcttcaggcgccttttccttggccgacgaacgacgacccgccttggcaggcgctggctcggctgccgctgctttcgcaggagtacctttgcctttggcggccggcgctgcggtttcgccgccacgttttttgcggccagtcggttcggcgggtttatcaggcatgccgaagtcgatcttgcgctcgtcgaggtcgacgcgcatgacctgcacttccaccgtgtcgcccaaacggaagctacgaccagtgcgctcgcccgccaggcggtgatgcacagggtcgaagtggtagtaatcgcccggcaaggcggtgacgtgcaccaggccttcgacgtagatatccgtcagctcgacaaacaggccaaagccggtcacggcggtgatcacacctgggaacgtctcgcccacgcggtctttcatgaactcgcacttgagccagttcaccacgtcgcgggtggcttcgtcggcgcggcgctcgctcatggagcactgctcgcccagctgttccagggccgcttcgtcgtacggatagatccgcgctttcggaatggtcatggcaccggcgcgcttgacgtgcggggtgttctgcttggaatggatcacgctgcggatcgcccggtgcgtgagcaggtccgggtaacgacgaatcggcgaggtgaagtgcgtgtacgcctcgtaattcaggccgaagtggccttggttgtcagcgctgtacaccgcctggctcagggagcgcagcatgacggtctggatcacgtggtaatccggacggtccttgatgctcgcgagcagtgcctggtaatccttcggcgtcgggccgtccttgcctttgtgcagggacaggccgagctcaccgaggaacgcgcgcagcttctccagacgctccggcggcgggccgtcgtgcacgcggtacaacgcaggaatctcgtgctttttgaggaattctgcggtggccacgttggccgccagcatgcattcctcgatcagcttgtgcgcatcgttacgggtggtcggggtgattgcggcgatcttgcgctcggaaccgaagacaattcgggtttcctgggtttcaaaatcgatcgcgccacgcacgtgacgtgcgcccagcagcaccttgtacaacgaatacagctgcttgaggtgcggcaccacgccagcgtattcggtacgcagggccttggcttcgctggtcttcggcgtttccaggatggtgctgaccttgttgtaagtcagacgtgcctgggagtggatcaccgcttcgtagaactggtagtcggtcatttcgccggttttcgagatagtcatctcgcacaccatggccaaacggtcgactttcgggttcagggagcacaggccgttggacagctgctcaggcagcatcggaatcacgcgctcagggaagtacacggagttgccgcgcacctgagcttcgttatccagggccgaaccgatcttcacgtagctggacacgtcggcaatcgcgacgaacaacttccagccgccggagaacaggcgcagcttgccaggcttggcttcgcagtaaaccgcatcgtcgaagtcgcgggcatcttcgccgtcaatggtgacgaacggcagatggcgcaggtcgatgcgtttttctttgtctttctcttccacttccggcttgagcttggcggcttctttgagcacagcctcaggccagacgtgagggatatcgtaggtgcgcagcgcaacgtcgatttccatgcccggcgccatgtagttgccgaccacttcaacgatatcgccttgcggctggaagcgcgcagtaggccagtgggtgattttcacctcgacgaactggccgaccttggcagcgccattgcggcccggggtgatcagcacttcctgctggaccttcgggttatccggcaccacaaagccaataccgccttcttcgaagtagcggccaacgatggactcgtgggcacgcgataccacttcgacgatcacaccttcacggcgaccacgacggtcaaggccggagacccgcgccagggcacggtcgccatcgaacaccaggcgcatttgcgcagggctcatgaacaggtcatcgctgccgtcatccgggatcaggaagccgaagccatcacggtgaccggcaatgcggccaaggatcaggtcgagcttatccacaggcgcgtaagtgccacggcgggtgtagatcagttgagcatcgcgctccatggcacgcaaacggcggcgcagggcttcgagctggtcttcggtggtcagaccgaattcttcaaccagctgctcgcggctagcaggcgaaccccgatcggcgaggtgcgccaggatcagttcgcggctaggaatagggttttcatatttttccgcttcacgagcggcctcgggatcgagggactgccaatcggccattagagagttttcaccttgtctatatgcgggttagtttggcatacgcgtattgaaacgggaaatttcagtcctcaacaagcgcttaaaaggcctttgtcgccctcgtaacgcaccttgcacgaccattggcgaaattttccagacttttttcatagcagggctttacagctcaaaatcgcctccgtatagtgcgcgccatcgacgacggcaacgttgttgatgctgcccaggtggtgaaattggtagacacgccagcttcaggtgctggtgatcgcaaggtcgtggaagttcgagtcttctcctgggcaccaatttcaaactcaaggttctgcctcgagtctccaaaaacccgcgaaagcgggtttttgcgtttcaggcctttgatttttaacgagaatcttgatttatatttttgaatcaggggtttacagatcaaaaagccctccgtatagttcgctccatcaacggcgcaagcgttgttgataatgcccaggtggtgaaattggtagacacgccagcttcaggtgctggtgatcgcaaggtcgtggaagttcgagtcttctcctgggcaccaaattcagatcaaacccgcgaaagcgggttttttcgtttccggggtttgaaaacctgccggacgatttcccccttgtccgcacttgagaagttttatcgtttatccttgtaaggatttgttgcactcaagtgaggaaaaccccggatgatgatccgcgatacccgtctcaagacatcccttctgcgtggcctgaccatcactctgctcggcctgaccctgctctcgcccgccgcctattccgccgacaaggtctcactgaccctgtacaacggccaacacaaagaagtcggcgatgaactcgccaaagccttcgaagccaagaccggcattcacgtcaacgtgcgcaaaggcagcagcaaccagctggccagccaggtcgtcgaagaaggcgaccgctcccccgccgacgtgatctacaccgaagaatcgccgccgctgaacaaactcggcgaacaaggcctgctcgccaagatcgacgccagcaccctcgacgtattgcccaaagactatgtcggcagcaacggcgactggatgggcgtgaccgcacgcacccgcgtcgtggcattcaacccgaagctgatcgctgaaaaagacctgcccaaatcggtgctggatttcgccggccccgagtggcaaggcaaagtcggcttcgtacccaccagcggcgcattccaggaacaagctgtggcgatcatcaagctacacggtcgcgaagccgctgaagaatggctgaccggcctgcgcgcgttcggcaaggtctacagcaacaacatggttgcgctcaaagccgtggaaaacggtgaagtcgccaccgtgctggtgaacaactactactggtttgccctgaagaaagaaaaaaccaacctggattcgcaactgcattacttcaccaatggtgatgccggcggcctgatcaccgtgtcgtccgctgccgcgctgaaatccagcaagcacccgaaagaagcccagcagctattggcctttatggccagcgaagaaggccagcgcgtgatcaccaacacctcggccgaatacccgctgcgcaagggcatggaatcgagccgcggcctcaagcctttcagcgagctgcaaccgccgaaagtcacgcctgcggaccttggcaatgccgaagaagccctggacctggaacgtgacgttggcttgaactgatgaacccatcgctccccgcccccgccttgcgcgggggtttcagcccgaggcgcaagcgcccatcgatctggctgctgattcccgtcctgttcctggtctgcttgagcctgctgccattggtgtatgtcgggaccaaagcctggcaagcgggctgggcggaagcggtgcatttgctgtggcggccctatgtattcgggctgctgcgcaacaccctggcgttgatgattggcgtgacggtggcttgtggcgtgatcggcctgtccctggcctggctgctggaacgcagcaacctgccggggcgacgcatctggggcgtgatcctgtgcctgccgtttgcggtgccggcgtttgtcagcagttttacctgggtgtcgctgagcgccaacttcgaagggctgggcggggcgatcctggtgatgaccctgtccaagtacccgctggtgtttctgccggtggcggcgacgttgcgcaatcttgacccgtccctggaagaatcagcccgcaccttgggactgaatcgctggggcgtattttttcgcatcacactgcccttgctgtggccttcgttgctggccggggcgctgctgattgctctgcatatgctggtggaattcggcgcgttgtcgatcatcggcctgcagacttttactaccgcgatttaccagcaattcgaattggaattcagcaacgctaacgccgcgatgctctcggcggtattgctggtgatgtgcctgacgctgctgtggcttgagctgcgcgtacgcggcaaaggccgacacgtgcgcatcggccagggcgcggcgcggcatgctgaacaggtcaagctgggcaagtgggcaccactgggccaagtgtattgcctggcgctggcgatcattggcagcggcattccgctgggcatgctcgggtattggctggcggtgggttcgtcggcggcctttcccgtggccgagatcggtgaggcactgctgtcttcgctggctctgtcgctgggcggcgcagcgctttgcctggtgctggccgtgcctgtggggctgctggtggtacgctacaaaggccagctggcgatctgggccgagcgcctgccgtacctgctgcatgccctgcccggcctggtgatcgcactgacgctggtgtatttcgcactgcattacgtgccggcgctttaccagacgtccgcgctgcttttgatcgcctacgcgctgctgttcctgccactggcgcaggcgccgattcgcacggccctgaacaaggctgcaccgcagctggaagaggctgcgcgcacactgggcgcgtcgtcgttcagcgcgttttgtcgggtgactttgccgattattttcccggctttgggcgcggcgtttgcgctggtgtttctggatgcgatgaaggaattgacggcgacattgctgctcagtccaacggggctgaacaccctggccaccgccgtgtgggcgcatacctcgaatgtggagtttgcggcggcagcgccgtatgcggcgctgctgattctggtgtcggggttgccggtgtatttgctcacgacgcggatgtatctgagccgctgaaacagcgattgcaggcaagccagctcccacatttaactgcattccaaggttggaactcggtcagctgtgggagctggcttgcctgcgatagcgccggtacaggcaccactaagcccgaaactgccccaaactcgccttaagctgcgccgccaacccatccagcaccttgccactggccgtggtctccaccaccgcctgcgccgcacgctcagcctgggcatgaatcacctcgacccggccacgcaccgcatgcgcaccttgcgcctgatgctcagctgcacgcgtcgccaagccaatcgccgcatgcacctgctccaccgaagcctgcaccgtctgctgcaggcgcacactgtcacgcagcaccagcaagccttcgttggcttgccgcccggccttgctgatggtttccaccgcctcacgcgcgccctgctgcaacgccacgatatgcgcctggatatcacccgtggagctttgggttttactcgccagcgcacgcacctcgtcagccaccaccgcaaaaccacgcccggtctcaccggcccgcgcagcttcgatggccgcgttcagcgccaacagattggtctgctcggcgatgccatgaatcaccgtcagcaccacttcaatttgctcgctttgctgggccaggcgctcaatgacctgggagccggcctgaacctgcccagccaaggcctcgatcaagctgccgacctccgccgaggtacgcgagttttcatccgtggcctggcgaatatccaccacctgctgcagtgccgcctgcatcgcatggctttcggcctgcgcctcatcggccatttgcgacagcgcgcgcaagctctcggccacttcatcgcgctgcaaaccggcggccttgtcagcgccggcattgcgcaaggtcatggcaccgatttccacgcccgtgcgctgagccacatcacctgcctcacgcacgatgggctgcaacttatccacaaagcgattgaccgccgaagccatgtcgccaatctcgtccttactgctgatttgcacgcgcttggtgaggtcgccctcgcccgccgccaggtcatccatggccgcgatcaacagcttcaggcgattgaccacacgccggcccagtacgatggcgatcagcagcaatacaccgaaccccacaatcgcgagccccatgccgatgcgccagcgcaaggtgcccgcagcttcctgcacggcgctggtggtgttggcggtcatctgcgtggcggtgttttgtgcagactgcaggcgcgcgcccatggccgctgcgctgtcggcagccgcgcccttgaggctgtcacccaccagctgatcactgctggcaatcagcgctgcaaaccgcttgtccagcgccgccaggtctgtctcgaccgccgtggtcgaaacccccatacggactttgccgatctctacgccgttagggctgatggaggcttcgacgtaaaacaccgaaggatcatttttcgccgcatccaagactttatccagggcacggtcgccctgacccttagccagcaatgcctggttgatcgggttgtcacggttcagatagcgggtcagatgctccccggcggcatcgtcgtagaccacgaacaacacgttgggattgcgctgggcacgccgggcgaattccgacaacgtcggcacgtcgctgtcccacatggcgcgcggcgccaccgaggccagcagttgcgccatgtcgttggcagagtcttgcaggtctttttccagcgtcgcacgcagttgcttctgctcgtccttcagacgcgtggagagccctgcggtcagacgttggcgcgtgctggaagacaagctgtccagactggaggtgacttccttgccggcttgcgccagctcaccggaaagtttctggctgtcgacgcccaggcggttgcccaaatcagcttccaatgcagtcaccgtgcttcgcgtcagggcgacggccaccagcacttgcaccaaaagagcgatacctagggtaacgaacaccggccgcaacagtcggctttgtaacaatgagagaacggcagacactggaaatccctccaccacgggtgccattaatttgatagcaccgcgaaagaaagaaccatagcaagggtcgtgccgtttgccagccagatacgacaaagggctcccgaaggagccctttgctttttacatcaacagcttattaagcgaacgggtgacgcagaacgatggtctcgttgcggtccgggcctgtcgaaataatgtcgattggcgcgccgatcagctcttcaacgcgcttgatgtaagcacgcgcattcgcaggcagctcttccagggttttggcgcccacggtcgattcggtccagcctggcacttcttcgtacacaggctgcaggcctacgtagctgtcagcgtcggtcggggcaacatctttaccgtctgcatctttgtagccgatgcagatgttgatggtttccagaccgtcgaggacgtccagcttggtcaggcagatgcccgagatgctgttcacatcgatagcgcgacgcaggataacggcgtcgaaccagccgcaacgacgagcacggccggtggtagcaccgaactcgtgaccttgtttggccaggtgtgcgccaacgtcgtcgaacagctcagtcgggaacgggcccgaacctacgcgagtggtgtaagccttggtgatgcccaggatgtagtccaggaacatcgggccaacacccgaaccggtcgccacgccaccagcggtggtgttggagctggtcacgtacgggtaggtgccgtggtcgatgtcgagcaacgaaccttgggcgccttcgaacatgatgtctttgccggcgcgacgcaggtcgtgcagctcagcggtcacgtcgagcatcagcggcttgagcagctcagcgtattccttgcactcggccagggtcttttcaaactcgatggccggctctttgtagtaaccgaccagcatgaagttgtggtaatccaccagttcacgcagcttgtcttcaaagcgcggcatgttgagcaggtcgcccacacgcaggccacgacgtgcaaccttgtcttcgtaggccgggccgatgccgcgaccggtcgtaccgatcttcagctcgccacgggccttttcacgggcctggtccagcgcaacgtggaaggacaggatcagcgggcaggacgggctgatacgcaggcgctcacgcaccggtacgcctttctcttccagcttggtgatctcacgcagcagggcgtcaggtgcaaccaccacgccgttgccgatcaggcactgcacgccttcgcgcagtacgcccgacgggatcaggtgcaagacggttttttcgccatcgatgaccagggtgtggccagcgttgtggccaccttggtagcgcactacggcggcagcatgttcggtcagcagatcaacgatcttgcctttgccctcatcaccccattgggtgcccaggactacgacattcttacccataacacttgtcctcattcgcgcaaacttggtgccggcgatggccggcaggaaaactcaagaagccagtggcgatacttgccaaagcccgttctgcagaatcaattgccggtcgcagtccgcatcacgggcggcggccaatggctggccaggcaacgcctggacaacacgctgaccctcactgcgcaactggcaaacctgctgccagagtgctgcgtccgtactgtcgggcatccagatgccaccagacggcagctcgacctcagcacgccccagggtcaccagggttttcaaatcggtggaaaagccagtcgccggacgcgcgcgaccgaagtcggcgccgatatcgtcataacgaccgccttgggcgatggcctggccaacccccggtacaaacaccgcgaacaccacaccggtgtggtagtggtagccgcgcaattcacccaggtcgaaatacagcggcaactccgggaaccgcgccgacaaacgctcggcaatcgccaatacgtcatccagcgcagccaaaactggcgccggcgcattggccagacgctcacgtgcagccaccagcacttcacggccgccgcacaggttcaccagtgcgcgcagcatgtcagccagatcggcaggcacgccagcggtcagggcgatgacttcatcgatggccttgcgctgcagggcatcgaacaattgttgctccacttcaccggacaaaccggccgcacgggccaggccacggtagatacccacgtggcccaggtccatgtgtacatccggcacatccgccagtcgcagcatggccagcatcaagctgatcacttctacgtcactgctcgggctggcatcgccgtacaactcggcgcccaactggatcgggctacgcgaagacgacaaggcacgcggctgagcatgcagcacgctgccggcgtagcacagacggctcggaccttcgcgacgcagggtgtgcgcatcgatacgcgccacttgcggcgtgatgtcggcacgaaagcccatttgccggcccgattgcgggtcgatgaccttgaaggtgcgcagatccaggtcctggcccgcgccggtcagcagggattccaggtactcgatatgcggggtcacgacaaactcgtaaccccagctctggaacagatccaacacctggcgacgcgctacttcaatgcgcgcagcttctggtggcagtacttcttcgatgccatctggcagcagccagcggtctaccgttgccattacgccattcccctatgatccgggcgaccagccttcggccgagccctgagtgaagcagaaaatgcccggcccctgcataaacaacgcgcaagaacgacgtgacgaaatggcctgctagcggcctcgtcgggcactttcctcgaaaaacctgtcacgcctgccgaatcaaacatgcagacgcaaaaaagccgggaatttcccggctgccgcatcatacacccgttttctgaaaggatcaccccgccaggcattttagccgcccgacggagtgggccctacagaatcaccggctggttacttggacttttccaggtagcggaagaagtcgctgcttgggtccagcaccatgacgtcggttttgttcgcgaagctttcacggtaggcacgcaggctacggtagaacgcgtagaactcctggtcctggccgtaagccttggcgtagatcgccgcggcttgagcgtcgccatcaccacgggcctcttcagactcgcgataggcttctgccagcagtacacggcgctgacggtcggcatccgcacggataccttcagccaactcgttacccttggcgcggtgctcacgggcttcacgctcacgctcggtgctcatacgctcgaacacgctgcggttcacttccttgggcaggtcgatcgccttgacccggacatcgacaacttcgatgcccagctctttttcagccatggtgttcaacgaacgcgtgatatccgccatcagcgcatcacgctcaccggataccacctcgtgcagggtgcgtttaccaaactggtcacgcaggcccgattccagacggcgcgacaaacgctcgtcggcaatctgcttgaggccggaagtcgcggtgtagaagcgctcggcatccttgacgcgccacttggcgtaggcgtcaaccatcacggctttcttttccagggtcaggaagcgctgtgtcggtgcatccagggtcatcaggcggccatcgaacttgcgcacctggttcacgtaggggactttcacatgcaagcccggctggacatccgcctggaccacacgaccgaattgcagcaacaccgcgcgctcggtctgagacacgatgtagaagcagttccaggcagcgatgaccacgacgacgcccacaatcagggcggtcagcgatttattgctcatcaacgactctccctggtacgtgtttgctgttgcagcaagtcagcggccgcacgggcgctcgcttcgttggcagcagcggtcgaaccggtggacggcgcgctggtgctgctacgaccaccttcgatcatcttgtccagcggcaggtacagcaggttgttctgcccacctttgctgccggtcacgagaaccttgctggtgttgctgaagacttcctgcatggtgtccaggtacagacgctcacgcgtgacttccggagccttgcggtactcggcgaccagcttggtaaagcgatcagcctcacccttggcgcgggagaccacttcgtcgcggtaaccgttggcatcttcaaggatacgctgggcctgaccacgggcttccggcacgacgccgttggcgtaggtttcagcctggttgcgcgaacgctgctcgtcttcacgggcgcggatcacgtcgtcaaaggcttcctgcacttcgcgcggtgcggctgcgctctgtacgttcacctgggtgacggtgataccggtgcgatacgtatcgaggaaccgttgcaggcgctccttgatctcgctggccatcaattcacgaccttcggtcagcacctggtccatggcggtggaacccaccacgtggcgcagggcactttcggttgcgtgttgcaggctaatctctggctgatcaacgttcagcacgaaatcctgcaggttgctgatcttgtactgcacggtcagcggcacttcgacgatgttctcgtcttcggtcagcatctggccctgcttggtgtaggcacgctcacgcgtgacgttctccatgtacttcttgtcgatcggggggaagtagatgttcaggcccgggccgacagtctcgtagtacttgccgaagcgcagcactacggcttgctcctgctcgtcgactacgtaaaccgcgctgtacagccacacggctgcgagcacgacaagacccaggcccagcaggccatagccaccgcccttgcttgtgcgaccgccgtcgtcaccaccacgttttttcccaccaccgaacaacccattcaggctttcctgcagctttcggaaggcctcgtcgagatctggtggccccttgcggtcgccgttattgcggcgtttaccaccccaaggatcctgattattcgagttgccacccggctcattccaagccatagcgctctccatctgataaagcaaagacgcacccacggcgcgccgaccaatgctacagaatgcctgctgctgcggcacaaccgctttagaaggcttttattgcaaagtgtgttgttcgatgaactccgtcggcacaacgccttcacggctgaccagccgattcagctccgagcgcggcaatcgaacggccagcaagctgacaccctcttcgtcgtattcttctttctgtaccgcgcccaactcgaaaaactgtgcacgcagtcgagcaaaacgctgaggcaagcgcaaggtgccgacaaacaaatcgctgcccagcagctcggcaatggcttgttcaagcaattccaaaccactgccgtcacgtgccgacagccagacccgctggggcttgccgtcttcgtcgcgctggatttgtggctcaacgccttcaagcaaatcgagtttgttatagacctcgaggatcggcaagtcctgtgcaccaatctcgcccagtaccaccatcacctgttcaatctgcaacatgcgatccggttcggccgcatcgatcacgtgcagcaacaagtcggaattgctcgactcttcgagcgtagaacgaaacgcctcgaccagcttgtggggcaggtgacgaatgaaacccacggtatcggccaggacaatcggccccaggtcgtccagttccagacggcgcaaggtcgggtcgagggtagcgaacagttggtcggccgcgtaaacgtccgatttcgtcacgttattgaacagtgtggatttgccggcgttggtatagcccaccagggaaacggtagggatatccgcacgcatacggccacggcgtgattgttcgcgctggctgcgtactttttccaggcgacccttgatctggcgcaggcgaacccgcagcagacggcggtcggtttcgagctgggtttcacccggcccgcgcatgccgataccgccaccctgacgctcaaggtgagtccagccgcgaaccagccgggtgctcatgtggtcaagctgggccagttctacctggagcttgccttcatgggtacgggcgcgttgggcgaaaatatcgagaatcagaccggtgcggtcgatcacgcgacactcgaaaacacgttcgaggttacgttcctgactgggcgtgagggtgtgattgaagatcaccagatcggcttcttcagcgtggaccaggtcgcgcagctcctcgaccttgccgctgccaatcaggaatttggcggttggccgatgacgcggcacgttaaaaaacgcaacggtctcggcgccggccgaatttgccaactcctgaaactcctgcggatcttcgcgcgcctcagggtcctgtccatccaagtgaacgaggattactcgctcaccaccaccgtggcgctcaaagaacaaaggagactcctatcaggcgttacctggctcagcgtcaccggcttcgtcacctgctgcgctaggcagacggataggacgaactggaacgactgtcgagatagcgtgtttgtaaaccatctggctgacggtgtttttcagcaggatcacgaactggtcgaacgactcgatcgtgccttgcagcttgatcccgttgaccaggtagatggaaacccccactttctctttacgtaaagtattcaagtaagggtcttgtagcgaatgcccttttgacatgtgccgcactcctttaaggatcaataataaaattcggaaaatagatagcttatggccgtcacacccccaaggatagacggcaattgcaaggactcagctcaatatggagaccgatcccaagtatttcaaggcgcgtgacagattgtcgctgtccaggctgtccagccagtgcaaatcgctccagctgcgcaaccaggtgaactggcgtttcgccaattggcgcgtggcaatgatgccgcgctcctgcatttcggctgacgtcagcttgccatccagatgatcccagacttggcggtagccaacagcacgtatcgacggcaacccagcatgcaggtcacctcgggaacgcagtgctacgacctcgtccacaaacccctgttccaacataattgtgaatctttgtgcaattcgttcatgcaacacctggcgatttgccggagcaatggccagattcgccacagtatagggtaatactgcctgcccagatgcgcctgcgtcagcactttgcgcagtttgtttcagccgatgttcagtcatggtctggccgctgacccgccaaacttccagcgcgcgagtgagacgctgcgggtcattggggtgaatacgcgccgccgacaccgggtcaaccgccgccaattggtcgtgcagggcttgccagccaaggcgtacagcctcttcctcaagttcggcgcgcacctgggcgtcagccggcggcatatccgccagaccttcctgcaaagccttgtaatagagcatggtgccgcccaccagcagcggaatattgccccgcgcggtaatttcagccatggctgccagtgcatccgtgcggaaatccgcggcggaatagctctcggccgggtcgatgatgtcgatcagcttatgcggatactcggccagcagggctttggaaggcttggccgtgccgatgtccatgtcccggtaaaccagggcagagtcgacactgatcagctcgcacggcaacaccttggtcagctcgatagccaggtcagtcttgccggcggccgtagggcccatcaggaagatcgcggggggcaaggcgctcatcaacggccgcgcaaaaacagtttgtccagatcgtccaggcccatttgggtccaggtcggtcggccatggttgcattgcccactgcgctcggtgttttccatatcacgcagcaaaccgttcatttccggcaaggccaggcggcggttggcgcggatcgcaccgtggcaggccatggtgccgagcagttcattgatgtgggcctggatgcggtcactggtgccgtattccatcaggtccgccagcacgtcggcgaccagacggttggcttcggcctgcttgagcagcgcgggaatctggcggattgccagggtttccgggcccaggcgctgcaattcgaagccgagtttctggaacacgctgtggtgttcttctgcgcaatcggcttcacgctggctgacggccagggattcaggcaccagcaacggctgaccgctgaggccttcgctggccatggcgatcttcaggcgctcgtacatgatccgttcatgggcggcatgcatgtccaccagcaccaggccgtgggcgttttccgcaagaatgtagatgcccttgagctgcgccagcgcataacccagtggcgggatgtcaccgccgccttccggcaacgcgaccgcactcggctcggcacccggcagcggcgcaaaaaattcgcgataggccgcctgggcttctgccaccggcactgccgattgcgggcgcggcgtgtattgatactgatagcccgcaccagaaccggagcccgccggcgtcgtatagctcggctgcgactgtggcgactgcagcaagttggctgccaggctcatttcgccttgcgggccaaactcaccggcctgcgggccactcggccgcaccaccgccgtgacgatcggcgcagacagctgatcatccgggcgcacatcgcccaaggcgcggtgcagcgtgccgtaaaggaagtcatgcaccatgcgcccgtcacggaagcgcacttcgtgtttggtcgggtgcacgttgacgtcgaccaccgaagggtcgacttcaaaaaacagtacaaacgtaggatggcgcccgttgaacagcacgtcgcggtaggcctggcgcaccgcgtgggccaccagcttgtcgcgtaccgcacggccattcacgaagaaatactgcaagtctgcctggctacgcgagaaggtcggcaagcccacccaaccccagagccgcaagccattgcgctcgatctcaatcggcagcgcctgctccaggaagcccgcgccgcaaattgccgacacacgccgcgcgcgcgctgcgtcgtcatgggcttcgtgcaggctgaggatggtcttgccgttgtggcgcaggtgaaacgccacgtcgaaacgcgccaaagccaagcgtttgatgacttcttgcaggtgatcgaattcggttttttcagctttgaggaatttgcgccgcgccggggtgttgaagaacaagtcgcgtacttccaccgaggtgcccaccgggtgcgccgccggctgcacgcggggcgccatgtcgcggccttcggtttccacctgccaggcctgctcggcgctgcgggtgcgcgaggtcagggtcaggcgtgccaccgagctgatcgacgccagggcttcaccacgaaaacccaggctcatcacccgctcaaggtcttcgaggtcgcgaatcttgctggtggcgtgacgcgccagggccagcggcaggtcatcagacgagataccgctgccgtcgtcgcgcacgcgcagcagcttgacgccaccctgttccacgtccacatcaatgcgcttggcgccggagtcgatgctgttttccagcagttccttgatcaccgacgccgggcgctcaaccacctcgcccgcggcaatctggttggccaggcgcgggctgagcagctcgatgcgcgaaccgctgttcaagactgactcgctcattattgcgccgccaattcggtgccagggatggtcaacacctggccgactttcaactcatcggttttcaggttattggcgctgcgcaaggtcgcggccgagacctggaaacgcacggccagcatggccagggtgtcgccgggctgtacgcgatggtcacgcgggccctgggcgattttcccggagtcgcgcagccaggcaatgtaggtgcccggtggcgggttctgctggaagaactggcgaatgcccgcgctgatcgaacgcgccagcgcctgctggtggctggcgctggccagcttagaggcctcgttggagttggagataaacccggtttccaccaggatcgatggaatgtccggcgacttcaacaccatgaacccggcctgttccacgcgctgcttgtgcaaggaggtgacgcgaccgatgttgctcaggactttctggccgacgttcaagctggaagtcagcgaagcggtcatcgacaggtcgagcagcacgccggcgagcattttgtctttgtcgtcgagggacacgttgccggccccgccgatcaagtcggaacggttttcactgtcggccagccaacgcgcagtctcggacgtggcgccgcgatccgacagcgcaaacaccgaggcaccgaaggccgcggccgacggtgcggcgtcggcgtggatcgacacgaacaggtcggcgcccttcttacgcgcgatttcggtacgcccgcgcaacgggatgaagtagtcgccggtacgcgtcagctcggcgcgatagcctttcatgccattgacctgacgctgcagttcacgggcgatggccaataccacgtctttttcatgctggccgcgcgagccggaggcgcccgggtcttcaccgccgtggccggcgtcgatcaccacgataatgtcacgcttgcccgccggcgctggcggcggcggtggcagcttgacctgcggctgcgacgggttgaccggcacggccggcaccgtcgccacgctcggggttggcgcaggcggcggcgcggcatcggcggcgttgtcgaacaggtcgaccaccaatcggttgccgtattgggcgttaggcgccagcacaaagcttttcggagtcacggcctttttcaggtcgatgaccacacgcaggtcggtcggcgtgcgctgggccgagcgcatcgcggtaatcggcgtgttggccatggagaccttcagcggcgcggccagggtcgcaccgttgatgtcgatcaccaggcgatcaggcgccgtcagggtaaagacgctgtgctggaccgggccagacaggtcgaacaccagtcgcgtgttatccggcgctcgccacaggcgaacacttttcacctgtgaagcagccagagcattgaaagtcattgccgcaagcaacacccctacgacagcaaccatcgcgcgaaagcgcatacctaaccccaccaattatttgaattccaatgccaaagcggcgcaccacgactgaccgcgcgcgctttggggcaacaacttcagctgacgtccagattcatgcggcgtaatggtaatggtcaggtccggctttggcaaaaagcctgtgcctttatctggccactcgatcagacacaacgcgtcttcgtcgaagtaatcacggatacccatgtactccagttcttcggggtcgaccaggcgatagaggtcgaagtggaaagcccgcagctcaccgatttcgtagggttcgaccagggtaaacgtcgggctttttaccgcgcccgtgtggcccaacccgcgaataatcccccgcgacagcgtggttttaccggcgcccaagtcgccttcaagaaaaatcagcccagcgcccttcgtcacctgggcgatgcgctgaccgagcgcaaccatcgcgtcttcgttggccagaaaaagggttacttcagacacggtgactgttcctccagcaattgacgaatggcaggtatcaggtcactggcagccaaaccgcgaccaaaggtaccttggcgatcccccgccgtggcgtgcaaccacacggccaggcagctggactcataggctggcatgccttgggccagcaatgcgccgaccagcccgctcaatacatctcccaggcccgccgtggccatcgccgggtggccctggtcgcagcgtgaaacccgcccgtccgggctggcaatcaaactgccagcacccttgaggatagccactgcattgaatttctggctcaacgcgcgcgccaccttaaggcgatcggcctgaacctcggctgtcgtgatgcccatcaagcgcgcggcctcgccagggtgtggcgtgatcaccgagtgggccggcaagctgacactgccggtggccagctggttcaaggcgtccgcatcccagacttgcggctgcttggcgtttgcggcaacggacaacaggcttttaccccaggaagcatcacccagcccagggccgatgacgatcactgagattttttccagcagccccatcaactggttggccgaactcacgcccaccgtcatcacttccggcaagcgcgccaacgcggccggcacgtgttcaacacgggtggccagcgagaccatgcccgcgccactgcgcagggcactttctgcgctcaatagcgcagcaccgccaaagccgcggtcgccgccgatgaccagcaggtggccgaactggcctttatgggcgtccggggaacgtgcagccagttgcggcaaatggccgtgcaataagggttgtacgtcggttattgcgtgttttgtctgcggcatgcgtcttcaagctccgatgtctggcagaattatacctatctaacctgcggtttcccttgtctcatgcctgccatcaccaccgatctgcctgccctcgcccaatcgatcaaagactggggccgcgagctgggctttcaacaagtcggcatcagcggcctggacctggccgagcatgagcagcatctgcaacgctggctcgacgcgggctaccacggcgagatggactacatggccgcccatggcagcaaacgctcgcaccccgacgaactggtgccgggcacgctgcgtgtggtgtcgctgcgcatggactatctgcctggcgacacccaaatggcgcaattgctggccaagccagaaaaagcctacatatcccgttacgccctcggccgcgactaccacaagctgatccgcaaacgcgtgcagcaactggctgaccgcattcaggcgcagatcggcccgtttggctttcgcgcctttgtcgacagcgcgccggtgctggaaaaagccatcgccgagcaggccggtctcggctggatcggcaaaaacaccctggtgctcaatcgcaaggccggcagctacttcttcttgagcgagctgtttgtcgatctgcccttgccggttgacgccccgcacagcaccgagcactgcggccgctgcaccgcgtgtttggacatttgccccaccaatgccttcgtcggcccctatgtactggacgcgcgacgctgcatttcctacctcaccatcgaactcaagagcgctatcccagaagacttgcgcccgctgatcggcaatcgcgtgttcggctgcgatgactgtcagatcgtttgcccgtggaatcgtttcgcccgcgccaccactgagggcgatttcaagccacggcataatctggataacgccgagctggccgaactgtttatgtgggacgaggataaattcctcagcagcaccgaaggctcgcccctacgccgcgccggttatgagcgctggttgcgcaatttggcggtcggcctgggcaatgcgccgtcgagtattgcggtactggaagccttgaaggcgcgccgggattacccctcggacttggtgcgcgaacacgtggagtgggcgctcaacaggcacgctacgcgttagtgcacgtcgtcgttgtagacgaacttgggcatttcccagtgaaaacgaatcgccagcagacgcagtagaaagccactgaacaatgtcagcagaatcgcttgctcgctcggcagcgcaaggtaaaggcacagcatgtagaaccacgcggccaggaacgacacgctggcatacagctcacggcggaagatcagcgggatgtcgttgcagaaaatatcccgcaggatgccgccgaacaccccggtgatcacgccgctgaccgacgccaccaacatgccgtggcccatttccagggcggtcatgcagccaatcaaggtgaacgccaccaggccgacggcatcgagcgccaggaacagcgagcgcaggtggcgcatcaacggcgcgataaagatcgtcaccaatgccgcgatggaggtcagcaccaggtattccgggtgcttgacccacgtcagcgggtaatgccccaacagcacatcgcgcaccgaaccaccgcccagagcggtgacgcaggcgatcagcaccacgccaaaccagtccatgccgcgccgcccggcggacagggcgccggtcatggcttcggcggtgatggcgatgaggtagagcatcaacagcatgatggcgatccttgcaaagaggcgcgcagtctaatcatttggtgatggcaccaaaagagggcgcatggcgaaagaccgtgtcaacagcatcgcaggcaagccagctcccacacttgaatgtattcacacatcaaaatgtgggagctggcttgcctgcgatgaggccagggcaggcactacatcttcaagccttgatgaaatgcttgcggtaatgctgcagctcggcgatcgactcgcgaatatcatccagcgccaaatgggtgctgcccttatggaagctgtctttaacttccggcgcccaacgagcagccagctctttcaaagtggacacatccaggttgcgatagtggaagtagctttccagccccttcatgtgcgtataaaggaagcggcgatcctggcaaatgctgttgccgcagatcggcgacttgcccttgggcacccacttttccaggaaggcgatggtttcagcttcggcatcgcgcatgctgatgcggctgtcgcgcacgcgctgggtcaggccggagttgccgtgggtgcgggtgttccactcgtccatggtggcgaggacggcgtcgctgtggtgaatggcgatcaccggaccttcggccaaggtgttgaggttgctgtcggtgacaatcgtcgccatctcgatgataacgtcggtgtcggggttcagaccggtcatttccagatcgatccaaatcaggttctgtgggttttgcatggcttgattctcttggcaccttggcttagctgcgcagtttagcaggcggggccgtgctagactcgcgaccgttttacccaacctttgcattatcgacacggaacaccaatggccaaacgccagctcaaccgtcgccaaaactggcgcatcgaaaagattcaaggtgaacgcgccgctcgcgccgccaaacgtgaatcctccgccgtggaagcgctcgagggcggcgacctgggccccgaacaaacgggcctggtgatcgcgcactttggtgtgcaggtcgaagtcgaggcgcttgaaggcgaactcgcaggctctgtttcccgctgccacttgcgcgccaacctgcctgcgctggtcaccggcgacaaggtggtgtggcgtgccggcaaccagggcatcggcgtgatcgtcgcccagttgccgcgtaccactgaactgcgccgccccgacagccgcggccagctcaagccggtagcggccaacgtcgacatgatcgtgatcgtgttcgcaccgctgccagagccgcatgccaacctgatcgaccgctacctggtcgcagccgaacatgcgggcattcgcccactgttgctgctgaacaaattcgacctgatcgacgagcagaacgccccggcgctcaacgcgctgctggcggtctaccgcacactgggttacccggtgctggaagtttcagcgcaccacggcaacggcatggaacagctgcaacagcagttggacgggcgcatcagtgtgttcgtcggccagtcgggcgtgggcaagtcgtcgctggtcaacagcctgctgccggaagtcgacacccgcgtcggcccgctgtcggagctgtccggccagggcacccacaccaccaccaccgcgcggctgttccacttccccggcggcggtgagctgatcgactccccaggcatccgtgaattcggcctcggccacgtcagtcgcagcgacgtggaagcgggcttcatcgagttcaacgacctgatcggcacctgccgcttccgcgactgcaaacacgaccgcgagccgggctgtgcattgctcaaggccctggaagacggccgcgtgcagcagcagcggatgaacagctaccggtcgattattgcgagcttgccggagagcagttactaaaccgcacctacaaaaaggccgcgatcatcgcggcctttttgtatctggattacgacccgggcgctggcgcaggcgccgtcggatctttcaccccaccgtcatcaaacaggttcagcttctgtcgcagctcatgcgccggcagcggttcctgccctggcgggatggcattcgggtcggccggcacttcgcctggcgcgccttcgccttgggtcggtgccgtcggcgctgcgccttgatcgccctcaatcgcgcgctgggcttttttggtcagcacgacgatatcgatacgacggttgatcgggttgaacgggtccttgggatcaaacagctgcgaggacgcaaaacccaccacgcgggccacttgcgggtccggatagctgcccgcgaccagcgcacggcgggcagcgttggcgcggttggcggaaagctcccagttgccgaagtcgccctggcccgcatacggcttggcgtcggtgtggccgctgatgctgatcttgttcggcaccgccttgatggtgtcggccatggccagcaggatgtcctcaaagtacggtttcaagcgcgcgctgccggaatcgaacatcggccggttggcggcgtcggtgatctggatgcgcaggccttccggggtgatttcgaaggaaatctggtccttgaacttcagcagctgcgggttctcttcaaccttggtctgcaactcctgcagcaacagctccaggcgctcttgctcgacctgctcggccatggcctcgacggtgtcgcgctcaatcgggattttttcctgcggtgcttcagtcttgacctcggggttgatggtgcgctcaggcgccagctgcggcgagccgcccaggtcgatcacaaacggggtgccgctttccgagaagccaatcgggtctttgaagtaaccggcgatggcaatcttctgttcgggcgtggcggtggacatcagccacagcaccaggaagaacgccatcatcgccgtcgcaaagtcggcgaaggcgattttccaggcaccgccatggtgccccgcagcgaagcgcttgacgcgcttgatgattattggctggttgttttccatgacttagcgaccgcgaaccgcttgttccagctcggcaaaactcgggcgatgtttcgggtacagcaccttgcgcccgaactccaccgccagcgacggcggcatgccggatgccgaagccaccaggcacgccttgatcgcttcgtacaggttcacttcttccttggcatcgtgggccagggaagtcgccagcgggccgaagaaaccgtaggcggcaagaataccgaagaacgtacccaccagcgccgcacccacgtgcatgccaatggccttctggtcgccctcgcccagggacgccatggtcaccacgataccgagtaccgccgcgacaataccgaaaccgggcatgccgtcggcgatgccggtcacggcgtgggatgggtgttccagctcttctttaaggctgaacagctccatgtcgaacaagccttccagctcgtgcggcgccatgttgccggaggacatgatgcgcaggtaatcacagatgtaagcggtcatgcgctcatctttgagcaccgccgggtacttggcgaaaatcgggctggcggcggcgtcttcgatgtcgccttcgatggccatcatgccttcgcggcggctcttgttgaggatctcgtagatcagccccagcacttccaaataaaaggtgtgggagaagcgcgagctgaacatgcccagcgacttcttgatcacgtgcatggtcatgtagccggggttggcctgcaggaatgcgccaaacgcggcaccgccaataatcagcacttcgaagggctggatcaacgcggcaattttaccgtgggacaggacgtacccaccgagcacacttgcgatgacgacgatgatgccgataattttagccataggagattggtacttgcgccgtcgggttcatggacatattgggtgaagctgaaaactcttgttctacttatcggcaaaactgcgccagactatagcccgttaaggcgaaaagccaattcggcccgttccgggcgtgttgaatgcaagtgatgatcgcgccccaatcatggctaatgaaacgacagttccaacgacaaaacccaccacactcgccgcttggatcaagcgcctggacgaggtgctgctgcccgttccccaggccagccacgagcgtgtgtgcaaagccattcgcgatagccgcagttcattgcgagatattgccgagctgatgcaaaacagcccggcgctggtgctcagcgtgatgcgtgaggccaacagccacacccacggcagcatggccgaaccggcggaaaaccttgaagtggcgctgaaccgcctgggcctcaaacgcgccgaagagttgctggcgcgcctgccctcggtgccggaaaaagacatcccggtggccttgcgccaattgctgctggtgagccaacacgcgtcccagcaagccaacggtttgttcgccagccgcctcgcgcggttgtggcaggacattcactggggcagcctgctgtttctgtcgccactgtggccgatggccgtcgcctttcccaagctcctcgaagaatgggaattgcgggtgatccataaaggccagccggcacgcaaggtcgagcaggaattgttcggtgtgcgcctgctggacctgtgcctcggcttgaccgaagcctggcacctgccgatctgggtctcccagggctacaacctgctgctgaccgaacaacgcctgttggtaaaagcgctgcacatcgcccgcgaagacgacgccttgcgccaccagcaattgctcgacgccgaacccaacctgcgccgctggctcaaccaaccagccaacaccgtgctgctggcgaacggcctggcgatgtcggcccaggaatcctggacctgcccgcacaccgagcgctggcagtacctcaccgcgctgtacctgcaagcgccggtgggcgacgtgcagcagcaggttcaccagcaagcggtgaccagcgcgcgcagcaccttgatgccggacctctggcacccggcgctgtcgctgatctggccgtggcatgtgcagaagatccatcgcggcctgctgccggcaccgccgcccactgccgaagcgctggccgtgtggcgcaagcgctgcaccgagctgctggtggagccgagccgttttgccaacgccatgcacctgactacgtgtgccaaggaagccttggtcgccagcggcatgcagcgggttttgctgtttatggccgaccgtgcgctgagcaccttgcgcgtgcatcaagccgatggcttgcccaaggacgccgccaacctcagcctggacgtggtcaacagcacgctgctgcaacgcctgctggaaaagtctgcccaggtgcgcctcacgccggacaatcacgcacagttctcggcattgctgccgccgatcctgcgccgcctgttcacaggcgaacacctgttgctacgctccttgagctgcaacggcaaggtggtgatgctgatggttgccgaccagggcggcgggccgttctcggaaaccaccgtgcaggcgttcggcaaaaccgctcaatgcatcgagaaagccctgcacagctttaccaaccgcagcgcttgatgcttgcgctacaatcgccgtcttttatcgccaacatttgtgcccaggagacctcacatgcctgacttctctggcttgccgctggtgatcgagtccagcgacctgctcggtcaactggatgccgaacacctgattctggtggacctcaccagtgccgcccgctacgccgaagggcatatccccggcgcgcatttcgttgaccccaagcgcacccaactgggccagccacccgcgcccggtttgctgccgaacaaggccgacctggaaaaactcttcggcgaactgggccacaccccggacgcgacctacgtggtctacgacgacgaaggcggcggctgggccgggcgtttcatctggatgctcgacgtgatcggccaccagaaataccactacctggacggcggcctgctggcatggctggacggtaaccacccgctgtccaccgaggtgcccgccccggtcggcggcccggtcagcctgaccttgcacgacggccccaccgccacccgcgaatacctgcaaagccgccttggcgcggccgacctgggcatttgggacgcacgcggcccgctggagtattccggcgaaaaagtcctggcggccaagggcggccacatccccggcgccgtgaatttcgaatggaccgccggcatggacaaggcgcgcaacctgcgtatccgccgcgacatgccgcagatcctcgaagacctcgggctgaccaaagacaaagaaatcatcacccactgccagactcaccaccgctctggcttcacctacctggtggccaaggcgctcggttatccgcgagtcaaaggttatgccggttcctggggcgaatggggcaaccaccccgacacccccgttgagatttaaggtttaaaggacagttaatgaaaaagcagttgtttatcctcagccagtatttgctgccgcaccacttgctctcgcgcttggccggctgcattgccgagtgccgcgtgcgctggttcaagaacgccttcacggcgtggttcgccaagcgctaccaagtggacatgtccctggcgctggttgaagacctgaccgcctacgagcacttcaacgccttcttcacccgcgcgctgaaagacggcgcccgcccgctggatcaaaccccaggcgcgatattgagcccggccgacggcgccgtcagccagttgggcccgattgaacatggccgggtattccaggccaagggccacagcttcagcgtgctggaactgctgggcggcgatgcggcagtggctgcgccgtttatgggcggcgacttcgccaccatctacctgtcgccgaaggactaccaccgcgtacacatgccgctggccgggacgctgcgcgagatggtgtatgtgccggggcggattttctcggtcaaccagaccaccgccgaaaacgtgccggagctgtttgcgcgtaacgagcgtgttgtctgcctgttcgacaccgaacgcggcccgatggcggtggtgctggtgggcgcgatgatcgtcgcgtcgattgaaaccgtgtgggccgggctggtaacgccgccgaaacgcgagctgaaaaccttccgctacgacgaagccgcacgcgcgccgattcatttggagaaaggtgccgaactgggccgcttcaagctgggttcgactgcgatcgtgctgttcgggccggaccaggtgaagtgggctgaagaactggtggcgggtacgccggtgcagatgggccaaggcatcgccgcgcctaaagcctgattaaagccgattgaagatcaaaatgtgggagcgggcttgcccgcgatgacggagtatcagtcgatacatcattgactgatccactgctatcgcgggcaagcccgctcccacattttttactgcatttctacagtgcgaactgcttacaactgaccatcccgatcgcgaaagcccagcagatacaacacaccgtccaaccccagggtcgaaatcgcctgcttggccgattgcttgaccaacggcttggcgcggaacgccacacccaacccggcaatcgccagcatcggcaagtcattggcgccgtcgccgaccgcaatggtctgctccagacgcaagccttccttgtgggccaattccttcagcagatccgccttgcgctgtgcgtcgacaatcggctccaccgccacgccggtcaccttgccatccaccacttccagctcgttggcgaacacatagtcgatgcccagcttggcctgcaattgcttggcgaagtaggtgaagccgcctgacaggattgcggttttgtagcccaggcgcttgagttcggcgaataaggtttcggcgccttcggtcaggcgcagcgacgcaccgatcgagtccagcacgctcacatccaggcctttgagcaacgccaggcgctctttgaagctcgcacgaaaatccaactcaccggccatggcgcgctcggtgatttccgacacctgctcgcccacaccggcagccttggccaactcgtcgatgacttcggcttcgatcagcgtggagtccatgtcgaacactgccaggcggcggttgcgacggaacagcgagtcttcctggaaggcgatgtcgacattcagctcctgagccacgctgaggaattctgcgcgcagggcttgcggatcagccggctcgccgcgcaccgagaactcgatgcagcccttgcccttgtcggctggcgtgtccaagggcatgcgacccgacaaacggtcgatgtggtcgatattcaaaccgtattgcgcagtgatcgaactcacgcgctgcaactgttcggcggtgactttgcgggtcagcagcgtgacgatgtggcgttttttgccctggccttccacccaatgctggtaatcggcttcggacaccggcgtgaaacgcacctgctgatcgagcttatacgccgtaaacaggatgtccttgagcaccgacgaagcctgttcggtactcgggatttccaccaggatgccgaacgacagggtgtcgtggatcacggcctggccgatgtcgagaatgttcacaccaccctgggccagcacaccggtaatggctgcggtgagacccgggcggtcttcgccagtgatgttgatcaggacaatttcgcgcaaagcgcacccccaggctggaaaaaaaccgcattctacccactttcagtgaccatcgggcacagccagcgctttgccggtcccaggcctgtcgctatactgcgcgtcaacttcacggactaaagagccgagctcaagtgaaccggcctacgccagtaaaaaccgataacttcttcctgctgatcttccgggcactgcgccaccgccgtgtaccgatcgcattacgcatcgccagccataacgtgatcctggtcgctctggccttggtgatctacgcctgtgtgatgggtttgcaattcaagcaggccatgcacgagcaagccgacgccctgggcgagagcttgaccactcagaccgccacctcggcgactgagctgctggtgtccaatgacatcctcagcctcaacgtgctgctcaataacctgaccaagaacccgctggtggctcacgccgctatctatagcgtggacaaccggatcatggccgaagccgggcagcgcccgaaaaacggcctgctgggtgaggccgaaggcctgtaccaaagcaacatcacgtttcaggatgtgaaggccggccaactgcgcatcagcctcgacatgcagcaattccagcagccgatgaccatcagcctgcagagcatgggcatcctcagcgcgatcctgctggccttggccctggccctgagtttgcgcctgggtcggcatatctccacgccgttgatgcagctgcgcatctggctgcgcgatatcgacgaacacaccccggccaccgaccgccaggatgagatcggcgacctcgcccgccaactccacgccagctttgctccggaaccggtagtgcccgaggttgaaccggagcctgagtacgacgacaccgactacgacgaagacgaacccgagtttgaagtgcgcgatttgcgtgacccgggctttgacgaaagcgcgccggtggcgggcctcaagcctgcgacgcgccaggtcatcaaggccgaggaagatgaactggatgatgaagatccgttctccgacctgcgcgacacctcggctgccgccccggccgttgcgccaaagcctgcaccagtgaagaacaccgaacctcagcacagcgccgtattggccgtgcaactgggtgcgcaggaccaattgcgccgcctgccgcgtgcgcgcttgaccgaactgctggaacgctaccgtgactgcctggaccaggctgcttcgctgtatcagagcgagctgcacaccctgaacgatggcagcacgctgatgctgttccacagcgaagacagtggtgaagactatctgaccaacgcgatctgctgcggcgagttattgcgcgccctgggccatgccctgcagatcgaagtggccgacagtggcatcaccttgcagctgcagcttggcctgaccgtgggcgatgatctgtttggcatgagccagattgacctgctactgaccgagatcgcccaggatgcgctggccttgtcgcaacacagccgcaacctgttgctggtggagcgcaagatcagcgaggacaccttgatccgccagcgcgcgcgtatccgcccgatcgccagccctgaaggcgcgagctgtgtggagcggttgatggagccgtatccgtcgatgctggaacgccagttggcgcggatgcatgagacccgtaccaaactctaaagaaaccatgtaacacctgtgggagcgggcttgcccgcgatagcggagtatcagtcaacctatccatgactgaatcaccgccatcgcgggcaagcccgctcccacaggtgatctgcaacatggctcatatcgcagacaaacaaaaaggcccgcttattcaagcgggccttttgtttgatggagccatacaaagctctaagaccacccactgatcgttcccacgctctgcgtgggaacgcctcttgggacgctccgcgtccggaggtccaagccatgtgcaaggggtgacgcagagcgtcactggctgcattcccacgcagagcgcgggaacgatcaatgagtaagcgggcggttgatggagacgtacaaagctctaagaccaaccattgatcgttcccatgctctgcgtgggaatgcctcttgggacgctccgcgtcccgccagtgcgagggtgacgcaaagcgtcactggctgcattcccacgcaaagcgtgggagcgatcaatgagtaagcgggcggtagatggagccgtacaaagctctaagaccacccgcggatcgttcccatgctctgcgtgggaatgcctcttcggacgctccgcgtcccgccaggcccgagccatgtgcaaggggtgacgcggagcgtcactggctgcattcccacgcagagcgcgggaacgatcaatgagtaagcgggcggtagatggagccgtacaaagctctaagaccacctgcggatcgttcccatgctctgcgtgggaatgcctcttcggacgctccgcgtcccgccaggcccgagccatgtgcaaggggtgacgcggagcgtcactggctgcattcccacgcagagcgcgggaacgatcaatgagtaagcgggcggtagatggagccgtacaaagctctaagaccacctgcggatcgttcccatgctctgcgtgggaatgcctcttcggacgctccgcgtcccgccaggcccgagccatgtgcaaggggtgacgcggagcgtcactggctgcattcccacgcagagcgtgggagcgatcaatgagtaagcgggcggtagatggagccgtacaaagctctaagaccacccgcggatcgttcccatgctctgcgtgggaatgcctcttgggacgctccgcgtcccgccagtgcgagggtgacgcggagcgtcactggctgcattcccacgcagagcgtgggaacgatcaacaaaaaggcccgctgagtaagcgggccttttgtttgtgcgctattcagatcagaacctgaacacttccatatccgtacgaatcggcgtagccatcggcatcttcggcttttccggggctgccggtttggcctgcgccggcgcctgcttacgcggtgcttcggcaaccgacggctggttagccaatggcttgagcgccaccgataactgctgcgccagatgctgcaacaacacgccctgggcctggacctgggacgcggtggtgccggtgtgttcttcctgcaggtgcacgatgcggttatcgcgcacctggccacggcggtcgatcaagcgccactgtgcatccaggatcgccggctgcgaagcacccgagtcgagtcgggtaatggtcagcaacacctgcacatccggcgtgaacccggctggcgcaggcgccagcaccacgcgctggctgtccaaatgacccgccacctgacgcaacatcagttggttgatatcggacgacaaactgcccgcccaacggccatcggtggaaccttgcaagctgccgtcgttctgacgttgcagcagggtttcgcgttgcaggtagtcagcaaccactaccgggcccaacaacacagccatgccagcggattgggctggctgagccggacttccgctgtccagctggtacagcgacaccggctggtgtgtgctgcaacccgccagccccaaaaggccagcgagcatcaaaaatagaggaaggcgtggagcagtcatcatcccatccaggtggctgccacaaggcgaaccacaatgtaatactaaaaataacctaaatacgctcggccacgccggcgctggaaaggccatatcatccgtgaatatgcgccatgactccagcgcgaaagcgtcgatctacgggttaaatcgtagatcgagggctctaatacgctttaaaccggcgtttcaaccaacaaagcgtccactcgctggaagccacgcggcagtttgttaccacgtcggccacgctcgcccttgtaatgttccaggtcgtcggggcgtaacgacagtgtgcgtttgccggcctggagtaccaaggtagagccttccgggatcaccgcgatgtcggtcacgtactcttcgcgactggccactcgctccccgggaatcccaataatcttgttgcccttgcccttacccagctgcggcaagtcactgatcttgaacaccagcaaacgcccttcggtggtcaccgacgccagccagttgctctcgcggtcttcaactgtacgcggcaggatcaccttggcgttgttcggcaaactcaacaatgccttgcccgccttgttcttggcctgcaggtcttcacccttgaccacgaagccgtagcccgcgtcagaggcgatcacatacagcgaatcatcgtccggcagcagcacacattcgaaattcgcccctggtggcggtgtgagacgcccggtcagcggttcgccctggccacgcgctgaaggcaaggtgtgccccggcaccgagtaactgcgcccggtggagtcgataaacaccgcaaactggttggaacgcccggcagcagcggtcttgaagccatcaccggccttgtacgacaggccggtggcgtcaatatcatgccccttggcggaacgaacccaacccttttccgacagaacgacggtaattttctcgttaggcaacagctcggtttctgtcagcgctttcgcttcagcacgctcgacgattggcgaccgacggtcatcaccataggtttcggcgtctttgatcaactcagtgcgcaccagcttcttgagcttggcttcgctgcccagcagggcttgcagcttggcttgttccttaagcagtgcgtcctgctcatcacgcaacttcatctcttccagtcgcgccaactgacgcaaacgggtgtcaaggatgtagtcggcctggatctcgctcagctcgaaacgcgcgatcagctcggccttcgggtgctcggcggtacgaatgatgtggatcacttcgtccaggttgaggtaggcaatcagcaagccgtccaacaggtgcaggcggcgctcgaccttgtcgaggcggaattgcaggcggcggcgcacggtctgtacgcggaactccagccactccaccagcaagttgcgcaggtttttcagctgcggcttgccgtccaggccgatgatgttgacgttgacccggtagctcgactccaagtcggtactggcaaacaggtgctgcatcagcacttcgtggtcgacccggctgttggtcgggatgatcacgatgcggcacgggttttcgtggtcggactcgtcacgcaggtcggcaacttgcggcagtttcgacggtttggcctgcatcagcgcggcgatctgctcgagcactttggcgccggacacctggtgcggcagcgcggtgacgataatgtcgccgtcttcgatgtggtacacggcgcgcatgcgcaccgagcctttgccggtttcgtacatcttcagcaggtcggcgcgcggcgtgatgatttccgcttcggtcgggtaatccgggccctgaatatgctcgcaaagctgttcgaccgtggcctttggctcatcgagcaagcgcacgcaggcggtggcgacttcgcgcaggttatgcggcggcacgtcagtggccatgccgaccgcgatgccagtggtgccattgagcaggatattcggcaaacgtgccggtaacaccagcggctcgtccagcgtgccgtcgaagttcgggccccagttcgcggtgccctggcccaactcgctgagcagcacttccgagtaacgcgacagacgcgcctcggtgtagcgcatggcggcgaaggacttgggatcatccggcgcaccccagttaccctgaccgtctaccaacgtgtagcggtagctgaacggctgggccatcagcaccatggcttcgtagcacgccgagtcgccgtgcgggtggaacttaccgagcacgtcaccgacggtacgcgccgacttcttgtgcttggaatctgcgtccaggcccaactcactcatggcgtagataatgcgccgttgtacaggcttcaggccgtcgccgatatgcggcaaggcacggtccatgatcacgtacatggagtagttgaggtaggcattttcggtgaagtcagccagcgaccggcgttctacgccatctaagctgtctgcgaggatgtcactcatgcgggcctcatcattgtttggtctggcgcagcagcaatgtgccgctgcgctgggtaaattcaagttgtttcaatgcactcatgcccagcagcacctgttccccgtccaagcccggcgcgactatcgcgcgcacgtcctgcaggacgatatcgcccagtttcaggcggtcgaggtgggtgcgatagccctgaacacggccattggcggtgctcaaggtcaccggcaggccacgtttaagcccgaggtggtcggccaattcggccggcaccgccacatcggtcgccccggtatcgagcataaacaccaccggctgagcgttaatctggccgctggcaacaaaatgcccctggccattgcccagcaatttcacttcggtgtaaccctcatgttgcgccgaggtcaccacggcattgggattttcctgacgcgcctcccactgcccaaaaaagcgcgtagccaaaaacagcccggcgccccacgccacaaacatcaatacgcgtccggcgcgcttgccaggcggttgcccgctcatggctgggcgctccaaccacctgccggggcggcgaaacgatagaccacagggcgcttttcaccatcggcgcgcgggccgaaattgttgtcgatacccaaccaggcaccgtcggcatccaccaccagggcttcggccaggccatacggctgagcataacgccggtttggcgccagggtttcatcggcaaacgaccagcacagctcgactttggccgtgaccgcatcgcgccggcaaatctggaacgcattgcgttccagggtaaacagcttgccgttgaacagcaccaggtcggcgaaatccttggacaccgccttggcattggtgaactgcgccggctgcacttcctggccggcttcgctcaacaacacgcaagggccgtcgcaatcccagacgctttgcccgcgcttgatcgagatcaggccacgccgctcacgctcggccgccagccaaatctgattgccttgcgggttaatcgccaggccttcaaacagcgcgttgaaatgcagcaacatgccgctggcccgggcttcacgcaccatgctcggtgcaattttcaaccactgcaccgcgccctccaccggcacttgcagcacggccgcgtgggcctcgctgacaatgtaacggttaccggctgcgtcacaggtgatgccttcaaaatccaggtcgccaccacgaatgaacgacgcggccttggtgcgcgagcgcaaaccccagggcaaaccggactcgggcaccggtggcacgtcgatctttaccgtttcggcttgccaggtcggcgcactgatatccaggcgatagatttgatcgtcatcgcggtctgaaaccgtccacaagtccttgccacacagcgccaggcccgagaggttgccgccgcgcatgccgtccaccgggtgttcggaaaccagcttgagttcagccacgggcgaggcagccactgaggtggccaccaacccgctcaacatcaggatcgccagggcgaagcctgtgcgcatcagcccagaacctcggccaggttgcctttggattccagccaggccttacggtccggtgcacgcttcttcgccagcagcatgtccatcatttccgaggtgccggcgaagtcttccagggtcaactgcaccaggcgccgcgtgttcgggtccatggtggtttcgcgcagctgcggcgggttcatttcacccaggcctttgaatcgcgtgacctgtggcttgccgcgttttttctcggcgaccaggcggtcgaggatgccatcgcgctcggcttcgtccagggcgtagaaaatctctttgcccaggtcgatacggtacagcggcggcatggcgacgtagacgtggccggcatccaccaacgggcggaagtgctgaacgaacagcgcgcacagcaaggtagcgatgtgcaaaccgtcggagtcggcgtcggcgaggatgcagattttgccgtagcgcagttggctcatgtccgccgcgccagggtcaacgccgatggccacggcgatgttgtgcacttcctggctggcgaggacttcgctgccatcgacttcccaggtgttgaggatcttgccgcgcaacggcaggatcgcctggaattccttgtcccgcgcttgcttggcggaaccaccggcggagtcaccttccaccaggaacagctcggaacgcatggggtcttgcccggcgcaatcggccagcttgccgggcagtgccgggccttgggtgatgcgcttgcgctcgacctttttgctggctttcaaacgacggccggcgttgttgatcgccagttccgccagggccaggcccagttccggatgctcgttgagccacaggctgaacgcgtccttgaccacaccggaaacaaacgccgccgcctcacgggacgagaggcgttctttggtctggccggagaattgcggttcctgcatcttcatcgacagcacgaacgcgatacgctcccacacgtcttccggcgccagcttcacgccgcgcggcaacaggctgcggtattcgcagaattcgcgcatggcatccagcaaaccctggcgcaaaccgttgacgtgggtgccgccctgggccgtggggatcaggttgacgtagctttcctgcacgctgtcgccaccttccggcaaccacagcagtgcccagtcgacggcttctttattaccggccaggctgccgcagaacggctcgttgggcaggcgctcgaagtcgctgacggagtcttccaggtaggagcgcaggccgtcttcgtaatgccactcgaccttttcgccggtgcctttgtcttcaaagctgaccagcaggcccgggcacaacaccgccttggccttgagcacgtgcttgaggcggctgatggagaatttgggggaatcgaagtatttcgggtccggcgcgaagtacacgctggtgccggtgttgcgcttgccaacggtgccgaccacttccaggtcggtggccttgtagccatcggcaaacgtcatctggtactcgttgccgtcgcgcttgaccttgacccgcaccagggtcgacagggcgttgaccacggaaatgcccacaccgtgcaagccaccggagaactggtagttcttgttggagaacttgcccccggcgtgcagtttggtgaggatcagctcgacgcccgacacaccctcttccgggtggatgtccactggcatgccgcgaccatcgtcggacacttccagggaatggtcggcgtgcaggatgacctgcaccgacttggcgtgcccggccaaggcttcgtcgacgctgttgtcgatgacttcctgggcaaggtggttcggccggctggtgtcggtgtacatgccggggcgtttgcgcaccgggtcgaggcccgagaggacttcgatggcgtcggcgttataagagctagcgctgggagtggccatggggtctcgtcgtgagtcgttcgattaaaaagtgacctgcgattcttacaatgaagaaaaatcgaaggattgatactgatctgcgccaataccggcaaagctcaacatggccggcaattgctgggcgaaaccttgataaccgtggtcgccacccgcctggatgcgcaaggcacaggcccggtaatactgctgggcgaggcgatagtccagggtttcatcgccggtctgcaaccacacctggtaacgcccggcgtcctgcggggccggcacttccagttcggccagggccgtgacgtggtcgtgggtcaattcccaggtttcatcggtgtagaggttcttctgggtgcccaggtaaccgtcaaacatccgatgagggctgaccgccgggttgaccaacagcgccttgaggccatggcgttcggcaagatgggttgcatagtagccgccgagtgagcttccgaccagcagcggccgccccagttgctcaatggcctcctccaattgaggaatcgcctgacggggatggtgatgcagggccggcacgcgcaattggtcggccaggccgaggctgtccatcacggtgatcaactggctggccttgttggaggctggcgcgctgttgaaaccgtggatatacaagatcgaagcagacatgccgggctctccgtgcttcagccaaagaggcgcagtttacagggatcggggtggtgtgtgaggccctctatccaaaggacacagaagatccactgtgggagctggcttgcctgcgatgacggtgtatcagtcgcacatttatcaaccggtgtaccgctatcgcaggcaagccagctcctacacttttaaccagtgtttgcagcggttagtagccgttgctgccgtaatcgatggtaaacgcgaaaccttcgacccgctctaccccggtctccaaccgtccgtcggcatgcaggcgcagccagcggtaacccggcgcttgttcgctgaccttgaaatcttcactgcccggcgcgaactggatgcacgtcgacggcgacgccagcaggcgcacgccgttgcgctcgcggtcgatttcctggtgcacatggccccaaagcaccgccttgacctgcggaaaacggtcgagcacggcaaacaaggcgtcggggttgcgcaggccgatgggctccatccacgcacagccgatcggcaccggatggtggtgaaagcacaccagatggtggcggctcggcgcttcgctcaaggcttgtgcgagtaattgcagttgctggtcttgcaagtaacccggcaccgaaccgggcacggcagagtcgagcagggtcacgcgccaattgccgatgtcgaccaccggctcaagcaaatcactgtgctcggcggcgtgggccatgatctgcggctcgtcgtgattgccggggatccagcgcgccggggcatcgatctgccgggtcagctcgcgaaactgttgataggactcaagcgtgccgtcctgggacaaatcccccgtggccagcaccaaatcgatctgcggctgctgctcgcgcaccaacgcaatcacccgctgcaggctctcgcgggtgttcatgcccagcagcgcgccgtcggcctcggcaaacaggtggctgtcggacagctgcaccagcagcgccgacgcgtcagggttcacagtggatacgctcggcaaggcgctctcccaaggcaatcacaggaatggatgtgtggcgtgattatgctagggcaggacacaaagaggaaagacgcagttcacatctaccgcacgacttcaaactcatggcccagggccaggcagtggctcaaccattcaccgaggaacacattgagctgtgctttctcatcgggctggtgcatgaacacattcgggtaaggatagatgctgcgaaagcgtcgcgcatgttcggcgctgatcacttcggccatccgcgcatcgtgatacacctgcacttccagctgcggaaccggcagccacggcaggctgtgttcctggcgcacacgcaaggtggtggtgtacgggcaattgacgatgacctcaagggtcagcacgccgagcatctggtcgccgtgggtcacggcaatgcgccgcgcctccggcgtgtggcgcatgtcgggaagcaagcgcatcagccgcgcatagttggcctcgcaggcggcttgcagcccgatcaggtcgactcgataacgttcccgtgcctttactgccataaccccctcacttccgcgcgattaagcgcaagccattgcagggcgatgatgctggctgcgttggaaattttgccgtcacgcaccgcttgcagggcatcttcgaacgcccaggtggtgacgcggatatcttctgcctcttcttccagtccatggacgccaccggcccccgagctgtcgcaacggccgaggtacaagtgcacgaattcagtactgccaccgggcgacggaaaatatttggtgatcggccacagcgcggagaacgtcagcccagcttcctcctcggcttcgcggtgtgcaacctcctccggctcttcatccttgtcgatcaggccggcgaccatttccaccagccacgggttatcggtgcggcccatggcgccgacacgaaactgctcgatcagcaccacttcatcacgctgcgggtcgtaaggcagcacgcacacggcgtcatgacgcacgaagacttcacggttgatcacccggctcatgccgccatcgaatttttcgtggcgcagctgcacgcgatcgagcttgtagaagcccttgtaggcattgtcgcgctgaacaatttcgattttgttcggcgtcgatttggcaatgtccgtcatattcttcctcgttaaggccgtgcgattcgcgccatcctaacgcgcccatgccggttggtgcagcccctttgcagttgccgggatagacggcgggcgtcaaactcactctaataagcttagtggcgaactgactgccttgtcggtagtcgaagctccactcttttcgctttccatcgatttccgaaggacacacatgtcgcttttaaaaatcgcctccgtggcctgtatcgccttgaccctgggtgcctgccaaagcctgttccagcccagctacctgaagccgctggacgccaaaccggacgcctcggaacagataaagcccggctgtgacagcccggattgcccgctggtgaacatcgacaccgtgcatttccccagcgagccgcaactcgacacgattgtggaacaacgcctgctgcaaatgacccgcaccacgcccggcgccagcgtgccgccgacgctgaatgcctaccgggacaagttcctgcgcgaatcgccagaccgcaacagcatgtacttgcaggccaaggtacgtgaccagcatgacggactggtgatcattgaagtgtccagctacctggacaccggcgccgcccacggcgagcccggccgtggcttcatcaactattcacgcttgttgcacaaagagctgagcctgaccgacatgttgctgccgggccaggaacaagcgttctggaacactgcaaaagtcgcccacaacagctggctgatcaactcgcagatggaccgtgaccccgagttcgtgaagaactggccgttccagaaaaccccgaacgtggccctgacaagcgccggcgtggtgctcaagtacaacgtggccaccatcggcccgtacgcattggggctgatcgaaatgaccatcccctatgcgcgcctcaccggcgtgctcaagcctgagctgatgcccgcgcgccactgacggctcgccccaggatcaactgcaacagccctgccagcagcaatgccggcagggttgcgccaacatccggatacaggttggcgagcaggtgatacgtggcgatgccgcccagccaggccaccagtgccggccaatgcaaagtggcgactgcgccctggccacgccggcgcaggatgaaatgatccaccagcaccacgccaaacaacggcgcaaacaccgagccaatcagcaaaaggaagttctggtactgcgccagcggtgcaaagcaggcgatcaaggtgcagatcacaccaatagccaaggccaggtgctcgactttcaagcgcaacaagatcccgctggacaccgccgccgagtgaatatcggcaaacgcgttttccgactcgtccagcaggatcagcagtagcggaatgcccaggccggcaccggccagcgccagcaacagcgcattcacttcgccgcttggcgcgaacgccagggtgtaggccacgcccaggctcatcagccagaaattaccgataaagaagcccagcgccgtgccaccaaacacgcttttggcacgcttgccgaaccgcgagtaatcggcaatcagcggcagccacgacaacggcatggcgatggcgatgtcgaaacccaccgcaaacggcatcgagccgtcgccggacttggcccacagcgcggcgaggtcagccttggcgaacaggttccaggtcagccacaggcaggcggcgagcagcagccagatgccccacttgcgcaggatttggcgcacgaacgtcagtgggccgctgacggcgagcaacgttgccaaaccaccgaaaaacactgtccacagcaacgggctggccaacaggctgccctcgctgaacgctcgcgtgcccagcaggctggcggcgtcacgcatcacgatgatttcgaacgagccccagccaatcaactgcagcaggttcagcaacgccggcaggctagcgcctttggcgccgaggctgagtttgagcgcggccatggcggacaggccggtgtcgctgccgatcacgccgacggcggccagcagcagcacgcccaccaaggtgccgaggaaaatcgccagcaacgaaccggacaagcccaggcccggcgcgagcaaggcgccggtttgcaggaccatcaggccgatgccgagggagaaccacagggaaaacaggtcgcgggcgccgaagacgcgtttgtcagcggggaccgcgatgtcgggggagtaagtactcggttgaatgctcaagggtgttatctctgaggggctgatcgttcccacgctctgcgtgggaatgccgcttaggacgctctgcgtccgcctgtgtgacgcagagcgtcacgggatgcattcccacgcagagcgtgggaacgatcattggggtcagacctttttgtacagctggctgccttcctgcttgaaccgctccgcctgctcggccaagcccttggccacgtccacatccaccgcttcaatgcgctggttggcggcgtactcacgcacttcctgggtgattttcatcgagcagaatttcggcccgcacatcgagcagaaatgcgcgaccttggccgagtcttttggcaaggtttcgtcgtgataggagcgtgcggtgtccgggtccaggccgaggttgaactggtcttcccagcggaactcgaagcgcgccttgctcaaggcgttgtcgcgaatctgcgcgccggggtgccccttggccaagtccgctgcgtgggcggcgatcttgtaggtgatgatcccggtcttcacgtcatccttgttcggcaagcccaggtgttccttgggcgtgacgtagcagagcatggcgcaaccgaaccagccgatcatcgccgcgccgataccggacgtgatgtgatcgtagcccggtgcaatgtcggtggtcagcgggccaagggtgtagaacggcgcctcgtcgcagcactccagttgcttgtccatgttctctttgatcagctgcatcggcacgtggccggggccttcaatcatggtctgcacgtcgtgcttccaggcgatcttggtcagctcgccaagggtttccagctcaccgaattgcgcggcgtcgttggcgtcggcaatcgagccggggcgcaggccgtcgccgagggagaagctgacgtcataggccttcatgatttcgcagatttcgtcgaaatgcgtgtaggtgaagttttctttgtggtgcgccaggcaccacttggccatgatcgaaccgccacgggaaacgatgccggtgacgcgcttggcggtcagcggcacataacgcagcaacacgcccgcgtggatggtgaagtagtcgacgccctgctcagcctgttcgatcagggtgtcgcggaacagctcccacgtcaggtcttcagcggcaccgccaactttttccagggcctggtagatcggcacggtgccgattggcactggcgagttacggatgatccactcgcgggtttcgtggatgtgtttgccggtggacaagtccatcaccgtgtccgaaccccagcgaatgccccaggtgagtttcgccacttcttcttcgatggacgaacccaaagcgctgttgccgatattgccgttgatcttcaccaggaagttacggccgatgatcatcggttccagttcggtgtggttgatgttggccgggatgatcgcgcggccacgggcgatttcttcgcgcacaaattccggtgtgatgattttcggcacgctggcgccgaagctgtggccggcgtgttgctggtcaagcaggccgctggcgcgggcttcttcgagcttcatgttttcgcggatggcgacgtattccatctcggcggtgatgatgcctttgcgcgcgtagtgcatctgcgtgacgttggcgccggccttggcgcggcgcgggttcttcacgtgggcgaaacgcagcgcggtcagttcggcatcgctgaggcgctgttggccgaagtgcgaactcaggccggacaggcgctcggtgtcgccgcgcgactcgatccacggcgagcgcacatcgcccaggcctttgcgcacgtcgatgatgacgtttgggtcggtgtaggggccggaggtgtcgtagaccaccacgggcgcgttgatttcaccgccgaaatcggtgggggtcacgtccaggctgatttcacgcattggcacgcgaatgtccgggcgagtgccgggtacgtagattttttgcgagcgggtaaacggctgcacggaaccggagtcgaccttggccgattcactcaggtgcacggtgtttttcggttttgtactttttatttctgcgttcatcacgggctctccaactatccaggcggtggatttttgtcggagcgaacctgtgacggatggacgcactgaaaccagtgctgtgctgacgcacgagggctgttcgattgtcgaacaacatcccggacgaagcacaagaggactcgccgggtgacgagaaatcttgttccctacgcaggcgctaacctgatcaggttcaacgggatccggtatttaccgatctcagccttccaacaaggcaccccgacaagaacgcggccagtctagaccatggcgtgggcaaattgccaatagcggtgcattcagcgtgatgaatggcgtgattgcgggattgttgcgccgggtcagcaacactacactcggttgccgccacaatggcttgacgccagaaatggcccgccttagccttgggcgctaaattatcgccgtaatattcacactagggatcgcctcatgctgcgcaaactctcactggctcttgccgtgtcttgtgcgaccaatggaatggtctgggcagctgaagcgcccttgtccgccaaaaccgatttggtcagcgtctaccaggaagcggtgaacaacaacgccgacctggccgccgcccgcgcccaatatggcgcgcaaaaagaagtggtgccccaggcgcgtgccggcttgctgccgaacctgtcggccggtgccgacagcaataacgtgcgtacccagatcgaccaaccggcggccacggtcaaccgtgacgcccactcctggcgtgcgaccctgagccagccgctgttccgcgccgatcgctggttccagctgcaagccgccgaagccgtcaacgagcaggcctcgctgcaattgtcggccaccgagcagaacctgatcctgcaaagcgccgaaaactacttcgccgtgctgcgcgcccaggacaacctggcctcgaccaaggccgaagaaaatgccttcaagcgccagctcgaccagtccaacgaacgctttgatgtgggcctgtcggacaagactgacgtgctgcaatcccaggccagctacgacaccgcccgcgccaaccgcatcgtcgcccagcgccaggtcgacgacgcctttgaagcgctgatcacgctgaccaaccgcgactacaacgcgatccagggcatcgtgcacacgctgccggtgctgccgccggcgccgaatgacgccaaggcctgggtcgaaaccgccggccgccagaacctcaacctgctggccagcaactacgccgtcaccgccgccgaagaaaccctgcgccagcgcaaggccggccacttgccgaccctcgacgccgtggcgcaatacgaaaagggtgacaacgacgcgctgggcttcagcaacccgaaccaactgccgattccttacggcggtgatgtgtcgcaacgcaccatcggcctgcgcctgaacatcccgatctacagcggcggcctcaccagctcgcaagtgcgcgaatcctattcgcgcctggaccagagcgagcagcaacgcgaaggcctgcgccgccaggtggtggaaaacacccgcaacctgcaccgcgcagtcaacaccgacgtggagcaggtacaggcacgccgccagtcgatcatctcgaaccagagcgcagtggaagccacggaaatcggttatcaggtgggtacgcgcaacatcgtcgacgtgctcgatgcacagcgccagctctactcgtcggtgcgcaactacaacaacagccgctacgactacatcctcgacaacctgcgcttgaaacaggcggcgggcacgctgaacccaggggatttgcaggacttgtcgcgttacctcaaggctgactacaacccggacaaggacttcctgccgccggatttggccaaagctgccgccgagcagttgaaggctcgccccagtaactaagcacactacaaaaccaatgtgggagctggcttgcctgcgatgcagacacctcggtactgctgatacaccgaggtgatgctatcgcaggcaagccagctcccacacaagccagctcccacatttggatcagcgttgaatcagcctgtccaagccatccagcaaacgcttcagcgcgccctggttggcctgcatcaccgcaagccccgcctgcgccatcttgcgcgcatcctgcggcagttcgaacagttgccgcacggcttcggccaaaccctcggcgtcatccacctcacgtaacgccccggcgtcgcgcatcatcgcgctgatttcgaggaagttgaacaggtgcggccccatgatcaccggcttggccagcgctgccggctccagtgggttatgcccgccagtcggcaccaggctgccgccgacaaacgcgctgtcggccaaggcatagagaaacagcaactcgcccatggtgtcgccgagcagcaccgaagtttgcgccgtcacgggctcgccactggagcgacgcaccgtggtgaatccttgttgctcgcataactcaaacatcgggccgaagcgttcctggtgacgcggcaccagaatcaacaatgcattgggatagctttcgagcagttggcgatgcgcagccagtaccacgtcgtcttcgccttcatgggtgctggccgcgatccacaccgggcgctcgctggcgccccattgctcacgcaaggccgctgcccgcacgggaagctctgggtcgatggtcaggtcaaacttgatcgagccggtgacttcgacggtttccgcacgcgcgcccaggctgaggaaacgctgggcttcggtatgcgtctgcaccgcgaacaggctcatttgcgccagcatcggcgccgtcagcttggcaaagcgtgcgtaacctttggccgaacgcgccgacagccgcgcattggccagcgccaccggaataccgcgctgagcgcaggcgtgaatgtggttgggccacagctcggtttccatgatcaccgccagcctgggctgtacgcggtcaagaaaacgcctggccgcgcacggcaagtcgtagggcaggtagcaatgctgaatgcgcggttcattggcgaacagcgcctggatgcgctcggagccggtcggcgtcatgcaggtgacggtgatcggaaacgtcggatgccgcgccagcagcccgcgaatcatcggcgcggcggcgatgctttcgcccaccgacacggcgtgcacccagatcccgcccggttgcatcaccggcaggccgtaggaaaaacgctcgccaatgcgttgggcataggccggcgccttgcgcgcacgcagccacagacgtaaagccaccaacggcagcgccaggtaaaacagacagctgtagagagttctattcatggcggcggagtttatcggctttttcagtcgatcgcctgcaagcactcggcaaatcgctcggccaggaagcgcgcggcagggccgaggtgttcgtcgcggcgccagaccagttccaccaccaacgcgggcggcgtccattcgctgtccagttccaccatttgttgttgataggtcgggtactgcacgatgtgccgcggcagccaggcccagcccaggccgctcatcagccattcggccaacacgtagaaactgtcggcacgccacaccagcgggcttgcggcttcgctgccggggtagacgctggtctgggtcgacatcaacagctggcgaaactgcgccaagtgctggcaggtcacgtacttttccttggccagcggatggttcacgccgcacaccgtgaccatttccacactgccgaccacgcgccgctcaagggcttcggggatttggtcgtgatagaacaacaggcccaggtcagctttgcgctcgaccaacttgcgcgccacatcgccctgggcagcactggacaactgcacctccagcaacgggtattgcccggccagcgcttcgagactgtcgagtaccggctggaacaacatcgcttcgtcctgggccaggcgcaggcaggcttcctcgccgcgcgtcagcgacagcgcgcggccattgagccgctcacactggcgcagcacctcgcgcgcttcttccagcagcacgctgccggcttcggtcaggcgcggctggcggccactgctacggtcaaacaggctcagcccaaggtcagcctcaagcaaggcaatgccgttgctcaccgccgattgcgccttgcgctggtcgcgcgccaccgccgaaaacgaacgctgctcggcgacgctgacaaacaggcgcatctgttccaggttccactgcacgctcatggctaaacccatctgtaaatcggataggtaatgactttaccccatctttccaggcgttagaatgccgaccttatcaagcacgcccacaccgaggattaccccatgaatgtcgcctatgtttacctggccattgccatttgctcggaagtgatcgcgaccgtgtccatgaaagcggtcaagggcttgagcacgccgatcccgctgctgctgatgattgtgggttatggcgtcgcgttctggatgctcacgctggtggtgcgcaccgtgccggtgggcgtggcctatgcggtctgggcggggcttgggattgtgatggtcagcgtcgccgcgctgtttatctacggccagaagctggatgttccggcgatgctgggcatgggcctgattgtgctgggcgtggtggtgattcagctgttctcgaaaaccgccgggcactgatcagcgctcaacagcctgtatactgcgcctcttgtcttgaacactgaggtcgcccatgccatccgttatttccaccgacgttctgattgtcggcgccggggttgccggcctctggctcaatgcgcgcctgcgcagccaggggttttccacggtggtggtggaaagcgccaccttgggtggcgggcaaagtgtgaagtcccaggggattattcacggcggtgcgaaatacgccctgcacggcgccctcaccggcgcttccgaagcgattgccgatatgccgcgccgctggcgcgaagccctggccggtaacggcgagctggacctgtccggtgtgcgcttgctgtctgaagcccattacctatggtcccccggcaccatcgccggcaacctcaccagctttttcgccagcaaggccgtgcgcggccgtgtcgatcaggtcaagggcgatgaattgccgcctgccctgcaagaccgtcgcttcaagggcaaggtctatcgcctggcagagctggtcatcgatgtgcccagcctgatcgaacgcctggcgcaactggccggtgacggcttgctcgccgggcaacacatcgaaccgctgctggagggcgacacgctggtgggcttgaaggtggatggccgcgagatccgcgcccagcgcatcgtgttgagtgccggtggcggcacagctgatctgctcagcgccctgggcctgagccagccagccatgcaaaagcgcccgctgcacatgatcatcgccaaaggcccgggcctgaagccgttgtacgcccactgcctgggcggcggcaccaagccgcgcctcaccatcaccacccacccggccgccgatggcaattgggtgtggtacatgggcggcgacattgccgaggcggacggcgtggcgcgcacgcctgaagaacagatcgccaccgcgcaaaaagagctggcgcaattactgccgtggatcgacatgagccagacccagtgggccaccctgcgcgtcgaccgtgccgagccgctgcaatcgggcctgagccgccccgacaacgctttcctcgccgaacagggccgcctgttagtgggctggccgaccaaactggccctggcgccggacttcgccgaccgcgtgctcagcgcgctggagcgcgacggcatccacccgagcgccaacagcgaagccctgcccgacctgccaaaaccggccactggccaacctgcctgggagcaactgttgccatgagcctgcccactctgcatgacctgcatcgcccgctgggcagcaccggcctgatggtctcgccgctgggcctgggcaccgtcaagctcggtcgcgaccaaggggtgaaataccccagcggtttccagattccaggcgacgacgaagcacggatgttgctgcgccaggcccgccagctgggcatcaacctgatcgacacagccccggcctatggccgcagcgaagaacgcctggggccgctgctgcgcgaccagcgcaaggattgggtgattgtcagcaaggtcggtgaagagtttgccgatggcgtgtcccggcacgacttcagcgccgcccatacgcggatgtcgatcgagcgcagcttgaaacgacttgaaacggattttatcgacctggtgctggtgcattccgacggcaatgacctgcacatcctcaatgattgcgaggtgtaccagaccctggccgagctgaaaaaagagggcaagattcgcggctacggtttctccggcaaaaccgtcgaaggcggcgtgaaggcgctggaacaaggcgattgcgccatggtcacctacaatttgaacgaacaagcggagaaagccgtcattgattacgcagcggctcatggcaaaggcatcctggtgaaaaaagccctggccagcggccacgtgtgcctggagccaggaatggatccaattcacgccagtttcatgttgttgtttgcgcaaacgggcgtcgccagtgctattgtcgggaccattaatccgctgcacctggcccataacgtggcgaccgctgccaaggtcattcgtcaactctgatgccgcccacgcggccgaccccgtcgcaagaaggagccgacatgccgcgaacgcttattagaaaaaaccccagtaactttaaaacactgccgctgcacgtcgaagccacacccgaaggcctgagctaccaaagcgtgggcatgccgctcaactttgcccaaaccctgcagcggcgcaagccggtggaagtggcagaccccgagcgtttcgccctggaactggcgaacctcggcgtgtcggtgcgcctgacactgcattggcaaaacaaggattattgggtgctggtgcgccagcgtcgccaggaccgtggcgacgtggtgctcaagctgatctccggctacgtgccggctcacgaactgaacctgccgctgcacaccgccatccaggaaatagccgaagagtgcctgctggaaacgcccgaaggctggctgggcgggcgcttcaatgacacctggctgccggcgccctattccgccgccctgcattaccgcgaagccctgccgtttcgcttgagcccgctgtcgggcgccgcccgcccggtacgttgcgcgaccacgcaactgatcgagcgcccgcgggcttacgtgcacctgccgaccgcgtcgctgcaattgatttatgacttgcgtttggaagtgccgaaggaagccaagtccctgagcctgtttcatgtggatgagcggcttgaaggtgaccagttagtggcgcgcctggaccgccagcggcccgacctttacctgatgccgctcaaagacgggcaaccgttggccgagctgtacacggtgaaaaaagaccagctgtacccggccagtacacgcggtttgtatttggcagaaagcttcgctcagcaggaaggctggctggtgcgcgatgagcggattcgctggaaggattggctgcggcagcaagggctggccgaaccggagaaagagtcgaaactcaagcgcctgaccggcaaggcgcggcagatgttgcgcaagattgtgccgaagaaaaaagccagccgctgacacccgtcgatcgatcgttcccacgctctgcgtgggaatgccgccccggacgctccgcgtcctgatgtcacaatgtgacgcggagcgtcacaggatgcgttcccacgcagagcgtaggaacgatcatcacaaggctcagccgttgagcaaccgctccagcccgaccttcaacggggtcggttcaggcaacttgaagctcgccaacagccgctggttattcgcccgcgaatgccgaatatcccccgaacgcgccggcccgtaagtgatcgccggcaactggccgaccacttcttccaacgcctgcaacacctgcttgagcgtggtggtgcggttccagccgacgttgatcgcccccagtggcgcttcaggcgcttcgatggcctgcaccagcacatccaccaagtcttccacgtacatgaaatcacgggtttgctcgccgtcaccgaacacggcaatcggcaagccctgctgcacgcgctcactgaagatgctgatcacccccgaatacggcgatgacggatcctggcgcggcccgaagatattgaagaagcggaagatcaccggctccaggccatgctggcggcggtagaaatcgaagtagtgctcaccggccaatttgtcggaagcatagggtgtcagcggcgccttggtggtcgcttcgtcaatcgaatcgccctcgccgttgttgccatacaccgccgcactggaggcatacaccacacgcttgacgcccgccttgcgcatggcctcgcagacattcagggtgccgacgaaattactctggtgagtgctcaccgggtcgtccaccgacgcttgtaccgacgccactgctgccaagtgcaccacggcgcttgcgccaacggcggcttgcgccacccgttcggcatcggccacatcaccttcaatcaactgtacgcgcgggttatccagcggcaagttgctgcgcttgccggtcgacaggtcatccagcacccgcacggcatagccgttggcgagcaaggcatcgaccaggtgcgaaccgataaagccggcgccgccggtgatcaagacccacttatcagcgttactcattgttgcgaatcttctcgacaatcgccgtggtcgagctgttttcaaccagccccagcactttgaccgtgccgccgtaggcgctgacgatatcggcgccgacgacctggtcgacggagtagtcgccgcccttgaccaatacgtccggcttgacttgagcgagcaggttttccggggtgccttcagagaaactgatcacccagtccacagcgcccaaacccgccaatacggccatgcgccggtcaacgctgttgatcggacggcccgggcccttgaggcggctgaccgaagcatcgtcattgacggcaacgatcaggcggtcgccttgggcgcgcgcctgttccaggtaagtcacgtgcccggcatgcaggatgtcgaagcagccattggtgaacacaatgctttcgttgtgagcacgcgcatcgtcaatcgccaacagcaactgctcgatggtcagcacaccgcgctcggagccttcggagcgctggatcgcgcggcgcagctcaggcgcgctgatggctgcagtacccagcttgccgaccacgatgcccgccgccagattggccagggccacggcgtggggcaactcttcgccggctgcaatcgaggcggccagggtagaaatcaccgtgtcaccggcgccggtcacgtcgaacacttcccgcgcacgcgcgggcaggtgcatcgccgggtggccggggcgcagcagggtcatgccgtgctcgccacgggtgaccagcaaggcgcccaggtcaagatcggccatcagcgtggcgcccttggtcaccagttcgtgctcatcggcgcaaccgccgacaatggcttcgaactcgctgaggtttggcgtgatcaggctggcgcctcgataaatcgagaagtccttgcccttgggatcagccagcactggaatgttgcgggccttggcggccttgatcagttcctggtggttcttcaaggcgcctttgccgtagtcggacaagaccagcaccttgatgccttcgagcaacgcgtcgacctggccgctgagggccaaggcgtcggtggcgaagggttcttcaaaatcgatacgcagcaattgctggtgacggctcatgacccgcagcttgacgatggtcggctgatgggcaatgcgctggaacagcgcgcgcacgccggcgccgcgcaggctgttggccaggctgtcggcggcttcgtcgtcgccggtcacacccaccagggaggccggggcgccgagggcagcaatgttaagggcaacgttggcagcgccgcctggacggtcttcgatttgctcgaccttgacgaccggcaccggtgcctcaggggaaatccgtgaggttccgccatgccagtaacggtcgagcatgacatcgccgaccaccaagacaggggcttgatcgaatcgcggcatggacaacttcatggagcaacccacatacaaaatgaacaggggcgcgatattagcacagggttatggaaggcttgtggagggtgtgcacagaagatagtgcgacgggcctgccagtgaatccactgaggaacacctgtgggagcgggcttgcccgcgatggcggtgaatcagtcgaaacattcggtgactgacactgcgctatcgcgggcaagcccgctcccacaaggttttaggtgatgtcggccgggaccggtgcatccaggcccatggcatgcaggcgggcgtaatagccgttctgcgccaacagctcgccgtgggtgccgcgctcgacaatccgaccgtcgtccatcaccaggatcaagtcggccttctcgatggtggacaggcgatgcgcgatcaccagggtcgtgcgcccttgcatgaccttgtccagggctgcctgaatgtgccgctccgattcggtgtcgagggccgaggtggcctcgtcgagaatcaacagcggcgcgttcttcagcaaggcccgggcgattgccaggcgctggcgctggccgccggacaacagcacgccgttttcgccaacctgggtatcgaagcctttgggcaactggtcgatgaagtccttggcataggcatctgccgccgcggcttcaacgtccgcccttggcgcgccggccaggtcgccgtaggcgatgttgttggtcaccgtgtcgctgaacaaggtcacgtgctgggtcacctgggcaatgtgcttgcgcaggttgagcagcttgtaatcttcgatctctacgccgtcgagcaggatgtcgccgctttcatggtggtagaaacgcggaatcaggctggccagcgtcgacttgccgctgccggaacggcccaccagggcgatcatctgcccaggttcagcggtaaagctgatgtccttgagcacatggcgttcggtgccggggtaggtgaagttgaggttgcgcacttcgaggcggccactgaccttgtcgcgctcgacggtgccgccatcaacttcctgctcttcgtccagctgttcgaaaatgctttcagcgccggccacacccttctggatggtcgagctgacttccgacaattggcggatcggcttgggcagcaagccggccaaggtgatgtaagccaccatgtcgccagccgacgcgtcaccgcgaaggtagagcaccaggaacatcaacaccgccatggcggtgtagatcaccagttgcagcaacggggtgtagatcgccccggtgcgggtcatgcgcagttgcttgtcggtgttgccctggctggccttgaggaaacgtttttcctcgtagacttcgccgccgaagctgcgcaccacgcgataaccctggatggtttcggaggcaacgtgcgtcacgtcgcccatggccacctggatcttcttgctctgcttgcggaatttcttgctggccgtgctgaccatcaccgcaatcaacggcaggatggcgatcatcaccagcgtcaggcgccagttcatgaacagcagcgaggcgaacagaaagatcaccgtcatgccttcgcggatcaccaccttgatggcatcggtcgcagcccccgtgaccatggtcacgttgaaggtgatgcgcgaaatcaggtgcccggagttgtggttgtcgaaatagcggttgggcagcgtcagcaggttgttgaacaactgcacccgcaggtcgtggaccaggcccagggagaccttggccaacaagtagttgcccaggaacgaacccaggccctgccaggctgcgatcagaatgatcaacaacggcacggcttgcagcaattgcaggtcacgcaggaacggtacgctggggaacagcaccgcttcggggttggataggccgtcgacgaagtacttgaggatgtaccccagcatgggctgggtcgacgcgaaaatcagaaatccgacgatactcagcgcgaacaagccggcgtagggcttaacgtacatgagcaggcggaagtatattttcaagctcgaagggcttgcgctcggactggagtcggtcatatcacgcggcgttttgaaaaaggaggctgactttagcacagcttctctgttgtacttgcacccggcatgacccccggcccggttggatccagccggcgacattatatagccactactttaagatggtcggctttctctttctggaatggctttatcgtatgcactccaagcgccttacctatggctcaaatcgcgttttcgacttcctggtcctctggattttgcccattggcttgttgttgctgctgagttcgctgttctacgtcaccaatcgcaatgtcatgcaccggttctactccggcttcttcagcgtgccgaccttgctgttgctgtgcctgcgcccgcgagaactcaaggcgttgttgcgtgaaccactggtgattgccttcgcggcgttttgcgcctgggcaatgaccagcgtgttgtggagcccggaacctaccggcgactccaacctgttcaaggtgccgctgcaaaccttcatgctgtttgccggctgcgggctgctgctgcattaccgcaacgaactgttcaagccgatctttttcagtgctgccgcggtcgcgctggtggtgtgcctgtgcaacctggtggcgttcgtcaaaggcttcgagccgggcatgcgcatgatcggcggcttgggcgccctcgataacccgctgctcagctcgcacatgttcggctttttctgcgtgtactggctgtacgtctgcatgaccacccggcgcttgcaggtgttgtggttcagcgtgcccgccctggcgatcatggcggctgccatcctggctaccgggtcacgcacgccgctggtggcgctgacactgactatcctgtggatgagctttatcagccgcaatcgacgctctgcgctgctgatcgccgccatggtcgcgggggctgccgggctgctgttgatctatcccgaggcgatcaccgaacgcggcagctcgttgcgctttgaattgtggggcatgacgctgcagcggattgccgatcaccccttcatcggccacagctacgactccgagctgtacctgaccctgggcgatggctacgagctgcgcgaaccccacaacttcgccctcggcgtgctgtattacgtcggcatcatcggctttatcccatggatctgcatgctcggctggggcttgtacaaggggctcaaggagcgggcacagccgttgtttatcctggcatcctcgctgctggcctacggcatcggcgcaggcctgaccgaaggcggtggcattctgtcgcggcccaaggagcactggttcctgttgtggattccgctggcgctgatcgccggcctgagcattgcccaacgccgccacagcctgctgcgcaggccagtggaaatgcccaagccacaggcctttgaagcactgtgcaacggcgcccacgtcgtcgaagaagatggcctgggaccgaaggtgctgcgcctggaggatggcagcttcctcaaactgttcagggcgcgccgctggtacacctcgggccggtttaatccctattcggagcgcttcgccagtaacagcgaacagctgcagcaaacaggtattgcttcaccgacgattctcaacctctacagcctgcacgacggcagcagcgccgtgcgttatcagccgctgccggggctgacgctgcgtcaagccttgcaaagcctggacagcagcctgcgcgaatcgctgatcgaacggtttggccgattcatggcgcagttgcacgaacgcggggtgtacttccgctcactgcatctgggcaatgtgctgttactggaagatggtgagttcgggctgatcgatgtggccgacatgcgcatttacccgtcagcactgcgcaacacgctgcgccagcgcaacttgaagcacatgcagcgttacccgcaggaccgcaattggctgttcgaagcgcactttgagcaattggccaaaggctatgggtccgttgcgtcggcgcacgccacggtcaaactccgtgagcaggtgctgacactggcgcgcccggccgcctgaccggcgagggtgtgcgccacagggcggggcgcacacaacgctgtcagtctttttccagcggggagaaaaacaaccggctcaagccgcgccaggttttcttgttccaggcccggaacgggatctgtgccagcagctcgcgcgccaacttacgatcacggttggcggtcttgaggaacatcgagctgaggaacttgtaacgcacctcgtcatagagcgggtggtcgctgaacaacgcgtaggagcgcaggatattgtcgatcatgaatcgatgattcttgtacgagttggtggcgtgcttgcgatagcgggccatgaccacgttcaagccatcgataaagtacccggcatgggtaatcttcaactcgatcagcaaatcttccagacgaatttcaggatcaaacccaccgaccttttccagcgcctcgcgccggatcatcagcgtcggtgcaggcgggtaaggcttgcgctccaggaacatgtcgtcgaagtccaggcgccgaaacggcacgtcgcgacgctggcgcttctcgggaaacaactcgccctgggcatcgatcagctcgatgttacccgcacagataccgacctccggcttgccatccatgtaggccacctgggtcgcaatccgctccggcaacatgatgtcatcggagccgaacggcacgatcagcgggccctgggagcgtgcaatcgcgccattgagcgtgttggtcagcccctggttctgctgcacgcgaaaatcgaagctgtgctgctcctgcaagcgacgaatgcgctcgacgctgtcgtccttggacccgtcgtcaatcaccagcagttcaatattggggtacgtctggttcaagacgctgaggatgctttgctcgatgtacggagcatggttgtaagacgcaatgatcaccgtgaccaagggttgactctggttcatacattgttcccgcgcacttgagccaatcccgaatcaatcaattccaggtattcctggcggaacacctcaatgtcgtgttgcgcctgcaaatactggtaggcctgctcgcccttctgcgccagcgcttcgtcggacagcgccaggtaggtgtccagcgcctgggtcagcgcgggcacattggccggctctaccgccaggccgcctgcgccttcaatcagcggcagcatggccggaacgctggaggcgatcaccggcaggcgcccactcatgccttccagcagcgccaggccaaggccttcggccagcgaaggcatggcccagatgtcgaaggcacgcacgtactgcagggcattttccttgaaacccaacaagtgcacgcgcccatcaaggcccaggctgtggatttgagcggcgaggttggcctcttcacggccagcgccaatgatggcgagctgcgccgtggggtacttgtctttaagtgcagcgaacgcctgcagcaaatacgtgtggcctttgaccggcaccaggcggcccaaggcgccgatcaaccgcaccgaagggtcgatgcccagcaattcgcgcgcacgttcacgcgaatgctgcaaggcttcggcctgctcgatgtcgatggcattggtaatggcgaaagtattgctgtcggtaaacccgcacttgcagtccagcaggtattgcttgaccgccggcgacacaccgacaaaacgccagtgcgcgtcgatccagcgctgcgcctgcttgcggcggtacaggcggtcatattcaccgaagccgtgggagatgccgatacacagcggaatcttcaaccaacggttcagttgcaacatcatgttgaccggcttgaagcgattgcacactacgacgtcaaacttctcccggcggcagaacttgtacagctgccacatggcccgcagcctcaagcccttgagcgacttgtcggagaactcgaagtagaccgaggtggcggcgcgactgaccgggccacccggcgcaggccgaccgcgcaggaacgcggcggtgacttcatagcggtccgcaggcaatgccttgacgatctgttcggccaggtcggcaaaatcatgggatttaacattgtagtcaggctgcaattgcagaaccttgaaacgccgactcataactctcctcgatggaatcctgtggcatcaacaacccaggatgtctcggcggccagcgcctcgacgtgctcggcacttggctgtggcaccagcggccattgattacgcttccagcagacaaaatggaaatacggaaattcccggtcgccatccctgtcattggtcaagcgaccgttgttccagaaccactggtgcggaaaacgatcagtgccgtcgtgccacttgatcacaccacccggcgtactgaacgcctcggtgaactcactgcgacggcgccacgggttgagtttgccgaccagttcgaacaacggcttcgggaagttcttgcgccacaggaaaatcctgctgaacgccccttcatccagcgcatgatgctcctgatcggtgaaacgtgcttcccaatccttgatctgcatgaacacctggcgctttctggcggtgttacgcatcaggcacaaatggccggcgacccgccgctcatgggtcgaaaacaagtcataacccgccaggcggtcagcggtgaaataccggcgcaggttgccatagatcaggtccaggtcgccaaacgcccaaaaatcgtagccgtcgaggcgatcaacatggatatgccccagcgccggcttgatgtcacacagtttgtaagccgcctgaggcgcgaaattgatcttcagccgctgtgagaccagcgcgcagtaatcggcaaaggtgatgctttcaatcctgacgttgtcgggcacgttgtcgggtatcgggcagtcgctgaataacagccagtcaatatccgcattgtgccggcagctttcgagaaaaaacggcatccagaaaggccattggccaaagtaaggaatgatgaaaaggatgcgggggcatggattgatcactggggactcactgtcttttttacgggagcgctcagcgctccaccacgttgtttaacgttacttgtgcttgatgaaccaaaaaagttcatgccgccgaatggccttgcggaaaaactcattctcaccccaaggcgagacagcccgccccgccaacagccgctggataacccggcgcacacgccgcttgaacggcatgcggggttgcaagtcatgcatcatgcccagcgacatggccttgtcacactgccgctcttgggacaacggcaagcaataaggctgcaaagtgtacgtcgaatcaaagcatggtggcaaagcgacaccagcgcccgaatcacccatcggccagcggtcattgtcgtgcaggtgattggcgtaaccgagcaacgtcgtcggctgccattcaagcccctgcaaggcttccaatacggcttgctgcgcgcagatatgatccgggtgtgggtcgagcaccggatgcggcagcacgatgacctcggggcgagccatcagcagcacggcgcgcaggtcggccagcaggttgttccaggtgggctggccatcggcatccgccggcaacgggaacgggttgaattggcggaatacacggatgtcgctcaactcggcttctcgcgaagccacggcccgttcaggctcggccttcattgccgccaattgcaggcagaaataccccagctgtacgcaatgttcctgcgccacgcccgcccaacgcggcaccgcgatgctgtcccaagcgcgcaaacggcccttgaggcgtgcagcctcgggtttgcccaggcccatgtgctgatagtgttcggcttcgatttcgccggccgtcagcgttacgatccagggttgcgtggcctggctgtacaggccaaaggcggccagttcggcgtcatcggcatgcggcgcgatgaccatcacccgttgcttgcgcacatcgggctgacggaacaccgacaacaccggcgtaccctgcacacggcagaaacgaggctgcagcagcagttgcccatcgagcagcgcttgcgtctggccggtgaggttcaggtagcgcaggccattgacgccgcgttcgaagacctggcgatcagcacccggcaacgcaataaacgggtcgataaagcggcccaacagactgctcttgaggcgcagcgcgaggatcagggtctcattgcccgccagcgccagcgcctcgtccaacaccaaccggccgttggccagggagaccttgggctgctcggtatccgccgcgaattgatactggtagtcgtccttgggcgagtagaacaggtggtcggcaaaccaggcctcatgggccacccaggccaacacggccagcaccagcggcagccaccaggccaccagcacacccacgccaatcaacagcagcaggccaatcagcaagctgatgcgtttgttgcggcgatggcgcttgagcagcgcctgcttacggcttgtcgactcactcatacattgaataccggtacagggttgcaccaacggtccttgtactcgcggtccgctcggccaaacgaaaaccgcagtggcttgccggcttcacgcgcctgctcccaggcactttgcgtgttgagaaaactcagcacgctgcccgggctgaacgcgcgggtttcagggtcaacgccgccattgatgtactcgacgctgatccactccggggcttcaacgcggtagaccagctggatagctatcggcgcatcgttgaggaaaatcactgagccgatcaaccattcacgcagcaactcgataacctgcgccatgcgctcggcgcccgtggcagggaaaccccagcggcgctggaacaaatcgcaatagatcgccgccagctcggcactggaaaacgcctgcaccggccgcaccacaccgcccgcctcttccagcaggcgcagctcgcggcgctggttatagcgaaacttcttcgacaactcttccggggtgcgcgccatggccaactgctcggcctgcaacttgaggccggcaaaacggccttcattcagcgccgacaggtagcgcgcgcgatgccgcaaaggcgcctgggcatctgcggcggcaggcaggatcaactcggcgttgcccaagtcgaacaagccctttttgccatgccgcttgagcacgtccttggacaaggccaggtcgcgcccccacgtcgcaatgcacgccttgagttcgccgccctgctcccacgccaggtagcgcaccggaatatcggccagcccggccagacgctcaaccacttgcggatgggtggcaacactgccgccataacgctgccaggcatcgctgtaggtggacgcatcgacgacggaccagccacgctcgcgccagccttggaatcgattgagcatcaagcccccgcggtcagttcagtaacgtgcggcagtgcccagaaagcagtacgaaccgcctgatccgagaagcgctcatgcaagcgctccagcatcatctcggcgcactgctgctgttgttgacggtccatcgccgccaggtgccgaagcccctggcccaggtgttcggcatcagcgaagggaaacaggatccccacgccttcgaccacttcccgcgcgccgccacacgccgttgccagcaacggcacgccggcggccatggcctccagcaacaccatgccgaacggttcgtgatcggagctcagggcaaaggcgtcgaacgcacggaagtaccggcgcgcatccggcacctggccgaggaacagcacctgctcggcaatgcccagctcacgtgccaaggccttgaggtttttctccagtcgcccggtcccgaggatcgccaggcggctttgcgccggcaaatgcggcaacgccaaggcaaagcctttgagcaaggtggcctggtctttgtccgggtgcagacggccgacgttgccgaccacccactcatccggcgacagccccagggcatcgcgcgccgcgtcggccggaacctgcagcgcctgcatggcttcgacatcaatgcggttgtacaaggtctggatacgcgccgcaggccaagccggcaggcagcggcgcatgtcatcacgcaccgcatcggaaacaccgagcaggctcaggcgcttgcggaaaatcgacgcaaacagcttgcggctgcggcgctggtaatcaccaaaggcgtgatgcacgccgatcaccggcaggcgcgtgccgagcaaggcgatatagatcggcttgaaccggtgggcaatgcaaaaactgaagttgcgcgacgcggcgatcttgcgcagctcgccaatggcgcccagcttcaggccacgaatggccttggagctgaattccatgaacaacacttcgtccgaggcacaaccggcggcaacctcggggtcagcgaccccggtgaggaacaccgtggtcactttatagccggagcctgcgaacaggctggcgtattgccgcgcgcagtccagaaacggcccgtcatagccgtggcagaactgcaggacgtggcgctcagccgaccgagtcataagggtccacgccgtctttgacgaccaggatgtcttccatgatcaggtattgcaggtcggagccgaagaacatgttcagcgcgtcggtcggcgagcagatcatcgcttcgccacggcggttgagcgaggtgttcagcgacacgccgttgccggtcagtacttccagctctttcatcatgtcgtagtagcgcgggttgtattcgcgcttgagcacctgggcacgggaagtgccgtcttcatgcaccacttccggtacacgggtcttccactcctccgacacttcaaaggtgaaggtcatgaacggcgccgggtgatcgaccttgatcatctgcggggccacggtgtcgagcatcgacgggcagaaaggcctccagcgctcgcggaacttgatctggtggttaatgcggtccgccacgccggttgcacttgggcaaccgatgatcgaacgaccgcccaacgcacgcgggccaaactccatgcggccctggaaccaggccaccgggttgccgtcgaccatgatcttggcgatgcgcttaggcatgttttcgatcttgcgccacaccggcttgctttcgtgcttggcgcacgcggcgatcacgtcttcgttgctgtaggacgggccgaggtagacgtgttccatcttctcaaccggtacaccacgggcgtgggacacgtaggctgctgcgccaaccgcggtgccggcatcgccggacgccggttgcacgaacagttctttaacgtcgtcgcgggcgatgattttctggttcagcttgacgttcagcgcacagccaccggcgaaagccagcttgccggtgtctttgaggatgtcgcccaggtagtggtcgatcatctgcaacgccagcttctcgaacaacgcttgcatgctggccgcgtagtggatgtaaggctcgtcggcgatgtcgccttcgcgcttgggacccagccactcgatcagttttggcgagaagtagaagcccttgcccttctctttgtagcggcgcaggccgatgacgttggcgtagtcggtgttgatcaccagctcgccgttttcaaacgaggccaaacgcgagaaatcgtatttgctggcgtcgccatacggcgccatgcccatgaccttgaactcgccgtcgagcatctcgaaaccgaggaactcggtgatcgcgccgtacaggccgcccagggagtccgggtcgtagaattccttgatcttgtggatcttgccgttttcgccgtagccgaagaacgtggtggcgtactcacctttaccgtcgatgccgaggatcgcggttttctcctggaagccggagcagtggtaggcgctggaagcgtgggccaagtggtgctcaaccggctcgatcttgattttctttggatcgaagcccagttgctccaggcaccagacgatcttgttgcggtagcgcttatagcgacggttgcccatcaggatcgcgtcgagggcgcggtccggggcgtaccaataacgcttggcgtagtgccagcgcgcctcgccgaacaggctgatcggggcgaacggaatcgcgaccacgtcaacgtcggaaggcttgatgccggcttgttccaggcagaacttcgccgattcgtagggcatgcggttctttgcatgtttgtcgcgtacgaagcgctcttcttcggcggccgcgatcagcttgccgtcgatatacaaggctgcggaaggatcatggctaagggcgccggacaggccaagaatcgtcaatgccacaggggtctagcctcttttagtctgcatgcaggcgggttgcgcctgaaaaaagtgtgcctctcgcctggacgagaaacagctaaagggcgggattatagcgtaaacatgcggcgtgatgatctagggaatatggcgaccggttgtcactgcacgctagcggtagatctcgatgctgccgtccttgctctgacgatagatcgtgtagggcagcaccagggtgtctgccacgccggaggcgatcgcctcgatggcgatgatcggaaaggcattccccgtatggtccgacaaggtctggtcgttcaggcttttttcaggcttgggttcaccgttgagcgtgcaaaacccgtagatcaccccgctgtagatacgtggcacgctttcgcagttgctgcgcgactccttgaggttctggctggcaaccgcgtccgggcggaagacggtattgatcgttccgcagccagtgagcagtacgagcgttagcaccaacaggatattagaaacgcggttcacggatgactccttgtgtcttcaaagggcgaatgcgggcaacgccgacgcgcttatgcttgccccgctcaagcgccgccggggcgccaatagatactgatattaccgtcactcacctgtcgataaatcgtatagggcaacacaaccgtgtcggcaatcccggacacggcaatgtccagcaacaccaagggtatcaatataccggtcgggtcaggtgcggcgtgcagcgagcaaaaatcaaaggccaccccactgtaaacgcggggtatggattggcaataggtttttatgagccggagttcacgagcggtgtcaccgtctttgcgaatgacgctgttcacggttccacaaccgctcaacagcaatgcgcaaacgcccagtgcaaccgtaatgcttactctcatagcccggccctcataaacgttcagccacgctatcaccgggctatcaactcacccactccagcgcaccgacaagtcacgtgggaaaaatccgaaatggtaaaaactcagcatttcactaaactcgcgcccttttgcgcgtttatgtcgtatgcgccacagatcctggctgaccatgaaaactctcacccacctcaccttattgctccccggcctgttcgccttgagcgacaccgcgctggccgatgacgcccccctgatcctcgaccccagcgtggtcaccggctcacgcagcgccagcccgaccttcgacctgccgtattcggtggacagcatcagccacgagcaaatcagcgacggccaactcggcatcaacgcctccgaagcactcgcgcgcgtgcccggcctggtggtgcagaaccgccagaactacgcacaggacctgcagatttcctcgcgcggcttcggtgcccgttcggcatttggcgtgcgcggtatcaagctgattgccgacggtatccccgccagcaccccggacggtcagggccaggccgccaccttcaacctcgacaccgccgaacgcattgaagtcttgcgtggcccggcggccaccttgtatggcagcaacgccggcggcgtgatccagatgttttcccgcgacggcgaaggctcgccgcgcatcggcgccgaaaccctggtgggcagcgacggcctgagcaagcaccacctgacggccgaaggcgccgccgacggcgcaggttttgtgctcgacgcctcgcgcatggacaccaacggctaccgcgaccacagcagcgcccggcgcgaccagacctttgccaagctcaacgtcgagccggatgacaacagtaaactcgcgctgatctacagcagcctggagcagaacggcacgcaggacccactgggccagacctgggcagcgtataaggcggacccgcgctcggtggcgcccgccgcattgcaatacaacacgcgaaaaagcatcgatcatcagcaattgggcctgaattacgagcgttatatcggtgatgcgacgctgcaggtgaacgcctatacggggcggcggagtgtgattcagtacttgtcgattcccggcggcactcccccagacaagcgcggcggggtggtggatttcgaccgcactttctacggcggctccgtccactggctgcaacccatcaccagcgcccccggcgacctgaccctgatcaccggccttgactacgaccgcagccaggatgatcgccaaggctattccaacaccctcaacggtgtgcacggcgtcaaaggcgccctgggccgtgacgaactcgacaccgccaccagcctcgacccgttcgtgcaagccaactggctgctgggcgactggaccctgcaagccggcctgcgccacagcaccatgaagatggacgtggatgaccacttcctcggtgacggcaacgacagcggcaacaagacctaccagaagaacacgccttcggtcagcgtcatgtatgccttcacgccggacctgcatggttatgtgagcgcgggcaaaggcttcgaaaccccgacacaggccgaatcggcctattccagcacctcaaacggcttcaactttgcgctcaagccctcggtcagcaagcagtatgaagtcgggttgaaagcgcggatcggccaagatacgcgcctcaacgccgcccttttccagatcaccaccgacgatgaattagtggtggcgcaatccaaagatgggcgcactacctatcagaacgccggccgcaccctgcgtcgcgggttagaactaggcatcgaaagccagctctcggaacaatggagcaccaacatcgcctacacccgcctgcaagctacgtatgacagcgacttcatcggtggcggcaaacccatcgacaaaggcaactacctgcccggcgtgccgcaaaccacgctgttcgccgagctgaactggaagccccacgactgggtcagcaccgccatcgagggcatgtaccgcagcaaggtatatgtcgaagacaccaaccagcaacgcgccgcaccgggctacagcgtattcaactggcgtgcgcgcttcgaacagaaggtcgagcactggaccttccaccagaccctgcgcctggacaacctgctggaccgccaatacgtgggttcagtgatcgtcggcgacagcaacaaccgctactacgaagccgcgccgggccgctcgtggtatgccggggcaggcgcggagtatcagttctgacgcgcaccgttcaagaaggttttgagtcagccgaaaggtttgatcgccacggaacccttctgatcgttcccacgctctgcgtgggaatgccgccccggacgctctgcgttccgccctgtgcaaggcgacgcggagcgtcaccggatgcattcccacgcggagcgtgggaacgatcattacgggtacttcttcaccagccagagcgtgctgagtaacggcaggcactgatcgttcccacgctctgcgtgggaatgccgccccggacgctctgcgtcccgccctgtgcaaggtgacgcggagcgtcacgggatgcattcccacgcggagcgtgggaacgatcattacgggtacttcttcaccagccagagcgtgctgagtaacggcaggcactgatcgttcccacgctctgcgtgggaatgccgccccggacgctctgcgtcccgccctgtgcaaggtgacgcggagcgtcacgggatgcattcccacgcggagcgtgggaacgatcattacgggtacttcttcaccagccagagcgtgctgagtaacggc

SEQ ID NO: 43 - DNA, 111362 bp, Pseudomonas poae FL10F
caacgccgatcccatgtgggagctgtcgagccccagcgaggctgcgaaggcggcggcatggacaaagttgagtcgcctgacccaccgctttcgcagcctcgctaaagctcgacagctcccacagggttttgctttgtttgtgggagtccatgcttaactgaggttcgatgcagtcagtcacgccccaactgacaacgccgatctcttgtgggagctgtcgagccccggcgaggctgcgaaggcggcggcacagacgaaattaggtcgcctgacccaccgctttcgcagcctcgctaaagctcgacagctcccacagggttttgctttgtttgtggggtgggggcccacgcttaagtgaggttcgatgcaggcagtcaaacaacgccgatcccatgtgggagctgtcgagccccagcgaggctgcgaaggcggcggcatggacaaagttgagtcgcctgacccaccgctttcgcagcctcgctagagctcgacagctcccacagggttttgcatcttttggaagattctagcggttagaacgcgatcgaagtctgcacgtacaccgtgcgcggttcacccacgtatttgcctttgttgttgtcgtcgaacgagcgcgtgtagtactgcttgttgaggatatttttcacaccgactgccacattcaagtccgacaactgtgggccgaagtcatacgccgcgcggctgctgaacagcatgtagccggggatgcggccgttggcgccgtcggcggtttccgtctgggtgttggcgttgtcggcgaactggctgctctggtagctgctgtccaggttgagcttccagcggccttcggtatagccgacgcccaaggtgcctttgtgcttggacgagaagggcacgcggttgcctttgttcgggccgtcttcgcggatggtcgcgtcgacgtaggcgtaagtggcgtacacatcaaaaccggccagcgccgggctcaaaccgtcgagggcatagttgatgctcgactcgatgccttgatggcgggtttcgccacgggcaatcaccgaatcgttggtctggttgctgtcgtactggttgtcgaagttgatcaggaacgcgccgatttccgcacgcaggctgccattgtcatagcgcgtgccaagctcccaggtgcgggctttttccggcttcacttcgccgctgctcacgcggttcggcatctggctgtactgcacgctgccaaacgaaccttcggtgttggcgtagaggttccagtcttcggtcaggtggtacagcacattcagcgccggcagcgcggtgttgtagtcgcctttgtatttaacgttggtcaggttgttggtttgctgggattcgatcatctcgtagcgaatgcccggagtgatggtccacttgccgatatcaatacgatcatcgacgaaaaacgcattggcctcggtggcgccgcgcgtatcgcggtcgttgcgactgttggtgtcaggcagttgctggttggcgctgatcggcgtgcggtagcgcaactcgtggccggcttcgttgatgtagcgatagccgacgcctacttcatggctggtcgggccgaggtcgaagccctgggcgaagcgggtttccaggccgcgcacccagtactcgcgcggcgacagcgagaggaagttgccctggtccaggtagccgttgcgcaaggtggtggtgaagaaggtattggcggtgaattcgcgtcggtcttcctggtagcggtaaccggcgttgaacatcgtgcggcggccccagaatttgtcgtaggggcgggtggactgatacgggtcagccttgtagtccttgacgttcaagccaccgggcatgtcggcctggccttcgtagtactgcgccatggcgttgaaactgttggcgtcgtccagctggtatttgcccttgaggatcaaatcgtcgatacgcgtgttgctgttttcgcgccagtcgccgccacgggtgccggagtacaaaatcgcgccgcccaggccattgtcggccgtgccgcccgccaacaggttgccggtggtcttgaaaccgtcatggctggaggacgggctggtttcggtctgcaggccgcctttgacggtcggcgcatccgggattgcgcgggtcacgaagttgacgatgccgccgacgttttgcgggccgtagcgcaccgcgccgccgccacggaccacgtccaccgcatccatgttgcccatgctgatcggcgcgaaagacaattgtggctggccgtagggtgcgaacggcactggaatgccgtccatcaataccgtggagcgcgaggccaggcgcgggttgagcccgcgaatgccgaagttcagcgccatgtcatggctgccggtgccgttgttttccggggcgttgacgccggggatacggttgagcacgtcacgcgcctgggtcgcgccctggcgttcgaattcttcgcggcggatgacatcgcgggcgccggggtgttcgaacacgttggtttgcgctgcgtcgccgagccagtcgccaacgacgttggaggtctgtaattcgagggtggccggggcgctggccggttgcaggctgtaggcgttatcgccctcggcgcgggcttgcaggccggtgccttccaggagttttcgcaggccttcatcggcgctgtaattgcccgacagcccacggctctgcatgccggctgtgacctcggagccgaaggaaatcaacacgccggcctcacgcccgaattgattcagcgcggcttccagcgtggccggggcgatgtgatagggcttggcgtctgctgccaacacctgcggcagcacggtaagactcaggctcgcgccgagtaggagttggcgcaaggtgcgggcaagaagtgtcggttgctggggcatgaagggcggtcctgagaaggtaggatcaaggtggctttccttctctgtcacgcgaggtgtggaaaacggctcatgttttctgaaaataatttacgcacgtgcctggacagtcacccagtagcgggtaaaccgccgcactttgaccggcaggctgacttccagcaggtcgaggatgcgttcgctgtcgtccaacggataactgccggacagcagcaggttggccacttgcgggtcgcaattgacttggccacggcgatagcggcccaactcggcgaggaattcttccaggcgcatgtgcgccgccaccagcatgccgtcggcccaggcgccgctgttggcgtcggtcgcgcgcggggtgtcccagcctttgcgggtgaaattgacctggcgcgaggcctcgacggtcagcggcaggccgctgtagcggttgggcatcacctcgacatggccgtcgaagaccgccagttgggtgtggtcgttgaactgacgcacgttgaggcgcgcagcctggctgctgagcagaccctggccggtcagcactcgcagcggtgtgtcgccggggcgcgcggtcagcaggatttcaccttccaacaggcgcaccaaacgttgatggccatcaaaatgcacatccaccgcgctgccggtattgagctgcaactggctgccatcggccagttgcaccttgcggcgctggccgacggggctgcggtaatcggcgctcagcggcggcaaaatatgttgctggcgcaggctccaggctgcggccgaaccggcgccgagaatcagcaacagcttgagggcctgacgccggctacgggatttcggcgcgttcaaggcggcatgcgccaagggtgagggcatgccgcgcaggcgttggttgacccgctggatatggtcccatgcacgttggtgttcgctgtgggcatccagccattgttgccaggctgcttgctggcgcgggttgagcgcgccttgttgcatttccatcagccagtgcacggcttgttcggcgacctgcgtggagaaattcatagagcgaaatagcagcgcatggcggctttattcaggtggcgtttgacggtggcgatggagatgcccagttcgctgccgatttgcgcgtaggtcaggccgtcgagctgggccagcaggaaggcgcgtttgacctgaacgggcaggccgtcgagcagttggtccagctccatcagcgtttgcaggatgattgcgcgttcttcttccgacggcgccacgtgttcgggcagttgcgccagcgcgtcgaggtaggcgcgttccaggtcctggcggcggtagaagttgaacagcacgcgcttggccacggtggtgaggaaggcgcggggttcgatcagtgtcggggtttcccgtgcggtgagcacgcggatgaaggtgtcctgggccaggtcggcggcgctttccgggcagccgagcttgcgtcgcaaccagccggtgagccagtggtgatggtcgttgtacagaacttcaacggtgttggacggctgcaacgcgttcactcagaaagtctcggtgtactttagagaacaagaattgttcgcattgtagggcgggtgacacacttgggcaatcctgcaagacaggtgattcatccgttctcttttgcttatgagaatatttatcattaatattgcgcgctgatgaccctggcgcctcccgcatgaaaagcaaaacctcacttcccgtcgtttatcgcctcgccgtcacctcgcgcgtgctggcggctgtggtcggcggttacctgatggcgtccctggccgccgtttgcctggcgctgtggatgcctgcgtcgcgcgccgacgcagtgatcaccgggatgatgagctcgtttgtgttctacctgttggcggtgctctggtgttttgcctgccgcacggcgtggcgtgcctggtttggcgtgatgctgccgagtgcactgtttgccacgctggcgggtgtcggtttttggatggcgcgcacatgaaagagggctttcgccaggccatggcctggttgcacacctgggctggattgattttcggctggctgctgtttgcgattttcctgaccggcaccctgtcctatttcaaagacgaaattacccactggatgcagcccgaagtgcaggcgtatccgctggatgacgcgcgcagcctcgccgccgcgcaaacctatctgcagcaacaggcgccgaatgccgcgcgctggtttatcaccttgccggacagccgcgaccccggcctgtcggtgatgtggcaagacaaagtcgaccccggcaagcgcggcaacttcatccaaaaagtgctcgatccggtcaccagccagcccgtgcaggcgcgtgaaagcatgggcggcgagttcttctaccgtttccacttccaactgcaaatgccctacccgtggggccgctggctgtcgaccattgccgcgatggtgatgttcgtcgcgctgatcaccggcatcatcacccacaagaaaatcttcaaggacttcttcaccttccgcccgcgcaaaggccagcgctcctggctcgacgggcataacgcagtgggcgtgctggtgctgccgtttcacttgatgatcacctatagcagcctggtgatcttcatgagcatggtgatgcccgcgcccatcgttgcctcctacggcgacgacagccgcgcatttttcaatgaagtgttccccaataccaacaacgcgccggcgctcggccagccgggtcaattgctgccgttactgccgatgtaccagcaggcgcgcgagcaatgggcgggtgggcatgtggggcgtttggtggtcaacaaccctggcgatgtgaacgcctcggtcaacgtggtgcgctccggtgccgaccgtgtggcgcatgatttcggcagcagcgtgtcgttcaacggcaccaccggcgagttgttgcgggtcagtgccgagcagtcgctgccggccgcaattggcggcagtttctacggcctgcacatgggccatttcgccgggcctgtgctgcgctggctgtactttatctgcggcctggcgggcacggcgatgatcggcaccggcctggtgatctggctcggcaagcgccagctcaagcacgccaaaaccggcgtgatgccgtttgaactgcggctggtggaagtgctgaacatcgccagcatgtccgggttgatgatcgccatcgccgcgtttttctgggccaatcgcttgttgccggtgagctttgccgggcgttccgactgggaagtgcaggtgttctttatggcctggggcttgagcctgttgcacgccgtattgcgtcgaggccgtcagggctgggttgagcaattgagtgtcggcgcattgctgtttgtggcgattccattgctcaacgcgctgaccacttcgcagcacttgggcgcgtcactggccagcggtgactgggccatggccggcttcgacctgacctgcctggccagcggcctgttcctgacctgggccgcctggaaaatgcagcaccggacggcgccgcagcccaaggctgaacgcgcgcgtggattgacgctcaagcaggaggcgaactgaatgctgctcgccttgctgatgtgttacgccgggttcgtcgcgctgtgcctgtccaccgatcgccatcacggtgaattgctccacagcaaaccctcgccaccaaggcgtctggccttgcgcgtggccggttggttgctgctggcgctgtcgacctggcctgcgatgagtgcttcgggttgggcccaagggctggtggaatggtgcgcggtattgatgctcagcgcgctgctgctggtgatgctgttgccgtatcggccaaggctggccttgatcctggcgggcgttggcctgctggccagcccggttgcggcgttcgccttactctgagcttgccatgatgatcagcaccccaccggaatcccaagacagcccgcacaccgatgtggccggtggacgtgcgcatttcctgcaggtgtttttatcgcagcgctcgcagatggaagcccttgtcagccgacgcgtgggctgccgcgccaccgccgccgacctggtgcaagacctgttcctgcgtttctggcggcggccgttggtgcaggtcgaagaactcagcacctacctgttgcgctgcgccggcaacatcgccatcgaccacctgcgcagcgaaggcgcgcgcgtacgcagcaacgagggctggctgccggagcaacaggacaatcagggctccgagccccaggccgcacttgaagcgggcaatgacttgcgccatgtcgaagctgccctgcgcagcctgcccgagcgcacccggcagattttcctgctcaaccgcattcacggccgcaaatacgcgcaaatcgccaaggccatgggcctgtcccaaagcgccgtggaaaaacatatgatgcgtgccctcgaagcctgcaaagccagccttcgcgaaccaccgcccccacgcacgccagggaaagcaccgtgaacgtcacccccacgcccgcccaggagcaggccgccctcgactggctgagcctgctgcacgaccagcccagcagtggtgaccaggccacgttcagccgctggttgcgtgccgaccccgcgcacgtcgaggcctatgcccaggcccaggtgctgtgggaattgagcgaagtgccggcgcgcaaactggcggacgaggacgccttggcgttgcagggctacctgaatgcgatgaacacgtcgaaacgctcacgggcaatgcgctggtctggcgccctggcgatggccgcgtgcctgctggtgatggtgtcgatgggcgccggctggcagccgtcgcgctgggtcgatgacttcggcgctgattacgtgacggcgccggggcaggtgaagaccgtgaccctggccgatcaatcccaggtcacgctggatgccgacagcgctatcgccgtggatttcagccacggcgagcgccatatccagttgcgtcgcggcgcaggctttttcagcgtgactcacacgggcgcgccgtttgtggtcgaggccggcagtggcgaagcgcgggtgttgggcacccagttcgaagtgcgcctgcaaccggctggcgcccaggtgacggtgctgtccggccgggtgggtgtgacgccatccaagcagggccagcagcaaatcctgacggcaggccagcaagtggcctacgccgacggtgtggccgaagccatgcatgcagtcgacagcgaatcacgcctggcctggcgtgacggttggctcaactactacaaggcgccgctcgccgacgtggtgcaggacctgagccgttactaccccggccgcatcctgctgcttaacgacgaaatggccgccaaacgcgtcagcggcagctttccgagcaaagacccgcaggcggtgctgaatgcgttgcaggcggtgcttgggttcgagcagcacagcctgttgggtcgggtgattgtgttgcgctagacacacagcatccctcaattccccctgaatattctccagtcggtctctgcaggccttgcatcacggcacctgtagacccttcaccgaaccttcatcgcaatcacccaaacctgtcaccaaaccgttacacgtggcgtggatcatcgccgggttcctgagcgagtggtcaggaagccaagcgtcgtctgccaacgggtgccgagcgacgacccatacaacagagcaacgtcagtaagggatctacaggtgaactacaacaacgtatatgccctgcttttagcatcgggcctgggtggttttgcgccgctggttttggcggacgacactcaagatgtgggttcggtgaacgtggcaggcaaacaaaccctgggcaacgggcacatgattcgcgaagaaagtgccaaggcgcggtcgacggtgaccaaggaagccatggacgaaatgtcggcgaccgccaatgccatcgacaagctcaaatacacgccgggcatcaacgtttccagcgacgacgcgagcggcaccagcggcaccaacttcaccatgcgcggcatgagctccgaccaagtcggggtgtctgtcgacggcgtgccgatcaacgattcgggcaactacagcgtctattcaaaccaactgggcgacccggaaaacctcgccgaagtgtttgtcacccaaggctcttccgaggcggacggcccgcatatcggctccagcggcggcaacatcggcatgatcaccattcggccgactcaagagtccgggctgtttgccaaacagattgtcggtgccaatgacttgcgcaagacctttgtgcgggtcagcaccggtgatttcggtgggctcaagacgtgggtgtcggcgtctcacctggaaggcgacaagtggcgcggcaaaggcacgatgcgcagcgacaaagtcgagtggagcagcctgttcgaggacggcagcggcaactcgaccctggccacggtgaagtacaacaaccaggaaaactacaactacaacaccctgagcaaggcgcaattcgacaatgaggggcgacgcaaggactactcggaaacgccggtttacaaggcaggtttattgtcgtcgtcctacaagctcaaccgcaatccgttcgaaagcgtcaacgccacgctgacccagcgctggcagttgcaagacaacctggcgctgacggttacgccgtattactactgggccaacggtggcagtttcagcggtcagaccgcgtcgaacctggggccaaaatccgacaaggccggcaactacgacctgagcaacctgcaatcggccaactactatcgcccttcgtggaccgagacctggcgccctggcgtcaccgccaaactgaaatgggacatcaacgaagcccacagcctggactacggctattggtatgaacgcgcacgccagcgtcagacccaaccctttatcgggatcaacagcgaaggcgcgccggatgatgtgtggggcgactacaacagcggcggccaagtggtcgacaagaacggtgccaccgtccagggccgccactattacaccgtcaccccgtcgcagaaactttgggttcaggacagctggcaagccacaccggacctgagttttgtcggcgccttggcgtaccagtatgtcgagcgtgacggcaacaacctgggcagcctgtacgacaagccggaaaaacgtaacacccgttaccaccagttcttgccgagtttcagcgccaagtaccaggtcgacgagagcaaccaggcgttctacaacgtcacccgcaacatgcgcacgccacccaactacgtgctgtacaacaagggcgattccgtcagcttgaagtccgagttgagctggaaccaggaactcggctggcgctacaccgaagacgatatggctctgagcgcgaccttgttctatatcagcttcaaggaccgccaggtgtcgaccaccgactctgccggtgactacatggtgctcaacgtcggcagcgtcgaaaacaaaggcctggagctggagtggagtggcctgctgccgcataactttaactactacgcttcgtacacctacacgaagtcggagcagcaagacaatttgctcagcaaaaacttgttgttgcccacggcaggcaagcaactggccaacgtgccggaaaacatgttcaacctggtgttcgggtatgacgatgcgcgcttctacggcaacatcgcgggcaaatacgtcggcagcttctatggcgatttgaccaacaaggaaaagatcgaaggccgcacggtgttcgacctgaacgccggtatttacttgccggtggacaagaaagtcatcaagtcagcggcgttgcggttctcgatgctcaacgtgttcgacaagcaatacctgagttcggcgcgcaccgtggcgttcaactcggccccggtgaatggcttggcgccgagcacggcgtactacaacgtgggtgaagagcgcacggcgatggtgtcgttggaagccaatttctaagcccgcagaagaactgagtgtgggaaggcttgtgtgggagctggcttgcctgcgatgcagacacctcgggttttcatcaggaccgagttgaggctatcgcaggcaagccagctcccacaaaagcccgctcccacattagttctgcagtgttttgcagattagctatttcaaggcagccatgatcgcatccgggttgtaatcgcgaatcaacgtgccattcacgtccacaaacggaatcccgccgccgcccagcgcctcataggccttgcgcgcctgggcgtccttctcgatatccaacgcctggtacgggatgcctttctggtccaggaaacgccgggtctgcttgcagtagccacaccactcggtggaatagagcaccacgcgcgctgaggcgcgtatttgctcggacaccacctgcgaggggttgaacagccgctcgatcttgccccagttctggatgaccaccacgaccagcaacaccagcaggactttcttcagaaccccgccaagcatcagttacggcgcttgagctggtcggtcagttgggtgggcaggcccttgatgatcaaggtgccggcggcttcgtcgtattcgatcttgtcgcccaacaggtgggcttcaaagctgatggacaagccttcagcgcggccggtgaagcggcggaactggttaagggtgcgtttgtcggccgggatctccggcgacaggccgtagtccttgttgcggatatggtcgtagaacgcttttggccgatcttcatcgatcaaacccgacagttcttccaggcccatcggctcgccgagcttggcctggctgctggcgtagtccaccagggttttggttttctcgcgggcggattcgtccggcaggtcttcgctttccacgaagtcactgaaggccttgagcaaggtgcgggtctcgcccgggccgtcgacgccttcctggcagccgataaagtcgcggaaatactcggagaccttcttgccgttcttgcccttgataaaggagatgtactgcttggactgcttgttgttctgccactcggagacgttgatgcgcgccgccagatgcagttggccgaggtccaggtggcgtgacggggtcacgtccagctcgtcggtcacggccacgccttcgctgtggtggagcagggcgatggccaggtagtccgtcatgccttgttggtagtgagcaaacagcacgtggccgccggtggagaggttggattcctccatcagcttttgcaggtgctcgaccgccgtgcggctgaaggtggtgaaatcctggccaccgtcgaaatagtccttcaaccagccgctgaacgggtgcgcgccggactcggcatggaaaaaaccccaggccttgccttgtttggcgttatagctctcgttgaggtcggcaagcatgttctcgatggcggcggactcggacagctccgaatcgcgggcatgcagaactgcaggtgtgccgtcgggttttttgtcgatcaggtgaacaatgcaatgacggatcggcataggcttctcggctggttgaaggggagcggttggcctccccaaaaagtcgcccagtgtaccgcacccattgggcatggcacgcttcgaagggcgttttggctgctctccgacggcctatatgcctttttttcacggtttagagcgataaagctgaccaaatgggtatgttgaggcggatatttccccgtctctgtgctagttttgccccgtcttacgccaagactcggcgttaagcgtgcattcagcatctgtcaggtcgaaccaatccccgtttcaagcatctataaccccgatctccgtggttatggccgggggtgccaggccatgacggtcgggctcgacggctgacactgcactctgcaatccatatgaatttgatagggaaggaacaccacaatggctattactaaagaccaactgatcgctgacctggctgaagcagtagacgcaccgaaaactaccgtgcgcgctctgctggaccaactgagccaagttgttgctgaccagctggaaaacggcggcgaaatcactctgccaggcgttggcaaactgaaagtgactgagcgtccagcccgtactggccgtaacccttcgactggcgctgccatcgaaatcgctgccaagaaagttatcaagctggttgtggccaaaggcctgaccgacgctgttaacaagtaagacgcagcaaaaaaaaccgtgctccggagcaatccgggcacggttttttgttgcctgcgatttgtgctgggctttcttgggttagtcgcgcacccagcgctggcgccagatctgctgctcattcttggtctggaaggtccaggccacaaaacggctttgcttctggccctgggacatctccaccacctggctttcgagtacgccggcttttttcaaggcggtctcgatcgcgggcaagttcgacgcttttgacaccagggtgctgaaccacaacaccttgtgggcaaagtgcgcactctcagcgatcagctgcgttacaaagcgcgcttcaccgccttcacaccacaactccgccgattggccaccgaagttcagcaccggcaacttgcgcttggggtcggccttgcccagggcacgccatttacgctcgctgcccttggtggcttcgtccatggacgcgtggaacggcgggttgcacatggtcaggtcaaagcgttcgcccggctccagcaagcccagcaggatctgcttggggttggtttgctggcgcagttggatgaccttgctcaggtcattggactgcacgatggccttggcagcggccacggcaattgggtcgacctccgagccgaggaagttccagcggtactccatatagccaatcagcggatagacgcagttggcgcccatgccgatgtccagcaccttgacgatggaaccgcgcgggatcttgccgtcgttgacgctggccaacaggtcggcaaggaagtgcacgtagtccgcgcgccccggcaccggcgggcagaggtaatcctgcgggatatcccaatgctggatgccatagaaggctttcaacagcgcccggttgaacacccgcaccgcgtccgggctggcgaagtcgatactttccttgccataagggttgatgatcacgaatttcgccagttccggcgtggtcttgatcagcgccgggaagtcgtaacggccggtgtggcggttgcgcgggtgcagggtagcctctttgcgcggggcgacgggcttggccgtggctgcggttttaggcttcttgcgcggtggtttaggtgtgctgggggcggtcatgatgattctggtgttggctcaaagtggtgggcattgtcacacatcctgagcacaactcggtcaaatgtgggagctggcttgcctgcgatggcatcgcttcggtcttacagatgcaccgagtcgtctgcatcgcaggcaagccagctcccacattgatagggttttcaaggcaaaaaaagggacccgaaggtcccttttttcacacggtttgcaccttacaggctggaaatccgcgcatgctgctccgccagcttgcccagggcttgttcagcctcggccaacttggcgcgttctttctcgatcacctccgccggcgccttgtcgacgaacgctgcgttggacagcttgccgcccacgcgctgcacttcgccttgcaggcgcgcaatttccttatcgagacgggccagttcggcgcccttgtcgatcaggccggccatcggcaccagcacttccatctcgccaaccagcgcggtcgcggacagcggtgcttcggcgtcgtcagccaataccgtgatcgactccagcttcgccagcttcttgagcagcgcgtcgttctcggtgaggcgacgctgatcttcggcgctggcgttcttcacgaacactgccaatggcttgcccggcccgatgttcatctcggcgcggatgttgcgcgtgccgagcatcagggtcttgagccattcgatatcgctttcggccgcctcatcgatgcgcgcttcgttggccaccggccaaggttgcagcatgatggtcttgccttcgataccggccagcggcgcgaggcgctgccagatttcttcggtgatgaacggcatgaacgggtgcgccaggcgcagggccacttcgagcacacgcaccaaggtgcgacgggtgccacgctggcgctcgatcggcgcgttttcgtcccacagcacaggcttggacagttccaggtaccagtcgcaatactggttccagatgaactcgtacaaggcctgcgcggccaggtcgaaacggaactggtcgagttggcgggtcacttcggcttcagtgcgctgcagctgcgaaatgatccagcggtcagccaggctcagctcataggcttcgccgttctggccgcagtcttcgcctttatccagcacgtagcgcgcggcgttccagatcttgttgcagaagttgcgatagccctcgacgcggcccatgtcgaacttgatgtcgcgaccagtggaggccagcgagcagaaggtaaagcgcagggcgtcggtgccgtagctggcgatgccgtcggcgaactcgtcgcgggtctgcttctcgatcttcttcgccagtttcggctgcatcaggcccgaggtgcgtttctgcaccagggtttccaggtcgatgccgtcgatgatgtccagcgggtccaggacgttgcctttggacttggacatcttctggccctggccatcacgcaccaggccgtgcacgtacacggtcttgaacggtacttgcggggtgccgtcctcgttcttcaccaaatgcatggtcagcatgatcatccgggcaacccagaagaaaatgatgtcgaagccggtgaccagcacgtcggtggagtggaattttttcaggaattcggtctgttgcggccagcccagggtggagaaggtccacaggccggagctgaaccaagtgtccagtacgtcgttgtcctgttgcagcgcaacgtccgggccgaggttgtgcttggcgcgcacttcggcttcgtcgcggccaacgtagaccttgcccgactcgtcgtaccaggccggaatccggtggccccaccacagctgacggctgatgcaccagtcctggatgtcgcgcatccacgagaagtacatgttttcgtactgtttgggcacgaactgaatgcggccatcttcgacggcagcaatcgcaggctctgccagcggcttggtggacacgtaccactggtcggtcagccaaggctcgatgacggtgccggagcggtcgcccttcggcactttcaggccgtggtcatcaacgctgaccagcaggccggcggcgtcgaaggcggcaacgatttgcttgcgcgcttcaaaacggtcgagaccggcgtattcggccgggatcttgccgtcgatgctttcgttcagcgtgccgtcgaggttgaacacctggcaggccggtagcacggcggcgttcttgtcgaagatgttcagcagcggcaggttatggcgcttgccgacttcatagtcgttgaaatcgtgggccggggtgattttcacgcagccggtgccgaattcagggtcgcagtagtcgtcagcgataatcgggatgcgacgacccaccagcggcagctcgacgaacttgccgatcagcgcctggtagcgctcatcgttcgggttaaccgccacggcggcgtcgccgagcatggtttccggacgggtggtggcgacgatcaggtagtcgttgccttcagcggtcttggcgccgtcggccagcgggtacttgaggttccacaggaaacctttctcgtcgtggttttccacttcaaggtcggaaatcgccgtgtgcaacttggtgtcccagttgaccaggcgcttgccgcggtagatcaggccgtcttcgtgcaagcgtacaaaggcttctttcacggcttccgacaggccgtcgtccatggtgaagcgctcgcggctccagtctacggacgagcccaggcgacggatctgacggctgatgttgccgccggactggtctttccattcccagattttttccaggaatttctcgcgacccaggtcatgacggttctggccggtggcttcgagttggcgttccaccagcatctgggtggcgatacccgcgtggtcggtgcccggctgccacagggtgttgcggccctgcatgcggcgaaaacggatcaacgcatccatgatcgcattgttgaagccatggcccatgtgcaggctgccagtgacgttcggtggcggaatcatgatggtgtaggaatcacccgcgccttgcggagcgaaataattctcggactcccaggtctcgtaccaggaagtttcaatagcgtgcggctggtaggtcttatccatgcgcggcgggaccctagttggcattaattcaggaaagccgacaagtataacgggggatagggcgcagggcgaggcgaagacaggctagagatgtacgctgagcaaatgtgggagcgggcttgctcgcgaaagcgctggatcagctaatagatgcagcgactgtcacaccgcgttcgcgagcaagcccgctcccacatgagataggtgtgtggtttaggactggtattgactgagtaaccgctccatccgcgcatccagccggcgcttgatctcggtttcaatatgcggggcaaagtcgtcgatcacgtcttgcatgatcagttgtgcggcggcgcgcagttcgttgtccaggtgcagcagcagggcgtcgggcgctttttcggtggtaactggagcaggcgcggcctctgcaacgggggcgggtgcgacaggcgccggtgcagcaggcttgccaccgaccatgtcgaacaacagcggaatctgcacctcgccatcgaccgtttcggtcagcagcggcggttgcaagccatcatcaccgagcaactggcggatcgattcaaggtcgtccaacagatggtcgtctttttttatagggtttggtgtgtccatcatgtactcaaagtcgttgtagccggtgatcttgcagagaatagccctgttcgcggtagaaacggaaactctcccgcgcggcctgacgaatagccgggtcttccaccaccacttccgccacgcgggcaaacgccttggcaaaggccggtactttcaggtccaggttgaccagcaggtcgtggtgatcgccgcaactgtcgcccaggcccagtaccaccaggctctcgggctcggactcggcggggccgtgaggcacgaagctctcgcctttgaagcgccacaggcgggcgtcgaggtcatcacgctgggcggcatcgctgcaatgcaggtagatgcggtggcccatgcgccaggctttttcggtgagtttgcaggcaaagtccaggcgcgcagagggatcggcgctgggcaatatatagaagtcgacttgggtcattgcggttcctgagaccggagcggcacgcgggccgccccggaatcttcagtttcaggctttggcgcgatccagcaggtactgggtcagcagtggcactgggcggccggtggcgcccttgtccttgccgccgctggtccaggccgtgccggcgatgtccaggtgcgcccagttgaagttcttggcaaagcgcgacaggaagcaggccgcggtgatggtgccggctttcgggccgccgatgttggcgatgtccgcgaacgggctgtccagttgctcctggtactcgtcgaacagcggcagttgccaggcgcggtcgtcggcagccttgccggcgctgagcagttgctcgatcaattcatcgttgttgcccagcaggcccgaagtgtgggcgcccagggcaaccacgcaggcaccggtcagggtggcgatgtcgatcacggcttgtggcttgaagcgttcggcgtaggtcagcgcatcacacagcaccaggcggccttcggcgtcggtgttgaggatttcaacggtctggccgctcaaggtggtgacgatatcgcccggacgggtcgcgccgccgcttggcatgttctcggcacacgccaggatgcacaccaggttgatcggcagcttgagttccagcacggcacgcagggtgccgaacacgctggcggcgccgcccatgtcgtacttcatctcatccatgcccaggcctggcttgaggctgatgccgccggtgtcgaaggtgatgcctttgcccaccagggcgtaaggcttctcggacttcttgccgccgttgtattgcatcacgatcaggcgtggcggctggtcgctgccctggcccacggcatagaacgagcccatgcccagttccttgatcttcttctcgtccagcacttcaactttcaggcccttgaactctttgcccaatgccttggcttgctcgcccaggtaagttgggtggcagatgttcggcggcaggttgcccaggtcgcgggtgaaggacatgccgttggcgatggcggtggcgtgagtcacggcgcgctcgacttcagcctgggccgccttgatggtcagcagggtgatttttttcagggcgcgcggttcggctttctggctcttgaactggtcgaaaatgtagccgccgtccaccaggctttcggccagcaggcgggtcttgccgtagctgtcgcggccttttacgacgatttcatcgagtgccagtgctgcatcgctgccgcccaggcccttgagggtattgaggatgccactgatgatcttgcggaacgggcggtcgcccagttcggcgtccttgcccacgcccaccagcaatacgcggtcggctttgaggttaggcaggctttgcagcagcaggctttgaccgactttgccggccaggtcgccgcgcttgagcacggcgctgatggcgccaccgctgagttcatccagttgcttggcggcgacgccgagcttgcggccttcgccgacagcgaccacgagggtggcggttttcaacgtttcggggctaacgctttttacaaccaattccattttcgggtcccttataaaggtctgtgagcctgagtctgtacccaggctttaacgcgtggcagctctgtaaaccacccgcgacaaaggccgcagtttgaacctcgccagcggagcctgacaacccttggcgcatgctttgtgcgcgcgcatgaggttgcgcagtgacaggcgcggtcaatcacaggataatgcgccatctttttagccggcccgtgtaaacgggtcgacaacggtatgcttgcttgtttggccgccttagcctgacaaccctggagtgtctggtttgatcgtcttccgttatctgtcccgcgaagtcctgttgaccctgagtgccgtgagtgcggtgctgttggtcatcaccatgagtggtcgtttcgtcaaattcctggctcaggccgcttccggcgccctggatccgggctcattgttcctgatcatgggctttcggctgccgggctttttgcagctgatcctgccgcttggcctgtttctcggcattcttctggcttatggccggttgtaccttgaaagtgaaatgaccgtgctttcggccaccggcatgagccagcagcgtctgctcggcatgaccatggtgccggccgcgggcgttgccttggtggtggcctggctgagcatgagcctggcgcctcagggcgccatgcagtttcaattgctgctgaacaaacaggatgcgatgactgagttcgacaccctggagcctgggcgctttcaggcgctcaacgacggtacgcgggtgacctacacggaaaccatgaccgatgaccgtgccagcctcggcggcgtgtttatttcccagaaaaaccagggagagaaccagaaagaccgtggcatttcgattctggtggccgacagcgggcaccaggaagtgcgcccggatggcagccgttacctgatcctggaaaacggttatcgctatgacggcagccctggcctggcgaattatcgggcgatcaagtacgacacctatggcgtaatgctcgcacggccggatatcagtgaagaggtgacggaccgcgatgcgctgccgaccgcgtcgctgttcggtagccaggagctgcgctccatcgccgagctgcaatggcgtatttccctgccgctgctggtattcatcgtgaccttgatggccgtgccgctgtccagggtcaacccgcgtcagggccggttcctcaagctgttgccggccatcctgctctatatggcctacctgacattactgacgtatgcccgtggctggctggagaacggcaagacgccgcgtttgctcggcctgtggtggattcacgcgatattcctgtccattggcctggctctactttattgggaaccgttgcgcttgaagatgcagagtcgtcgcagcatgaaggagatggctcgtggttaagctcgaccgctacattggcagcagtgtactgatcgcgatcctggccgtgctgggcatcattatcggcctggcatcgctgttcgcgttggttgatgaaatgaaaagcgtcaacgacacctacaccgtatggaacgtgctgagctacgtgctcctcaccgccccacgacgcctttacgaaatgatgccgatggccgcactgatcggctgcctgatcggcctgggcagcctggccagcaacagcgaactgaccatcatgcgtgccgccggtgtgtccatcggccgtatcgtctgggcggtcatgaagcccatgctgttgctgatggtgtgcagcgtgctgatcggcgaatacgtggcgccgccgtccgaagccacggcccaggccaatcgtgccctggcccagggttcgggcgatgcgcaaagtgccaagcacggcctgtggcaccgccagggggatgagttcatccacatcaacgctgttcagcccgacggactgttgattggtgtcacgcgctacaggttcgacaaagagcgtcatatgctgtcgtccagtttcgccaaaagcgcgcagtacagtaacgaaaaatggcaactgactgacatcaccacgacttatttccgcaatgtcggccaaggtaacaaggccagcactgaagtgattaatgtgccgagcgaagagtggggtatctcgctcaagccggaattgctcaatacggtggtgatgatccccgaaagcctgccgatctccggtttgtggagctatatccattacctgaaggatcaggggctgaacaacggccgctactggctggcattttgggtgaaggtgctgcagccggtagtgaccgctgcgctggtgctgatggcgatctcgttcgtcttcggcccgctgcgttcggtgacgctcggtcagcgagtgtttaccggcgtactcgtgggctttaccttccaaatcgcccagaacctgctcggcccgttgagcctggtattcggtttttcgccgctgtttgcggtgctggtgccgacgggcatctgcgccctggccgggttctggctgttgcgccgagccggttgatgccgcgcttatgaacaaaaaatgccccggtcgagagatcggggcatttttgttctggtcagcaaagatgacgtttggcctgagcatcaggtacaattcccggctatttttcagcgggcaatctgcctgcagcctttttgagtgttgatccgtgagtgatttgagtcatatccgcaatttctccatcatcgcccacattgaccatggcaagtcgacgctggccgatcgattcatccagatgtgcggcggccttgccgagcgtgaaatggaagcccaggtcctggactccatggacctcgagcgggaacgcgggatcaccatcaaggcccacagcgttaccctgtactacaccgccaaagacggtatcaagtaccagctgaacttcattgacacccccggccacgttgacttcacctacgaagtcagccgctcgctggccgcctgtgaaggcgccttgctggtggtcgatgcgggccagggcgtagaagcccagtccgtggccaactgctacaccgcgatcgagcagggccttgaggtcatgccggtactgaacaagatcgacctgccacaggccgatccggaccgcgtcaaagaagaaatcgaaaaaatcatcggcattgacgccaccgacgccgtcgagtgcagcgccaagaccggcctgggcgtcgacgaagtgctcgagcgcctggtcaagactattcctgcgccaaccggcaactacgaagatccgctgcaagcgttgatcatcgattcctggttcgacaactacttgggcgttgtttccctggtacgtgtacgccacggccgggtgaagaagggcgacaagatcctggttaaatccaccggcaagatccacctggtggacagcgtcggcgtattcaaccccaagcacaccgccaccactgacctgaaggccggtgaagtgggcttcatcatcgccggtatcaaggacattcacggtgcgccggtcggtgacaccctgaccttgagctccacccctgacgtcgacgtgctgccgggtttcaaacgcatccagccgcaggtctacgccggcctgttcccggtcagctccgacgacttcgaagacttccgcgaagccctgcaaaagctgaccctcaacgactcgtcgttgcagtacaccccggaaagctccgacgccctgggcttcggcttccgctgcggcttcctgggcatgctgcacatggagatcatccaggagcgcctggagcgcgaatacgacctggacctgatcaccaccgcgccaacggttatttttgagctggcgctgaaaaccggtgaaacgatttacgtcgacaacccgtccaagcttccagatctgtcctccatcgaagacatgcgcgagccgatcgtgcgggccaatatcctggtgccgcaggaacacctgggcaacgtcattaccctgtgtatcgaaaagcgtggcgtacaacacgacatgttgttcctcggtacccaagtgcaagtgacctacgatttgccgatgaacgaagtggtcctggacttcttcgaccgtctcaaatccaccagtcgcggctatgcttcgctggattaccatttcgatcgttaccaatcggctaatctggtgaagctggatgtgctgatcaacggcgacaaggtcgatgccctggcgctgatcgtgcacaaggacaacgcgcactacaaaggtcgccagttgaccgaaaagatgaaagaactgattccgcgccagatgttcgacgtcgcgatccaggccgccattggcgggcagatcattgcacggacctccgtcaaggcactcagaaagaacgtactggccaaatgctacggcggtgacgtaagccgtaagcgcaagctgcttgagaagcaaaaggccggtaaaaaacgcatgaagcaagtgggcaacgtggaaattccacaggaagccttccttgcggtgctcaggttggatagttaggtcctatgtcactaaatttcccgctgttgctggttatcgccgtcgccgtttgcggcctcctggcgttgctcgatctggtgttcttcgccccgcgtcggcgggcggctatcgcctcctatcagggcagcgtcagccagcccgacgcggtggtggtcgagaagctgaacaaagagcctttgctggttgaatacggcaagtcgttcttcccggtgttgttcatcgtgctggtgctgcgttcgttcctggttgagccgtttcagattccttcggggtcgatgaaacctaccctggacgtgggcgacttcattctggtgaacaagttttcctacgggatccgcctgccggtgatcgacaagaaagtcatcccggtcggtgacccgcaacgcggcgatgtgatggtgttccgctacccaagcgacccgaacgtcaactacatcaagcgtgttgtgggcctgccgggtgacgtgattcgctacaccagcgacaagcgcctgttcatcaacggtgagtcggtggccgagcagttgatcggcgctgagccgaacaccttgggcagcgccgagctgtaccgggaaaaactcggtgcggtagagcacgaaatccgcaaggaaatgagtcgctaccgcgcgatgcccgatggcgagtggaaagtgcctgccgggcactacttcatgatgggtgacaaccgcgacaactccaacgacagccggtactgggatgaccccaatattcccaaggacctgctgggcatggttcccgacgagaacatcgtcggcaaggcctttgcggtctggatgagttggccggaacccaaactcagccacctgccgaacttctcgcgggtcgggctgatcaagtaatacaggcggcgctgtgaacacagcgccgaatgcttttctggggctcggacaatgcaccgtccggcctcatgcggcaccaaccaggatttgaatttgaacactgcgtcaatcgtcgatggccgccggtgccaccaactagatatggataaaccgtgaccgtttctctcagtcgtctcgagcgccagctcggctacaccttcaaggaccaggaattgatggtccttgccctcacacaccgcagttttgcagggcgtaataacgaacgcctggaatttctcggtgacgccattctcaactttgccgccggtgaggcgctgttcgagcgcttcccgcaagcgcgcgaaggccagctgtcacgcctgcgtgcacgcctggtgaaaggcgagaccctggccgtgctggcccgtggtttcggcctgggcgagtacctgcgcctgggttccggtgaattgaaaagcggtgggttccgtcgcgaatcgatcctggccgatgccctggaagcgttgattggtgcgatctacctggatgcaggcatggagacggccaaggagcgcgtcgttgcctggctggcgtcggagatcgaaagcctcacgctggtcgacaccaacaaagatcccaagacccgcctgcaggagtacctgcagtcgcgtggttgcgaactgccacgctacgaagtggtggatatccagggtgagccgcattgccgcgtcttcttcgtggaatgtgaaatcaccttattgaatgaaaaaagccgaggtcagggtgtgagccgtcgtattgccgaacaggtagcggcggctgcagcactgattgccctgggcgtggagaatggccatgactgattcaaccgcaacacgctgtggctatgttgccatcgtcggccgcccgaacgtgggcaagtccacgctgctgaaccacatcctcggccagaagctcgcgatcacctcgcgcaagccgcagaccacccgccacaacatgctgggcatcaagaccgaaggcgccgtgcaagcggtgtacgtcgacacgccaggcatgcacaaaggcggcgaaaaagcgctgaaccgctacatgaacaaaaccgcttcggcggcgttgaaagacgtcgacgtggtgatcttcgtggttgaccgtaccaagtggaccgacgaagaccagatggttctggagcgtgtgcagtacgttaccggcccgttgatcgtcgcgctgaacaagaccgaccgcatcgaagacaaagccgagctgatgccgcacctgacgtggctgcaggaacaattgccgaatgcccagatcatgccgatctcggcccagcacggtcacaacctggaagccctggaacgcgtgatcgccggttacctgccggagaacgagcacttcttcccggaagaccagatcaccgaccgcagcagccgttttcttgccgccgaactggtccgcgagaaaatcatgcgccagatgggcgccgagctgccgtaccagatcaccgtcgaaatcgaagagttcaagcagcagggcaaaaccctgcatatccacgccttgatcctcgtcgaacgtgacggccagaagaaaatcatcattggcgacaagggcgagcgcatcaagcgcatcggcaccgaggcgcgcaaggacatggaattgctgtttgattccaagatcatgcttaacctgtgggtgaaggttaagggtggctggtccgatgatgagcgtgcgctgcgctcactgggctacggcgacctgtaaaacaccgccagtaattctgtgtgagcaagcttgtgggggcgggcttgtgtgggagccagcttgtgtgggagctggcttgcctgcgatagcatcacctcggtacaactgaaggaccgaggtgcctgcatcgcgggcaagcccggctcccacacaagcccgctcccacattggtttatcgctgttcttaagttccgcgaagagactttcatgtcccaaaccccaccccccagccaactcgcctacgtcctgcacagccgcgcctaccgtgagaccagcgccctggtggacttcatcacgccccaaggccgcctgcgtgcggtattgcgcagcgcgcggggcaaggcaggcacgttggcacggccatttgtggccctggacgtggaatttcgtggcaagggcgagctgaaaaatgtcggccgcctggaaagcgtcggcacctccgcctggcttaacggcgaagcactcttcagcggcctctacctcaatgaactgctgatacgcctgctgcccgccgaagacccgcaccccgcggtcttcgaccactacgccgccacgctcattgccctggccgaaggccgcccgctggagccgctgctgcgcgccttcgaatggcgcctgctcgacgacctcggctacggcttcgaactgagcaacgatttgcacggcgatcccattgctgaagacggcatgtaccgtctgcaagtcgacgccggccttgagcgcgtgtacctgctgcaaccgggcctgttccagggcactgagctgctggccatgagcgaagccgactggagcgcccccggcgccttgtctgccgccaagcgcttgatgcgtcaggcgctggccgtgcacttgggtggccgcccgctggtcagtcgcgagttgtttcgaaagccctgacaaccccgtgtatgctgtgcagcgtttctttcccttttcaggagcgcttccgtgagcaccagcaatcgcattcttcttggcgtcaacatcgaccacgtcgctaccctgcgccaggcccggggcacccgttaccccgacccggtcaaggccgcgctggacgccgaagaagcgggcgccgacggtatcaccgtgcacctgcgcgaagaccgccgccacatccaggaacgcgacgtgttgctgctcaaggacgtgctgcaaacccgcatgaacttcgaaatgggcgtgaccgaagaaatgatggcgttcgccgagcgcatccgcccggcgcatatctgcctggtgccggaaacccgtcaggaactcaccaccgaaggcggcctcgacgtggccggccaggaagcgcggatcaaggctgcggtggaacgcctgtcgaagatcggcagcgaagtctcgctgttcatcgacgccgacgagcgccagatcgaagcctcacgccgtgtcggcgcgccggccatcgaactgcacaccggccgctacgccgatgccaccacgccgaccgaagtggctgatgaactgcagcgcatcatcgacggcgtcaaatgcggcctgaacgaagggctgatcgtcaacgccggccatggtttgcactaccacaacgtcgaagccgtggctgcgatcaagggcatcaacgaactcaacatcggccacgcgctggtggcgcatgcgttgttcgtcggtttcaaaggggccgtcgccgagatgaaagcgctgatcctggcggctgccaaacactaaaaaacaccctgaataacccctgtgggagctggcgtgtgtgggagctggcttgcctgcgatgcaggcgactcggtctatcaaacagaccgaagcgatgctatcgcaggcaagccggctcccacaggaaacctccagagtcttcacccgtgttttcgccatgcggcaatgcgaagccttactgtttagccgggtcaggtgtatcgtatcagccctttgcgggcctctggcctgcggcagatacgtgaggttgttgtgtcccgatccttttcccgtcgacaaatcctgggtggtcttgcaggcctggccgtagtgggcgtcggtgccggtggtgcctatcgctactggctggggaaagtcgcagaagccgaagccgggcacgattacgaactgatcgccgcaccgctggacgtagagttggtgccaggccacaaaacccaagcctgggcattcggcccgtccgcgccgggcaccgagttgcgtgtgcgccagggcgagtggctgcgggtgcgctttatcaaccacctgccggtcgccaccaccattcactggcatggcatccgcctgccgctggaaatggacggcgtgccttacgtctcacagttgccggtgttgcccggtgaatacttcgactacaaattccgcgtgcccgacgccggcagctactggtatcacccgcacgtgaacagcagcgaagaactcggccgtggcctggtcggtccgttgattatcgaagagcgcgaacccaccggtttcaaacacgagcgcaccctcagcctgaaaagctggcacgtggacgaagagggcgcatttgtcgccttcagcgtgccccgtgaagcggcgcgtggcggcacggctgggcgcctgtcgacgatcaacggcgtgtcccaggccgtgatcgatttgcctgccgggcagatcacccgcgtgcgcctgctcaacctcgacaacaccctgacctatcgcatcaacatcccaggcgtcgaagcgcagatctacgcgctggacggcaaccccatcgagccgcgcccattgggcaaggaatactggctgggcccgggcatgcgcatttgcctggcgatcaaggcgccgccagccggcgaagagctgtccatccgcaacggcccggtgcgcctgggcaccttccgttcggtggccaacactgacgcccccaacgaatggccaccggcgctgcccgccaacccgattgccgaacccgacctggccaatgcggagaaactcaacttcaatttcgagtgggtcggcacggtgtcggtggatgacggcaagccgcctagcctgtggcaaatcaacggcaaggcctgggacatcaccgacaagacctgcgccgaccgcccgattgccaagctggaaaagggcaagagctacatttttgaattgaagaacatgacccagtaccagcacccgatccacctgcacggcatgagtttcaaggtgattgcctcgaaccgccacaaggtgatcccgtatttcactgacacctacctgctgggcaagaacgagcgcgcccgcgtggcgttggtggcggataacccgggggtgtggatgttccactgccacgtgatcgaccacatggaaaccggcctgatggccgccatcgaggtggcgtgatgcgccagattcgccccgccgcgattatcgaccgcagccgcgaccaggatttcatgcgcgaagccctggccctcgccgcccagggcgccgcactcggtgaagtacccgtgggcgcggtgctggtgcacgacggtgagatcatcggtcgcggctttaactgcccgatcagcggcaacgaccccagcgcccatgccgaaatggtcgccatccgcgccgctgcgcaagcgatcagcaactaccgcctggtcggcagcacgctgtatgtgacgctggaaccctgcagcatgtgcgcgggcctgatcgtgcactcgcgtattgcacgggtggtgtatggcgcgttggaacccaaggccgggattgtgcaaagccaggggcagttttttacccaggggtttctcaaccatcgggtgttgtttgaaggcggggtgttggcggaggaatgtgggacggtgttgagtgagttcttcaaggccagaagagccaagcccccactctaaagaacactgaaaaccaatgtgggagctggcttgcctgcgatagcggtgtatcagccactgatgaattgactgacagatagctatcgcgggcaagcccgctcccacatttggatctgcatttagtcagggatatcaatcctcacttcttggcgataagcaccgcccgcatcggcgccggcagcccttcaatcgtcttgctgtgatcgtccggatcgaggaaatcactcaacgactgatacttcatccactccgtgccgcgctgttcctcaaccgtggtcacgctcacatccacacagcgcacctcactgaagcctgcacgccgtagccacagcatcaacgccggcaccgacggcaggaaccacacgttacgcatctgcgcgtagcggtcttccggcaccagcacttgctgctgatcgccttccaccaccaaggtttccaataccagctcaccgcctttgaccaggcaatctttcagcgccagcaaatgctcgatcggcgagcggcggtggtagaacacgcccatggaaaacaccgtgtcgaagccttccatgttcggcggcaaatcttcaaacgggaacggcaagtgccaggccttcggcgccgacaagtagcgctgcaccgcctggaactggcagaagaacaaccagttcgggtccacgccaatcacgctgtcggcgccggcgccgagcatgcgccacatgtaatagccgttgccgcagcccacatcgaggatgcgcttgcccttcaaatccaggtgcggcgcaacccgcgaccacttccagtccgagcgccattcggtgtccacgtgcacgccgaacaggttgaacgggcccttgcgccacgggctcaggcccatcagcgcggtgcgcatttgcgcgcgggtggcatcgtcgcaatcggtgtcgagtgtcaggccgttgagcaggtcgacgtcgctgggcaggatcttcggcaatgcgtccagggcgctctgccagcgttccaggtcgccatgacccttttccatcttgctatcgagttgcgcttgcaggccctgggcccacacagccaaaggagtaccgaccagatggcgggcgaggggggacagatcaatcatggcaaggcaatcaacgaggcaaagttaagacactggaaccacggcacgactttcgagaacccggccgccagcaggcgctcacggtgttcttcgaggctgtcgggcttcatgacgttttcgatggcgctgcgcttctgggcgatttccagttcgctgtagccgttggcgcgtttgaacgcgatgtgcaggtcggtgagcagcgcgtgttcctgcgggtcattgaaccgcagcttttccgacaggattagcgcaccgcccggcagcagtgactggcggatgcgcccgagcaacgccaggcgctcatcgggggcgataaattgcagggtgaagttcagcgccaccaccgaggccggttggaactgcagcgcgaggatatcgccctcgatcacttcaaccggtagcagctcctggaacatcgagtcctggccattgaggtattcgcggcagcgctcgaccattgccgccgagttatccaccgcgatcacccggcaaccgtcggtgcgcacgtgacgccgcagggcttgggtgactgcgcccagcgaagaacccaagtcgtagagcacgctgttgggttgcgcgaactgcgcggccagcacaccgaggttctcgacaatggtcgggtaaccgggcaccgagcgcttgatcatgtccgggaacacccgcaccacgtcctcgttaaaggcgaagtccggcacctggggcaggggctgggcgaataggcgatcgggttctttgctcacggttgttccggcgacgagggggaaagcccggcattttagccaaattgatcctcgtgtgcgcgggttaaaggctaggcagtcatagtgcggtgtctactatgtagtgaatgttgatttgcccttttaacaaaatggaagtgccggagccttttggatggtcctctttggcatcgatttcgtactcggcgacaatctgttgggtgctgtggtttacggtaataatctccagcttcagggttctcgggctgtagtgtgtatcgatgaggccggcatcaatgactacccatttgcttacgtcgggtacttctacgttgtactgcttctctttgatattgcctggcagccggaactcaataccttttacctgctgctcaagctctgcatactcgcctgaaattctaatgccgtggggtcctgtaaaggcattggcatattcgaagtcacgtggtttcgccccgttgatgcccatgctaaatacgttggtcgtatcagatgttgtgctcatgtcgagtatcccgatagtgcgacaaacccacccggctatcgcttgcgagaaactgtatgttttttaatcgagcggattaactgtcataagtgacagttctttagacctgattttgctgttaagcccgatgcttattgcctaatcctttattacactcgcgattgaggcgattgtgagaacgccgacgcggtaatcccccactggcccaaccagtaagtggtgatcaacaaatacggcgccgcttcaaatgacaccacaaaccggttgatcccaatcaaggtgtcggaaaacacaaacgacaccgcacccgccgccgccaacagcgccgactgtttcggcacctcactgcccagtcgcgccaatgcgcgccagagcatggcgctgatcaccagcgcatacaccaccaccggaatcagcaagtcgcccaagccgtgggaaatcaggatgctcaacaggatcgcgcccacgcccagtgccaataccagcggcaacaccgccatgcgcctgcagtcgctgaaataggctttcaagtacgccaggtgcgcgagcaggaaggcgccgaggccaaagataaacaggtcgcccggccaggcgagcaatacgtcgccgaccagggaaaaaatcagccccaggctgatccagcgtcgatagtcggtgggcggcgcatcatgcagccagcccagcaatgccagcaccggcagcggcttgaccaacaggcacaacaaggtggcatgggtggtcaggccgtagataaaggtgccggcgcccatcaacgcaagaatcagccaaggcatatcagttcaccgtaatggcgcagtcgaaggtttcggcaggttcggcttccggttcccacggttgttgcgacgtcaggcgcaaacggccctggccggccgcgaaggcctggaagcgccaagtggattggccgccaccgccgatcacgccggattctgcgctgctgtagacctcggggctcagcgcacgcagcacgccgccggcggaatcctggatggcccagcggtagccggtggtggggttgcttggcagggtgaggatcaggttttgcccggttttaagctgaagcgggcaggcgctctggttttccacggtgacgttttgcttgggggcactggcgcaggcgcccagcagggcaaggctcaaggggagaagcaggcgggcagcggtcatggaggctcctttgtatggcgacgaagggcgagcataaccgaagatgagacaaggtgtgacagagagctgatcgttcccacgctccgcgtgggaatgcagccagggacgctctgcgtcccagcagcggacgcagagcgtccagagaggcgttcccacgcagagcgtgggaacgatcaaatcagatcagaacagcaccttcgccacatccgcaaaacgcttggcaaagtgcaccgtcatgccttccttgaggtactccggcaactcttcaaaactgccacggttcggctccggcagaatcaactcgtgaatcttctgacgccgcgccgcgatgaccttctcacgcacgccgccaatcggcagcacatgcccggtcagcgtcagctcgccggtcatggccacgccttttttcggcggctggttgcgcgccagcgacagcagcgcactggccatggtcacgcccgcactcgggccgtctttgggcgtagcgccttcgggtacgtgcaagtgcacgaaggcttcatcgaagaacttcggatcgccgccaaacgacttcagattcgagctgatgtagctgtaggcaatctcggcggactctttcatcacttcacccaactgcccggtgagcttgaagccgcgattgagcgtgtggatgcgcgtcgcctcaatcggcaaggtcgcgccgcccatgctggtccaggccaggccggtgatcacgccggtgccggacagcacttgctcattgcggaacaccggcatgcccagggagctttccaggtctttgttgccaatcttgatcaccgagtccggctcgtccaacagcttgaccacggctttgcgcaccagtttgcccagctgtttctccagctggcgcaccccggcttcccgcgcataaccgtcgatcagtgcgcgcagggcgccgtcgctgatgctcaggctgttttttgacacaccggctttttccagttgcttcggccacaggtgacgcttggcgatggcgactttttcctcggtgatatagcccgacaggcgaatcacttccatccggtccagcaacgggccggggatcgaatccaacgtgttggcggtgcacacgaacagcactttggacaggtccaggcgcaggtccaggtagtggtcgaggaattcgacgttctgttccgggtcgagggtttccagcaaagccgaagccgggtcgccctggaagctctggcccatcttgtcgatttcatcgagcatgatcaccgggttcatcacttccacatctttaagcgcctgcaccagcttgccgggcagggcgccgatgtaggtgcggcgatggcccttgatctcggcctcgtcgcgcatgccgccgacgctgaagcggtagaacggccggcccagggactcggcgatggatttgccgacactggtcttgcccacgcccggcgggccgaccagcagcacgatggaaccggcgacttcgcctttataagcgcccaccgcgaggaactcgaggatgcggctcttgatgtcatccaggcccgcatggtgtttatccagcaccttgcgcgcgtgtttcaggtcgagcttgtcttcgccatacacgccccacggcacggaggtcgcccagtccaggtagttgcgggtcacggcgtattccggcgagcccgtttccaggatcgacagcttgttcatttcttcgccgatgcgcttttgcgcctgggcgggcagcactttgcccaccaggcgttgctcgaactgctcgacgtcggcgctgcgatcgtccttggtcaaacccagctcctgctggatgaccttgagctgttccttgaggaagaattcacgctggtgctcgccgatcttgcggttcacttcggcggagagttctttttgcaggcgcgcaacttcgacttccttgcgcagcattggcagcactttttccatgcgcttgagcatgggcacgcagtccagcacttcctgcaactcgttaccggtggccgaggtcaacgcggcggcgaagtcggtgagcggtgacgggtcgttggggctgaagcggttgaggtaattcttcaactcttcgctgtacagcgggttgaggggcagcagttccttgatcgcattgatcagcgccatgccgtaggccttgacctcgtcggtcggctgggttggctggtgcgggtattcgacttccaccaggtacggtgggcggtggtgcttgagccaggtcttgatgcgcacgcgggtcaggccctgggcgacgaattgcagcttgccgttctcgcggctggcgtggtgcaccttcaccagcgtgccgtacagcggcaggctggaagtgtcgaagtggcgcgggtcttccggcggcgtgtccatgaagaacagggccagggagtggtggtcggatttgctcaccagttccagggtctcggcccacggttcttcattgacgatcaccggcagcacttgcgccgggaagaacggccgattgtggatcggaatgatgtagaccttgtccggcaggttttgccccggcagggccaggccggtgttggacgaagcgtcatgttcagcgttttcggggtcagcgtaatcgttcaagtcgatgtccgggaattcttgctggtcgctcatggggcacctgcataaggaagtatgcaggttagatggggcgggtcggcggtggtttcaatggcgggggagagatagcaacatattgcataatattttcaagaatgccgctttcccctgtgggagctggcttgcctgcgatagcggtggatcagctgcctgatgtgccaactgacacaccgctatcgcaggcaagccagctcccacattttgtactgcataaagtcagctgattttgtggaggtaggccggcagcggctgttccggcagtaccgacaacactttcaaccgctgcagcatccgctggcgtgcgcgctgcaaatgctcacgcagattcaacgctgccgcatcaaaggcgccgtgcagcaacagctcaagaatcaggcgatgttcggcgagcatggtcggatcggcgccgattcccagtaaacggtaaaaaatccggctgatgatcatcgggctctggccctggcgaatcagcgcggcaatcttgcggttttgcaggccggccaggcagtgctggtgcaagtcctcttcgatctgctcgatggcttccagactgcattgcggatttgcctgggccgccaacacgcgttgcaacatggcttcgagcatgtcgcggtcgaggttcggcgcgctctggcgcagggcttcgggttccaggcaggcgcgcagttcgtagtcttcggtcacttcgcgggcggtcagcggcccggccagccattgtgagtacggctctttttccaccaggccgcgatcgcgcaagcgcatcagcgcttcacgcaccacggcgcggctgacaccgtagtggtcggcggcggcttgctcgtccaggcggtaatggccgaaggcgatgcaggtggacagcgccgcaccgatttcctcgacgatgcgttcgcccagcgggcgcgtgtcgaccaactcgtcgtcgccattgaggcccaggtgcgcgtggctcaggggcaggcgcagaggctccatggccaggccttcggggttgatcaggtaaccgcggccgttgaaacggcagatcaggccctcgtcatgcagcaggtccaaggccttgcgcaccggcacgcggctggtgccgaacaattcggccagcggcgcttcgagcaagaccagcccgtggcgcgcggtgccgttgacgatcgcgtcacgcaacacctggtgaatcatcgcgtaacgggaggccgaggcggacactgctttcatcgcattctctgacgtaaaaagtactaagtggtgtaggacgtaggccggggattctctcatagatgcacctgtcactctgcgccacgtcagcggccctttttggggccttgcacatcacactgttacttttatgcaccaaaatgtacttattaataaaagatacattatttcattcggggtcacccccaataccggcatcgcattattttgcttcctgcaaaaccatctagcccgtaggtccggacgataaaccctgtccgcagaaaaacggctgtaaagagactggcacgaaagctgcctttataaaacgtacattttattaatatatacgttttgtgaggaccgtcctgatgtcagatgccacatcaatggccgaggctttcgccaggggtcgcagcgacccggtgcaagtgctcgaacaggctctgctccacgcgagcatggccccgagcgtatttatttccctgaccgccgagcgcgcccgtcgtgaggccgaagcctccgccgcccgctggcgtgccggccagcccttgagcgtgttcgatggcgtgcccttggcctggaaagacctgttcgacctggccggcagcatcaccacagcgggtgccgcctaccgtcgcgaggcacccgccgccttgctcgacgcaccgagcgtggggttgctgtgccgcgccgggatggtcagcgtaggcaaaaccaacctcagtgagttggcctattccggcctgggcttgaacccgcatttcggcacgccccaaaaccccggcagcggcgatcaaccgcgtattcccggaggctcatcgtcggggtcgggcgtggccgtggcggccgggatcgtgccgatcgccatgggcaccgacaccgccggctcgatccgtattcccgccgcgctgaatggcgtggtcggctaccgcagcagttgccgacgctacagccgcgacggcgtgttcccgctggcgcacaccctcgacagcctcggcccactgacccgcagcgtgcgcgacgcgctggccatcgacgatttgcttaacggccgcagccaaacccatagcccgcgcagcctcaagggccagcgctttgtgcttgagcaaggcgcactcgaagacatagagcctggcgtacgcaataacctgctgcgctcggtggaccaactcaaggccgcaggcgcgctgatcgaggtgcgcccgtcagcgaccttccaggccacgctcaacctgatcaagcaggacggctggctcggttcattcgaagccttcgcgctgcacgaagccctgctcgacagccctgaggccgaacaactcgacccacgcgtacgccgccgccttgaagctgcgcgctcattgcccgccagccaattgctccacctgatcgacgcgcgccgccgcctgcaattgcaactggtcgacgaactcgagggcgccgtgctgattaccccgaccgttgcccatgtcgccccgctgttggcgccgcttgaagccgacgacgatctgtttgtgaaaaccaacctcgccaccctgcgcctgaccatgcccggcagtttgctcgacatgccgggcgtcagtttgcccagcggccgcgatgcccagggcctgcccaccgggttgctgctcagcgtcccgacgggcgaagacgcacgcctgttgcgcacggcgttgtccgtcgaatccgtaatgactatttaaggagacacaccatggctaaagacattctctgtgcgtttggcgtcgacgttgacgccgtcgccggctggctcggttcctacggcggcgaagactcgccggacgacatttcccgtggcctgttcgccggtgaaatcggcgcgccacgcctgctcaagttgttcgagcgctacggcctgcgcaccacctggtttatccctggccactcgatggaaacctttcccgagcagatgaaagcggtggccgacgccgggcatgaaatcggcgtgcacggctacagccacgaaaaccccattgcgatgacggccgaacaggaagaaatcgtcctcgataaatccatcgaactgatcacccaggtcaccggcaaacgcccgaccggctacgtcgcgccctggtgggaattcagcaaggtcaccaacgagctgctgctgaaaaaaggcatcaagtacgaccacagcttgatgcacaacgacttccacccgtactacgtgcgcaagggcgacagctggaccaagatcgactacagccagcaccccgacacctggatgaaacccttggtgcgcggcgaagaaaccgacttggtggagatcccggccaactggtacctcgatgacctgccgccgatgatgttcatcaaaaaagcccccaacagccacggtttcgtcaacccgcgtcacctcgaagaaatgtggcgcgaccagttcgactgggtctaccgcgagcacgagcacgcggtgttcaccatgaccattcaccctgacgtgtccggtcgcccgcaagtgctgttgatgctcgagcgcttgatcgaacacatccagagccatgccggcgtgcgcttcgtcaccttcgacgaaatcgccgacgactttatccgccgccaaccgcgttcctgacccttagcccacacccccgaggcgcgatttatgtccatctacaacaagcttgacctgactggctggaaaccccggcaactgacgtcccaggaagtacgcttcgccacctggatcgcgtttttcgcctgggtgtttgcggtgtatgacttcatcctcttcggcaccttgctgccggagatcggccgccacttcggctggggtgaagtggagcaagctgaaatcgcgacctgggtggcggtgggcacggcagtggtggcttttgcgattggcccggtcgtcgataagttggggcggcgcaaaggcattattttcaccgtggccggttctgcgctgtgttcggcactcaccgcgattggcggggcgtggggcaagtcaccgttgattctgatccgttcgttgggcggccttggctatgccgaggaaaccgtcaacgccacctatttgagcgagctgtatggcgcctccgaagacccgcgactgaccaaacgtcgcgggtttatctacagcctggtgcagggcggctggccggtcggtgcgttaatcgccgccgggttgaccgcattgttgttgccgatcatcggctggcagggctgctttatcttcgcggcgatccccgcgattgtgattgcaatcatggcgcgcaagctcaaggagagcccgcagttccagattcaccagcgcatcagtgagctgcgtaaaagcggtgcggtgaaagacgcgcaaaacgtcgccgtgacctacggcgtggactatgacgagcacagcaaggccggcctcaaagccgccttccgcggcccggcccgccgcgccacgctggtgatcggtgctgcgctgttgctcaactgggcggcgatccaggtgttcagcgtgctgggcacttcggtgatcgtcagcgtgcaccacatctcgttcgagaactcgttgatcatcctcgtgctgtcgaacctggtgggttactgcggctacctgacccacggttggatgggcgacaagatcggccgtcgcaacgtgattggcctgggctggatgctcggcggcctggcgtttgccggcatgctgtttggtccgagcaatatgccgatggtggtgggcctgtacagcctgggcctgttcttcctgatcgggccgtactcggcggcgctgttctttatcagcgaaagtttccccaccagcatccgcgccaccggtggcgcgatcatccatgccatgggcccgattggggcggtggtggcaggttttggcgccacccaagtgttgtccgccggcagtgactggcagaccgccgcgctgtggttcggcgcgctgccgtgcttcttgtccggcgcgttgatgtttgccgcccgccatgtgcgcccggaaaccgttcagtaaggagtgtgtgatgagccgtaaagttgccttgattaccggtgccgccagcggcatcggccaagccctcgccgtggcgtacgcacgcagcggcgtggcggtggtgggcgggtattacccggccgacccgcatgacccgcacaccaccgtggccttggtggaagaggcgggcggcgagtgcctgatgttgccactggacgtcggcaacagcgcctcggtggacgcgttggccgaacaggccgtgcagcatttcggccgcctggattatgcggtggccaacgcgggtttattgcgccgcgcaccgttactggaaatgaccgatgaggcgtggaacgagatgctcaatgtcgacctcacgggggtgatgcgcaccttccgtgcggcgacccggcatatgaatgaaggcggcgcgctggtggcgatttcgtcgattgccggtggcgtgtacggctggcaggagcacagccactacgcggcggccaaagccggcgtgccggggctgtgccgttcattggcggtggagttggcgccgttggggattcgttgcaatgcggtgattccggggttgatcgagacgccgcagtcgttggatgcggagaattcgttggggccggaaggcctggcgaaagccgcgcgggcgattccgttgggccgggtagggcgggccgatgaagtggcgtcgctggtgcagtttttgaccagtgaggcgtcgagttatctgactggccaaagcatcgtcatcgacggtggtttaaccgtgcgctggcccgactgactgtacgcggttaaaaaaatgtgggagctggcttgcctgcgatagcggtgtttcagccccacatgtactgactgatccgccgctatcgcaggcaagccagctcccacgggggccgtgtttgtttaaggagattttgtatgtcccaactcgttaaccgccgtgccgtcatcaccggcgccggcagcggcattggtgctgccatcgctcgcgcctatgccgccgaaggcgcgcgcctgctgttggccgaccgcaatgccgccagccttgccgaaaccgccatcacctgccgcaacctcggtgccgaggtgtttgaatgcctggcggatgtcggcacggtcgaaggtgcccaggccagtgtcgaccgctgcgtcgagcactttggcggtatcgatattctggtcaacaacgccggcatgctcacccaggcgcgttgcgtcgacctgtccatcgagatgtggaacgacatgttgcgtgtcgacctcaccagcgtgttcgtcgccagccagcgcgccttgccgcatatgctggcgcagcgctgggggcggatcatcaatgtcgcctcgcaactgggcatcaagggcggcgccgagctgacccattacgctgcggccaaggccggggtgattggcttcaccaagtcgctggcgctggaagtggccaaggacaatgtgctggtcaacgccatcgcgccaggccctatcgaaacgccgctggtgggcggcatcagcgaggactggaaacgcgccaaggctgccgaattgcccttgggccgcttcggcctggccgatgaggtggcgcccaccgccgtgctgctcgccagcgagccgggtggcaacttgttcgtcggccagaccctgggcccgaactccggcgatgtcatgccatgagtgaggtgtagccatgtgcggactctgcggtttgctcggcgaagacctgcactggagcgaccccttgggcgatgaactgcctcggcgccgcgagcgcctgcgccggatcgcggcgatcaaccaggtactggcggtgtttcggctcaaggtcgaggactttcaaggcgcgtcgtatctgctgttgggcgccaccggcaagcaggcattggcgagcggtttggatcaactctggctggaggcggaaagcatgctcgggcgcccgctggacccactcgatccgcgcttgcttgatcacttggagtcatcatgagcattgccctcaacgtcatcaccggcttcctcggcagtggcaaaaccaccttgctcaagcgcctgctgcacggcgaaagcctcggcgacaccgcgctgctgatcaacgagttcggcgatgtcggtatcgatcacctgctggtggaagaagtggcgccggacaccgtgctgctgcccagcggctgtgtctgttgctcgattcgtggcgaactcaaagacgcgctgctcggcctgttgcagcggcgtgagcgcggcgaaatcccggcgttcaaacgggtaatcctggagaccactggcctggcggatccggcgccgatcctcgccaccctgaacaacgacgtgcaactgcgcgggcgttttcatattggcttggtgattaccctggtcgacgccagccacgccacgctgcaggagcgtttgcacccggaatggctggcccaggtggcggcggctgaccgcttgttgctgagcaagactgacctggccggcgacagtgcagccctgcgcgcgcacttgcaggcactcaacgccggcacgccgatcctcaataccgatgagattcacagtggcgatcaattgctcctcggtgaaggtttgcgcagcgccgaacccgccgtcgaagtcagccgctggcaactgcaccaaaccaccaccgctacccacggcgcggcgcaggtgtgctgcctgagcttcgaccagccgctggactgggtgggtttcggggtgtggttgtcgatgctgttaagatgccacggcgaacgaatccttcgcgtcaaaggactgctcaacgtgaacgcaagcctggcccccatcgtcattcatggcgtgcagcactgcctgcatgccccggtgcacttgcccgcgtggccgggcaccgaccgccagtcgcggctggtgtttatcctgcggggcctcgacccggcgctgctgcggcgctctttcgaggtgttctcccggcggttcgccgcatgatcacattgcgcgtgctgggtacgtccgtgaccttgctggaatgtttgcgcgtgcgcgctgagcaagagttggggattcgcctggtgtatcaggtgcacgatgtggcgcaggcccagcgcatcgccgtaatgcagccggaaagctacgacctgtatgaccagtggttccacaacgttgacttcgtgtggccggcgcgggcgatccagcctatcgacacgcggcgcattgcgctgtggcacgagatcaacgacctgcccaaacgcgggcggctgtcggccaatgaccggctgggcagcggcagtgtgcccagcgagcgcttgtttgtgcagcacgacggcagcctcggcagcacggtgaccgagcgcatcagcatgttgccgctgacccacaatgccgacagttttgcctaccgccccgagcggttgcccgaaggcttcagccacggcaatgaaagctggggctggctgctcgacccggcgtggcgcgcgcgcaccgcgctgcaaagtgatgccgcgattggtgcgctggatgccgcgctggcggtgcagggcgcggggctggcgcagttcggggacgtcggcaatatgagcatcgaagaaatcgacgtgctcgccgacattctggtccgcaagcaaaaggaagggcactttgcggcgttctggtcggatgatgaagaggcggcgcagttgatgctcagcccgagcattgatatccagagtttgtggtcgccgaccttgatgcgcttgcaccgggccggggtgaagtaccggctggcggtgccccgcgaaggctatcgcgcgtggtttggtggcttgtcattgtcgcgccatgcccaggggccggtgttggatgcggcgtatgcgtatctgaattggtggttgtcggggtggccgggggcggtgatggcgcgccagggctattacatcggcaacccggcgcgtacgcgggatcatttgagcagtgccgagtgggattattggtatgcggggttgcctgctcgggaagagctgcttggcagtgatgggttgccgttgattgatatcggtgaggtgcgcgatgggggctcgtatgagcagcgcatgggcaacatcgccgtatggaattcggtcatggacgagcacaattacctggtgcggcgttggggtgatttcatgcgggctcgcagtacttgatcgaataaacctggggggcgcgacagacgcggcggcgtctgtcgtgcccgccggttatagcgacagtgttacggcgaaccgaggatcgagcagggttttgttgcccgcacgttattccagccacatttcagaaagtcacggcacaggtcgaccaccagcgcgctgtcccgggcattgataggcgaatccccgtttacatcctcattgatggcgacatgccggccggcaacgtcattcagaaagacacaggcggcggcccgcaccagggtctcgtcgctcggcgcgccttctccttgatgaaacctcagccggaccagatccggcttgccatccaggtcgaggtcttcggcatagatttccaggtaacggtcgaaggggcgatcaaccttccaccacttgaactgcagaaacctcctcgccagcgaccgcgccaaatcgccatcgacctcatcgttgaccccgttgccgttgatgtcgtcagccagcacccacttcaggctgccacggtcttgttccgctgtgctcatgaccaacgcctcagcgaccgccttggggttcacgccatcaaaaaactccaggtaaacggcatcgataacgtcattgtcgtagtcatcctgagccgtgatcttcaaataacgcatggcaacttccttgaaaaaaagagcgtcgatgttttcactccctcagtgaggacgccatggacgccatcggacgctaggtgtgggaaagccgcagttgataagtgtgacgtttcgagcatcagtcatttcctggtcgtcaataaagtgacgttgtgactgcagtatttactgggtttacttatccccgcgcccagctaatctgctaacaccaataacgcgataaaaatggatgtttttttgacgccaggtggcagccgccgggaatgcgtatgaaaaagggacgaatcggcaaagaacggcgaacgctgccagagggcacggccatgaagtggcgccacaccttccaaacccgtattgccggggtgttggcgctgttgctgctggtggtcgtggccgccacttactttgccgtccaggctgccaccacgcgtgccgtggaaaaccaggcccaggtgcaactcaccaccggcagccaagtgttcgaacgcttattggacctgcgcgggcgccgcctgcaatatggcctggattggctgactgccgatggccccttcaaacaggcggtgatcgagagcaaggatgaatcgattctgaccgcgctgcgtcggcatggcactggcctgcaaggcagcgaagtgtttgtgctgggcctggatggcaaggtgatggtcagcaccttgcccgtgctgacacacggccaaccctttccctatgagattgccttgcgccatgcgcggcgcagtggccagcaaatgctcattgtcgccctggacggccagccttatttgctggtgcagaatgacgtgctcgacccggagcctatcgcccgtgtggtcatgggtttcccgatggacaaactgttcgccaacgaactgcgttccatgagcaacctcgaagtgtcgtttctcagcgtgcaggacggccgcgtcggcgagctgttcagcacccagccagaggcgtatcgggcctcgattatcgaaacactgcaccaggcgcacctcaaccctgaggcgcaaatcacgctgttccaagggcaacgcgtgctcagccaggtattgccgctggccaacaccggcgatggcgatgaggtgcgcgtgttgctgcaaagcccgctcgaccacgcgctggagtcctttgcgccgttggaccggcagtttctcgggattgccttggcggtgctgctggtgtcgctggcgggcgcattgttcctggcgcggcgcgtctcgcgtccgctgaatgccttggttcaggccgccgagcgaattggtgccggtgactatcacacgccggtgcgagtccgcagccacgacgagttcggcttgttggcccgtgcgttcaatgccatgcaaagcgggattgccatgcgcgagcggcaattggcccataacgctttgcatgacccgcttaccggcttgcccaaccgcgccctggccatggagcgcctgggcagcgcgatcagtgcgcgcaggcctgtggtgttgctgtacctggggattgaaaactaccgggtgatcaacgaaggctttgggccccagggcgttgaggaaatgctgcgcgaggccagtcgatgcttgtccatgagcctgttggccagcgacaccgcagcgcgcatcgccggcagtgagtttctgctgttgctggaaaacaccgagatcgaccgcgccgtggcccgcgccgaccgtctttacgggctgctcaccgaaccccagcgcatcggcaacgacgaagtgcgccatgaagtcagtatcggcattgccgcttatcccgccgacggccagcaggtcgaagaactgctcagccgcgcggcgattgctcggcatgatgcggcgagcctgcccgggcatatgcaggtctatcaacaagaccgcgacctggcgcaccagcgccagatcaccctgatccgcgacttgcgccgtgcggtggtcgagggcgaattgttcctgtgctatcagcccaaactcgacctcattcacggccatgtacgccaggccgaagccttgctgcgctggcagcattcgaccctgggccaggtgtcacccgccgagttcattcccttggccgagcgcaccggcagcatgagtggcctcacgctgtgggtgatcgaagaagccatccgccagatcgccgaatgggcgcagcgcggcttgcccatgcagctctcggtgaatatttcggtggacgatttggccgatgatgacctggccattcgcgtcaccgcgttgctcatgcaataccaggtctcggccgagcagctgattttcgagattaccgaaagcgcgatcatgcacaacccgcaacaggcgctgagtgtgctggaacaactgcgcgcatgcggcatcagcttgtcggtggacgactttggcactggctattcatccctggcgcaactgcagcgtttgccggtgcaggagttgaagatcgaccagtcatttatacgcaacctcgacagtgccagcggcgacggcgtgatcgtgcggtcgaccatcgaaatgagccacaacctggggcttaaagtggtggcggagggcgtggagttcgagcccagcctggagctgctcaaagagtggaagtgcgacacggcccagggtcacctgatcagccggccgttgaatgccatggcgttcgagcggtggatgcggcgtgagcgagttgccttgtaaacccactcgcctgaacccccggcgagctattgtggcgagcgggcttgccccgcgttggagtgcgtagcgctcccaagtcagccgccgcggtgttacaggtaaatcgcggcgtcaggttttggggctgctgcgcagcccaacgcggggcaagcccgctcgccacaacaggccagctcccacattgagtaaatgcggggcacaaaaaaagcggctacccatcaggtagccgcctttgttttaccgccggttaacacttagtccggcagtttgaacgccatcacatagtcaccctgcttggtgcccagcgagccgtgaccgccggccatgaccagcacgtactgcttgccgtccttgccggtgtaggtcatcggtgtggtttgcgcgcctgcaggcagacggccttcccacagctgcttgccgtttttcacgtcataggcgcgcaggtactggtcgagggtgccgctgaggaaggacacgccaccagcggtggtgaatgtaccgcccaggctaggcacgcccatggtcagcgggattgggaccggcgagctgtcgcgcacggtgccgttcttgtgcatccagatggtctggtggttggtcaggtcgactgcggccacataaccccacgccggcgcctggcacggcaggcccagaggcgacagcaatgcttcgaggatcacgccgtacggcgcgcctttgtttggctgcacgccttcggtttcgctgacacgtgggccttgcttggcgatgtcggcggccgggatcagtttcgatttgaacgccatgtagctcgggttcacgaaagcaatctggcgcaccgggtcgacggaaatgccaccccagtcgaacacgccgaagttacctgggtaaacgatcgaaccttgcagcgatggcggggtgaacggaccgtcgtagcgcatggatttgaaatcgatccggcacagcatctggtcgaacggggtcacgccccacatgtcgcgttctttcaacggcggcggcatgaagttcaggtcggacttcggttgggttggcgaggtgtgatcaccggccactgcgccttgcggtacagggatttcgttgatcggcaccaccggcttgccgttgctgcggtccagcacgtagatgctgccttgcttggtcgatgccattaccgcttgcttgacgccgtcagcggtcttgatgtcgatcagcgaaggctggccgcccacgtccatgtcccacaggtcgtggtgagtgaactggaaggtccacttcacgtggccgctgtcgatgtccagggcggtcaggccggcgctgtatttttccgagtcttcggtacggtcgccgccgtattggtcgggcatctggttgcccatcggcaggtagagcatgccgagtttttcatcgacgctgaacatggaccacatgttcggcgagttgcgggtgtaggtcttgccctcggccaacggggtagtgtcgtccgggttgccgctgtcccagttccacaccagtttgccggtgtgcacgtcgaacgcgcggatcacgccgctaggctcgtcggtggaaacgttgtcggtcacgtgaccgccgatcacgaccaggttcttggtcacggccggtggcgaggtggagtagtaaccgcctggggcgaagctgccgatgttggcgcgcaggtcgacctggcctttgtcaccgaagtcttcgcacatcttgccggtgtcggcgtccagggcgatcagacgggtgtcggcagtcggtacgaaaatgcgtttcgggcaaacggcactgaccggagcagcgctggcgctgccggttgggctctgctcggaagcgtacacggcgtcatcgtgatacgacacgccacggcaggtcatgtgcgcccaacctttgaagttcgcggcaccttcggtgctgatcttcgggtcgaaacgccagatttccttgccggtgtccgggtccagggcaatcacctggctgtgcggcgtgcacacgtagagcatgccgttgactttcagcggggtgttttccgcggtggtttcaccgggatcgcctgggccagggatgtcgccggtacggaaggtccacgccggcaccagcttgtgggcgttttccggggtgatctgcgccagcggcgagtaacgatcaccgaaagccgaacggccgtaggaattccagtcgccatcggcctgggtcggcgcggcgctggtcatgccaggtacggcgtcgcggtccaattggccggtcttgaccatctcacccgggttggtgaattggctggccagggcggtagcaccggcaagcaccacggccacgctcagggcgccagtgcccagcggcgcgggttggccacgcagcaacggacggcgaaaccacggcagcaacaggacgatgcccaaggcgaacagcagggccaggcgcggcaccagctgccaccaatccaggccgacttcccacagtgcccacacggtgctggcgaacaacaccagtgcgtacaggcccagcgcagcgcggcgggtggccagcagcaaaacgccggtgagggcgatgccgataccggccagcaggtagtacagcgacccgccgagcatgctcagcttgacgccgccggccagcaaggccagccccatgatcagcagcaagacgcctagcagcctgggcagtaggcggcttgggcttgaagcaccatcagtgctcatagtgtgtttctccgtgacgttggaattatgtaaccccgtgcttcactgtagatgacgattcggcgcgggcttggttcagcgttatttgggtttttctggggaaagtgcggctatccaccggcgggcgatttattcccaggcgcaggtcggtgtaagacagcgctgtctttgaagagaggtgcgtttggcaagatgggatcgaccgcgggcgtgaaacgtttcagtttgttgcggcaaggataaagcgctgatgcgccaagagaaagcgcaaatcgcaagatgcatcatttcagatttggtaacagtgacagaacgtcgcgcgacagatcgttcccacgctctgcgtgggaacgtcttttgtgacgctctgcgtcacggtttacagggcggacgcggagcgtccagggcggcattcccacgcggagcgtgggaacgatcagtacagagtcagaaggtagtgcgcacaccaaattgcacactgcgccccggtgccggggcgatatcgcgcaggatcgagctggcataccgcacggtttggttggtcaggttttcgccattgacgaacgccagccactggctgccgccgacattgaagcgataacccgcgctggcgcccaaggtggtgtagccatcggtgccgctttcgttatccggcacacgcccctggcccgccgcgtgttccacatcgatacgcgcctgccagcggtccagttcccagagcaaaccgctgttcaaccgcagtggagcgatgcgtggcaaggcttcgccggtatccagattggtagcgcgggtgtagtcgcccgacagctccagggcgaacttgccgtaggcgccttcgccgagcttccagtgatcctgggcttcaaaccctgcgaaacgtgcgcgcacgccggagtaggtgtactcggggatgccgcctgcgtcctcttcaccttcatcgttgagcgtacgaccggtgcccaacaagccgatgtaattggagaagcggctgtagaacacgccgaagctgcccttgtgggtgccattgtcaaagcgcaacgccaggtcgctggacacggctttttctttcttcaggttggcgtcgcccagctcgtaagtgccggtggccacgtgggcgccgttggcatacagctcgtagaaggtcggtgcgcgctcggtgtagcccaaggtcgcggccagcgaccagatgggcgtgagggtgtacaccgcgcctgacgacaggctgccggcggtgaaatcgttggttttgtcggcattcgcaaaacgcgcgttgcccttggcatccgggtcgacactcgtgtgttccaggcgcccgccgaggctgagcttcaggcgttcggtggcctgcatttcctcgaggataaacagcgcgccggcgttggtgtcggtctgcggcacgaaggcttcttcacccagggccgaaaactcgttgcgggtcacctgcgcgccgaccacgccgtcgaacgggccgatgggctggtggcgcgcttcaacacgcgcctcgtaacccttgttcttgaacaccgtgccggtttcgccgccttcaatttcgcggtgctcgtagtcggtgtagccggcgtcgagtttcaccgaggtaaacgggccttgcaggttgcggatctcggacgcaaaggcgtagtgatcctgcttcatgcggatgcgcacatcctgctcggcgggtgaaccgtaattggcgtcgtagttgctgtaggacagcccggcgtaaccgtcgtcccaagtgtaggaaccgccgacggcgccgccgtcctggcgcccgtcgctattgcccaggcggccattcttgccggcgccgtcttcggtggcgggggcgtggcggctgcgtgcaaagcctgggattttcaggtcattgaattcccgcgcattcgcgtccaggtgcaaggcgaaggtgccgttgccggcttccagtttgccggcgctgctgcgggtggtgtcggcgccgccgtagcgcaattcaccggcaccgtgaatgccttcgatggcttcggtggggatgcggttatcaaaggtgttgaccacgccgccgatggcgctgccgccatacaacaacgcagccgggccccttacgatctcaacgcgctcgacattgaccgggtccagcggcaccgcgtggtcgtaggacagcgacgacgcatccagcgcgcccacaccgttgcgcaggatgcgaatgcggtcgccatcctggccacgaataatgggccggctggcacccgggccaaagtacgacgacgacacacccggctgcttgttcagggtttcgccgaggctgcctttttgttgcagcgtgaggtcatcgccttccagcacagtcgtcggcgaggcgagttgttcactgcccagcgggttgccggtgatgacttggggctgcagctcaagggcgtgggcttcggagcagatcagcaaggcggcggcgagcggggtcaagcgccacagagaagagagggacatcgggacattccttggcaaaacggcagaaaaaagagaaggcttaaaacggtatcgaatcagttacttttgataagtatcgttacaatataacatctcccttttcgctgaaaaggggaacttttccacaagggctatattcaatgcagtgcttccaccggtacgccccgtcggctaaggtgcgcggctgtgtttcctctttttgcaaaaggcctggcatgaccgcgacaagcaatgacccactccacggcgtgaccctgcagcacgtcctcaccaccctggtggaacactacgaatggagcgggctggccgagcgtattgatgtgcgctgtttcaagagcgacccgagcatcaagtcgagcctcacgttcctgcgcaaaaccccctgggcacgtgagaaagtcgaaggcttgtacgtaaaattgatgcgcaccaaacgcccgctggattgagcccgtgaagcgttttatcgcgacggcggcgctggccggttgggtcgggctggcgattcagcaatacctgattttctattcgcgctgggaagcgggcgccagcctgctgggcgggctgatcaactttttcagtttcttcactgtgctgaccaacaccctcgtcgtggtggtgttgagctatgccctggtcaatcgggagtgcgccgcgaagcggttttttctcgcgcctcacatcagcagtggcattgccgcgagcatcatcgtggtgagcctcgcctacaacctgctgctgcggcatttatggagcccgaccggctttcaatttatcgccgacgaattgctccacgacgtgatgccggtgctgtttgtggtgtattggtggcgctgtgtgcccaagggttttttgtgtttcaagcacattggtggctgggtgatctacccgctggtgtacttcgcttatgtgctgctgcgcgggcatttgctcgggcagtatcaatacccgttcattgacgtggacgccctcggttatccacaagtgtttgtgaatgccggggggattttggcggggttcatcgtgattgcattggcagtagtggggctggataaaatcttgaagccaagccgacattaaatgtgggagcaagcttgtgtgggagctggcttgcctgcaatagcatcaactcggtgtaacagataaaccgagttgccggcatcgcgggcaagcccggctcccaccgttgatttgagtccggctttactcttcttcgctgccttgcgcacgccagtagcccacggccttgaggaattcttcattgacctgatgggtgtccagcagcacacggcgcacctggcgcgacagcttggtttcggtcgccacaaagctgtacagcgagccgccaggcagcgtcaggttgcgcacggtttcgagcaggtcgtcctggccgcgtatcacccaaatcacttgtacattcgcagcactttgcagcgcttgctgttccgccgcattggcgatttcaatcaccgccagcaccgtgcggcctgccggcaactcttcaaggcgccgcgcgatggcgggcagggcggtttcgtcaccgatcagcaaatagctgtcgaagatatccggcacgatcatcgagcctcgtggcccgccgatatacagctgctggccgacctgcgcctgctcggcccaggtggacgcggggccatcgccgtgcagcacaaagtcgatgtccaactcaccgatgctcaggtcgaaacgccgcggcgtgtagtcacgcatggccggttgtgggccgtcgcccttgatgctgaatgtcgggctttgcagtgcggccagttcggcggcgttctgcgggaacagcaacttgatgtggtcgtcgctgcccaggctgacaaaacccgccagctcaggcccgcccaaggtgatgcggcgcatgcgcggggtgatgtcgacgacgcgcaatacatccaggcagcgacgtttgatttcgtgggtaacgcgatggataacttgagtattcattggtctttcccgtcggcaatggcttgagcggtgcgattgagcagcgccgcaacacgaacgatttcttccgggctccagcgcccgtgatgcgaatgcaaggcatggcgcaggttatgcaccgcctcgtgaatctccggtgggcggtcctggccccgcagcgagcgtttgctgacgtcgatgcgcatgcgtacgccgtccagggcaactgcttgctcgcttaagaagagacgaccggcgtcggtgattgtgtagcgtttttttccgccgtcggcgtcgccctggatcaagtcgctttcttccagaaaggtcagggtcgggtagatcacgccggggcttggcgtgtaggcgccgtcgaacaggctttcgatccggcgaatcaggtcataaccatggcacggctgttcggcgatcaacgccggcagcagcagtttcaaatcgccgggtgcaaatacccgggggccgcgaccgcggccggcgcgcgggtcaaaaccgtcgcgctggtgaggatggtctcgcatgatgggagcctctgtgtgtgtctagatataacgtaagatatatcttatgtccgaggcaagcaccgccgacagacggtctgccggcaaccgctggttctttagttacttagtttataaaaccaagtaaaggctattgttttttgaagtctgtcatcccattcttacggacggttatgggggtaaaccgttctcattgggctcgatgtagtctgtttcttacagttcatattaaagttttggcaaattgccataattttcgtatatgcgttgctgtcaccaagctacgcgattaagggaaacggacggcttacataatcaatcttgaagtggaaacttgcctggcttcgaacggagcctgatttgcaatacaactaattggaaagcaggtgtcgcgtttatcacgtgatgccactaccggttaagtgcaaatcaggggctaccccgttcttcgcttgcttaataagtcctacgcaccgctgcggcagggttttttatgacatttatcaatgtgtgagtatctgcaaatgaaaaccaagatgaaaactgcgctgttgtccatcggtctgctggtgggttcgatttccgtggctcaggcgtcggatgggacgattacgtttttgggctcggttcactcgggggcgtgctccatcaagcctgaatccgtagaccagtccattcacctgggggcgatcgccaagcatcagttgcaaaccggcggcaagtccgaagcccgtagtgtgaagatcgaacttgaaggttgcgatttgaccggcctcaccgataacaccgtcaccaccacctttaccggcgccccctccagcactgttccaggtgcaatcggcaccatcggtggcgcgggcaacgtgggcgtcatgatgacccatggcagcaaacccatcgtgctgggcacgccgaccaccccgcaagccatttccgtgggtagaaacaccctggaattcggggcttatgtgcaaggcgcagcgaccggtgacatcgtcccgggcgatttcagcgcggtaaccaatttcaccttggcttatcagtaagtttttcccccgccactgcgcgtggcgggggaatgctggcgggagattaaggtgaacacattcatacgtctcgctgttgcctcttcattgaccctgttcatcagcccttacggattcgcgcaggcgtcttcgcaaggcgatggcgtggtcacgctgggtggagaggtcgttgactcagcctgcgggctggaagcagtcagcgccgaccagaccatcgagatggaccccgaacccatcggccggttgttacgccacacgatagggcgaccgcagccctttcagttgcgcctggtcaattgcacgttgagccgccccgacccgtcgcgcccaggtgcaagcctgccggactgggagcatctgcgggtgacattcgatggcccaagcgacatggacgggcgcacgtttgcgctctttggcagctcggagggcgtggcgctgcacatccaggatgccgcgggcgaagagagtgttccgggtgtgccgatggcgttgcgccccctggtggaaggcgacatgacactccactacacgctgcgcctggtcggcaacggatggccgctggcggcgggaccacacagtgccgcagtgcgtttcaagttggaatacttttgaacattgatggactgctttcatgttgaataagtcgaaggtcaaacatgcgctgggcccgagcctctttggcgggttgatatcactggcaggcactgcattggctgccggggatattgaatttaataccgacgttcttgatctgaatgatcgctccaatattgatctgtctcagtttgcacgcagcgggtttattctgccgggcacttactcgatggtcgtgcagatcaatacccagtctataagtgagcagtcggttgcattttatccacccgataatgatcccaaaggcagccaggcctgtttatcacccagtcttgtagaacagttgggcttgaaagagtcgggcggtgccaaactcgcgtggtggaaaggcggggagtgcctggacattgaaagtttgcctggcatggaagtcagtggcgatctggcaacgtccacactgaacatcaacttgccccaggcgtaccttgagtacagtgcaatcaactgggacccgccttcgcgttgggatgagggcgtgccgggggtgttggttgactacaacatgaccgcgcaatccagccaccagcgaagtgaaggcaaccgcaccaacctcagtggtaacggcacactcggcgccaatgccggggcgtggcggctgcgcgcggattggcaagggcgtgtcgagcaaaacagtgagggcgcagcccggcaccagaagctggagtggagccgctactacgcttaccgcgccattcctgcgctcaaggcacgcctggtagtgggcgaggactacctgtattcggacctgttcgacagcttccgttttaccggtgcggcgctcaagtcggatgaaagccagctgccacccaacctgcgcggttatgcgccggaagtggtcggcgtggccaaaaccaatgccaaggtcgtcatcagccagcaggggcgtgtgctgtatgaaagcctggtggcggctgggccctttcgcattcgcgacctcaatgacgccgtgaccggcaggctggatgtgcgggtcgaagagcaggacggctcggtgcacacctcccaggtcgacaccgccagcgttccgtacctgacgcgtccaggccaagtgcgttacaagctggcgacggggcggccgtccaatcttcaatacggtgccgacggcgacgcgttcgcaacgggcgagttttcctggggcgtcagcaatggctggtcgctgtttggcggcggtatcggcgataacaactaccgcgcgctttccgtgggtgtgggccgtgacctgctggcgttcggcgccgtgtcgctggacgtttcacgctcccacgccgaggtctgggacgagacgctcacgggcaaatcctatcgccttcaatactccaagaactttgaggaatacgacagccaagtgaccttcgccggctaccgcttttccgagaaaaacttcttgagcatgagcgagtacctggacgctcgccattacgggttgaacggcgagctcggtgggcgcggcaagtacgatgaaaacggcgtgtaccgcgagggctggcggcccatcggtggcagcaaggccctgtatacggtgacggtaaacaagcagtttcgtgacctgggcgccaccgtctacgccagctacagcaaacaaacctattgggagcggccggacacccagcgctggaacctgtcggtggcacgctacttcaacgtgggcacgatcaagaacatgagcctgtcgctgaacatgtaccgcagccaggaattcaaccataaggacaatggtctggcgctgaccgtcagcctgcccttcgggcgctccggcacattgtcgatggacgccaacagagccgggggccagaaccgttacacaacgcgttacgccgaccgtatcgatgagcgcaacagctaccagttgtccgccagcgacaacggtgccagtggttacctgagtcatgtcggtgaccaggctgacatcaacctcagcgccagccagcaagaaggcagttacaccagcctcagcatgtcggcgcgcggcggtggcacgctgacgccttacggcggggccctgcatcgcaccaacagcatcggcggcacccggttgatggtcgataccgcgggtgtgcccgatgtgccggtacgcggttacggctcaccaacccgcagcaatgccttcggcaaggcagtcatttccgatatcagcagctatcagcgcaccgcagccagtgttgacctggagcatttgccgagcaatgtcgaagcgactcaatcggtcacgcaactgacgctcaccgaaggcgcgattggctaccgctcgctggaagtgatttccggtgagaaagccatggcggttctgcgcctgcccgatggcagctcaccgcccttcggcgccacggtgaggaacaccaaacagcaggacaccggcatcgtgaatgacggcggcaacgtctacctgagcggcatccaggccggcgaacagatggtcgtcagttggggcggcagcgagcgctgcgtcctcacgctgcccggcacattgcccgctgacggtttgaccgatgccctgcaactgcgctgccagatggtggccgccaacccctccttgcccgagccagcggcgctgaccggcaagccaattgacacggagaacacatcctcatgatgctcactatacgcaccacactgcccgctgccgcgctgctggcgctgggcctgagccaaagcgccaatgccgccgtcggcctggaccgtacccgcgtgattttcgagggcggcaaagacgccaccagcgtgaacatcaccaacaacaatacccaactgccgtacctggcccagggctggatcgaggacgaggcgggtaacaaaatcacctcgccgctgaccgtgctgccgccggttcagcgcttggagcccggcaaacaaagccaggtgaaagtccaggcgctgccggcggccaagctgttgccgcaggatcgggagacggtctactacttcaatttgcgggaaattccgccgcgcaccgataaagccaacaccctgcaaattgcgctgcaaacccggatcaaattgttctaccgcccacaggccattacgccaagccagcaagacctttccaacccctggcaggaaaagctgaccctcacccgcgaaggcgatgtttaccaggtgcataacccgacgccgtactacgtgacgctggtggatgcgcgcgcaagcaaggagggcaagaccgtgcccggcttcgagcctgtgatgatcgcgcccaaaggctcgcaaaccctggggccgacggccaaggcactcggcaccacgccctatctggcctacgtgaatgactacggcgggcgcccgctgatggccttcacctgcaacggcactacgtgccaggtcaacgcgcaagtctcaccgcctattcagtaaggcctgctgccggagaacaacatgaagtcgcacacactgaagctcctggccggcctgctggccttggcggggagcgcgcaggcccaggcggaagaggacatcgaaggcatgagcgggatgctcaacattcgtgggtccatgcatgaaaccccgtgcagcgtggagatgacatcgcagcatcaaacggttgacctgggcgccgtcacggccggccagttgcaacggccgggcgatcaggccatgccggtgacttttcagctgggtttcagggactgccagcgcaccgccggcagcatccgtaatgaacgcaccgggaacctgacatggagcgcctttcaacccgtgctctcgatagcgtttttagcgccgtccgatgccgaagacacatggctgatcaaagtacagggcatcactggcatgggtttgcgtatgactgacgccctggggcgggatgtacagctgggctccaagggcgaaccgttggtgttgcccttgggcgacagcacccagacctggacggttcggcccacgcgcacttcggcgccgttgaccagcggggcatttcgggccgtggtggatttcaggctcaattatgagtgagggcagcatgagtgctaagtcaaccggctcgcgggccattcttatcgcgggcggcctgctgtgggccgtcagccagggcgtgcaggccgagaccagtttgaccatccgcgcggtcatcatcgcgccgccgccgtgtgtgatcaacggcggcagtaccctggatgtgccgtttggcaacgacctgctgacgtcgcgggtggacggcgtcaattaccgtcgggatgtgccgtataccgtcgcgtgcgacgcgccgttcaacaacgcaatgaaactggaactcaggggcaccggggcagcgtttgattccaaggtgctgctgacccgcaagcaagaccttggggtcaagctgttcgtcaacggcgctgattggccactgaatacgccggtgaattttacctacccaacctttccagcggtgcaggcggtgccagtcaaacgcgtgggcagccggctgacggggggcgcattcgatgccgccgccacccttgtgatcgattatcaatgaagaggagcgatccatgacacgttggcagcagcgagcgttcctcgccttgtgctccatcggcctgtgcagcggtgcgtcggccaacctgacgttcagcggaacactgaacgagccaccgccttgcacgattgatgcgggcaacaccattgaagtggattttggcgacgttggggtcaagcgcgtcgacggcgtgagataccgcaagagcgtcggctacatcatcagttgtggcgccgacacgctcccctgggaattgaagttgagtgtcaacggcacacccacggggtttgacggcgcagcggtgcaaaccaatgtgccggagctgggcattcggattttccagaacaacgtgccattcccgctcaatacacccatggacataaacctgtcgtcaccgccgatgttggaagtcgtaccggtcaagcagctcggcgcagtcctggcccccgcaccgtttgcggcggtggccacgctgttggctgaatacgagtaggagtgaagtctatgcgacatgaactgcttcataaggcctggccctgggccggcctggcattactgctgaccttcggcctggtgcccaaggcacaggcggcggacaacctgcgcttcaagggcaacctggttgaagaggcctgcaccgttcgccctggcgacgaggccatcgtcctcgaactctgggacgtgaccagcaagcacctctatatcaacacgcgcacccaggggaagggcttcaagctgcacctgcaagactgcgacaccacgattggcaagacggtaaccatcaccctgggcggcactgaaagcatcaagttgcctgggttgttcgccctcgacggtggcagtgccgccacaggtatcgcggtgggtatagaaaccctcaacaacaagccgttgccggtgaataccgtcagtgacgaacaagtgctcagtgatggcagcaatgtgatcgagcttaaagcctatgtgcagggcgaaccggatgcgatccgggatcagaccatcgggccgggtgcgtacacggtgagctccacgttcaccctcgactacccgtagcggtaagccgtcattcatcggctggcaacagccttggacatacttcaactctctcttggtgctacggattgaatattcgtcaggctgcgcctggagaggggggcaatgagagatcaacatgaaacaactctatggcgccatcgcgcttctcgtcttgatggctgttacggcgactgcgcaggcggttgattgtcgcgtgaatggcgggccgtggcagacgggcaaccccaatttatatgtgcccgttaccgtccgcctggccccggatcgtacgagggttttgctggaaggtgcacggcttgaatgtaagttctcccagtggtcggggagcccctcctggcgggcggactattgggcgaccggtaacttgtcgggcaccccatggacaccgggtccaaaattcagcggcgaaggcacgggcttgcgaataaacggcgcgtacctgaatacgccggtccagagcggggtattggccgccacgatgccggacaacctggccagttaccccatcaatatcgacccctatattctgctgcgtaactatccggcgaactccatcgatattcgagtcggcgataacctcggtctattgcgtctgagcagttcgaacaactacgacgccacccgcccgcaactgacggtgacttactccgccgccaacaacttcaccgtgtcgccgtcaatgtgcacgatcaataacaacaacccgattgatatcaacttcggcaacgtccaccagcgcggcatcggcaccgatccgctgaccaccaccatccgcaccgaccgcaggctcagctattcctgcccggacggtggggttaacacgccgatcaccattacctacaaaggcacgccgtcgtcgtttgacacacgcctgctggtgatgagcaacccggacgtgggcacggcccttgtgcgtgccggctctgcggtacaggtcggcggttcgtttttgacccgcattaccaacagcgtgggcagcgatgatgtgacctttaccctggttcggcgcaatggttcgctacccgcggcggggcccatcaatggcagcggtgtactggtgatgggcgtgccgtgaatcacgcctcactctgcctgctgagcccatccgggttcagcagcacgcagtgctatccatccccttaaagagtgctttacagggctgcgttataagctagagtgattgctcaagtgtaagcgcagtagaacttattgtgctctttaatatatctgtatcatggcttggtgtgatgtgtaagtatgggattacagaaatttcttcggttaaataattcctgtttatagaagtgtagtcctgctcttacggttaattccaaagttttggcaaaaggccacctttttcattcaatgattacactttaaacccacgccgagtagggacatggctggcatacctgttggttgaattaacggattctattgcagcgttgcaacactgagttggcggggttaatgcgactgatgttaatgcgttcagacgcagcgtttgtctcgatctcgccgtgcagcgcctcaactaaacgttaaaaacaggtattgaccatgttcaagaaattcgcagtttgcctccctctggctgtcgcggtattaggcgcttcggctgcgatggccgccaacgatgccagcaccctcattaacatccgcgccgatattccgaccaagcagttccacgcccagccgctggaccctaacttcggtcgtgacgaagtcatgacttacaacacagtgagcggcgagttgagccagctgtcgaccgtcttcaccctgaaaaacaccggtggctcgatcgatgcctacctgcaggacggtcccgctgcgctcaccaacggctccgacgctatcgcactgaccatcaccctgggcgatgtgacgctcgatggcacgcctaaagaagtggcggcagacgccgagtccaaccccggcctgcaaaaaaccatggtgatcaaggcggccaagccgaccgacgcacaaaccggccgatacgccacggtgtccaccgtgatcttcgataacgtgccgcgcaccacgccatgagtgcaggtggccaataaggccagcccttattgaacgcgtcagccggctgctccctgcggtcggctttcaaccggtttgcagtttgccaacagagtattgagttcatgttccctttgaggcccctcgtggcagccattgcgctcgccacctgttcggtcgttatggccgcgcctgataacaactacacaccgcgcagtttgttgtctcaagctaaaggtctgccaagcgatttcgaagagcactttttcgatgtgccgctggcggtacgggtcgagcgggatcaacagttcgtgggcgaagcgatgattgtgctgagccgggatgaccggctcaccctgctggagtttaccgaccacagcgacagcccgatcagcggcaccgaacgtgatacctgggagcgttacctcaagcccggcattcccttgggggcgtgcattcagggctgcccggaacaattgctggcggtgcactacaacctggaaaactcgctggtctccatcctcaccgaaaatgccgagcgtgatgcggccccgcagcagttttacacccagcccgacggcggcagcaccgggctgatcatcaaccaccaattgaacctcaatggcgggcagaaccaggacctgggcgggcgtttcggcatcgaaaccagcagcagcctgggcaactggagccaaaccctgaatatgcaactggcgcgcctcggcgggccggatacccagctttaccacgcgctttattcggcttacgcccagcgcgagttcgagggccagttcttgcgcctgggctatttcacccccaacgccgaaggcttgaaccgccagccccgttcattcggcgcggcgccggatgtggccgtcggggtgatggtcggcagttccgacagcctggcgatcaacaaccccaagccgagcgtttacccgatctacgtcacgtccaaccgccagggttcggtggagatctaccgcaatggcctgttgatcaacacccagccagtgccggccggtttgcagacgctggacacccggccgttgcccggcggtatctatgaagtggaagtgcgcctgatcgaagacggccaggtcacgtccacccgccaggagttggtgtacaagcccaataactggcgcaaccatgacgagcgctggcgctacaacctgtttgccgggcgtgaaagcaccttgctcaacaactgggaacagcgtgacaagggcgacatgaccgccggtgcctcggttaactatctggcgcacccgcgcgtggtccttggcctgtcgggccgccaggtgcaggaccgcttgcagttgggcagttccatcgactggagcctggcccagagcgccagtgtgtatgccaacgtctaccagactcgcgactacggcaccggcatggatgtgcaagggctcttcagctacggcatgggcagcgtgatcgccagccataaccgcagttggctcgacacccgcaacacctacgaaaccctgcccgacggcacacgcctgcgccagcgcaacacgtttgtcggccagaccagcacgtcatcgctgtcgatcaaccaccgtttgggcaaccagaattccgtcaacgcgcgcgtgtcccacagtaagggcaatgtcgaaggtgtcggcctggacctgggctggtccaggcacgacaccctgttcggcagcgacgccaactggcgcctgtcagtgttcgaccggcccgccacgggcagcctcagcgacaagcgcaatcgcggcgtcgacctgaccctcaacctggccctcggcggccccggggaaagctggtcgggcagcatcggttcgcgcaccgcgcgcgaaggccagcgcgataacaacgcctcgctgacctaccgcaaagaactcaaggatcacgccctgcaaaacgtctcggtcaccgccctgaccgatgtctacggcgtgggcctgtcgagcatgaccagcttcgccaccgacaccctggcgggtgatgcctttgcccagcgctcgtcctataacggcgatttgaccggcggcctcaacctcaacaacaccctcgcggtgggcgcgcagaagatggtcctgaccagccagtaccacggcagcggctcgggaatgatcattgacgtggaaaccgacgtggagggcatcgccctgcgtgccgatgacatgaccggctccagcatgccactgcggcccgggcgtaacttcgtgcccatcaccgcctacaagagcagctcggtggccttcgacttcgagggcaatcacccgccggccgccactatccagccggcgcgcagcgcttaccacctgaacaagggcggggtcggctaccgcaagatcagcgtgatgaaaaccgtgaccgtactcggtcgcctggtcgacccgcagggccgcccgctcaaaggccaccacctcatcaatcacgccagccgtggggtcagcgaagtggatgggtttttctcgatggaaatgaacgccggctcaccgacgctggaggtccgccgtggcaccgagttgctgtgccggttccgtctcgacccgagcaaggcccgccgcgaaaacgatgtgctgatgatcggtgatctgcgctgcacccaagacaccctggccgacgcgctggtggtgccgccagcggcgggttgaaggggttgaaaagggcaggtggcccgcgcccctgcgtcagttattcgatgaggttcaccgcaatgaaacgagtattggcagtcatgggtttttgcctgttggcccacggggttcaggcaggtccgagcattaacgtcggggtggtgtatgactacttggatggcgacaaaagcacctatctcaaacgcattttcaacggcggcaccagcaccgcttttgtgaaggtcgagattctggaaatcgtctacgacgcacaaggcgcggccagggaaatacccctccagtcccagcccgacagcagcgcccgtgacggcttgatcgccagccccgcgcggctgatcgtgccggccaacggcatgcagggcacgcgcctggtctacctgggcgagcgcgaccgcgagcgttacttccgggtgcgctacatcccggtgatgcccgaaaaggaggacgcattcgcagtgtccgaggaagaacgctcggcctaccaaaacaccttgcaagccggggtcagcgtgctggccggttacggcacggtgttttttgtgcggcccaaggacacccgctacgacacccgtattgaaaacggcggtgcccactacaccctgcgcaatagcggcaacagtgtgatcgaggtggatgagttcaaaaactgcgtggccggcaagccgaatgactgccaccccaccaccaagaaccacgtgttgccggggcgcgttttctcgttcgacaagcaagccggtcgcgaataccgcttcaagctcgtagaaggtgcggcccgcaaagactatgtggtgaaagagtgaaccgctcgatgccgcagtggcggttgtcggcggtgctgctgttgtgtgggttggcgctgctgagtttttccgccatcgccgcccgtgaagaggcggtgttccacgtttcggtgaaggtgcccaccagcgactttttcgtgctggcgctcaaccctggctttctcgagcgcgaacaggtcatgcactacaacctggtgaccggaagccttagcccgttgcgtgaaccctttgatgtgaagaacgtgctgggcggtatcaatgcgcgcctggggtttgcgccggtgctgtccaacggcactgacgtgattgccctgcaagtgaccttcaatggccaccgcctggacgtggtcgacaccctcgtggtgccggaggacgaagccaaggtgggcaagcgcgtgccactggtgattgccgccgagccgccgccctcggacggctacctgccgggccagtacttcggcagcgtgcagattatttttgatgcgctcaggccttgatgccgccgactcgatggatgagtaatagaaatgaacctcaagacattcaagcaaaaggccgtggccgccggtttggcgagtgcgttgtgggctgtagcggcaagcgcagaaactcagcagatcaccgccagtttcaggcctgaccccacgaatgtgacggccaacaagttcaagaacaccacgccccaaagctcgatttgcgcagggcatatcccggcccaatgcaaggcgttgggtattttcagcctgcgctttatcaacttcgtagccagttcccaggcgcctatcgtggccaaccatgcggacccacgagccggggcctatttcaaggtgccttcatcgttcagggacgtggaggtgcgcaataccacaaccggtgaactggaaaccgtgcaggtgcgaattgccgggctcggggcgctctggtcgttgccaaggccgcctggtgtttctgcatggacgcagccgggggccaattgggacacccaatggcggcgcgcgccaagcccctgtgtcagcaccgggcatctggcagcatccgcctcttatgcctcatttttctgggtcgtacccaaggatgccggcgcgtgtaaccgtgtaccgtcgtctgacattgcgtggctcaactattacaccctggagtacgcctacgaactcgtcacccccaaccccttgggcatggcgtccgggcaatacgtgggcagcatgacgtacaccgtcggcggcgcgggggcggactttgactttggcgataatatgatccccaccggtgatagttcgctcaccctggatttcaccctggacgtcgaccatatcctcaaggtcgacgtgccgcccggtggcacccttatcgagctggtgccccagggcggctggcaagcgtggctgaaccagggccgcaaaccgacgcggttattcaaggaccagaccgtcaacctctacgcctcctcgcgcttcaagatgagcctcgattgccagtatgccgaggccgacaatacctgtcggattctcgatagcgtatccggtgagtcggtgccggtgaacgtcagtgtcagcctgcctcacggcattactgacccggccgggcgcccggtcaaccgccggccgttgcgccgcgatggcgtgggcaccgagctgttccagccgactttttatgtggaccgcaaacccagcaccctgcatttcgagatcgagcgtgacgaagtggaaaagatgctcaaggtgggtgagtcgcgggcttattcaggcaacatcacggtgatctgggattcggaagtttagtgccgatacacctcggctccacgcgtgcaagcgcttcaggcaaccgcgccagcacacccgggctgcccttgagtggcagtgcgaggcagctgcgcactttcgtcgccaaggcgtcaaaggtgctgtgggacgcgctgaaggcctgctcgatatccgcctgttgctggtcgagctgggcgtgcaggcatgcactgaatacgggcccggtgatcggcgtatagcgcaggtattgcccgtcgcgtaacgtctcactggcctgggcgcgatggcgttgagcaacgttggcgagcagcagggttttgtcgtcgccgctcaccagacggcggcgcaagacgttctccatggcggagaagtgctcgaatatctcaaccccgaattgcggcgtataaagcactgtcggccgtggcccatgcaggtgctcggtcagtatgaagcagccgttgagcgacgtggacccgtcaggcgacgctgttgaatacagggtaatgctgacggtttgcggtggcgtggcgttgttcgaggtttcatggagtatccgattctcgatcaattgtcggccctcggtcagcgtcttcaggcgcgcgttgaggctggcgacggctgtttgcgcctgagcatcgccaggctttttctcatgagcctgctcagccagagtgagctgttgccgggcatccagcaattgcaggtccgcctcaagcgcaaacatcacccgctgctgttggcttacagcctccagcacgctcagggcgccggtgctggcgtggggcgctgaccagaatgccgcgagcgcctgcaagtacaggctcaggctgtcgtgtccctgtgtcgacgtgctgtcgtaaatgtactcgttgagaaacaccgtatcggggttcagcgcactgaatgcctggcgtaactgagcgtccatcaccgtcgccaagtccggttgtgcatccagcagatgctcaatggcggtgatacaggtcagtaacgggcggagcatttcctcggcaatgggcagtgggggtaaaggcatggtttgggttccctgtggcgatagaggtaaccgtgcagtgcgggcaccacacgcgaatgcccacactaatcacctccagcaaagccacaggaatacataaccactacaagtcggtggttagacgccggcgatcaccatggcctggcgagtcaggcgtcggctcagttccttctcatcctcaaagccggggagaaacaggctcccgtataactcgtcgctcatgggttcgccggtcaagaattgctcaggggccacattcaacgtgtcggccagctcgaccacgcgctggcgcagttgcgcgccggtggcctggtttttttgttctgccggcagttgctcatgggcggccaaggcgttttgcgccaggcgcaagctttcgatcgtttcacccacctgtctgtgcgcgtcttcgatctggtcgtagtcgtcggcatggaggttgcgcaaatagtcgctccagaagtactgctcaagcatttggtccaccagcccttcgtcctgttcttcctcgatcactttgttgtaggcactgaccaattgccttgcatcgacttgagcggttacgcggtagagcatgtgatcggccagccagggcagctccaggcgtgccttcaggccggtctggtaggcgccgtacacctcgacttcatccagggtgcccggttcgccattgaccacatcggtggtcagccgcaagggcgggcctgcgctgccgtcatcattgagcgtgggcatggccaggcgcctctggatatcttgccgggcgatctggttgaccttgtccagccgcgccttttgtttggccagcagcaccagtgcattggtccgcgcttgcacagtgggtttgacccaggcctccagtttcagtacctcaaagcccatcgcgttgaacagttgagcgccggcatcggcgcattgggccggtacggcggcgaggttgaacagtgcggtacgggttgcctcatcgctttcggcagcctgcagcaggcgccgtacattttggcgcaagtgggtaaggttctgttgataacgcaccaggtccgccgggtcctggacgatctcgggggccggtgcttgctggctttttataacctcgaaaaagccctgggagccgtgcgcctgctccagttcatcccagacttcctgccagccttgacgcatcacaggcgtcaggtggccgagccagaactggctgtcctctgcacctcgcggggagtaggtgcggtaagggtccaggccggcggcgcggcggtaactcacgacgcggtcctcagcgtcgcgctccagcttgtggcggtccaggcgtgtgcgggcgatcagttccgccgacgcggacccgggctcgacgatgggcacctggctgataggcgtgttcagcaagttgaggtggaaggcctgcgtgcggggcagctcgaagaggccttcgggccattggctgatgcgcgtgttattgagcatcagtacctgcaatgcgggcatacggctgaggttgggtggtacgctcaggtgggggttgtgcgagaggatcagcacccgcagatgctgcaggttttgcagctgctccaactgctgtgaggtccagtgaatgggattttccgccagccccaagtgcctgagcctacgcatgcccgctatggcgtccggcagtttcctgaggcgcctgccggtgatatccaggctgcgcaggttgggaaagttgtgcaggaacgggctgtcggcgtcgttaaattcggtgtctatcaaattgatgctggtgacgtggctcaactcggtgttgagctgcgggaagttctgtaaaaagccgtggatgatttctccgcgcaggtccagctcgctgcccagttgccgggtgccggtgtcggtttcgtaccccttggccgattgctcccaactttccctgatgtgcttgatcatgcgttttctgaataactgttccggcagcgatggccgtaattgccggctgccggcggcggggagttgctgccaggttttgagctctttgagcaggttttttttctgggtttcgagttcgagtaacaggcgttggccatcggcggtgttcagggaatgggcgtaggccgtcacgtcttcttcggtcagtgtcggatacagctctttgagccgttcctcgacgctggtacggcccatgcgctggcgcagggcgctgagcatgggtttttgcagcaagcgcagggtctctcggcgcggctcggcgaagatcggcggttcggccagcaaggtacgacgttcgctcggtggttgcagggtttgcttgagccactggcgcaacgcctcgccttggccgggcgcgaagcccagcgtgtcggcgggcacggcgtgcagcacggcctcatataaatcccaggtggcctcagtgtctgccccgtgcagcgcataccgccctggcgcggtgcgtatcagcagggtttcggtggccgcatcatccgggccgacacggcagcgcaattgcccgccaggcagttgctcatggatgctcaggcgccggttgccgaaggcgtcactgtggattctcaaggcattgagcagcaggcgttcggtgtcgggcgtcggtgcatcaccctggtaaaagccttcataggcgtgggtggctcgcgcttcgaattgcagctcccgcgcctgatgcctcaggcgcaccgacaggcgctgttgttcgcccatgagccgcagttcggcggggcgcgcctgggccagtattgtttgggccaggtggtcgggcaggtcagggaattggcgttgcagcagtaacccatgggcgctttttgactggcgtctgaagctatacagatgctcgaaaatgtcgtccttgcgcgatgccacatagcggctcaggtgttctcgcagtgcctgtgcccgcgtgttgggggcgacgggcaatggctcgccgagcaaacctgtgagttcgctttcgtcgaggaagtccaccacgcgctgcgccagccggcctgccagcaagtcttcacggctgatggacagggtcgcatccgccgcggtgccatgcacgatcggcgcgccgctcaggtcaggcgcctcgaacacggcgatggctttgccgctgggccagccgtccatgcgcgtgaccatatcggccgaccagtaggcggcctcaccgttaccggcgggcgactcgctgagggtctcgatgtgttggcgcagttcgaagcggtccagggtgtcggccagcagcggcggcggtgcctggttttcgacgtacatccgcctcaactcgccgggttcggtgccgctgatgtcgcgcacttgttgcaggcgtgcttcgggccaggtggcggtggtcgggctcacgcgccgcaacagttgcgacgcgtcccaggtcctgggttcctcgccttcgagcaccgcagcgccgcgacggttaagcaccacctcggggcgataggcgtcgggccgttgtggatggatcacccggtgctggccgctgttggcgtcctggctgacggcgtagtgcttgttgcccaggcgcaggattgttttgccgtcgtgctgatgaaaaccctgggcgtcgggtttcgcgcctgggggcaaggtcacggcggtttgctcataagggctcaagtccgcatgccataaccgctgtttgccgtcggccagggtcaccggcttcagcccttcgacaaaggccgacaactggacgtgcgccagttgcccggcggcgccgaaggcgatcagttgcagcacgttttcggtcaccccgaccacatgttcaatcgcctccaaccccaagccttcggcccagtccaagaggccttcacacacttcgtcggcgagttggtaagcggtataggccaacatcagctcgcccaaaaacggcacgaaaggggtcacgaccagcaacgcggcattgagaatgtccgcgaagatcttctccaggttgtcccaccaggcccagcgcgccatgcggtcggcgtaggccgtgggcaccgccagttcacgcgcatcgttgaggattttattgagtttgcgcctgtacacatgttcccacagcgccgtgcggatgcgcttcgcacgaaactgcagctgggtgctgtccagcgccgtttcgcgccagctcggcagtgggtcgccgggcacatgcgcgtgccacttcaccgcgctcaggcgcccgcccatctggctgaagaaatgcccctggtattgatgctcgacaaaccggctgaagaatttctggtagtccggctggcgcagttggcgggtcagcgcctgcatgaacgccactgtcgaggcgtagcgcttgagcgggtgctgcgggtcatccggcacataggcgatgaccggcagcgcctcgcgctgttgctccaggtcggcggcgatcaacatgacgccggtcaaggtcgcgtccaacaggctcaggtcatggcagtgcgcggccttgccgtcgagtgtcagcccttggcggccttcgaccaagtgcatgaccagttgatggtcctgtggctggatatcgcctttcatcagcgccatctgcgccgcgaccttgagggccgccagctggttggcgctgacacgggcgcgcagcacgccgtctaccaccggctcggtgcggcccaggtaaagttcaaggtgcgtttgatactgggcaccgatgtcgaggctgcgcaccaggtttttgaactgctggaccgacagtgtgttgttgagcctcagcacatcgaaacggcccgaagcgtcgggccgcgtgatgaattgcgagtctgcggtgaacacctcgctgtcggcgaagttgtgcaacgccgcgtccagcagcgacaccgtgcggctgtgcacaccgccgctgaggttcttgacccaccacgcttgcttggccggcgcatacagccgcaggcaggtgcgctgcacatccacgtcgaggttgtagtgccgtttcagcgcggcttttaacaagggctcggcaaaccctttgaggtcggtgaccggggtcagtttctggtcgacctgcgtttgggttttccagtgttcggctatcgcggttttcaacagctgatgctgctggggcgaggcgcttttgtaccaggccggaaggcttttctggctggttttcagggcgttgatgcgtgagcttgagaccgtttttatccagtcgggcaaggcgtcccggatcagttcgtagtgcgggctttgagcttcgagggaggcggtagcaagtgtcgtcatgacgctgttttctgtggcaggaagggccctcagactaggcccgcgcagggggctgccaggcggtaattgtctatcgacaggcgctgccgagcggcctgctggtcagcccggcgatttttttactgccgactagccatcggcgcgcacagcgtctgctcacccggcttcaagtacggcataagaatcggcgccatgcctttgagcacctgcacgggcagcgccgaggtgaagcggaaaccctgcgccgagctgccgggtacaaacgcggtgagtgtgccgaagtgccggtcgccgatgtaaaacacaaaggtggcggtgcggttgatcgacttggaactgagcacccgcccaccggcgccgatggcttcgatgcggttgtcgccggtgccggtcttgccgcccatggccagtggtgtgccgtcgtccagcttgaaactgccggccacgcgcttggcggtgccggcatccaccacttgcgagagcgccccacgcagcgcccgcgcgacttctatcggcatcacgcgtttgccttcggccgggtcgttgatgacctgggtttcatagggcgtgtcggctgcaaagtgcaagccgtcgatgcgtaccgcttttgcgcgcaggccatcgttgaggatgatccccatcagttccgccaacgccgccgggcggtcgccggaactgccgatggccgtggccagggacggcaccaggtgatcgaacggatagcccaccgcctgccagcgctggtgaatctcgaggaaggcttccacttcaagcatggtgcggatacggctgtcgcgggcgctctgatggcggctcttgaacagccagctgtagacctcctggcgctcgaactggctggctttaaccacctcgctgaaggacgcttcgggatggttgagcaagtaccccagcagccacaggtccagcgggtgaaccttggcgatgtagccctggtcgggcaggtcgtaggtgccggggcggtaatcgttgtagagtttttgcaggcgttcgtcgttgagtttttcgccggttttgacgccggtcaggtgcgcgcgcacgaacagattgaagctggcctggctggcctcgggcaacaagtagcggtgcacggcggccaggcgaatcggcgtggggcgcaggccgtcgaggaacgtgtcgaggcgcgcctgggtgtctttcttctggtacttcttccagaacttgcgcaggaaggtggtgccttcgcgatcagcgaaaccggcgaggtattcctggcggcgcgggtcgctgtcgtccttgagcagcgcggcgctgttgttggcgccggaataggtggtgaagcgcaccaggtcacgcatcaggcgaatgaacggcaggttgatcgactcgcgcaatgcgtcgcgcagggtcgggctgcggccgttgtcttcgttgcgaaagttatggaaatgatgcaagccgccgccggtgaaaaaaccttcgttggggctggccgagtaggtgcggttgagcgcggcgtcgagcattgtcgcgaggtcatggtcggggttttgcgtgaggtaatccacggcccaacgcgagagcgggtcctgttcgggcacctcgacttttttcagcgcggcgggggcgagcgcggcgtatttgtcgtgcagctcggtaatgatttgcaggtaagtggtcagcacccgcaacttggcagtggagcccagttcgagcttgctgccttcgttgatgtcgaagggctggtcggtgttgtcggtttgcacgcgcacccgtgagccgtccggggtcagctcgaacaaagtgaagctgtagcgcacttgcgcggtgttggccggggtcagcaggcgctcgccgagcagcccgacctggcgcgcgaagtcggggtcggcgaggtgcttgaggtagtcgctgacctggccctgcaacggtgcttgcagggtggtggtggccgacaggtcgagacggtccaggtcgtacagcggccggtcgagcagggcggccaggcgcgcgcgggccatgctgatgcctttgttggtttccaccggctgcacggtgggttgttgcacccaatcgcggtagctgacgctggccgccagcgccgcctgcaacagcgcaggggtaatgacgccgttctgcgccagcaggcgcagatggctgtcggtcagctcggccagttcttcgcgacctttggccaggtagtgagaagggcggcgctgggcaatgatcaacgacagcacttcccgcagggccaggccttgttcagcgctgaccgggccgaccagcgcctggttgaccctgttgaaatcggcgccgtaccacacccgcaaaccttcggccaaaccatgcacttcgccgtggccgggcaccgccgacagcggcacgctgttgaggtagtcacgcaggatattctgccgcgccggcaaagtttgcgggccgtcgcgataggtgcgcacggcggcggaaaacatttgccgcagtttttcctcgcccgacaccgtcaggccatccggggagtggcggtatttttccaactgcgtcgccaacgtgctgccaccggcactctggccgggcaggtgcagcactttggcgacttgcgaccatgcggccttggcaaagcgcggccaatccacggcggggttggcctggggctggctggggtcgagcaggtcgcggttttcgatgaacagcaggctgctgaccaccaccggtggaatcgccgcgaagctcgcatacagctgttgtggatagttgtactggtacagcggttcggcgcggcagtcggtgatggtcagcccggcctggattttttccgcatagggcacaaacaggcctttggcgctgtagtccatcaacgccggcgaaaagcgcgcctgggcctcaatgacatagccgcgcttgagcaggcgcggcaggaaagtgccgaggtcgctgtaacccaggcggcggtcgaaggggccggcgccgggatagcgcatggcctggctggggccgggctcgacctgccaggtgaggtcgtgggccaggcggctgaggtgctgggcctgcaggcgtgaggtgcgcatctctttaacggcagcaaaccccaaggccaccaatgccatcagcacaatcaaccagaacaggcgccgcacatagcggggcctgggtttgtttttgggtagaggcgctgggtccgaactgccttgtaatttcgcagccttgctcgattcggtttgccacagtgcgcccatagtcgattgatccttaacgcagattgatcggacttgtatggagcttagtcgctgggggctgagtgtgagggaaatgtgtgttttggttgttgtggcgagcgggcttgccccgcgttgggctgcgaagcggccccaataaagtcaccgcattacttcagacaaaccacgccgcctgggtttagggcggcttcgccacccaacgcggggcaagcccgctcgccacaacaagcccgctcacacattttttaccgtgttcaggcaggcgtttttaaggggttcaggcactcgatagagcggtccacggtggtcttggccatttccagcaaatgccacaccgccagaattttcgcccgctcggggccaggcagcaggtcactgcaattgagcgttgtggccgaagcgctgtcgagcaagcttgcggtgtagagcagggcgtcttcaaagctcaggtcttcgatgtgaacgccttgggtgggcaggtaatggtcgatggcgcggttgaaggcggcacgggctttggctgaagtgtggggtgggtcggggacgacttttttcattgtttagtacctgtctgatcaaggagccgaaactcttcgcgactaaacgagggtggcggctgtacgcaggttagtcgaccggtcagaacaggaacccggcgcgcccgaagacgccctgcgcacagccaccataacttctggaggacatgcgcctgttctgaaaccgagcgactaaacccgatcactgatgagcagtgacggaccgcagactagccatcgattccaacaggcacaaggcggcagggattgtctaggaaacgtcctgcaatttaaagagacgcgccttgctggccttttaaaaaccatgaccagatgccactaaccccaccattgatcgttcccacgctccgcgtgggaacgcaccctgtgacgctccgcgtcacgccttcaagagccggacgcagagcgtccatagcggcattcccacgcagagcgtgggaacgatcgcggagatcgacggtgttgatcgttccctcgctccgcgtgggaatgcaccctgtgacgctccgcgtcacgacttcaagagccggacgcagagcgtccatagcggcattcccacgcagagcgtgggaacgatcatgcatctagtgcgtgggaacgatccggcagtggctgtgcgacgttttgccgctcaatgcaggttagatgctcctgtaaaattgcaatttaaccggcacttcccctaaattgccccgtttttatagtgaaagaacctgctcctggctttttatactgcacgcccgttgatcttgcctggcaagaagggcccgtccatgaggcggccccggtttcggcaagggcgcaggcttatcggtttgcaccctggagactcgacggacactccaataacaaaatgaggttgtacccttatgccagtcggcaacccactgccccatggcgagaccgctcaaggcggcccgctcaaacgcgaacttggtgagcggcatattcgcctgatggcccttggcgcctgtatcggtgtcggcctgttcctcggctcggccaaggcgattgaaatggccggcccggccatcatgctgtcctacatcattggcggcctggcgatcctggtgatcatgcgcgccctcggcgaaatggcggtgcacaaccccgtcgccggctcgttcagccgttacgcccaggattacctcggcccgttggcgggctttctcaccggctggaattactggttcctgtggctggtgacctgcgtggcggaaatcaccgccgtcgccgtgtacatgggcgtgtggttccccgatgtgccgcgctggatctgggccctggcggccctggtcagcatgggcaccatcaacctgatcgcggtcaaggccttcggcgaattcgagttctggttcgcgctgatcaagatcgtcaccattattgcgatggtcatcggcggcgtcggcatcatcgcgttcggcttcggcaatgacggcgtggcgctgggcatttccaacctgtgggcccacggcggctttatgcccaatggcgtgcagggcgtgttgatgtcgctgcaaatggtgatgttcgcctacttgggcgtggagatgatcggcctcaccgccggtgaagcgaagaacccgcagaagaccatcccgagtgccatcggctcggtgttctggcgcatcctgctgttctacgtgggcgcgttgttcgtgattctgtcgatctacccgtggaacgaaatcggcacccagggcagcccgtttgtgatgacctttgagcgcttgggcatcaagaccgccgccggcattatcaacttcgtggtgatcaccgccgcgctgtcctcctgcaacggcggtatcttcagcaccgggcgcatgctctacagcctggcgcaaaatggccaggcgccggccaccttcggcaccacctcgagcaacggcgtaccgcgcaaggcgctgctgttgtcgatcttcgtgctgttgctgggcgtgctgctcaactacatggttccggaaaaggtctttgtgtgggtgacttcaatcgccaccttcggcgcgatctggacctggctgatgatcctgctggctcagctgaaattccgcaaaagcctgagcgcggccgaagcggccgggctcaagtaccgcatgtggctgtacccggtcagttcctacctggcgctggcgttcctggtgttggtggtgggcctgatggcgtacttcccggacacccgcatcgcgctgtacgtgggcccggtgttcctggtgctgctgacggtgctgttttacgtgttcaagttgcagccgaccaaagccggcctgggcgcaacctgtagccagcagtaaaccctttacccgtggcgagggagcaagctccctcgccacaggtgatcagcgtttgccaggcttaggcgtgtaacaacgccgcttgtgtggcgacggtcagttgccgcaccaggcggttctgttcttcctgctccaggtccaccagtgactggcgccgctccagatactcgtccgaacgtttgtcgggtatttcctcattcagctgcctctccttgtgcttgatagcgtccttgaccgtggaaaacggctccgggtgacttctggccaggtattcgatccagaacgcttgcatcaataaccactcctgcaaggcctcggtttggcccagccggcgcagttcagtgcgcgcattgtcgagtacgtcctgggtgacgtctctagcggagtagagcaactccagcggctcgaagggcaggttgaactcattggccaattgggcgcggaagtaaatgatgacttcggcccgatcaacctcaaggccggccgcttcctgactgcgaatgaacctgtcagtaatctcgtccagttggtccagatagaagcacccgtcggacaacgcaatcaaggctcggtcggcgtcgtaggtgcgactttgttccttggcccggtggatccgatgttcaagctccatattggtaaaggccagcaaggcgctgtcgccgcactggccggcgcctcgggtcttgaggcaaacattattgcgcagctccgtggactcgcccatggccagcagcaaggtccagacgcgcgcggtcagcgcttcccgggaggcaatcgacgacctgtaggcatgggtcttgggcaggtcccgcaggacctggaacacatcgtctgcactgacctgttcattggcgagcagttgctcccacagcaatgtgcgttcggcatgtgcggtgacagtaacgccggccagccattggcggacctcgttcggcgcaaccggtgcgtgctgtattccggggagtacaccgcccagccggatgccctcacgctgccagtattcgtcaagcagcacctgcatccccggttccaagtcgttgccatgcagcacggtattgcggttggtgacgcgcatgcgagcgtcggtaaacaacacgtcaggcacgctggtgatcaggttttcctgcaacgacaatgcctgcatgccgggccgtcgttcggcgccaatcggccaccggctgataccggtgcgttgcaggctcagggtgcgcaggcgcgtcatggcgctgacatccggcgtcagttccaacgggttgtcgttcaaatgcaattcgcgcaagcgggtcattccggcaaggttttggcgggactcttgcgtcagtcgaatgttgttgtcgtcaaggatcaggtgttcgagctgggtcatgtcggtgatgctggtcggcagatcggtgagcccgcactcgacttgcaggaacctgaggttggcgaacttgctcaggaacgcgttgccggtggcggggaacgcgtcacccgtcagcatcagcgattcgatgtgcgcgaacccccgcgtgcccaggataaagtccgcgtcgggcaagtcgttgccgtccagttgcagcaccaggtggtgggtgtcaaacagaccgttgtcgaaaagttgccgggtttctcggcgccaggcgctgcggatctgttgggcaatgaggcgccgtctgtcgaggtttacgccctggggggcgtcggcgtcgttggcatggggcgcttcggcccaacgggtcaggccgtagtccagtgcctggtactcggccttgcgccgttgcagttcgagcaacgcagcgggttcgctcgtgcccagctcggctatcaggtcattggcgccggcccggctgaggctggggtagagctcgcgcactttgctcagcaggtcaaccggctgctggctgctgaacggccacaggttttgcaatgagaaaggataggcgctgaacgaggtgtcaacctgcatgggcggttgcagccagaagggaacatgggggatgcccagcagggccttgatggcgatgcgttggttaagggccgcatcggcgatgccgttttgcaaggtggatagctcgccatcccccagcacttggtggatggcgctcagcaagccctcacccatgccgctgatcagttggccctggtcgtcgcaggcttggtaacgcccgtcgaccttggccagcactttgcgttgagtaccgttcaggtgcccggcgctgctgagtaactggccgctggcgttgccttgatggatgtccagccgcgtgtcggccggccagcccgcagccgaggcgagtacgtgcaggatgatggtttcgctgtcggggttgcccgaggattgcaggtacaacccctcaaatgcgcggttcaggcgcacatcgttgcgggtcaggcgcacctgctcggccaggcgcaggccgatctcgtcatgttcgtgcagttgcttgatctcgcgcgggctggcttgctccagaatcgcgtcgagggcgctgccgggcaaatcggggtagtgctgtttgaagcggcgttgcagcaccgtgccggtgttttcgctttgggcgtagaggctgtcgaacaattgcgtgcgctcgcgataagcatgttccgcgaccttcctggccagtttgaacaggcgttcttcaaggctcgcgggtagctcacccagcagggcgcgtgtcacggtgtcgtctttggcaatgttggtcagcggggcggacccgcggctttgcctgacggtcatttgtattgtgtgtgcggcgcccacgttggcactcgggaagctgcgaatgatttggccgtcagtgtcgaccacttgcagcacgtggctcttcggccattcgcgcagggcgcagaccaacagtaattgcagcgccggccgtgcgttgccggtggccgagtaggtggtcatggcctggataaaatgctcgatttcgcgctcgatgcgaaagcgtttgctggtgtctgccagcagcggcggcggcggccggttagcgctgtgcacctcgcgcaaggcgcgggccggggtgtcggtgacccgcaggatgcgcgcggcggttggctggtcgacatcgtagcccagtgggccgaggcggtagaacagcgagtagtcactccaggccattgggttctcgctggacagtcgccacgcgcctcgacggttgtgctcaaggcgcggggtgtcgacgccgacttttttcgggtgcttgaggcgccatttgagcagcgtgttatcgaaggtgatcgggtacagcgagccgtacagcggcaccaattgctggccctcgtagtcgtaaaggccttcggcacttggctgcaggtcggagggcaagacgaggcgctgttcgtattggaccagggaagtgttcagcaggctgatgtggccgtcggggctgcgttgagcactcatcaagtcgccgagggtcttgcgcaaaccttcggcgtcactggccgattgcatgcccagttgcaggcgttcgtggggctgcagcactgagccgatagccaggtaaaaactgtccacggccggtgtcaccgggataggcccgccgttgagcatgtcgtaggcctcgtagcggcctgcgccgtaatgcagcagttcgacggtggtgtcgtccggcccggtggagacgtagctatcggcgggcctgcctttgctcatctcggtgaccacgaagtgccgcttgagcgtggtgcgcaccaggctggcggcaaactcacgggcccataggtcggtgtcgtgatgaaacgcccgtgggtggtagaggccgtcgatgaccgcgtcgatccgtagagcggtgcggtggtgttccaggctttgcctcaccggcgcgggcagcttgccgtggctgagaaattcggtttgctgctgcgggttcaggggcgtctgcagcaacagttgttgcaggttggcgggcgtcagcggcgggtacaggtcgcgcagtttttgcagcaccggggtcacttccaccagcgctggcgcgaccttgaccgccaccaggtcgcgggcgctgtcggtcaccgggacttcgtcgcgggccttgccggcgtaacgggtcatggcactgaacaggtccacctggcgcgtcttggccaaggcgctgatctgcaaccgcaggcgggcgatacgctgggccaggctcaggtgtgcgctgccttctttgcccaaggtggaattgccgggctgcctggcgataatcagctcgaacaactgctcctgcggcgcggcgccaatcgtcgtgtcgcccaacgccaagtaggtgccgtcatcgcgtcgtgtgaggtcgatggtgtgggcgatgggcggcgtgtaacggttgccggcataggtctcaatgtggctgcccgactcatcatgcacacggatgatcgcgtcctgcggccaggtctcaagctgtgtcagcaggcacagcacgctgctgtcggcatgcggcggcatatggccgcgacggtgaaattcgtggatcaattgcttgatcagttgatcgacctgcaggcggcgcacgccttcggtgaggttaatcggcgcgggctcgccgctccagatgcgattcagtgtggcgcggctgggggcggtgctgcgcagcatgcgctccatggcagcgcgaggtaccgggcttgagccttcgggcagcatgcgttcggtcaactctacgtccgacagggtgtgagcattttgcaggtccagcgtccaggcttgctgcgccgggtcgaagataatcggcggcgcgtaggcaccgctgttgtgttgtttgagggccatgcgcttggtctgcggatcaaggtgcacctccaccaccacacgttgctgggcatgcaccagccagacgtattgattgcccttgacctgatacacgccttgagggttggcgacctggccgttgagcaggttctggtccagcgtggcataggcgctgatatcgggtttccacagctcgaattcgccgtcggcgcgctgcactttgcgtgggttgcccaggctctgcattaacccgttgatacgctggcgatggacgcggccggccgttgagatcaacaggctgttgaccgccaggtcggcaacgtcggttatggccgcggcgaagttgctcgcgtcaccctgggcggcttcagtgatgccgaccaccacgctgtaggtgaggctgccgaacaccaccacttgcatgatccggtttaacccggtgacgccgccgggtacgggggtgagcaacagctgcaggatttcgtcggcgaccgcggcggcgccgtcgatcacggcttgcaggtcacgttcggagcgggtggtcgccagggtcgacaggttggcgtggtaacgctgcacctggcgcaaggcaaaggcgttgaccaggctttttaccgggccggttttcgggtcgatgctaaagcgcagatggcccaggctgcgttccgggaaccagtgatggaaggtgtcatagaggaactccgccgcatcgctgaggccgacggggcgcggtgcttcgctcggcagttgcttgaacgcgtgcatttgcgccatcggcagttgccgggaaaaccagccgaggtcgccgctgctatggctgctcttcaaatcgtcgaggaactgagcgttggcagccctggcatccgcatgaaagcgcagtgcgccgccggggcgaaacggaaagtaggatatgacgccgaggctggccacctggatcagcagcagcggcaacggcgtggcgatgtcgtagggcgaggcatccatgctcacggtgtcgaaggccagggccgggccgctgccgtcgatggcgtggaccagtttttcgtagagggccagggtgatgccggtgctggcgtggttacggtaggcctccaacgcttcgaaccgcaggcaggcatgcgcgctggtttcgatcagggcctggagagtgccgcctggggcaagcgctgctttcagaagggtttgcaactggccgcccaagtccagctcgcggctgatggcgacaaagcgcggcacgtccagttggtcgctcggcaccccggtgaggtaggtcgaatcgacaaaactgtgcccggacctttgcttcgtctgcgtggcaaaatcgaagttcaggcaggcggcatcccagagtgacagcgtggacaggtgagggcggtatttccattcatcataggtgcggcgaaagcgtgagcctgagacgggcttggcgatgctggtccgcggttcccagggcagtggcacactcacttgctccaggtagcgggtgtgcaggaatatcgcctcggggtccaggccaccgagcttgctgcgcaattgcgccaggccctgggttttgaaggtgttgatcagtgcggtgtttgccgtttccaccgcgttcagtgccagcagcgcttcgcgttgcagccgcacataggtatgttgttggctcggcgtcaggccggtgaagttgcgcgcgagggtgtggcgaataaactccagggcctgttggcgggtccaggattcgttggactgcaggttgcccgacagtccgtcgagcagtagatgggtagccatgggcgtttcctttcacagtcaagtggaaggccaatggaaacacccggccggggcaggctggcgctagctatgtagtgctgctgcgccaggcgcgcgcggcgcctggttgaggcgtttgttaaattccatccaggcggcaagggcagacatcaacaccacaccggccagggccgtcagcaattgcacggccacggcgtcacccgccagggcgttgagcatgtccgccaggggcgccagcaccacgcccaggcagaacacttccagggaataccggcccatctggcaaacccgttcggccaggcggttttgcgtccactcgcggccgggcagcagtttggcggtcacataggccagggccaggaaatgcacgagacgcaccggtgacaggtcggttttgctgatggggtacagccagttgctgagcgtctgcggcatcaccgcgtcatggatgtgcggccagagccaggacagcgtgatcaccccggcgaccactacatacagcgccgcggcgacgaacagcggttgccgttgcaaggggcgcgtctggggcaccttgggtcgttggctgtaaatcgccgctgcgccccccagcacaaacagcaactgccaggtgaccgggttgaaataccacacgccatcggcgatggcccgcaggttccagcccatccacggcgccatcaggtacaccgccagcgagacgccgaccaccgcccaggttgcgcgcaccatcagcggcagcaccacggacaagccggcgagcaatacgatgtacagcggcaacgggtccatcaggttgggcttgaagcgcaacaacagttcatcggtcagcgcctgttgcgggtgcgtgacgaagtgcgtcaggcccatctcttcgaccagatcgcgggtttccacatggctgttggcgaagaatacgatgcccatcaacatcgccagcaggaagatatgcaccacgtacaacacccaggtgcggcgcaggattttcaggcaggccagccaatagccttcgcgctgcatgactttgccgtaggccagcaccgaggcgaagccggcgaggaacacgaagacttccgccgcgtcgctgaaaccgaagttgcgcagggtgatcaggccgagaggattgtgggggacgtgatcccagaaaatgaagatcaacgccaggccccgaaaaaaatcgatgcgcgggtcgcgtccgttcagcatggcagcgggctcttgaacaaaaggtttattaatgacaggcgaatgcgcgcgttgtcgtacgccacacgtcgggcgggcgcaggttggcggtatttgtaagcaattgcaaaggctgggtattactgaatgtctctagacatcaatgatcaccaatgtgccgtggctgccggcgagtacggcatgggcgataccggcctccatcaggtacatctggccggcttccacgcggatttcctcattgccgatgcccaggcgcagcaggccgctgacgaccagcagcgcttcgttgtagtcgtgggtttcttcttcgtacgcctgctcatccatgcgcaacactttgatccgcgccgggccaacctggcccaggcgggtggatttccagctttcgggcagttgcccggcgatggcggcgaagtcgagtaacggcatgtgaatttccttgtttcaacgatgccgtcggtggtccggttcagcagtcaataatttccaaatgattacgcagcgaccccttcatgcggctcaaaactgtccgcccgcgccatttgccacatgcgcgaatagaactcgccgttcacttcacccgtgagcaattcaccgggcttgaggaacacatgcaattgcgagaacagcttgatttcagtcgccgacatgcgtcgtaccaagtgcttggccgacagttgcgaagggtgatccaggccggccgccgcgagcatttccgccagggccttgagggtgttgcggtggaagttgaacacgcgctgggctttgtccggcaccaccagagcgcgttggcgcagcgggtcttgggtggcgacgccggtcgggcatttgttggtgtggcagctttgcgactggatgcagccgatggcgaacatgaagccgcgcgccgagttggcccagtcggcgccgatggccagcacgctggcgatatcgaacgcgctgacgatcttgccgctggcgcccagcttgatcttgtcgcgcaggttcaggccgaccagggtgttgtgcacaaacagcaagccttcacgcagcggcacgccgatgtggtcggtgaactccaccggcgcggcgccggtgccgccttccttgccgtcgaccacgataaagtccgggagaataccggtttcgagcatggccttggcgatgcccatgaactcccacgggtggcccaggcagaacttgaagcccaccggtttgccgccggacagctcacgcagttgggcgatgaactgcatcatttcaatcggcgtggaaaacgcgctgtgacgcgaaggcgaaatgcagtcttcgcccatcaggatgccgcgggtttcggcgatctctttagtgaccttgtgcttgggcaggatcccgccatggccgggcttggcgccctggctcatcttgatttcgatcatgcgcacttgcgggttttgcgcctgcacggcgaagcgctccgggtcgaaacggccgtcgctggtgcggcagccaaagtagccgctgccgagttcccaggtcaggtcgccgccgttttcacggtggtaagggctgatgctgccttcgccggtgtcatgggcaaagttgccgagcttggcgccttggttgagcgcgcgaatcgcattggcgctcagtgagccgaagctcatcgccgagatgttgaacaccgacgccgagtacggttgcgtgcactgcgggccgccgaccatcacacggaaggcgctcgggtcactcaacggcgcggggcgcatggaatgaccgataaattcgaagcccgactggtacacgtcgatcaaggtgccgaagggtttgtcggcggtttcgttcttggcgcgcgaatacaccagcgaacgctgcgagcgcgagaagggcagcgcatcgctgtcggactccagcaggtattggcggatttccgggcggatagcttccaccaggtaacgaatattgcccaggatcgggtagttgcggcgcaccgcgtgggggctttgcagcaggtcgaacaggccgatcaggctgagcacgccggtgactacggtaatgggccacagccattcatgttcgataaacgggaggctggcgagggtgaaaatgacgcacacggcaaagaaggcgtaacggcttagtaacgacaggctcatacggttttccttggttcggactcatcggctaggcgttttgcgcctgaagaaagatcgagaacagctccgactgggatttgatccctagcttgctgtacatgtgtttcttatggactttcacggtttcaacagagatttccagcttacgagcgatttccttgctggagcaaccgctgagcatcaagcggcccacatccagctcacgggcggtgagttgcgcgccccagtcatcattctggatcggcggctgtggcgcgctgacctgcttgagttcatagggcaggcgctggcgcagcaggctcagcacccagggttggatcagcgacagcagggcgatctgctgcgggtcaaaacgctgtttcgagcccagggacaggcacagcgtacgcccatccgccaattggcaattaaattggatttcatcggccaccacgttcaggcggaagtagcgctggtagtactcagtgagttcaaagtgctccggcgccacttcggccaggcgaaacagaccggtgcgcgagtgctcgcggctggcgatatagaaggggtcgagcaggtacaggccgttgaggtagtcctggaacaactggtccggcgtgccgtcggcgcctgggcattcggcgaataccaggggccggtgctcactgctgaacagcaacgccacccaactgtcgaacggcacgtaggggtccagcaagcgcacaagctgggtccagaaattggcctggtcgagggcgtctatcatttgccccaccgaacggtgccaggcgatgtcatccagcgacatggtcattgatctacccctatcgggttacccccgccgcgtaattccctggcaggttgtggctgcgcatactgcggcacagataaagaacaaggaatactcatgaaggtcgaatttgcccagttggcaggccgtgataacgacacagcttacaaccttgagcgcgccttggcggcaattgctgcgtgcgccgccgacacacaactgatcgtttttcctgagacccacttgatgggcttcccgtcggccgagaccgtcgctgccatcgccgagccggtggatggccccacggtacaggccgttatcgacgccgcccgcgcgcgccatatcgccgtggtgatcggcatggccgagcacgacgctggccaattctataacaccacgttgctgatcacccccgagggcatcgccctgcgttatcgcaagacccacttgtgggcctcggaccgcggcgtgttcacgccgggtgatcgctacgccacgtgcctgtggaacggcgtgcgcgtcggcctgttgatctgctacgacatcgagttcccggaaaccgcccgcgccaacgcgcagctgggcgccgaactgctgatcgtcaccaacggcaacatggacccgtacggccctacgcaccgcaccgcgatcatggcccgcgcccaggaaaaccaggcatttgcgctgatggtcaaccgcgtggaagagggcgatggcggcctgttgtttgccggtggcagcgccttggtcgacccgattggcacgctgctgttcgaggccgggcgcgaagaggggcaatttaccgtcgagctggatctcgaccaattggtggcggctcgcaaggactaccgctacctggacgaccagcgcttgaaattgccgggtgaggtgattgagcgcacggatgggacgcgcgaattgctcatccctaaaccctgaggattgatcgttcccacgctctgcgtgggaatgcctcctgtgacgctccgcgtcacgctgttaaaagcggacgcggagcgtcccgagctgcatacccacgcggagcgtgggaacgatcgaataagaaaaatgacatccgcttcaccgacttcagttctgccataaatctaataaatcagcggagaatcgctcatggctcgtttgcaacgcaccctgtcgttagggtcggtggtgctgtttggcatcgcctatatgacgccgatcattgtgctcggcaccttcggcatcctcgcgcaatccaccgccggcatggtcccggccgcttacctggccgccctggtggcgatgttcttcaccgccatgagttacgggcgcatggcgtcggccttcccggtggccgggtccgcctacagctacgtgcgcaaggccatcagccccaagctgggctttatcgccggctgggcggtgttgctcgattacctgttcctgcccatggccatctggctgatcggtgctgcgtacctgcactcggcgttcccggcggtgccgcagtgggtctgggtgttggcgtttatcgggattaccacggcgatcaatatcatcggcctgaaactggccaacggtattaacgcgctgctgatgctggtgcagtttctggtgctgatcgcgtttgtagcgctgtgcatccattacatcgggggcgacgcgagcaagccgctgtggacgatcacgccattcttcaacggccagatgcaaatgccgctgatcatgagcggggcggcgattgcctgctattcgttcctgggctttgacgcggtcagcacgctgacggaagaaacccgcgacccacgccgcaccattcctcgcgcgatcatgctgatcaccttgatcggcgggctgatcttcgtcggtgtgtcgtattttgtgcagatcgcccacccatccttcgagtttgccgatgtggattcggcagcctatgagattgcgcgcaatatcggcggcgacctgtttgtgtcgatcttcctgatcggtttgatcgtcggccagttcgcctcggggctgtcggcccaggccagtggttcgcgcttgttgttcgcgatgggccgtgacggcgtgctgcccaagtcgttctttggcaccttgcacgcgcgcttcggcacgccggtcaacagcatcctgttgtgtgcagtcgtggcgctgctggcgttgaaactggacgtgaccacctccacctcgttcatcaacttcggcgcattcctggcgttcagcctggtcaatctttcggtgatctttcactactggattggcgcgaaacaacgcggcgcgcgggagttgatcctgttcctgctgttcccggccattggcctgctggcggatgtgtggctgatggtcagtcttgatcacctggcgatttacctgggtgtggtgtggttggcaatcggcctggtttacctggggtttctcacgcgcggcttctcacaacagccgccggaaatggacttccaggaagccgcatagaagccccaggcctattcttattgcaatcggttctcgtttgggtgtgtgatttgtgttactgtataacaaatcaaatgcacccagacgccccggaggccttatgaaagctggtatccatcccgattaccgtaccgtgctgttccacgacaccgccgctgacgtgttcttcctgatcggctccaccgccgacagcgatcgcacccaaaaacacagcgacggcaatacctacccgtacatcccgctggacgtttccagcgcctcgcacccggtctacaccggccagcagcgcaagacccaggccgaaggccggattgccgggttcaacaagcgttttgcttcgtttggctccagcccgaaaaacgccgaggcgtgagggtttcatgtttcacctcaaaggccgctcgcgtttctggagcggcttttttttgcgttgatatcgcagtgccatcacttcttccgaaaaccaactaaactactctgtaatcgccaggaggcattgccccagaccgtaaggaacgcacatcgacgatccgaggtgtcccatgggagagtcagttgccttcaccgatgccgaccgtccagtggtgctgttgatcgatgcccacccggatgtattgcacagcctcacgcaattgctgagcctggaacccttcgaattgcactgcgccacctgcgccgctgatgccctcgccacgcttgccaggcaacccatcgacctggtgatgagcgccgcgcgcctgccggacatggacggcgcctccttgctggcgcatatccatcaacactacccgcacaccgtgcgcatcctgctgaccggcgagaccgacctgacgctgatcatcaaagcgatcaacgagggccagatctaccgctacctgagtaaaccctggaacgacgaagaattgctcctggccctgcgccagtccctggcgcatcaacactcggagcgtgaacgtgggcgcctggagcaactgatccagcagcagaacgatgagctcaagcaactcaacgccacgctggaaaaacgcgtggcctcgcgcaccagcgaactgcagcaaaccgccgacatgcttgacctggcctacgaagagctcaagcacagctacgccaccgggactgaagtgttctcgttgctggccaacctgcgcctgccgcgcgccaagcagaccaaccggcagatcatcgagctggtgcgcacctggtgcgtggcccatggcgtagacgaggcaagcaaccgcgacctgaccatggcggccgcgctctataacatcggcaagctgagctggagcgacagcatgatggcctcgccctcggacctgttgcacagcagcgaccgtgaacgctatcgcgcctatgccacacaaagtgaatcgctgctgatgactctggaaccgatgaaagacgccgcgcgcctgatccgccatcaccaggaacgctgggacggcagcggttttcccgaccacctcaagggcgaagcgattcctgccggttcacgcttgctgaaactcgccgtggactttatcgagctgcaaaaaggcctgatcctggaacggcagatgaacagcgacgaagcgctgctgtacatccgcaaatacgccggaaggctgtatgacccggtgatggtcgaagactttgtgctggtgtgtgccacctaccttaatgacgtgacgctgggcgacccgaacgtcaaagtgctgggcacccgcgagctgcaagaaggcatggtgttggcgcgcaacctcaatgccgacaacggcatgttgctgctcaatgcgggcaaggtcttgaacctgccattggtggataagttgattgcgttcgaaaccatggagggcgcgcggtacagcgtgttcatcaagcaagacgcagtcatctgtggttgagcagcgcttaaaaaggtgggagctggcttgccggcgatagcggtgtgtcagccaactcaggtactggctgatagaccgctttcgcgagcaagcccgctcccacattggattgcagcgtgcctgtgggtcatgtgatccttgcggtttttgcagccaaggaagacctcccatgccatccaccctgcgcattgccgccgccctcctgatcggcagcgacggccaaaccctcttggtgcgcaagcgcggcacccaggccttcatgcagccgggcggcaagatcgacgcgggcgagcaacccgccgaagctctggcccgtgagctgtttgaggaactgaacctgcgcatcgagccgcgcgaagcggtgtacttagggcacttttcggcgcctgccgcgaacgagccgggctttaccgtggaagccgaactgttccaggtgaatatcgacgtggcggtcagcccggccgctgaaatcgaagaggtgcgttggatcgacccggccggcgatggcggcttgcacttggcgccgttgacgcgcgacgtgatcctgccgttttatcgcgcatcactcgctgtatgctgattcgcacgctaggcgccggcgacgccgaaggctatcgagcgttgatgcttgaagcctacggcgcctatccccaagcgttcacctccagcgtggccgagcgcgcgctgatgccgttgagctggtggcaaaagcgcctggacaacccgctggatagcctgctcggcgctttcgatggggacgtattggcgggcattgtcggcctggcgtacgaaccgcgtgagaaggcgcggcacaaggtgaccttgttcggcatgtacgttaacgaggcctaccagcgcaacggcctgggccgccagttggtggaggcggcactcgccgaagcgcgcaagcatccgcgccttcaagtcatccagctgaccgtcaccgccggcaacgacgccgcgtttgcgttgtatcagcgttgcggcttcatccagtacggcctggagccgctggcggtgcgggtgggcgaggattatttcgacaagattcacatgtggcgtgaactcaagaccgactgaaatcctaaccgggaactcaatcccctgtgggagctggcttgcctgcgatagcatcacctcgctgctgctgccagaccgcggcgtctgcatcgcaggcaagccagctcccacctgtttgatcggtttcggctagcgcacgacgctgaccccgtccaacgtggaaaacgacgtgtccttggccgtcagcaaaaagtcgcgcatgtacggcgcatccagcatgtccgctcgaatccccgcgtacaacgtcgcaaacaggcctttctcgcccaagcgcttggccttcacgtaaccgcgcgagctgtattcatgcagcgcccaatgcggcatgccacacacgccacggccgctggccaccaattgcatcatcatcaccgtgagttccgaggtgcgcacctgggcaggttccacatcggccggttccaggaaacgcgtgaagatatccaggcggtcgcgctctaccgggtaggtgatcagcgtttccgtcagcaagtcttcgggcacgatgtacgacttgttcgccagcgcgtgctggttggccacggccagcatggcttcgtaggtgaacagcggcacataggtgatgcccggcagctccagcgggtcggaggttaccaccaggtccaaatcgccgcgcgccagcgccggcaatggggcgaaggcaaaccctgaggccaggtccagctcgacttccggccacgcatcgcggaactggtcgatggtcggcatcagccactggaagcagctgtggcattcgatcgccatgtgcaaacgcccggcggtgccaccggccaaacgcgcaatatcacgctcggcgccgcgcagcagcggcagggtggcgtcggccaattgcagcaggcgcaaaccggcgctggtgaaacgcagcggtttggttttgcgcacgaacagcggcatgcccaggcgctcttccagttccttgaactggtgggacagcgccgactgcgtcaggtgcaggcgctcggcggcatcgaccaggctgtcggcttcgcgcagggcgtgcagggttttgaggtgacggatttcgagcacgggctctccatgaagacaatttgtgaagaagctgaatagcgtgagtttgtctcatgttgcgaagcctgtcgataacgcgtcgattgtgaccgctgggcactcttcatcaaactgtcacgcaactgtggcagcgcgcttgaacaaacttcatcagactcgcgctctactggggttctgcgtttcggtgtttttcatgcgcgtgttgtttttactggccgctctattgttcggcctgccgtcttttgcggcttctcgatgtgatgtcaatgtcccgacacaaacggtcgacctggctcaggtaagcatcgcctaccagagcatcggccgtgcatccgaccctgcgttgctgctggtgatgggcctgggcgggcagttgatccactggccggatgaagtggtggtggcgttgtgcgaacagggttttcgggtgattcgttacgacaaccgtgacgtcggcctgtccacctggcgccaggcgccggccagcgccaacctgacctttgaagtgctgcgctacaagctcggcctgccggtggcggcgccctatacgctgaccgacatggccgacgacgcactggggttgatggacgcgttgcaggtccagcaatttcacgtgctgggcgcgagcatgggcggcatgatcgcccagcacctggcggccatggcgccgcaacgggtcgagagcctgaccctggtgatgaccagctccggcgccgaaggcctgccggcgcccaacgcagcgttggtgcagttgctgtcgcggcgcagcgcgccgaatcgtgaagtggcgctggagcagcaggcggatttgctcgcagccttgggcagcccgtatgtgaaagatgaccgccaagccttgctgcaccaggcggcgctgtcctacgaccgcgccttcaaccccgagggcgtgaaacgccagatcatggcgatcctcgccgagccgagccgcgtgccgttgctcaaccaattgcgcgtgccgacgctggtggtgcatggcacggccgacccgttgttgccggtgatgcatggtgtgcatctggcggcgcatatccagggcagccagttgaagctgattccaggcatggcccaccgttttcaggaagcgttcaaggcgccgctgctgacggctgtgctgccgtacctcaaagcccatcgcgaagacgccgcacattgggcgcagattgacttgggcgagccttcgaaggtgttgtgaagttggtgtatcgtgcaacctttacggcacattaatgatgccagcgaggttgcctgtcatgagtactcccctgaaaatcgatttcgtcagcgacgtgtcttgcccctggtgcattatcggcctgcgcgggctgaccgaagccttggaccagttgggcgccgaggtgcaggccgagatccatttccagccgttcgagctgaacccgaacatgcccgccgaagggcaaaacatcgtcgaacacatcactgaaaaatacggctccacccctgagcaatcccaggctaaccgtgagcgcatccgcgacatgggcgctgcgctgggctttgcctttcgcacggacgggcagagccgcatctacaacacctttgatgcgcaccggctgctgcattgggcggggcttgaaggccggcagtacaacctcaaggaggcgctgttcaaggcgtatttcagtgatgggaaagacccgtccgaccacgcgacattggcgatcatcgccgagagtgtcgggctggatatccagcgtgcggcgcagattctggcgtctgacgagtacgctgctgaagtccgtgagcaggaagaattgtggatttcacgcggtgtgacttcagtacccaccatcgtcttcaacgaccaatacgcggtcagcggtgggcagccggcggaggcctttgtgggggcgattcggcagatcatcagcgaagcaaaaggctaagcgcaggctcacttttctgtgggagctggcttgcctgcgatggcatcaacccgatgtacctgatacaccgaggtgcctgcatcgcaggcaagccagctcccacagttgctactcagtcaaacttgtagctgatcgccgtctgcacctgcccctgattcacatcacccttttccttaacaatggtgctgttggccgccgaacccaccaggtgcgtccaactggcgctggtcagcaacgaccaatgcgtatccagcgggaattcaaaactctgggtcaacgtcaggttctggaagcccgcgctggcgttataggcgcgaatacccgaagccgcagattccttgtcatccacaccaaaaaaggtctgggtctggcgggcgtcggcaaagtgcgccatcagcccggtgctgccaatgatgccgccgccgagcgggtagcccagctcgccgccgagtttgcccagcacaccactttgatcacgcccgccgcccacggcctggccgacttgcgcgtacacacgccagaactcggccggggcgtattggataaagccgccgacttcggccatgtccgacacatcgcgcaggccgcgcagtgagccattcgccgtgcgccccgacaggtaattgatgtacgggccggcggtaataccgtgggtgttcagtgcgctccaggtcaggccgtcgtcggtgcccaggctgacactgccccagtccaggtcgaaatagggaatcggccgggtttcgtagcggctgccggtcgggtcgtggggctgatagctgacgcccgcgccgacttcaccgctaatgccgtcagcccatgccgagctggaaaagctccacagcccaagcaaaccagcgaatacagcagaagtaaccttgaacatggagcgtttccttatctgaacgtgcgcgcattcacgcgcgaagcgcatccctggcgcaagcactcatcttgtttgtagcaagctacaaaaattgtagctcctgcgacacaaatcaccctgcacatcgaccaaagccccagccccgctgggctttaaccagttggcacagtccctgctatagccctgatacaagcgcacagagcgctactcttcaaggtcaaggtaaacgcaatgatccagtggcatatcgtgtgcgacttcgacgggaccatcacccccaccgacgtcatcgacaacgtcctccaacgcttcgcaggcgaagagtgggaaaccatcgaacaggaatggctggatgggcatatcggctcacgcgaatgcctgagccgccaactggcgctgatcaaggcgaccccggctgaactgctggcgtacttcgacagcgttgagatcgacccggacttcccggatttcgtcgaccacgtcatgggcctgggcgcgactatcgaagtggtcagcgacggcattgaacaaggcatcgcgcgcatcctgtcgcgtaactacgtgaccttgctgccgatcctcgccaaccgcctgcgccaggtcgaccagaacagctggcgcatcgacttcccgtattccagcgacgcctgccgtgccgcttccggcaactgcaagtgcaaatccaccccgcgcaacaagcgcgtgctggtgatcggcgacggcaagtccgacatgtgcgtggcttccaccgccgacttcgtcttcgccaaaggcagcctggctgactactgcgaaaccaacaagatcccccacgcgcgcttcgacacttttgccgaagtgaccgcattgctggccaagctgccgcaaggcatcgccgccaacgccaccacctttactgctgctgacaatcaggaactcttccaccatgtctgatatccgtatcgccacccccgaagaccagatccttctggataaagaagccaaatactgctcctacggcgacaccgttcactacatcgagccaccgcgtattttcagccgttgcgaaggctcctacgtgtgggacaccgaagaccaggcctacctcgacctgcaaatgtggtactcggccgttaacttcggctacgccaacccgcgcctgaacaacgcgctgaaacagcagatcgacaccctgccgcaaatcgccagccagtacctgcacaaaggcaagatcgagctgtcggaaatgatcgcggtcgacgccaagaagaaattcggcctcgacggtcgcgtgcacttcaacgtcggcggttcgcagtccatcgaagactccctgaaagtggtgcgtaacgccaccaacggcaagagcctgatgttcgccttcgaaggcggctaccacggccgtaccctcggcgcttcgtcgattacgtcaagctaccgctaccgtcgccgctacggccacttcggcgagcgtgcgcagttcatcccgttcccgtatcacttccgtggccctaaaggcatgaccaaggaagagtacggcagccactgcgtgcagcaattcgcccgtctgttcgagaccgaatacaacggcgtgtgggacccgaaagtcggccagagtgaatacgccgcgttctacgtcgagccgatccagggcaccggcggctacgtgatcccgccgatgaacttctaccgcgaactcaagcaagtgctggatcagcacggcatcctgatggtctcggacgagatccagatgggcttctaccgcaccggcaaactgtggtcgatcgagcacttcgacgtgcagccggacgtgatcgtcttcggcaaggcgctgaccaacggcctgaacccgctgggcggcatctgggcccgtgaagagttgatcaacccgaagatcttcccaccaggttcgacccactccaccttcgcctccaacccactgggtacggcggtaggcctggaaatgttcaagatgaccagcgaagtcgactacggcgcgatggtcatggccaagggcaaatacttcctcgaaggcctgcaagacctgcagaaacgtttcccgatcatcggcgacgtcgacggcctgggcctggccctgcgctgcgaaatctgcggcccggatggtttcacgccggacaaggcgaccctggactacatggtcgaagaaggcatgaagggcgacatggtggtggatggccagaaactcggcttgatcctcgacgtgggcggttactacaaaaacgtgatcaccctggcaccgtcgctggaaatcagctacccggaaatcgacctgggcctgaagctgcttgagcaactgctggtgcgggcgactaaacggtgaacagcttcgggatcgacctcggtgaaggtgatgccggcttcgttctcggtgaaggtccggtcgggatcctgttgatccacggcctgaccggcaccccgacggaattgcgccaggtcgccaaaggcctggcgaaggcgggtaactgcaccgtgtatgtgccgaccctggccgggcattgcggcgacaacagcgacctgcaggccaccggctggctggactggtacgaaggcgtgcgcaagaccttcgtacaggtcaagcaacgccacgagcaggtgtttgtcgggggcttgtccatgggcgcggtgatgtccatgtacgtcgccgccgaacacccggggcaagtggccgggctgctgatgtattccaccaccttgaagtacgacggctggagcattcacaagctggcgttcctgacgccattgctgatgaagattccgttcggcgtgcacatctgccgcttcgaagagaagccgccttacggcatcaagaacgagcgcctgcgggctatcgtcgagcgccagatgaaggaaggggagagcagcgaggccggtttgctgaccatggaaggcatcacggtgcgcgagttgcaccgcatgaacgccgtggtcaagaaacgcatgcccgaggtcaaggcgccggcgttggtgctgcactccatcgaggatgacatcaccagccgttggaacgccgactacgtggagcgccacttgggcggccccgtgaccaagatcctgctggacaactgctaccacatgatcaccgtcgacctgcaataccgccgagtgatcgagttgagcgcggagtttgtcgagcaacatgcctgcgtcactcgcaagcgcgctaccagtggcgagcgggcttgccccgcgttgggtggcgaagccgccccatcactggtactgcatgcttccagttagaaccgaggtgcctgggtttggggctgcttcgcagcccaacgcggggcgagcccgctcgccacaagaaatagaaaaaagggaaactcgtgatcaccgcccaagccttttcaaccatccgggccatcccgcgcagtgcctggaacgactgttttcccggagccctggaggattgggatttttacgtcgccgtggaaaacgccgctatcgatgatttcaagtggcgttacctggcggtctacgacgatgaaacgctggtggccgtggccgccgcgttcatcacctattatcgtctcgacaccacggtgtcgggcgccggcaagcgctttaccgagcgcctggagcgactgtggccgggtgttttacgcttgcagctgtatgccatcggctcgccaatcgccgagcgatgcgacgcgggagtcgccagcagcgtgcctgaagagcagcgcccgctgttgctcaagcatttaattaacgccgcccgccaggacgccactgcctttggcatcggcctggtggcggtcaaggatgtgccgaccaaagacctgcactgggcggccagctgccgtgccgccggcttccagagcatgccgagcttgcccagcggtttgctggccgtgccttacggttcggtggacgcctacctgggctcgttgtgcaaatcgacccgcaaggacttgcggcgcaaactgcgcgcgccgggcccgcgggtggaatggcgacacaacattgatgacgtgctggcggacgtgatgcgcttgtacgaagccacgctcagtcgcgccgacttgcagtttgaacgcctgccggcgagttacttcactggcatcctcgaacggcttgaagagcgtgcggtctgtgtgctgtattgggtggacgagcggttggtggcgttcaaccttgtgctgttggaccagcaccgtatgatcgacaagtttttcgggcacgacatagcgttcagccgcgagtacagcttgtacttccgctattggctgaccaatgtcgactattgtattgagcacaatattcctgtgtacgagtgcggtcaggacggttacgccagtaagctgcgcctgggttgcgagttccggggcaacagcatgtttttccgtcaccgtaatcggctggtcaatggcctgctcaaactcgtgaaaatgtacctgagaccggatcgttccgaccctgccatggctgctgcgataagcgaaacctgatgatcaccaagacccgccagaaagcccgcccctttgccatttcgcgttggagcgtccagcgcaagctggtgctggcgttttggctggtcagcgttattcccaccatgatcgccgccgagttggcggcgactacgttgtcgcagattttcgacagtaacgtgcgcatctggctgcaagagtcgaccaagatcgtcaaggacgaaatcggcgatatccttcatgacaacgcgcgcatggccaagctgttcctgcgctacaccagcccgccgtcgaacaggcaagctgccaagcatgaccggctcaccgccgacatcgccgacgccaccgacatcgacgtggtcgcgctgattcgcgtcagtgaccacaaagtgatgttcagcacggcagccgacgacgtcgtcaagcagatcgacctgaccagcaatgcggtactgcagaccgtgcaggtcgctggcgtgagtacggggctggtggtctcgacgttcgaaaccaaccaggagggggttgattacctgctgttggtggccacttacctggacagcagtttcctcaccagcgtggccgatgtgcactccctcgacctgcgcctgtacctggccaacccgtcgggcttcaacgagatattctcgacccagcgcttcgagaatcacccgtcgcgcatccccaaggatgtcgagacggcgatgcgcagcaccaagcagccgagtgagcagttcaccaacaactacagcggcttgtactggccgatcttcaatgacgccggcgacctgcaaggcgtgatcttcagcggcctgttgcgccataccagcctggtcgggctggtcaaccagagcaacctgttcgtgctgattttcctgctcagctcagcgttgtcgctgggcgccggcgtactggtgtcgcggcgcctgaccaagccgctgcgggacttgtcccaaggcgtgaacgcggtgatctccggcaattacgaacaccgtgtgttggtcagcggcggcgatgaactggcgcaactgagcagcaccttcaaccacatgaccgagcgcctcggcgagttgcatcacctggaggcgcagttgcggcgtcgcgatcggctgcacgccttgggcgaagtagcgatgggcctggcccatgagatccgcaacccgttaggcattatcaagacggccacgcagctgctgcaccgccgtgtcgacctgccggacaccgacaagcgccacctggaatacgtgatcagcgaggtcagccgtatcaacgacctgatcaccgagtttctcgattttgccaaacccaacccgccgctgcgggtgttgcaggcggcgcgaccgctggtggaagaaatcctcggtttctgcagccctgagctgtcgacgcataacatcgatgcgcaaatcgacgaccaggcgccgggcgcaacgatttatgccgatgccaagcagctcaagcaagcgtgcctcaacctgatcctcaacgcgattgatgcgatgcccgaaggcggccgcctgaccctgggccttcgcagcgtcgacggcaacacggtgatcagcatcgccgacaccggccagggcattccggcggatatgatcgagcggatcttcacgccgttcgtcaccaccaaggcctccggcacgggcctgggcctggccaaagtctattcgatcatggaaagtcacgacggcagcatcgaatgtgccagtgagaaagatgccggcgccaccttcagcctgtacattccggcccaaggtgaagacgacggcgacgatgaggaaggtcatgacgcataacgtattggtagtcgacgatgagcccaagctctgcgacttgctgtcgtcggcattgagccagaacggcatccaggtattcaccgcgagcaatggcctgcacgcgctcaaggtgctggaacaggaagacatcgacctggtcatcagcgactggcgcatgccgggcatggacggcccggcgttactggccgagatcaaggtgcggttcccggagttgccggtgatcgtgatgacggcctacagcacggtgaaaaatgccgtgcagtcgatgcgcaatggcgcctatgactacatcgccaagccgttcgacatcgacgaactcgacatcaccgtggccaaggccctgcagtttcgcgacatcatgcgcgacaacgcgcggctgcgtgccgagctggaccaccatgcgcagttcgacagcctggtcggcgacagcccggcgtttcggcaggtgttgcacgcgattgactcggtgcgtgacagcagcgccaccatcctgctgaccggcgaaagcggcaccggcaaggaaatggtcgcccgcgccatccacaagcatggcagccgtgccgacaagcccttcgtggccgtcaattgcgcggccatcccggaaggcttgctggaaagcgagatgttcggccaccgcaaaggcgcgttcaccggcgccgtggcggatcgggtcgggcgctttatgcaggccgacaaaggcacgctgttcctcgacgaagtgggcgacatgccgctggcgttgcaggccaagattctgcgcgcattgcaggagcgggtgatcgagccggtgggcgacccgcgcgagcgcaaggtggacgtgcgggtcatcgccgccaccaacaaaaacctgctggatgcggtggccaataaagagtttcgcgaagacctgtattaccgcctcaatgtgttcccgatcccactgccggccttgcgcgaacgcgccgaagatatcgtgcccctggcccgacacttcgcccagaccctgagcgccaccgccggcaaacgcatcaccggtttcagccccgaggcgttgcaggccatggccgcgtacaactggccgggcaatatccgtgagctgcagaactgtgtggagcgcgcgaccatcgtcgcagccaaaccggtgatcgaagacatcgacctgccggcgtacctgtttgcgtcccggccggccgaagagggcgttgcggcgctgctgggtgacaacccaagcgtgccggcggacctggacgcggcgctggcggaagtcgagaaaacctacattctggcggcgttgaacgagagcaacggcgtgcaggctgcagcggcggcgaagatcgggatttccgagaggagtttttggtatcggttgaagaagctggggattcaggtggacaagatcgtgcgctgagattccagggcacacatgattgctttaaatgtgggagctggcttgcctgcgatagcggtctgtctgtgccaaatgagttggctgatacaccgctatcgcaggcaagccagctcccacattttttacccccggtgtgtcaggtattgaggcggacccacatccgagaggagtttttggtatcggttgaagaagctggggattcaagtcgacaagatcgtgcgttgatctatcaggctcaccactgaa

SEQ ID NO: 44 - DNA, 106216 bp, Pseudomonas poae FL10F
gcagcggacgggactcgaacccgcgacccccggcgtgacaggccggtattctaaccgactgaactaccgctgcgcgtcggtgcaacctttaacgttgcgtcttgccctaaggcaaaactctcaagaagtggtgggtgatgacgggatcgaaccgccgaccctctgcttgtaaggcagatgctctcccagctgagctaatcaccctttgcttcgttgaggccgcgaaatttacgcaggtagcggacctaagtcaatagcctgcttgaagtttttctgaaaaagacaaaatggcttcaagacggctatccgccctactcgctgtaaatcatcttcttgctcatgccaccgtccaccacgaactcctgcccggtgacaaaccccgcctgacgcgacagcagccacgccaccatcgccgccacgtcctcaaccgtgcccaccctgcccgccggatgctgggcgtggtcggcatcggtcagcggctcggcacgccgcgcggcaggatcccgcgcatcgatccagccagggctgaccgcattcacccgcacctccggccccaggctcatggccaaggcgtgcgtcagcgccagcaggccgcccttgctcgcggcataggcctcggtgtcgggctccgactgacgcgcccgggtcgacgccaggttgacgatggcaccgccatgggcacgcaggtacggcgcacagtgcttggccagcagcatcggcccactgaggttcaccgccagcacgcggttccagtacgccagatcgaggctttccagggtgatattgcgcgggtcggccacggccgcattgcacaccagcgcatccaaacgcccgaattgccccagcacctcggcaacgccttgggcgacttgtttctcatcggccacgtccatggtgataaaccaggcgttatcacccagcaccttggacaccttggaaccgcgctcgcggtccaggtcggtcaacaccacctgccagccttcgctgatcagccacgcagcaattccaaggccaatgccccgcgcggcgccggtgaccagtgcgacgcggccgttaccgaccgctgcagcttccatggaccactcgatcacaaggccgccagcccgcgggccaggtcagcctgcaagtcagccacatcttccaggcccaccgcgatgcggatcaggctgtcacggatgccggccgcttcacgatcttgcggcgccaaacggccgtgggacgtagtgctcgggtgagtgatggtggtcttgctgtcacccaggttggcggtgatggaaatcaggcgcgtcgcatcgataaagcgccaggcgccgtctttgccgcccttcacttcaaagctgaccacggcgccgaaaccacgctgctggcgcagggccaactcgtgttgcggatggctcttgaggccggcgtagtggaccttctcgataccgtcctgctgctccagccactcggccagggcctgggcgttggcgcaatgggccttcatccgcaggctgagggtttccaggcctttgaggaagatccaggcgttgaacgggctcagggtcgggccggcagtgcgcaggaagcccaccacttctttcatttgttcgctacgcccggcaaccacaccgcccatgcagcggccctggccgtcgatgaacttggtggccgagtgcacaacaatgtccgcgcccagcttcaacggttgctgcaacgcaggcgtgcagaagcagttgtcgaccaccagcatcgcgcccttggcgtgcgccacttcggacaacgcggcgatatccaccaattcggccaaagggttagacggcgactcgacgaacagcaattttgtattggccttgatcgctgcatcccagccggacaaatccgccaggggcacgtagtccacttcaataccgaagcgcttgaaatacttctcgaacaaactgatggtcgaaccgaacacgctgcgcgacaccagcacgtggtcgccagcgctgcacaggctcatgaccaccgcgaggatggcggccatgccggttgccgtggccaccgcttgctcagcgccctccagggccgcgatgcgctcttcgaatgcacgcacggtcgggttggtatagcgcgaatagacgttgcccggcacttcaccggcgaaacgcgcagcggcgtcggcggcggtgcggaacacgtagctggaggtgaagaacatcgggtcaccgtgttcaccttccggggtgcggtgctggccggcgcgcacagccagggtatcgaaagctacgccatcgaggtcgctgtccaagcgaccggcatcccattcctgactcatgctgcgactccttactcaattctttatttaagatacaaaaccggcccctcagggccggtgtttactcagttgttgtacaggtcgatgatcgcgctgaccgcctgggtcttgatcttcgacgagtcattgcgcgcctgctcgatcttgttcaggtaagcctcgtcgacatcaccggtcacgtatttgccgtcgaataccgcgcagtcgaactgctcgatcttgatcttgccaccgcccaccgcttcgatcaggtcaggcaggtcctgatagatcagccagtcggcaccgatcaggtcggccacgtcctgggtggaacggttgtgagcgatcagttcgtgagcgctcggcatgtcgataccgtacacgttcgggtaacgcacggcaggtgctgcggaacagaaatacacgttcttcgcaccggcttcgcgggccatctggatgatctgcttgcacgtggtgccacgcacgatggagtcgtccaccagcatcacgttcttgccgcggaactcaagctcaatggcgttgagcttctggcgtaccgacttcttgcgcgccgcctggcccggcatgatgaaggtacggccgatgtaacggttcttgacgaagccttcgcggaacttgacgcccaagtggttggccagttccagcgcggcggtacggctggtgtccgggatcgggatcaccacgtcgatgtcgtgctctggacgttcacgcaggatcttctcggcgagcttctcacccatgcgcagacgcgccttgtacaccgaaacgccgtcgatgatcgaatccggacgcgccaggtagacgtgttcgaagatgcacggggtcagtttcggcgccaccgcgcactggcgggtgtgcagcttgccatcttcggtgatgtacaccgcttcgcccggcgcgaggtcgcggatcagggtgaagcccagcacgtccagggacacgctttcggaggcgatcatgtactcgacgccttcgtcggtgtgtcgctggccgaacacgatcgggcggatgccgtgcgggtcacggaaaccaacgatgccataaccggtgaccatggccacgaccgcgtaaccaccaacacaacggttgtgcacgtcagtcacggcagcgaacacgtcttcttcggtcggctgcagcttgccgcgctgggccagctcgtgagcgaacacgttgagcagcacttccgagtcggaactggtgttgacgtggcgcaggtcagattcgtaaatctccttggccagctgttcaacgttggtcaggttaccgttatgcgccagggtgatgccgtaaggcgagttgacgtagaacggctgagcttcggccgacgtcgagctaccggcagtcgggtaacgcacatggccaatacccatgtgcccgaccaggcgctgcatgtgacgctgatggaacacgtcacgtaccaggccattgtccttgcgcaggaataaccggccgtcgtggctggtcacaataccggcagcgtcctggccgcggtgctggaggacggttagcgcgtcatacagcgcctgattcacgttcgacttaccgacgataccgacgatgccacacatgcgacgcaacccctacttaatgaatcttgactgaacacaacttactgaggcgttttggccggtaagaggtgctccttgaacggaagatcagcgggtacgctgattccgctggccagccactgactgctccaccccaaaatgaggtttttggaccaatctgcaaccaatagaaattttggcacgagtaccgactcctgccaccacgaatcctgctgtaccggccccaggctcaacagcccgaccgccacaaccaccagcaagccgccacgcgcggcgccgaaggccatgccgagaaatcgatcggtcccggagaggccggtgacacgtatcaactcgccaataagataattgaccattgctcccaccagcagcgtggcgatgaacatgatggcgcagcccgcaatgacgcgagccgaaggtgtttcgatgtacccggccaggtaaaccgacagtgaaccaccgaacatccaggctacgactcctgcgatgatccaggtcagcaacgacagtgcttcttttacgaagccgcggcttagactgatcaaagcggagatggcgacgattgcaacgatcgcccaatcaacccaggtaaatggcacagtgcagcctacgtacggataaggcggcgcattttagcagagcgtcgggctatcggtaagctgtgattgcgggtgctttgcaaatcaatgggttgtgcagagtgaacgccctttcaagaccaccaaaaaccactgtgggagctggcttgcctgcgatgaggcaggcccattcaacatcactgttgactgagccaccgctatcgcaggcaagccagctcccacatttggcctgtattccagccagagctggcggttactcaaccgcgctcaggctggaaacgcaccacaaacccattcaggttctgctggcgacccagcaaatcccgcaggcgatccgcctcggcgcgctcgatcagcggcccgataaatacgcggttcttgccatcggcactgcggatataggcgttataaccttgagtgcgcagctttttctgcaaggcttcggcgctttcgcgattggccaggctggccagctggatcgaccaagtgatcggcaagccgttcgggtcgatgcggctttggcccacgtccggcttgcctggcgcggcaggctgcggcgcgaccggcttgggtgcaggcgctggcgcagcaggcttggcagccacaactggcgcagctggagccggcttgaccaccggaacactcggctgcacgggctgagtcggcgcctgttgctgggcgacttcctcgtcggccggcacgggctcttgcggcaacgcctgcggctcaggcaccaccaccggctcaatctgaacctgaggcaccgttggcgcctggggcgcagcgggcgcctcgacgactacctggcgctgctcgtcctggcgggaaaacagcatcggcagaaaaatcaccgccaacgccaccaacaccagggctccaaccattcgctgcttgtatgcgctatccagtaatgccatgtgcagcttcctccgtggagcgccgggccaaccactctagcgcctcggcaacacaataaaatgatccgaacaacagaatctcgtcctcggccgtggccaccgcacactgagcttcaagcgcggcggtgacgcttgcatacgacgccaccgatgcaccaaggttctgcaaggccacttccaactcggccgccgggcggctgcgcggcgtgtccagcggcgcaacggcccatgattggacatcaccgagcaacggcgcaaccacgccgtccaggtctttatcggccagcagcccgaacaccgccaggcgacgcccggccggaggcgtacgcgacaggcgttgcgccaggtattcggcagcgtgagggttgtgccccacatccagcagcaggttcaggcgcttgccctcccactcgaaggtgcgacgatccagacgccccaccacccgagtcgccagcaaggtggcagcaatctgctcggcctgccagggcagatccagcagcaggtaggcttgcagcgcgagcgcagcgttctccatcggcaggttcagcagcggcaggtcacgcaattcgaccacctggccacgtgcatcacgcccgcgccattgccaatgctgagtgccgatttccagattgaattcacgaccacgcaggaaaaacgcgcaatccagctcacgcaccttgtccagcaagggttgcggcgggtccaggtcaccacatagcgcaggcttgccctggcggaagatcccggccttttcataggccaccgactcacgggtgttgcccaggtagtcagcgtggtcaacgccaatgctggtgaccagcgccatgtcggcatccacgacgttgaccgtgtccagacgcccacccaggccgacttcgaggacgaccacgtccaattgcgcacgctcgaacaaccagaacgccgccagggtgcccatctcgaaataagtcagggaaatctcgccgcgccccgcgtccagtgcagcgaaggcttcgcagagttgcgcgtcagtggcttcgacgccattgagctgcacccgctcgttataacgcagcaggtgcggggaattgtagacgcctactttcagcccttgggcctgcagcagcgccgcgacaaaggcacaggtagaacctttgccgttggtgccggtcaccgtgatcacgcgcggcgccggccggcccaacccaaggcgggccgctacctgttgcgagcgctccaggcccatgtcgatggctgacggatgcaactgctcaaggtaggcgagccattcgccaagggtacgttgggtcataggtttgcaggcaccggcggcacgacgatcggctcgattttaggcgcgacgtacacaggggtcggcaggcccatcatttgcgccaacaggttacccaggcgtggacgcagctcgccacgggcgatgatcatgtcaatggcaccgtgctccagcaggaactcgctgcgctggaagccttccggcagtttttcgcgcacggtctgctcgatcacgcgtgggccggcaaagccgatcagcgcctttggctcgccgacgatcacatcacccagcattgccaggctggcggaaacgccgccgtagaccgggtcggtcagcacggagatgaacgggataccttcttcgcgcagacgcgccagtaccgcggaggtcttggccatttgcatcagggagatcagggcttcctgcatgcgcgcgccaccggaggcggcgaagcagatcatcgggcaacggttttccagggcgtagttggcggcacgtacaaaacgctcaccgacgatggcgcccatggagccgcccatgaaggagaactcaaacgccgacaccaccactggcatgcccagcagcttgccgctgacagaaatcagcgcgtctttctcgccggtctgcttctgcgcagcggtcaggcggtccttgtacttcttgccgtcgcggaacttgagacggtcaaccggctccaggtcagcgcccagctcggcacggccatcggcgtcaaggaagatgtcgatgcgcgcgcgggcgccgatacgcatgtggtggttgcacttggggcaaacgtccagggtcttttccagctcggggcggtacagcaccgcgtcgcaggaagggcacttgtgccacagaccttcaggaaccgagcttttcttcacctcggaacgcatgatcgaagggatcagtttgtctactaaccagttgctcatgctttctttctccagtaccggtggcttgaacacagccccgcgtatgcccttgagctaaattcatatgtggcgatgacacaagctggacggggtcagacgttcgaccggccatttcctgcctgtatcctcagccttccaaacaacctgccagcgcagggttgccacttcatttccgggcctcccgcaggcggcgccggtgctgttttacacagtggtagttactgacggcggcagactgccagccgtcacatcgcaccgctgctgttgcgcacggcctgcatgaatgcgcgaatcttgtggtgatccttgatgcccttgccctgctccaccccaccgctgacgtccacggcatagggcctgacctgctcgatggccgccccgacattcgcagggttgagcccacccgccaggataatcggcttgctcagcccctcgggaatcaacgaccagtcaaacgcctcgcccgtaccaccgggaacgccctcgacataggtgtccagcagaatcccgcgagcgccggtgtaggccgcgcacgcggcggcgatgtcatccccggccttgacgcgcaacgccttgatatacgggcgttgatagctttcacattcgtcagggctttcgtcaccgtgaaactgcagcatgtcgagctgtacggcatccagggtttcgttgagttcacagcggctggcgttgacgaacaagcccaccgtggtcacaaacggcggcagcgcggcgatgatcgcccgtgcctgcagcacattcaccgcccgcgggctcttggcgtagaacacgaaaccaatcgcatccgcccccgcctcgactgccgccagcgcgtcttctatgcgggtaatcccgcaaatcttgctgcgaacggctggcatgtcgtaaaaacctcaggggttgaaccgagaaagtcccggatggtaacaaaagcttttccgggcgtcagccgccaagttcgctgaaacctgtgaggaagtgtggcccgatgaagcgatccggcaattcgaactcgtcgcggtactccacatccaccaggtacaggccgaatggatgcgcagtaacgccgccggtacggcgaatgcggctttccagcacttccttggcccactccaccggccgttcgccggtgccgatggtcatcaacacgccagcaatgttgcgcaccatatggtgcaggaaggcgccggcacggatatccagcacgatcattttgccgtgacgggtcacccgcaggtgatggacttccttgatcggcgacttggcctggcactggccggcacggaaggcactgaagtcatgcacgccgaccaaatgctgcgcggcctcagccatgcgttcggcatccagcgggcggtggttccaggtgatttcctgattgaggtgcgccggtcggatctgatcgttgtagatcacgtagcggtagcgccgggcgatggccttgaagcgcgcatgaaaatgcgcgggcatgaccttggcccaggtgacactgacgtcatggggcaaattgatattggcgcccatcacccaggctttcatcgtgcgctcggcctgagtgtcaaagtgcaccacttggccacaggcgtgcacaccggcatcggtacgccctgcacacatcagcgacaccggcgagtcggcgaccttcgacaacgcgttttcgagggtttcctgcactgtcagcacgccggaagcctggcgctgccagccgcggtagcgcgagcctttgtattccacgcccagggcgatgcggttaaagcctgcggccgccatttcggcggccgcgttatctatatttgccaagaactgagagcccgatgagttgcgcaaaggcggccattataaaggcggcagccgtaggtggggcgcttttgttgtggctatgtgaaggcctgatgtgtgggagctggcttgctgtggcgagggagcttgtcgaatcgtcgcaccgtcccgttgactgcgcagcagtctcaggctttttgggggcgcttcgcaccccagcgcaagcaagcttgctcgccacagcaagccagctcccacattggtcccgcgttgcacctttagattttgccgagcatttccttggcttcgccgcgctgggtttcgtcgccttcggtcagcacttcttccaggatgtcccgcgcgccgtcagtatcacccatgtcgatgtaagcctgggcgaggtccagcttggtggcgacctcatcggtgccggagaggaagtcgaattccggttcatcagcgcccaacgccgcgtcttcagcggtgaaggaaggctcgattggcggatgttccaggctctgggacagacgatccagctcggcattgacgtcgtccagctcggaggcgaaggcatccggcttagccgacgccggcgcggccggttcttccgccagggacaggtcgaagtcttccggcaggtcgaaatcatccagcgcggcaggcgtgagggtcggcggctcaaccggcggcacgtccttcatctgctcttcaaggcccgagaggaagtcgtcgtccgagtgcgtggaagacggcgcttccaactgcaggtccagatcgaagtccgacaggtcatccgggctggccttggcttcggtctggcgctgaaggacagactcaaagctcggctcatcttccgggcgaaccacggcaggcgaagctgcttccagatcgtccaggctcaggtcgaaatcggtatcgaaggcatcgggttccgccaccggcgcggccggcttgtcttccagcaagtccttgacgtattgcgcgtccagcgctgcagcggcgacagcggcactgacgcccgccgccaacacggccatggccgggaagcggcctttgagctgctcgacctgggcatggttttcaccattagccaccagttgacgctcctgggagacgaacccgtctttgtcgccttgcaggccgtacacttccatcagtttcaaacgcaggtcgctgcgcttgggctcatgcttgatggcctgctgaaggacgtcggccgcctggttcaggtgaccgcgatcaatatgggactgggcttgcgccagcgcatcgctggaattctgcggagccacggcagcggccagtggcgacagcacggaagcaaccgacggcaccacgaccggctcagcaaccgcagccggggcaggtgcggccgccaacttgacgttcggcggcgccacttcgaggccttcgaagctgtccgctggcaagtcgtgatcaatgttcggcgaaaatggcggctcttcagccagcgcccgcgccatccgcaggtgcttttcctcttcaaggcgcgcattgcgatgacgcgcccacagcaacaggagcagcaacaccagcaagccggctgcaccgccgatcacgccgaggacaatcggattggtcagcagatcgttgaatttaccttcggtgctgctggcaggcgcggtctctggtgtgaccggctcgggcgcaggcgccaccacggcaggcgccgccgcgtcagaggctggcgcggtggtcgcaggctcacctgccaactgtgcgggcattgccgccgttgccgggcttccgttcgccgcctgcagtttggccagctgatcgtttttcagttgaatcagcttctgcaatttatccaactggctttgcaggtccgccgcccggcttttcagctcagcattgtcgcggcgcgtggtatccaattcttcctgggtcatcgccagcttgtcgctcagcgcattactgtcaccgaccttgcccttcgcgcctttcctggcggattccgccgagaccaggctcaagttgtccttggtagtggtgctcgacggcgcatcgccagcctgggtgcgcttcgttgcatccaactgctgcttgcccgcggctgggttattcgcggtgcgacgcccctcgcgccaggcggtgttttgcgcggccacttcggcaatcgcctcgggctgcggcaaactggtggcttgctggcgatccggaaggcgcaggacctggccggttttcaggcggttgatattgccgtcgataaacgcatccgggttgagcgcctggatagccagcatggtttgctggaccgaagccccgttgcgattcttcgcggcaatttcccacaaggtatcgcgcgaggtcgtggtgtgttgagcagacttgccgacagtgggcacagcgttggcaggcgcgtttttagtcggcgcactcaagcgcggtgccggcgcggcagcggtcggcgccggttgctcgaacttggccgggtcgagcagcacgctgtagtcgcgcatcaggcgaccattgggccattgcacctgcaacaggaaacggacgtaggaatcgggcagcggcttgctggacgtaacgcgcaccacactgcgcccgcttgggttgaccaccggagtaaacgtcaggtcattgagaaacgcctggcgatccacgcccgcgtccacaaacgcctggtcagacgccaggctcggggtaatctcggaagccgtgaggccaccgacatcgagcaattcgatttccaccgacaacggctggttcaacttcgacttgagggtcatctccccaagctgcagcgcctgcgccataccggaggacagcgccgaggcggccgctattgctaacaccagtttgcgaacttgaaccatagcctcatcctttgtttgaacactccccggcctgcgagaaggttggtaaccgctgccataaggcatggcgagccgataggtcaccgacgcgcttctgttccgcttggggccaagcatagcgcttggctagaatcaatctacaaattggcgccaagtatcttttacgcaaggccttttatcaacaactgcgccagttgcactgcgttgagtgccgcgcctttgcgtacgttatctgacgtcagccacagatttagttccgccgggtcgtccacgcccgcacgcactcggccgacgtagactacatcctgaccgaccgcatccccaacggccgtggggtagtcgccctcctccaccaactcgatacccggcgctgcttcaagtgcgcggttgaccgcaacgaggtcgaccggcgcgcccaactgcaatgacacagtcaggctatcgccaaaaaacaccggggcttgaacgcaggttgcggaaatctttagcaaaggcttttccagcactgcgcgcagttcgtgtacgagacgtttctccaaggctgtatgaccttgggcgtctggtgtgccgacttgtgccagcaaattgaaggccatttgccgatcaaagaacttgggctccagcgggcgcacgtttaacaactcggcagtctgccgagccagctcgctgacggcctcgcggccctgggcggacacagccaggttggccgtaacgctgacgcgctggatgtccagcaacccgcacaacggtgccaggaccaccgccaggttggtcgcggatgggcttgggctggccagttggaagggttttttcaggcccttgagaatgtgcgcattggcttccggcaccacttggggtgcctgatcggccggcaaggcgccggacaggtcgatcaccgagcaacccgccgccgtggcgcgcggggcgaaactcagggtgaccgccgggccagccgcgaagaaggccaactgggcttttttgaagtcgaactcatcgacttccttgacccgcacgttcttgccgcgaaacggcactgaggcgccggccgagttactgcccgccagcaggtacagggtgccgaccgggaaatccagctcttcgagaatctgcaccagggtttcacccacggtgccggtggcgccgatcacggcgatttcaaaggtctgggtcatggtggctgcctcgggcattgcggggggagcggcactttaccgggtggttgggggtgaggcaattaacctggggatcgtggcatggctgctggcctcatcgcgggcaagcccggctcccacattttgataggtgaacacattccgaatgtgggagctggcttgcctgcgatgaggccttgaagggcaataaaaaacccgcgcctgtcaccagtcgcgggtttttcgtacagcgctaagcgattaacgctccagcaaaatccgcagcatgcgacgcagcggttcagccgcgccccacagcagctggtcgccaacggtgaacgcgcccaggtactgagtacccatgttcagcttgcgcaggcggccgactggcacattcagggtgccggtgaccttggtcgggctcagctcctgcatgctgatatcacggttgttcggcaccagcttgacccatgggttgtgctggctgatcagcccttcgatatcggcaatcggcacgtctttgttcagcttgatggtcagcgcctggctgtggcaacgcatggcgccgatacgcacgcagataccgtccaccggaatcgggttcttgaaacgacccagaatcttgttggtttcggcctgggccttccactcttcgcggctctgaccgttcggcagctctttgtcgatccacgggatcaggctaccggccaatggcacgccgaagttctcggtcgggtaggcatcgctgcgcatggcttcggccacacggcggtcgatgtcgaggatcgcgctggccgggtcggccagttgatcggcaacggcggcgtgggtcgcgcccatctgcttgatcagttcacgcatgttctgcgcgccggcaccggaggccgcctgataagtcatggcgctcatccactcgaccagcccggcttcgaacaagccgcccaggcccatcagcatcaggctgacggtgcagttgccgcccacgtagttcttggtgccggcatccagctgctggtcgatgaccttgcggttcaccgggtcgaggatgatcaccgcgtcgtcctgcatgcgcaggctcgaggcggcgtcgatccagtaaccctgccagccggcttcgcgcagcttggggaagacttcgctggtgtagtcgccaccctggcaggtcagaatcacatcgagggttttcaactcttcaatgctgtaggcgtccttgagcggggcaatatccttgcccacggacggcccttggccacctacgttcgaagtggtgaaaaacaccggctcaataagatcgaaatcctgctcttccagcatccgctgcatgagcacggaaccgaccataccgcgccaaccgatcagacctacacgtttcatcgcaactacaccttgttaaaaagtgggccgccttgcagcaacaactgcaagcgggcccgagagattacagattccgcagcgcggcgactactgcgtcgcccatttcttgcgtgccgattcgggtacaaccctgtgaccaaatgtcaccggtgcgcaaaccttgatccagcaccaggctcacggcctgctcgatggcatcggcggcttcgctcaggttgaagctgtaacgcagcatcatcgacaccgacaaaatcgtcgccaacgggttggcaatgccctgccctgcgatgtccggcgccgaaccgtggcacggctcgtacatgcccttgttgttggtgtccaacgacgccgacggcagcatgccgatggaaccggtgagcatcgacgcctggtcggagaggatgtcgccgaacaggttgtcggtaacgatcacatcgaactgcttgggtgcgcgcaccagctgcatggcggcgttgtcgacgtacatgtggctcagctcgacatccgggtagtccttggccacttcttcaacgatttcgcgccacagttggctggaggccagtacgttggctttatccaccgagcagacctttttgccacgcacacgggccatgtcgaaaccgacacgggcgatacggcggatttcgctctcgctgtaaggcagggtgtcgtaggcctgacgctcaccattctccaattcacgcacgccgcgtggcgagccgaaatagataccgccggtcagttcgcgcacgatcaggatgtccaggcccgcgaccacttccggcttgaggctcgacgcgtcggccagttgcgggtagaggatggccgggcgcaggttgccgaacaggcccagttgcgcgcggattttcagcaggccgcgctcagggcggatgtcgcgttcgatcttgtcccacttcgggccacccacggcgccgagcagtacggcatcggccgcacgggcgcggtcgagcgtttcgtcagccagcggcacgccgtgtttgtcgatggcggcgccgccgatcacgtcgtggctcaattcgaagcccaggctgtacttggtgttggccagttccaggactttgaccgcttcggccatgatttccggaccaataccgtcgccagggagaatcagaatctgcttgctcatgcgttcctcatttcatcaagcgacctgcccgtgggcaggtcgggaaaattaatcagcgttcggcaaacaccaccagcacgtcggtgctgaaggggccgtcggcttgaatttcgtaataatcgcgcacttcctggcccatcgccttttgcagctcgaggatggcagcgcgcagtacttctggcgtgcgcatgcgctcgacccaagaggtgtattccaggcgcaggcgctggcgactgctgttgcgcacgtgcaaaccggattcgctgagctgctgcatccactcggcggcgtcgtaatcgcgcacgtggctggtgtcgcgcagcacttcgacggtttgcaggtaagtgtccaacagcgggctgcccggtgacaagacatccacaaatgccgccacgccgcccggtttgagcacgcggcgcacttcgcgcagggctacacccaggtcgctccagtggtgggccgagtaacggctgaacacgaagtcgaactcgccatcggcaaacggcaggcgttcggcggcgccgtttacggtgcgaatgttgttcaggccacgatccaccgcagcagcagcgaccacgtcgagcatctgctgggacaggtcgtaggccaccacttcgttaaccagcggcgcaacttggaaactcacatgcccggcaccgcagcccaaatccagcagccgtgccgcgccctgcccggtcagttcggcctggagcagcgcaaattcggtgccttgggcgtgcacggcactgctcaggtagaccgaggcttgctcgccgaattgtttttgcacgacttgggtgtgggcggtgttggtcatggtgagcttccttgagacttttgttgtttgtactgccgtcttcgcgagcaagcccgctcccacattcgaccgagtttcttcagttgaaatgcaaccaaatgtgggagcgggcttgctcgcgaaggggccagtccggtctacatagaatcaggcatcgcgaaacaaccagggctggctggcccggtgcttggtttcaaacgcggcaatcgcatcgccgtcctgcaaggtcaggccgatatcgtccaggccgttgatcaggcagtgcttacggaacgcatcgacttcaaagtgatacaccttgccatccgggcgagtcacggtttgcgcagccaggtcgacggtcagctggtagccgacattggcttccacttgtttgaacaactcgtccacttcggcgtcgctcaagatgatcggcagcaagccgttcttgaagctgttgttgaagaagatgtcggcgtagctcggcgcgatgatgctgcgaaagccatattcttccagggcccacggcgcgtgttcacggctggaaccgcaaccgaagttttcccgcgccagcaacacgctggcgccttggtaacgctcggcgttgagcacgaagtccttgttcagcgggcgcttggagttgtcctggtaggcgtaacccacgtccaggtagcgccactcgtcgaacaggttagggccaaagccggtgcgcttgatcgacttcaagaactgcttggggatgatctggtcggtgtcgacgttggctcgatccaaaggggcgacaaggccagtgtgttgagtaaaagcacgcatcgggtattcctcagatcaattcgcgaacgtcgatgaaacgaccgttgacggcagcggcagcggccatggccgggctgaccaggtgggtacgcccgccggcgccctgacgcccttcgaagttacggttggaggtggacgcgcaatgctcgcccgactccaagcggtccgggttcatcgccaggcacatggagcagcccggctcgcgccactcaaaaccggcttcgaggaagatcttgtccaggccctcggcctcggcttgcgctttgaccaggcccgagcccggcaccacgatggcttgcttgatggtcgaggcgactttgcggcccttggcaattaccgccgcggcgcgcaggtcttcgatccgcgagttggtgcaggaaccgataaacacgcgatccaactggatgtcggtaatcgcctggttggctttcaagcccatgtacttcaaggcgcgttcgatggagccacgcttgaccaggtcggcttctttcgccgggtcgggcacgttctggtcgacggccaggaccatctccggcgacgtgccccagctgacctgcggcttgatctgcgcagcgtcgagttcgaccacggtgtcgaacaccgcgtcggcgtcggagaccaggtctttccaggcttcgaccgcagcgtcccaatcggcgccttgcggggcgaatgggcgacctttgacgtattcaacggttttttcgtccgccgccaccatgcccacgcgggcaccggcttcgatggacatgttgcagatggtcatgcggccttcgatggacaggtcgcgaatcgcgctgccggcgaactcaatggcatggccgttaccgccggcggtgccgattttgccgattacggcgagcacgatgtctttggcggttacgccgaacggcaatttgccttcgaccaacaccaacatattcttcatctttttggcgaccaggcactgggtggcgaacacatgttcgacctcggaggtgccgatgccatgggccaaggcgccgaacgcaccgtgggtagaggtgtgggagtcgccgcagaccacggtcatgcccggcaaggtggcgccctgctccgggccaatcacgtggacgatgccttgacgcacgtcattcatcttgaattcggtgatgccatattcgtcgcaatagtcgtcgagggtttgcacctgcaaacgcgagacctggtcggcaatggcttcgatgccgcctttgcgctcaggcgtggtcggcacgttgtggtccggggtggcgatgatcgagtcgacgcgccaaggcttgcgcccggccaaccgcaggccttcgaacgcttggggcgaggtcacttcatggatgatgtgacggtcgatatagatcagcgacgacccatcatcgcgccgtttcacttcatgggaatcccaaagcttgtcgtaaagcgttttgccggccatcagtcggtcctcatcatcggtgtttctatgccccgggccttgagacattcaataaccctttggcttgtgaggctgatggtatggcgctacattaaataactcaaattcatattttttatgctttggattaccaactggaataccacaatggacttggccaacctcaatgcctttattgccatcgccgagaccggcagcttctccggcgccggtgaacgcctgcacctgacgcaaccggccatcagcaaacgcattgccgggctggaacagcaattaaaggtgcgtttgtttgatcgcctgggccgtgaagtcggcctgaccgaggctgggcgcgcgctgttgccgcgcgcgtatcagattttgaatgtgctggatgacacccgtcgcgcgctcaccaacctgaccggcgaagtcagcggccgcctgaccttggccaccagccaccatatcggcctgcaccgcttgccaccgatcctgcgcacctttacccgcgagtaccccgacgtggcgctggatattcagttcctcgattcggaagtggcctacgaagaaatcctccatggccgcgccgaggtcgccgtcatcaccctggcgcccgacccgcacaatttggtgcgtgccacaccggtgtgggatgacccgctggatttcgtggttgctcccgagcacagcctgaccggcaacggcacggtcaacctggccgatattgccaggcacccggcggtgttcccgggtggcaacacctttacacaccatattgtcagccggctgttcgaagcccagggcctgacgccgaacatcgcgatgagcactaactatctggaaactatcaagatgatggtctccatcggcctggcctggagcgtcttgccgcgcaccatgctcgatgatcaggtggcaagtatcgctttgccgggcatacagctcagtcgccagctaggctatatcgtgcacaccgaaaggacgctgtcgaacgctgcgcgggctttcatgagcctattggatgcacaggtcgatctgccagggataccggcgtgaaactgtgcggcctcaaggtctgagtaaacccgcgccgaacgcccattgagccaaggccctttgataatgcgcaaccccgtcgattcagtgccacccctgccccgcatttacgccctcgacccccaagaggcggaacaaagctgggacagcgccccgcagttgctggcagccctcaacgctgcccgcctgggcgcgtggtgctgggaaatcgacaccggcaggataagctggtcacggggcacccaggcgctgttcggcttcgatccccgccaccctttgcccaaagacctggattacctggacctgctggcaccgtcggatcgagcgcgggtggtacgggcctttcacgcggtgctggcaggcgagccgttcgagcaggccatgcaccaccacatccagtggccggacggctctcaccactggctggaaatcaacggcagcctggcaccggacaagaccggccggcgccgcatgatcggggtgattcgcgaaaccacgcgccaacgcgagcgcgagtgcgccctcagccattcggaaaaacgcttcgccacgctgttccacctgtgccccaatatggttctgctgacccgccaatcggacggccggatcagcgaagccaaccagtatttcgagatgctcttcggctggccggtgactgacgtcatcggccgcaccaccctcgacctcggcctgtggcgccacccggagcaacgtgcgctgctggtcaaggccacgcagcgcaagggtgaaccgatcagcatggaggtgcagttttgcgcgagcaatggccagattcacgatggcaccctcagcgcccaaaaggtcgagctggaaggcgaggcctacttggtcagcacgtttctggacaccaccgaacgcaaaaatgccgaacaagccttgaaagacagccaggagcgcctcgacctcgccctggactcggcgcagctgggcacctgggactggcatatacccaccggcatgctttacggctcggcgcgtgccgcccaactgcacggcctgccgcccgagccattccacgaatccttcgatgcgttttttgaaggcatgtccgacgacgaccgcgagggcatgcgcaatgcctatcgcagcctgcgcgaaggccccgagggcaactatcagctgacctaccgcgtgctggccgaagacggcagcccgcggtttctggaaagccgtgcacgcctgtatcgcgacgacgccggcaaaccactgcgcatggccggcaccctgctggacatcaccgaccaggtggaacgcgaacagcggctgatcgcctctgaagaaaagtttgccagcctgttccaggccagccccgatccgatttgcgtcaggtgcctggaaaacggtgcgtttatcgaaatcaacccggcctttacccagacctttggctggaccgccgccgaagtgatcaataaaagcgccgaacagatcggcctgtgggatgactcgagcaagcgcctgcagcgaatcgaacaagtgattcgcgagcaggccctgagcaatgtggccatcgtggtgcatcacaagacgggccaaagcctgacctgcgtgatctccagccgcttgatcaaagtcggcgaccaaccgtgcatcgtcaccaccttgcgcgatatcacccaacagcaacgctcggaagcggcgctcaaggccagtgaagagaagttcgccaaagccttccattccagccccgacgcgatctccatcaccgagcgcgacaccggccgctacgtcgaggttaatgacggcttctgccgcctgaccggttatcgcgccgaagaggcgattggcctgacgctgtaccagatcggcatctgggccgatgagaaccagcgcgccgccttgttggccgagctgcaaatcaagggccgcattcaccacctggaaatgctctggcacaacaaacgtggtgaagtgctggccgtggaggtctcggtagaacccatcaccctgaatgaaaccccgtgcctgctgctgaccgcgcgggacgtgagcctgctgaaaaacgcccaggcgcagattcgccacctggcctatcacgacccgctgaccaacctgcccaaccgcgccttgctgatggaccgcctgagccagcagatcgccctgctcaaacgccataacctgcgcggcgccttgctgtttctggacctcgaccacttcaagcacatcaacgactccctcggccatccggtcggcgacacggtgctgaaaatcgtcacggcgcgcctggaagccagcgtgcgcatggaggataccgtcgcgcgcctgggcggcgatgagtttgtggtgttgctcagcggcctggacggaacgcgcgcgcaagtcagcgcccaagtgcaggaattggccgatactttgcgcgaattgctctcggaaccgatgttcctcgacggccaccgcctgcaggtcacgccgagcattggcgtggcgctgattccggaccatggctccacaccggcggacctgctcaagcgcgccgacattgcgctgtacagggccaaggactcgggccgcaacaccacacagatgtttcacaacagcatgcagaaaaccgccagcgaacgcctgcgcatggagaccgacttgcgcctggcgctgtcacgcggcgagttcagcgtgcattaccaaccccaggtggacgcgcgtggcaatcgcatcatcggcgccgaagccctggtgcgctggcagcatccgcaactgggcgcgcagtcgcccaccgaatttatcaaggtgctggaggacagcggcctgattctggaagtcggcacctggattctcgacgaagcctgcggcgccttcgcacaattgattgccgaggggctggtggacccgctgaatttcagcctgtgcgtgaatatcagcccccggcagtttcgtcagaatgactttgtggaacgggtggaacgcagccttaaccagcacaaactgccctacggcctgctgaaactggaaatcaccgaaggcatcgtgatccagaacctggacgacaccgtggccaagatgcgccgcctgaaaaaaatcggcgtgagctttgccatggacgacttcggcaccggctattcatcactgacctacctcaagcgcctgccggtggatgcgctgaagatcgaccaatcctttgtacgcgacgccacccatgaccccaacgatgccgaaatcattcgcgccattgtggccatggcccgcagcttgaacctggaagtgatcgccgagggcgtggaaaccccggagcaactggcattcctgcaaaagctgggctgccatttgttccaggggtatttgcacagtcggccactgccgatcgaggagttcagacagttgctggagtagccgtcatacgagcttcgatgcccgaaacccggcattcatccagcgcgatgacgccacgtcgtgcttttgcccggcggactcggtcgccccatcggtcactgcgcccgcatgctcgttgtgcgcctgggtgccgagcgcggccttcatcagctcatcgacggtgctttcacgcatgcagccaatcaaccccagccgccgaagcgcttcacctgggtgctcgctttcatcgagggtgcgcaaggccgccgcaaaacgctcgccggcaccggcgtcgttgctttccatctgcgcgcgcttggcactgactgcgtacaagaagttggcgtaattgagcaactgcgtatgactgccgtagaacgtcgatgcctcgtacgcctgacgcatttcatcatgggtcacctgcagcgtgaaggaatccctcatgatcacttcaaagccgtcgcgggcgacctgaacccgcctgaagatcccctgggggtcctgccagaaccggatgatcgctgccttgatcgtcgacagcgtgccgcaatggccttccaccttttgataaatgccactccagatctgctcaggcgtcatgccgccagcagcatcgagttgattgccctgctcttgcgccggcgaaccttgaggatcatctgccgagatattcattcactgatttcctgatacttatcgaagtaataacctgcaaaaaacagcctggggcaacgctgcggtggattgagtcgcgccctgactgatcgcctatggccgagccgagcccatcaacacttaaacaagtgctatggcatcgccccaggtgggcgccgcccccgggcgcccccacttttcttcgcggccatgaatgaccgccaccgaatgcccaccccgattgcatatgcccacttgcccacgggcgaggtccctgggtgagaccgtgcgcatgtactgacgcaaccccagccgcaaaagagcctcgcccggtccgtgctcatcctcgccatcgttcaggctaaggattgccgcctgatagcagcaccctgccgcgtcatcgttgtcttccatttgtgcgcgcttggcactgacggcaaagagaaattgcgcgtccttgagcatccccgcgtcccaccctttgaactgggcgccttgtgcaccttgagccagctctcgatcagtcaggctgagcgcaaaaccatcgcgcatgactacgcgataaccgtcgtaaaacctggtcacctgttggtatatatccgtggggctttgaccgcagcgctgcatcgccaccttgatagccgataccgtcacgcagttgccgtcagggccctggcggaatccgctccagatattgtccggctttgcaccgccgcgtttgcttgaaagccctggaatgaaggctgccgggtttggcctgggcactcgtgcttgatgcattaccgattcgggcacgccctgctcagtaatcggcggcgcaggcgtgggtatcaccgcaattgttttatttttcccgcccgacgcgaaacgtgttaaccgagtcagaaatgaagagaacagtcccgtcagcggactcatagtttcatcggcatctttcataaacgcattattctcaaacacgcgataggagggaacacgacgctgcgctgcctcttcactaaaagcctttagtggttttattagtaggcgagtggggcgaaatgaatcggcacttctttcccgacctatatcgttgacatgggcactatttctaattgaaaagttaaacatagaatccccccatgggcaggcaccgcttcgcggttatatagcgaagaagtgcctgcacgctaagtgttcaaatcacggaagggttatcaggacctggccattgacctggcgttgaacggcctgtttcttgtattaacagggtcctgatcgggggctgggctggtcaatcccggggtcttggtagcagagggcttcggcgttggcttggcctctggatgcttgcccgacttgacctcatgttcgtgacctggcgtgacaggaggctgcttttcctgactcacctcagaccgcttgcccggcttgacctcatgttcgtggcccggcgtgacgtggggctgcttttcctggctcacctcagaccgcttgccaggcttgacctcatgttcgtgacctggcgtgacctcaggatgttgatccagccctaccgcaggccgcttgccaggctcgacctcatgttcatgacctggcgtgacctcaggatgtttatccagccttaccgcaggccgcttgccaggcttgacctcatgctcatgctcatgacctggcgtgacctcaggctgcctatccagccttaccgcaggttgctcgcgcggcctgaccgcatgctcgtgacctggcgtgatctcatgctttcgctttttagccggcatcggcaagaggtctggcgtctgcctcatgcttgtccaaatatccggagaaacacgctcatccggacagtggcaatgagcgacgttcacgttcacatgaacagttgcattggagtcattgtttacgctgacatcaggttgacttacgggcgggtatgccaccgtcaagcgctgcatgcgtgcatccggcgtcagcaccgaatggctacttgtctgcgtggctggtaacccgtcttcgtcccgcgatttctgcggcttgcccgcgtcaggtttcgccggcaaacccgcttcggctggcaggttctgctgcttaactgcctcaagtttttcctgcagccggcccgcgcccggaaagttcggctgcttgcccaggtcaggcttctcaggcaaacccgcttcggctggcaggttctgctgcttaactgcctcaagttttccctgcagccggcccgcgcccggaaaattcggctgcttgcccaggtcaggtttctcaggcaatcccgcttcggccggcacgttctgctgcttaactgcctcaagttttccctgcagccggcccgcgccgggaaaattcggctgcttgcccaattcaggtttctcaggcaaccccgcttcggccggcaagctcggctgcttagctgcgcccggcaatttcggctgctcactggcatcgggtttgcccgtcgaactcggcaaagccggttttccgtcaagcaatttgcctgagtcggacaatgccgaaggcactaaatctctccccgcgagcatttcacgcaggacgctgaagacctgctcaagcatctcaaacaacttgttgagcgcagcgccaggaatcatggcgccattggaagagaactgggtgttgtcaaggcgagcgggcaggttgctggtgctcgcacttgtgacgtgggtgttcgacgtttcaccgggcttggctgccaagtccagaagtcgatcaagggtggacgcatcaactttcgcaaccgacggattattaaccgatagagacatgggtagttccttattcaacagagcctgaccgcattaacagttcagggagtcaatagtttattcgctggaaacaacagcgctgcttcacagtccctacatacgtggaaagttaggctgttgagttccgaaaatcggacctcatataaggaaactaatgcgcattatcagactttgccccatggacttttccgccaggaccttgattcaagccgctctttacactcggaagtcgtcacacccgttaatacactgcagtcgcgcaactaaccgacaagattaaaacgcctattcttcaaacctttatgctaaccggcaggcgcaaaaaagggcgccaatggcgccctgttcaggtgaaatgtaaacgctggctcaacccatcaagctgccaggggatgctgcatgcccagcagacggctgacttgctgcaggtccgtctcacggcgcaaggcggtaaacaacgtcaccgcctcggggtagttacgcgtcagcatcgccagccattgcttcaaacggcccggagcctgtttttcggtcagttgtgccaccgactgggtccagaattcctggagcatgggctgcatttgcgcccaggtcatttcgaccacttccgcgcccgcctttgccgccacaatctgccgcgccaggtcggggcgcgccaccaagccacggccgagcatgatgtcttcaacgccactgatttcgcggcaacgtttccagtcttcgacactccagatatcgccgttggcaaacaccggcaccttgaccacatcctgcacccgcgggatccactcccaatgggccggcggcttgtagccgtcggtcttggtgcgcgcatgcaccacgatatgcgcagcaccaccctcggccagggccgtggcgcacaccagcgcaccgtcagggctgtcgaaacccaggcgcatcttggccgtcacagggatgtgcgcaggcactgcgcggcgtacgtgttcgacaatctgattgagcagctccggctccttgagcaacaccgcgccaccccgggatttgttgaccgtcttggccgggcaaccgaagttgaggtcgatcacttgcgaacccaactcacaggccagcgcggcattttcggccaggcacaccggatcggaaccgagcaactgcacgcgcaaaggcacgcctgccgccgtgtgggcaccgtgcagcagctcaggggcgagcttgtgaaaataagcaggggtgagcaggcggtcgttgacgcgaatgaactcggtcacgcaccagtcaataccgcccacgcgggtcagcacatcgcgaaggatgttgtcgaccaacccctccatgggcgccaaagcaatttgcatggaaaacactcaacaaaaatcgtggcgcagtttactggttttcccacactaaacgttaaccccctgtcagcgcagggccatagccgtcgagaaactcgggcggcatgcgcttgggcttgccactggacagttcgatgcagacaaaggtggtttgcgcacgtaacagggtcgcgccgtcgctggggcgcatcaattgaaaacggcgcgtcattttcaggcgctggtcccaatcgacgatccacgtggccagttgcagctcatcgccctcgtagcctgcggccaggtagtcgatttcgtggcgcaccaccgccatggcgcggtcgagtcggcgatattcggtgaggtccagccccaggcgctgggaatggcgccacgcgcaacgctccagccaggacacatacaccgcgttattggcgtgccccaggccgtcgatgtcttgcgcggcgacctgcagatcgatgataaacggcgttgccaaatcccagcccatgccttgctccagtcgattaatgtcggcggggcagtgtatcaggcggtctggcgctcctgtaaacgccggccggccaacaggccgagtaccgcctcgattacccgtgggtcggccagcactttctggtgcccgccttgctccaggcgcaacaggcggctgtcgaaccaggcgtcatgaatggcttgcgaggcgttgaccggcacgaaggtgtcgtcttcggcgtgcacgatcaggccggggatattcatctggtagtgggcgacgtccaagtgtttgagcggcatgccaaaggtcagttcgacctcgtggataaacgccgagcgcgcccgtggcggcaaaccgaccatgccggcaaacccacgcagtacatcaagaaaacgcgacggcgcggcaatgctcaccagtgcctctgtacgcaaccccaattgcaccgccagcatcgcactggcgccgcccatggaatgccccaccaccgcatgcagcggtggcagctcagcggcggcttcgagcatggcgcgggcgaataacagcacatgcgcctcgcgccctggcgaacggccatgggcgggaccgtccagggcaatcaccgaatagccgtcggccaccaaggccgtgatcaggcaggcgaactgcgtgggtcgcccttcccaaccgtgcatcagcagtaccgccggcccttgcccccaacgcaatgccgacaagccgaaccgcagggtgatgcgctccgattgcgccagcagcggcagttcccagtcacgcggggccaggttgcgcggcgtcatgaaggtgcggcgcaacttactggccaccatgtgcggcgccaggcggccgacggtgccattgaagcctcgaatccaggttaatgcgcccatcctacggctccttttttcagcgcaccgccgacttggctgcgcgtagcacgcggtctgacaattcacccggcccgagcgcacgcgccaaggccaggccgccgatcatcaaggccatatccgccagggctttgtcggtgtcctcggggctggcagccaactgggcggccatcaactccgtatgctcattgagcgccaggcgaaactcatccggcaggcggctcatctcgcctacggttgccggtatcgggcacgcctggtccgttgagtcacggtgcttgcgcgacaggtagaacgccgccaccagggctctgcgctcctcgccggtcagttgtgcgtccatgtcgtcaatcgaggcgcgacgccgggccagcaactgggtgaaggcctccagcatcaacgcgtctttgctttcaaagtgagcgtagaagccaccgaccgtgagccctgctgcgcccatgacttcgccgacgctcggttcggccgggccgcgccggatcagcgcggcgctggcagcctgcaaaatgcgttcgcgggtttgcgcttttttatcgctcatcgttgcctccgtctttcatgggttgaatattattaccataataatatttagcaagccatccgcataaccgctcgtccgagcagcgcaaatgagatgaatggaataaaacgctcgccccagccgttatcgatgcaacgaaccgcataccggagagaacgtcatggcctggagacagcaacacgcggattgcgcatgggtggccggagaggcgccctatgtgtttgccaacgaatacaccgccaacttcatcagcggctttcgcaccgtgctgatcgccaaggtggaaggagaaggcgtgggcaaccagccgttcggaaaattcttcaatgacgccgacgggcatgccgaggccaactttctggaggcgctgcgtgccaatgactgggtattcgatgcggggtatcaggagatcgtggtgagcatcaacaactcaccctgccggcactgctgtgcgctgttcaaagagttcatggaagacatcctgctgcgctttcccaacactcggctggtgatcgaaacggcgaacatctaccacccgaacgaccccgtcgaccaaggctgtctgcgtgccctttcgcgccggcccggcattcgtgtggaattgtggaacgtcgcgctggagaacgcccagaaccgaggcccgcaagtcgatcagcaacgcgagctggcgcgcatcaacaaatcactgcgcaccgccaacgtggtgcaaaacatgccgtagcctgccgcgagaaaacccaaacgccagacaaacaaaagggccattcaataattgaatgacccttaaaaatcccgcagagcgggtaatcgtggcgtcccctaggggactcgaacccctgttaccgccgtgaaagggcggtgtcctaggccactagacgaaggggacacaaaccttctatacaactgatcagcgctgagaactgatcgattcaaggacggtgtggccggaaccttgaacctgtaaaattggtggagctaaacgggatcgaaccgttgacctcttgcatgccatgcaagcgctctcccagctgagctatagccccggatttttcgtctcgcgacgcagcagacctttcgagctgcttgttgaaactggcgtcccctaggggactcgaacccctgttaccgccgtgaaagggcggtgtcctaggccactagacgaaggggacacaaaccttctatacaactgatcagcgctgagaactgatcgattcaaggacggtgtggccggaaccttgaacctgtaaaattggtggagctaaacgggatcgaaccgttgacctcttgcatgccatgcaagcgctctcccagctgagctatagcccctcatcggtgaggacggggcgaatcttaatggcggtttgaaaggctgtcaaatttattttcaacaattttcaaaattttttgccgggataacaatcacttaccgttaaaaccccggaaaaccggggttttatcgttacagccggttgcttaggcgatagcgcccagcagcttttcccactctttgttttctttcttcgacacacccccaagcaaatcaagggcttggcgcagacggaaacgcgtgaggtccgggccgagaatttccatcgcatcaagcaccgacaccgaactcgcctgcccagtgatcgcggcaaacatcaacggcatggcatcgcgcaatttcagctccagggactcaaccaccgcctgaatcgttgcggtgatcgcgtccttctcccattgacgcaggctttcgagcttccacaggatcaactgcatcaactggcgaacctgatcgcccgagagcttcttggattcaaacagcttggcatcagggttcacgccaccggcaaagaagaagctggccagcggggcaacctggctgaacgtctccaccctgccctgcaccagcggcgcgatcttcatcatgtagtcagggttcagcgcccactgctgtacacgcgtggcgaactcttccaccggcaggtcacgcagccactgaccgttgagccacgacagcttctcgatgtcgaaaatcggcccgccgagtgacacgcgcgacaagtcgaagttatcgaccatttcctgcagcgagaacttctcgcgctcgtccggcatcgaccagcccatgcggcccaggtagttgagcatcgcttcaggcataaagcccatgcgctcgtagaaggtcaccgaggtcgggttcttgcgcttggacagcttgctcttgtccgggttacgcagcagcggcatgtagcacagctgcggctgttcccagccgaagtattcgtacagcaggatcagttttggcgccgacggcagccattcctcgccgcgcagcacgtgggtgatgcccatcaggtggtcgtcgaccacgttggccaggaagtacgtcggcaggccgtcggtcttcatcagcacctgcatgtccatgcggtcccacgggatttcgacgtcgccgcgcagcatgtccggcaccacgcacacgccttcgctcggcactttcatgcggatcacatgaggctcgccagcagccaggcgtcgggccacttcttctttcgacagcagcagtgcgcggccgtcgtagcgcggggtttcgccacgcgcctgttgctcggcgcgcatctggtccagttcttcggcggtgcagaagcacgggaaggcatggcccatgtcgaccaattgctgggtgtattgcttgtagatgtcgctgcgctcgctttggcgatacggaccgtgcgggccaccgacgtccgggccttcggcccaggtaatacccagccagcgcagcgcatcgaaaatctgctgttccgactcacgggtcgaacgcagttgatcggtgtcttcgatccgcaggatgaattcaccgccgtgctgcttggcgaagcagtagttgaacaaggcgatgtaggcagtgccgacgtggggatccccagtaggcgatggcgcaatgcgcgtgcggacggtggtcatggctggtctcgaatgggcgataaaactgaaaattgaaacaaggggcgaatggtaacagcctggggtggttgggctccagaccgaggtgatgccatcgcaggcaagccagctcccacagttgaaatgctttccaatgtgggagctggcttgcctgcgaagaggccggtgcagtcaccgccaatcaaacagccaacaaccgctcccgcagcttgccgatctcatcacgcgtctgcgccgcggcctcaaactcaaggtcccgcgccagttggtacatcttctcttccaactgccggatacgcttggtgatctcactcggcgagcgcaattcgttctcgtacttggcgctttcttcggcggccttggccatgcccttgcgcttcttgctgcgcgagcccggcacggtggcgccttccatgatgtcggcgacgtccttgaacacgcctttggggatgatgccgttctcgaggttgaaggcgatctgcttgtcacgccggcgctcagtctcgccaatcgcccgctccatggagccggtgatgcggtccgcgtacagaatcgcgcggccattgaggttacgcgccgcgcggccgatggtctggatcaacgagcgctcggagcgcaggaagccctccttgtccgcatcgagaatcgccaccagcgacacttccggcatgtccaggccttcgcgcaacaggttaatgcccaccagcacgtcaaaggtgcccaggcgcaggtcgcggataatctcgacgcgttccaccgtgtcgatgtccgagtgcaaatagcgcacgcgcacgccatggtcggccaggtagtcggtcaagtcctcggacatgcgcttggtcagcgtggtgaccagcacccgctcttccagggccacgcgcttggtgatttccgagagcaagtcatcgacctgggtcagcgccgggcggatttcgatttgcgggtccacaaggccggtcgggcgcaccagttgctcgatcacacggccagcatgttcggcttcgtagttacccggtgtggccgagacgaaaatcgtctgagggctgatgctctcaaactcgtcgaagcgcatcggccggttatccagcgccgagggcaggcggaaaccgtattccaccagggtttccttacgcgagcggtcacctttgtacatcgcgccgacctgcggcacgctgacgtgggattcgtcgatcaccagcaaggcgtcatccggcaggtaatcgaacaaggtgggcggcgcctgcccggattcgcgacccgagaggtagcgcgagtagttttcgatgccgttgcagtagcccagctcgaggatcatctccaggtcgaaacgggtgcgctgctccaggcgctgggcttccaccagcttgttgttggcgcgcaggtagtccaggcgctcgaccagctcggccttgatgccctcgatggcgcccatcagcgtttcgcgcggggtcacgtagtggcttttcgggtagaaggtgaagcgcggcagcttgcgaatcacctcgccggtcaacgggtcgaaggccgaaaggctctcgacttcgtcgtcgaacagctcgatgcggatggcttcgaggtcggattcggccgggtagatgtcgatcacatcgccacgcacacggaaggtggcgcgggcaaagtccatgtcattgcgggtgtactgcaagctcgtcaggcgacgcagcagctcgcgctggtcgagtttgtcgccgcgatcaacgtgcagcaccatcttcaaataggtttccgggctgcccaggccgtagatgcacgacaccgtggtgacgatgatcgcgtccttgcgctccagcagcgccttggtcgccgacagccgcatctgctcgatgtggtcgttgatcgacgcatccttctcgataaaggtgtcggacgacggcacgtaggcttcgggctggtagtagtcgtagtaggaaacgaagtactccaccgcgttgttcgggaagaacgccttgaactcgccgtacagctgcgcggccagggttttgttcggcgccagcaccaacgtcgggcggttggtctgcgcaatcacgttggcgatgctgaaggtcttgcctgaaccggtcaccccgagcagcgtctggtgcgccaggccggcctcgatgccttccaccatcaggcgaatggcttcgggttggtcgccggcgggttcaaaacgggtgacgagctggaaatccgacataacgtacctctttcagtcaccccgggcctacagccgccaaggacgaaaatagctcagcaacccacgaataatcatcgcaggttgcaggaaaaaaccatgatagctgtagaagtggtggcgaatgtgacgggtttcaaggcaatcgtcctacctgccgtcgctgactcatgttgcaataagactaacggtcggcaaataaaccgaaaaacttggccgaaaagccgtttcggctgtcgccctgcgcgtggatggtctctatactaactccccgtttgtgcaccgctctagtgcattcggctggagcgcgacacgtccctccattcccccatagagctgccgcaaaaatgagcctgttctccgctgtcgaaatggcaccacgcgatccaatcctgggcctcaacgaagcattcaacgccgacacacgaaccaccaaggtcaaccttggcgtgggcgtttactgcaacgaggaggggaagattccactcttgcgtgccgttgccgaagcggaagccattcgcgtggcgcaacacgccgcccgtggctacttgccgattgacggcatcgtcgcctacgaccaggccgtgcaaaagctgctgttcggtgctgactcgccactgctgagcgccggccgtgtgatcaccgcgcaagccgtcggcggcaccggcgcgctgaaaatcggcgccgacttcctcaaacaactgctgcccaatgccgtggttgcgatcagcgacccgagctgggaaaaccaccaggcgctgttcgaaaaagccggtttcccggtacagacctaccgctactacgacgccgccacccatgacgtgaaccgcgccggcctgcttgaagacctcaacgccctgccgccgcagtccatcgtggtattgcacgcctgctgccacaacccgaccggcgtcgacctgagcccggccgactggcaacaagtgctggacgtggtcaaggccaagaacctggtgccgttcctcgacatggcctaccagggttttggcgacggcatccacgaagacgccgccgccgtgcgcctgttcgctgaatccggcctgaccttctttgtctccagctcgttctccaaatcgttctcgctgtacggcgaacgcgtgggcgcgctgtcgatcgtcagcgagtccaaggaagaaagcgcgcgcatcctgtcccaggtcaagcgcgtgatccgcaccaactactccaacccgccgacccacggcgcggcgattgtggcggcggtgctgaacaaccctgagctgcgtgcccagtgggaagcggaactggctgaaatgcgcctgcgcatccgtggcatgcgtgagcagatggtcgccgaactggccaaggctgcgccaggccacgacttcagcttcgtcggtcgccagcgcgggatgttctcctactccggcctgagcgttgagcaagtcacccgtttgcgcaccgagtttggtatctacgcgctcgacaccggccgcatctgtgtggccgcgctgaaccagtcgaacattggcgcggtaacaaaggcgattgttcaggttctataaacctgccagcgtcatgcaaaggggaagccggtggcttcccctttttattggcgaacacactagactgaaccccgactgccctttgctgtgagagccctatgagaaacgacgacctggacctgcgcgccgaccgcgacgaactgcacgacttcaccccgcgcgccccgcaagccaagcgccagaaaagcctggtgctgcaagtggcgctgggtgtgttcctcggtggcctggcgctgtggctggtgcaactgggcgcaacggcgattatggccaaattggccatgggcaccttccagtttggcggctgatgaagataagagtgtgggagctggcttgcctgctcccccacattagagctgagcggctaccagaccgcgctcttccagcaacttcacaaagctgttcaaactctgcgacaccgtaccccggcgccagatcagccaggtgtgcaaaatccgaaatttatccgtcaacggccacacgctcactgccgtaaaccccggcatgctttccagcatgctgcgcggcatcagtgccaggccggccccggcgctgacgcaggcgagcatgccgtggtaggactccatctcgaagatcttgcccggcaccgcaccatcctgtgaaaaccagcgctcaaagtgatggcgatacgagcagttcgagcgaaaggtatagatgctctcccccgccacatcctgcccgcgcgtaatcggtgcgtggtgcagcggcgcgatcaccaccatttcctcctcaaacactgccaccccttccagcgtggcatgcaacaccggcccatcgacaaacgccgccgccaggcgccccgacaacacgccctcgatcatcgtgcccgacggcccggtgctcaggtccagctcgaccttggtgtgtttctggttatacgccgccagtaacgcaggaatgcgcaccgccgctgtgctctccagcgaacccagcgcaaacgcgccctggggctcctctccggccaccgtcgcgcgagcctcttgcaccaagtcgagaatacgccgcgcataaccgaggaaattccacccggccggcgacaggcgcaggcggctcttctcgcggataaacagctccacgcccaagtcctgctccaactgcttaatacgcgtggtcaggttcgacggcacgcgatgaatcaactgcgcggcggcgctgatgctgccttgctcggcaacggccttgaagatttccaactgcaccaggtccaaatcattctccactgtgatcgttcccatgctctgcgtgggaacgcatcttgtgacgctctgcgtcacagccttgcgcaacctcaggcgcagagcgccacgggcggcattcccacgcagagcgtgggaacgatctcaagccaatcattctccatttgagaatgtattgcttaatattattcagtttccagaaaagatacagccccgtaggctgaacccattccactcattcagccggacggtgccatgaacgctatttctcaccagacccacgctttgtcgatcaaccccgccaacggcgcaacggttgccagctacccctacgaaaccgaagcgcaactggacgcagcccttaaccgggccaccgcggccttccgcacctggcgccgccagccggtcagccagcgtgccgaattgctgctggccctggccggtgccctgcgtgaccaagccgaagacatggcgcagatgattaccctggaaatgggcaagcccatcgcccaggcccgtgccgaaatcgaaaaatgcgcgcagctcagcgaatggtacgccgcccaaggcccggccatgctcgccccggaaccgacgctggtggacaacggcagcgcccagatcgaataccgcccgctgggcccgatcttcgccgtcatgccgtggaatttcccggtgtggcaagtgctgcgcggtgccgtgccgaccttgctggccggtaacacctacgtgctcaaacatgcccccaacgtgatgggcagcgcctacctgatccagcaagcgttccacaaagccggtttcgccgacggcatttttgaagtggtcaacgtcaccaacgacggcgtctccaaggccatcgccgacccacgcatcgccgccgtgacgctgaccggcagcgtgcgcgccggcatcgccatcggctcccaggccggtgccgcgctgaagaaatgcgtactggaactgggcggctccgatccgtttatcgtgctcaacgacgctgacctcgacgctgccgtgcaagccgccgtgatcgggcgcttccagaacagcgggcaagtctgcgctgcggccaagcgcctgatcatcgaagaaagcgtggtggaagccttcaccgctaaattccttgaagccagccgtgcattggtgatgggcgacccgacctcgaccagcacctacgtcggcccgatggcccgcttcgacctgcgcgacgagctgcacggccaggtccaggccacgttggaagaaggcgcgaccctgctgctgggcggcaataaagtacctggcgtcggcaactactatgagccgaccgtgctggccaacgtcaccgaccaaatgacctcgttcaaacaggaactgttcggccccgtggcctcgatcatcaccgcccgcgacgccgaccacgccgtggccctggccaacgacagcgagttcggcctgaccgccagcatctttaccaccgacgcggccaaggcacgggagattgccaacaggctggaaaccggcgggatcttcgtcaacgccttcagcgtgtccgaccctcgggtggcgtttggcggtgtgaaaaagagtgggttcggtcgggagctgtcgcactttggtgtgcgggaattctgcaacgcgcagacggtgtggctggatcgcaagtaaataggcacccagcccctgtgggagctggcttgttgtggcgagcgggcttgccccgcgttgggctgcgtagcggccccttgcccaggcaccgcttactgtctgaaaccatgcggtgaccttggtggggggcgctacgcaccccaacgcggggcaagcccgctcgccacagaggctgtgcccgtccgacaggtcagttacacaacggcagcgtcaccacaaactcgctgcccttgcccttgcctgcgctattggccgtcaccttgccgccgtgggcttcaaccaactctcgcaccaccgtcaagccgatgcccagccccgagccgttgaagccaatggcgtgttcatcctgcacatacgggtcaaagatcagcggcagcgccttggccgagacgccgatgccgttgtcacaaatactgatcctcagctcatccccggcactgaccgacagcacaatgcggccgcccaccggcgtgtacttggcggcgttggccagcaggttatgcagaatttgcgcaaggcgcccggcgtcaccactgagcatcaattgaccgtcaggcaggtgcgcctcgaactgctgctttttcgccctcatcaccgggccgcacgcatcaatggcgcctcttaggatctgcaacatatccacatcatgccgctcgatgcgcagcttgcccgtgctgacgcgggacacgtccagcaagtcgtcgaccaactgcgagatatgctgcacctggccttcgatcagctcacgcatgcgcggcagctggtcactcggcaggcgcaccatgcgctcggcgatcatgctgattggtgtcaaggggttgcacagttcatgggccaccatcgccaggatgcttttctgctggcccagcgcgcgctcggcggtcgcctgcaggtcttgcgcgctgagtgcggcaatcaccaactgcgcatttgcctcgcgcagctcctggtacaaacgttgctcttccaggcgcggcgggctggccgcgtccgattgcgcaagaaggatcgccagcaccaattgctggttggcctcaatcacctgctcaacgtgctgggtatccaccagacggctgctggcgtccgtcagttgttgctgcagcgcagcgagcacggcacgcgcctcaacggttttttgcccaagcagaaacagttcgtgagcggcagtggtcagctcactttcgttgttgccgccggtttcgctcatgcgccgggctcacacatgtttgtctcccgccaacacccgcttggtgggtcgcccacccagcagcccttcctgttccggcaacatctcgcgaatctgcaggccgttatcgtcgatgtggtactggcgcaactgatcggagtgggcactggcgcgcaccttgaccaccgccatgatgcgcagcaaacggctttcaacttcgatgtaccgctgcacgatgatcgcatcggtcaaaaacgccgtgccgtaagggctgaaacgcaagtcggtgtaacggtcttccagctccgaggtcatcaatacactgacacccacagacgtcagcgcggtgaccatgcgcgacagcgattcgcgaaagtccgcacggaaggtaggcgccagcgccagttcaaagcccgacagcgaatcaatcaccacgcgggtggcattcaaacggctgatctcgccgagcagcaactgcacgatttcgtcgatggacaagtccggcgcgcggctgtccaccaggcccacctggccgtttttgatcaattcggccagcttggggttctgtgaatggttgggccgttgctcgaacaccgcaatcaccccggtttcaccattgcgtgcaccctcggccaggaaagtcgccgccaggatgctcttgcccgaccccgacggcccggccaccagcagcgaatagccgcgcggcaggccaccgccgagcatctcatcgagtgccggcacgcccattttcaggcgcgtgatcgggaacgtcgacggcgcatcaatggcgcgattgagcgcggccggcgggaacaccttgattcccgaggtggcaatacggaaggtgtgcagcccgggcaacgtcggctggccgcgcatcttcatgatttccatcttgcgcaccatcgagttgcgctcgacgctttggcgcagccagatcaagccatcggccacggtgaaaatcgggttggtgtcggtttcggtgaaatattcgccgatcaggaaggtcgtcgcctgccaggtggtcatcaacatgcccaactgctggatgaactgcggcaggttgttgttggggttgtgctgggtctggctggccagcaccacggagcggaacgagtcgacaaacaccagcgacggcgaatgtgcctccacttcgctgacgatgcgccgcaaaacctcgtccaaatccccggccagggtgtcgtcggccaggttgatatagcgaatcgactggttgatcgcatcgttgtcgaaaaaatcgaattgctgctggtaacgcagcatcttcagcggcggctcaccgagtacggtaaagaacagcgccgggcgttctggcgtggccagggcaaacatcatctggtgcgccagggtggtcttgccacagcctggtgggccggcgataaggttgaacgaaaactccggcaggccaccgcccaggacctcgtccagtcctggcacaccggtggccagacggttgatagtcactttggtgctcatggcgaaatttcctgcgaagaggtgtcgctcgaagaaggctgccacacgtcaaccagcagacgtgcggtgagtgaaggcccgatcagcgtggtcagaagctcgtagagggtagtcagcaacacctcaccgaaaaacagcgcatcggtttcgttctgctcgacgagtacggatttgagggcaagcaagtccatcgcggccggcacactgtcgaaggtggcggccagccgtggatgggtagagacgcacagatggaagctgcgacggtacagcgcggcaacgccctgctggccgataatgggcgtaagtgctgcgcccatatcctgcaaaatcgaaacaatcgcctcggtaatgcttgcagtgtcagcgtgcggaccaacacggtgcgccagagaagctacgatccggcggctctcttcgctaagcgtgggcatgtctgactaatatctgatgaacagagactgatggtacaccctatgggaatggatagaaccccacagcacgcgacggggcaaatgcgctgagtcgaaacatttgccgtcgccggcgtgcctcactcgatcaaagcgcccacatccggatcaatgcaaaccccaggtccacactcacgcattcgcgtccgtccacccactcatcttcgcgaaggcgccgcccggtgttggtctcgcgctcgcctttggcaatcaccagcacaaacaatcgggtcgggcattcgaagttgcgcaaccgttcaacatcggccctgaccgaccaatcaccttccagacacttggcttgggatatatcgcccaggcatttgatttcagcgaccatcgtggtcgaacccgcgtcatccaaggcatacaggtcggccttgcgccgctcgccgatcggcaagtcagtccagatttcgatcctgtcgttgaaccaggcatgcaagctgatctcggcctgaatccaatgttcgcggcaactgttcaattgcaacacctgctcgagtttttcgcccatttcgcgaaaggcctgcgcgtacaaggcaatccattggtcggtgtccattgcgtactccctgtgtgagaaatcgtagttaacgttcggtcggcgcattccaaccctgcttgatagaacgccggacgacatcatatagccaccaccccgactcccacacgccaaaatccgttccaccctttgacggcaacccgtggcagcccccgatagatcaaactccccctgcccgtcacgatcgactaccataccgcgccggttcccacacgggactaatagggaattcgaagcgcggcccattgcgccaatcgaaactgcccccgcaactgtaggtgctgagcctgctccatatcgccactgggcattgcccgggaaggccggagcgtggcgacgacgcatcagtcaggagacctgccggccaagcaaaaccactaaccggcggggtgtccgggaaggccatccgtgccctgcaagactgcagcgttcgtgggtgtatttccgcgccgtacctctcctgttttcacgtagggttcacccggagactgccccatgctgccacgcgttaccgccctgatcgccagcctcggcttctgtgccctggcccacgccacgccgacgcattacccgctgacggtgcagaactgcggcaccccccagacctttgagcaggcgcccgcccgcagcgtgaccattggccaggccgccaccgagatgctctacgccctgggtgtgggcaacaccgtggtcggcacctcgctgtggttcaacagcgtgttgccgcagttcaaggcgcagaacgaccgcatcgagcgcctggccgacaacgagccgagcttcgaagccgtcatcgccaaacgcccgcaactggtggccgccgagctggaatgggtggtcggcccacaaggcgtggtcggcacccgcgagcagtttcaagaattgaagattcccacctacgtgctgccctccgactgtgaaggcaaggacaatctggtgggcgccgacggcacgcggctggaaccgtttcacatcgaaaccatttacaagagcatcagccaactggccgagatcttcgacgtgcaagcgcgcggccaacaattgaacgacgaactcaaggcgcgcctggccaagtccgtcgccaccgcacaaggcaaaggcctcaagcaagccagcgcattggtgtggttctccagcgccgaaatggccagtgacccctacgtggccggccacaagggcattcccgaattcatgctccaaaccctgggcctgcacaacgtggtgcagtccgatgaagagtggcccgccgtcggctgggaaaccatcgccaaggccaacccgaccttcctggtaatcgcgcgcatggaccgccgccgctacccggccgacgaccatgaaaagaaactcgccttcctgcgcagcgacccggtgacgcgcaacatggacgcggtgaagaacaaccgcatcatcattattgacgccctggcgctgcaagccagcctgcgcatgttcgatggcctggaacaactggccggcgccatcgacggctacgacctgcacaaatgacccgcaccctactcgccctcgcgctgctgttgctcgccgtgctcgccggcgtggccatcggcgaaaccgccatcgagccacacgtggtgttgcaggtgctcgccaacaaactgtggggcgccggttacgtgctggacccgatcgatgcaggcgtggtgtggaactaccgcctgacccgcgccctggtcgccgcggcgtgcggtgccgggctggcgacctgcggggtaattttgcagtcgttgttgcgcaacccgttggccgacccgtacttgctgggcatcagtgccggcgcctcgaccggcgcggtgttggtggcgttgatcggcgtgggcggcgggctgatttcgctgtcggccggcgcgtttgtcggggccatggcggcctttgcgctggtgattttgctggcgcgcgccagcggttcgtccagcggcaccgggcagatcatcctggcgggcatcgccggctcgcagttgttcaatgcgctgaccgcgttcctgatcaccaagtcggccagttccgaacaggcgcgcggcatcctgttctggctgctgggcaacctcagcggcgtgcgctggccgtcggtatggctggcggtgccggtggcggtcgccgggctggcggtgtgtttgtggcaccggcgtgcgctggatgcgtttacctttggcaccgactcggcggcgtcgctgggcatcccggtgcggcgtgtgcagtttgtgctggtgggctgcgcggcgctggtgacggcggtgatggtgtcgattgtcggctctatcggctttgtcgggctggtgattccccacgccgtgcgcctgctggtcggcaccgcgcattcgcgattgctgccggccagtgccttgggcggcgcactgtttttgattgccgccgatgtgctgtcgcgcaccttgatcaaaggccaagtgattccggtcggtgtggtcacggcattggtgggcgcgccagtgtttgcgttgattttgattggccggaggaacgcgcgatgacggtgctgagttgcacgggcctgggcttcaaggtgcgcgacgtcgagctgctacgcgatatttaccttgaagtgcagttgggcgaaaccttgggcatcgtcggcccgaacggctccggcaagtccaccctgctcaagctgctcgcgggtttgcgtgcgcctgccagcggcgaagtgcgactcggcggccagcgcctgggcgagctgtcgcgccgcgccattgcgcaacagttggcggtggtggagcagcaagccgacaccgacgacgcgattcgcgtattcgacgccgtcgcgctgggccgtacgccgtggctgtcggccttgagcccgtggtccagcgcagatgacgccatcgtcaaccaggcgctgcacgatgtggacgccacccatctgggcaaacgcgcctggcgcagcctctccgggggtgagcgccaacgcgtgcacatcgcccgcgccctggcgcaacggccgcagattttgctgctggatgagccgaccaatcacttggatatccagcaccaactggcaatattgaagggcgtacaggcgttgccggtgaccaccttgatcgccctgcatgaccttaaccaggcgctgacctgtgaccgcctggccgtgttggatcacgggcgtttggtggcgctgggcaagccgatggacgtgttgacgcccaaacgcctacaggacacgttcggtgtgcaagcgcattacctgaccgacccgttcgatggtgcgcagatcctgcggctgcgctccaactgataacttgaatgaggctgttccaactgtgggagctggcttgcctgcgatagcggtgtgtcagctcaggataggccactgatccaccgctatcgcaggcaagccagctcccacagtcggactgcggcgcgttatagagaccggtgcatatgcgtggtgcgccacaccggatcggcttcgatgtcgacaatttcaaacccctgccgaagccagaaatcaatcgcccccgccagaaacggatgggtgtgcaggtaaaccacctccacgccatccgcccgtgccttggtctccagcgcgcggtacaactcgcccgccaggccaaagcgccgaaaggccgggcgtacaaacaggcgtaccacctccaccgttttaagccctcggtaatccaattgcgggaaacgaccgtcatagggcaaatagccgatggcggccacgatctggccttcagcgcgggcgatcaggaatcgcccgtcaccctcaaggtaggtggctgcaaactgcgccaggtcggcgggcatgcctgtggcgctgagcttgggaaacaactcggcacgcgcctgcagtagaaaggccaacacgtcagggatgtcggcgacggtgaccgcctggaggatggggcgttggctcacaggaccttgatccgggttatgcccaccacctctgcctgctccaaaatctcagcgggtgtcgcatccgcagcaggcaggatcaacccgttctccgcatcgccgaaatgcaattgcagcaggtgcattgccgcctcatccaacggcaattcagactgtttgagttcaaaaacatgggtgcgaggttcgtcgttgaacaggtatttcagcgtgtattcgcgcatggtggcgtccttgtgatcgaagggaagcagttgataaacctgactaagtgatcaggttttaagttcccgtgcggcgacgccatggtgacgaccggctggggttgccgacgccttgatgtgcgccgtgatccacgctcggctatggttaagcaccgcctgcgccatcgccaccggaaaatgaataaacccatgggcagattccgctagcaggtaggtttcaacctcagccaccccgccccatcgctcagcgagctgcagcgtgtcatctttcagcgggtccaactcgcccacaaacatcaacgccggcggcaacccgctgaagtcgccatataacggcgacaacggcggctgccgccgttgttcatcactcagccccggcgtcagcaattgcaacgccgtgaccattcccgggccatcgagcagcaatgtgtccggcccggcgctgcgcacgctcggcgtgccggccaaatcataaacgccgtaatacaacactgcgccgctcacccgttcaagcatgtccggccattgcttgagcgccagcaaggtcgcggccgccaggtgcccgcccgccgattcaccgacgatgaacaccggcaagccagcgaactcatcggcactcagcaaccaacgcgccgccgccaggcagtcgtccatcaggccttcaatcggggtgtcgaccgccagccgataatccaccgacaccaccgccacctcacaggcgcgcaccatgcccaggttgaggtcatcatccatctgcgcattgccgatcacccagccgccgccgtggatatccaacaccacgcccttgggctggccttgcggccgcaggatgcgcacgggcactgcgcccacctgccgagtctcggccacaggcgcttttttgagcgtttgactgacccgcagcagcgcctggatcacacgcggcgtgacacggttgcggatcttgaagcgcggcagccacgcgagctttttgttgaacgcgcgcatctgcgccagctcaggcgcgctggcaggccaaggggtgtgggccatcagcggttattccgcaaaatcgaaaaattcaacgccgccgcgacactcagccatgccaggtaaggaaacaggatcagcccggtgatcaggtccagccgcagtgtcatcaccaccagcgccgccaccaccagccacagcagcacgatcaccaccatcccggcgaaaaggcgatgcgcgccgaagaacaccggcgtccacagcgtgttcaaggcaatctgcgccgcccacaaacccagggccagctggctgccggggatcagggtcaagcgatagcccgcccaggcgagcagcagatagatgaccgtccaggccaccgggaacagccaattgggcggcgtgaagcggggtttgaccagcgcttcgtaccattggcccggtttgaaaataatcccggtactggcggccgcgccgcaggcgatgagaaaaataagcacgatcatgagctgtccactgtcaggtttatttcaagataggacgcctgtagaacgggtaaaagttcacaaatgatcaggcgccacgatcttcagccacggccagcgcgcttgataactcctggccttggccgcaaacagttcgggttcagggtgataaggattgatccgcagcacgccctgctccacatccgccaacccgtaaggcgcgtacacctcacccgttgcaatctccagcccgatgcaggtgcccgccaccaggtaacgatcaacaccttgtttagccgtatgcaattgtgggtaaggccggccgaagcgctcgccgtaccagaggtgaacccgcgcttgattcttgacctcgacgttgacgcccaagtcttgaaatagctgatcggccgcgcggatgactgcgtcctccgcctcgtaggacaggtctgtgtcgaagtaaaaaacgtcgtagtccttaactccctgggcggcgggaaggttcgactgatggttccacaccgcctggaacagacagcccgccgtgagcatgcactggtccacgccgaggtcgggcaagcgcgcagtgatttcggcgttaatggggttggccatggccagttcgagcagggttttgacggtcaatgtcatgtttaatcctgggtgatcgcgcctgagcgtggttaacgataggttacctgaacgcagtgtaacccggccgctagcgacctttgtggcgagcgggcttgccccgcgttgggctgcgaagcggccccaaaaccagccactgggttgtgcctggcacaccgcattcctcatggattggggctgctgcgcagcccaacgcggggcaagcccgctcgccacacaaaaaaagcagttcaccacaaaaggtctactcaccacagaggatgtggcggcccacacggcaggtgaacggaccgcagcgccttgctccattgcctacgcttacgtcagaatccgccggcttgtgtgctgaggtggccgtctctaaggttgctcggtcgctgaatcgttcagtgatcgggtttagtagcctgagttgggtatcaaaagtgtacgagcttcatcaatcagacattgcgtctgtgcttgatggtggctgtgcgtagggcgtcttcgggcgcgccggctttgatatccaccggtctactaacctgcgcacagctgccacctttttgtttagtagcgaaaagacggcagccaaaaccagaatatctatatgcctcaagcacaatcagattcaaccaccctcttcaccgtcgtccccgacgccagcaccgaaaccctgatcaccaacagctacgaaaccttcgcctcagtcagcacactcctgctcgacctggccgaagacctgcgcggcaaacaccgcgacattgcactggcgatccaccaactgagcgagctgggcgtgctgctcacggccaaactcctcgaccgtgaagcgccctgccctggctgatgattagcctttgagctcacccgcgcgattgctcgccgcgtcgtcgtaagccacatacagcgactcggcgatctggcttttgatggctttggtggcttccaggccaagcacgaaaccttcggccttgccgccagcgcggttgagttcttcatgggtggcggcgccggtgatggcgtcaagcagcttggcggcgtgcgggcctacgcctttgggcagggagatttggtcgatggacatggcgatacctttaagaatggaagtcggtagcgcgtggaaccactgccggggttggcatggtagaccggttagccaagaaaggggctgctttcggccagatgcttacaaatcgccctactgctccacgctgcgcaccaacaccccaaaaagctcccctcgcggcatttcgctcagcgcaatccccgcattctcaaaccactcccgccccgcttccggatgcggcccgctcagcaccaccacgcctttctcataggtgtagcgcgcggctgccacatcaccgtttcggtaggtggcgatggcggtataaggcgacgccccgtcagccttgggaaagtaagggccatcctggtaaaacacgctgtccggctgcccatcccacaccacccgcaccgctgcatcgtcaatgcccgacacctcaaagcccggccggcctgcttcagagtccaaatcctgcgggatcaagccaaggttgctgtcatccgcaagatacgcccccatgcacaggcccaaatagcgcccgcccttggcgacatactcacgaatggcctcagcgcgcgcatccccaaggcttgcgagtgcagcaggaatatcctggccgccgcccggttgcacatagaggtcatagcgcgcgaggttttgcggggtgatgtcgaccgattcatccgcaccgacaaagtcgatctgataagccgggctcaggcgctgcaaggcctttttcacgttctcggaacagtcatcacagccggccgggcctcggtagatcgccacatgggtgatgggcgtggcggcgtgcacgaacgatgcttgcagcgtggcaaacgcaagaaacacggtggcgataacggacaggttcatggtggttggctcatcaaacagggctgatgcagacttgccatccgaagcctatatcgaaagccacattgaaaccgttaacagttgtaaatcggctacggccgcctgcttgaaagccctgcacccacaacgtgcagggccaacgtgatttaaacggcggtcaagtgcacttcttttttgagcgcctcaatcaagtggttcaacattaagtaacgcttgtctttcaactgcggccaacgctcaataaaaaactgccccttgtcgtcaatttgaatcggggtggtaataatttcgcggctattggagtggtgaaccaggttggcctgggtcgttgaaggttgctcaatcaggaagtcgccgatgtttctaagccgtgtgcgatccggcagcgcggcagggccgggttgacgtaagccgacagtgccgacttccactttaaaatcagtgcgcgcagccattgcgcctcgcgcgcctatgccttgatcgatgatttcccatgtactgcggtgcagggggcgtgcgttgccgggggcgacatcgcgcaccgtcaggctgactgcatcctgcaattgcgcgacgcccggaacaccgttgaacatatcagcgtgggcattccccatcagcgctacccacttatgcggccccactgccgcctggtcggccttgatcacctcattggcgaaatagttgaacaaggtctcgcggccgttcaacgcagacatccctttggcgtgataactggcagtgcaatcgagcgctcggacccgtattccgtatttattcgcggcgttgatcacatgggtgtaagtgttgacgcctgaataacccggcatatggccgcggtcttgcgcgatcagatatcgcttgaggtttacgggcatattcgccgatttataaaactgctcaagctctgcctgatgcagatcggtgagcaggtgttccacgtacagcgtcttgacgccctgctccttcaaatacgccatgtacttgatcagaaacgctttgctggactgatgttcatgagcttcggcaacgataaatccccacctatgctcatacacttgcttgataaacgcctgttcatcggtggccgttgcaagggcggtgaagtcgggtcgtgccggtggcgtgtaagcggcaaacacatcgctggcagccttctccaatcgatcacgcgtgttgcggaaagcaccgaacgctgcgctgaaagggcttccagcgggcgggctgtagcgcgtatcaaaagcgcgtttgctatacagcatctcttccagttcacgcttaaacgtcgcgggcagatcaaacgcactgtaatgagacactgaagcaggcacctgcaccgccgttgaagggccggctgtcggtatcgcttgtgccgtcgaggccagtgtcagcctgtaatcccctcgggccattgcggcggcagacgtatcggggagcacactcgctgcctggcccgccgtcacctcatccacgcgcagcgcgatgacattctgcaaatcggccaggcccggcacctcatcaccactgccgatacggttgtgatcaaccagggcaatccagccttcatcggggtcttttgtcgcgagtttcttgtgcgagtagaagtttcgcagcttgctgctgcgcggcacaaaccgctccgcttcggagagttccagcacgtgttccatatggtaggaacttgaagcgtccacgccttcgatcgcaacattgtgtttgtgcgcctcaagcatcagcttgcggtaggtaaacggagcgtccgcctcccagcccagggccctgtcgacccgtgccaagtgttcttcgacacgtttcaaggcgtgctcagtattgcccttggcttgcttgttgataattttaagcttggtgcgaaacacatccgccggcaggttttcgatgtacacacgcttgagcccttgcgcagccaacgcctgcatattctcgataagcaactgcttgctggcgacgctggcgttggctgcaccgatgatcagccctttcttgagtgcaaacaggctggcgagcacggtggcgccgcttgaatccgccgccagcgccggcaaacctgaacggtccgggcgtgcgggcggcgatttgaagaatgcctcggtatcctcgaccagctgtttgacctggttggcatagcttttacgtagcggacccaactgatcataggccgcactttgtgatgcctgggcaatcacttcgtccgggctcttgcgccagaaacccgtatcgagtgccactctaaagtgtctgccttgctcggcgggtatttcgtagccggccagggtctgttcaacctcttcctgaagtacctggtactgcttgcgccctccacccacgacgcctgaacgtacccaacggccgtcaacctgttgattgaccagacgcgaggttgaacgcatgtgcccggtcagcgcgtcatagcgatacaacacatgacggcccatggcatccgccgtggtctttacccagaactcactgccgtcgaacagcacgggttgcatatcgccaggaatactcaaggccggtgctttgagcaactgggcctgttttgccgttttagtcaccgttctgatcgacagcgtgttaagcgggcctttaagcgcggggcggaagtcgaacactgcggcaccggccacattggccatgtagccgatgaagtgttgcaaggccgcacccgtgtcgccctgatggtaggcattaatggcaagcatcgcgtccttgaaggcgagcaggccgcccaggcccaggctcaacaccggaaaaggaatggtggcgatggcggtgaccagctcaacgcaggtccagacaatgcccatgatcatgttggttcggttgaccgtggtggccgccacgtcatctattttgcgctgcaataccatgttgtagagctcatggcgcaggtcggccacgggcggaacatgggcaattgggtcatggcgtgcggggcttggggttgtacgatcaatcctctcgggcaagcccttgcgggcagcctccaggaaactcgcgatccgggtcttggctttgaccgccaccctggcaagcagatactccgacacaccatcgacttttttcagccagtggttgaacagcttcgcctcacgcacggcgatgccatcgggtgcatcggggctgtacagcagcaccgggttgtccgcatggctgaacaggtaattgccgatgacccattcgccatccagcatcagccgatggaccttgtaggtgttacgggttgccaccgtcgtatcaccaaggctgtcgatagcacgctccagccacgccagatcgacctgggcgatatgcccgcgcaggcagcattccaacgccgcgtgtttcatctgcaactggttgatcaccaaggtgacgtcacgccgtttggagtaaccggggctggttgcgctctgcagcttggcgcgaacctcatcgatgtaggcctggccgacccacacaccggtcaccgagcgcgcaacgttctgcggcgtcaggcggctcaggtcaaccccgctcggcccactgaaggtggctgaggtggagaacttggggtcgataaagccgacgttgtcctgatagccgtctcggtacagctgggtgtaggtgatgggcgccggcatgccgcccaacagtggccaaggcgccgacacatacaccgtgtccgggtcgatatcattctggctacggcccagcagtgtgttcaggctgagcttggccttctggtgcacaaagtcgttgaaaggcgtgatggctgaatgcaagtcccgatcgaatttatacgtgcgcagggcgcccgccgcgtcatcgacaaggcgggtcagccgagtgcgatccgccgccgaagcagagcgataccacaacggcgtggtgtattcgtagtcgtccaccgccacgctttgcgaatgcaccaccatggcgtccagacacgccgcgtgggagcacaaagggccgaacgtcacctcctcatgttccagtgcatcgggcctgaggctcagcccggtgaggaacgcgcgcatttttggacgaaaacgcagcgggcattgctccagcaggtagtcgctcatgctccggccgctgtaccgggtgttgtcatccgcccagcccacgatgtgcgcctggcattcgcgctcactggtgaatgcaataaatggctgctcgcgcgggctttcgggggtgcacaacagcaagcgcagggtgtggccgtcggcatcgttctcacgtaataaccacaggtctttgagctgcgcgccgtgcagcatcacggtctgcgcgtgcaggtgctggtttgtgcccgcgcgcaggtctgcgaaccgctgatagccggtctcggtcaagtcacctcgcaacctggcaacataggcgagcaacaccaggcgatgatcgaacaggtcacgggcagcctgtttgagttcaggccagccctgcacttctttttgcaacgcggcaaaatccaggcgcggttgcaggcccgacgtgtgaagcatatccaccaggccctgcgcattcagctcggcatgccgacctcgcagcgcctcgcccgcatagcgcacggtggtgcgggtcagaaagtacgagccgggcagctcatcgccggtgtgcaaccccgaataggtcaactgcgtcaggttgcgcttgcgcgtataggtgccgacgttgggcacatggttttgggtgacgatctccagcagttgcgggtccaggtcgtacagttccagcacttcgtccaggtactcggtcacctggtaactcgccaaggcttggggcgaagcggccggccccaacagatcgacaaaggtctcgcgggcctggttgtaggtgtggatcaaaccactcagggtggcctgacgggtcgagtcagcgctgcgataccaatccggcaagctgttgtacaggctgcgttcgagcaactgttgctgcctgaaagccaggcgcaaggacaagtccgggagcgccgccttcaccgcgttttcgagtgccgactgcagcaaccgtgcatcgtgcagcgggttgtcgaccaggctcaaggcgtggtcgatgtcctggcggcgcttgtcgagcagcgcgttgtaggtgtgctcgaacagtggtttgccttcaatcggcagcaattgcaggggccagataccggcgacctccagcgcttggtaacgcaccggcaaatggccgcagaactcttcgcgccctgcaggcagcgccagcagtgtcttgaggccttgatcgagctcggccaacgaatcaaaggcttccaggcctcggttgggggtaaacaacagcacttggcccagatcctcacccgacgtcagattatccacgcggggcgtggcgttgcgcgtgagcacgaaggcccccgcaaacgccacggtctggccctggtaactgaaattgagcgagtacatgcccggcctgaaggtcgggcctttggcgcagtcttcaatcatgcgttgttcgtcggcagacagcaggtaatcacgcacatccagcctggcctgttgctccagcgcgccaaggccggccgccaaggtgatatagcttttgcgaccctggccgcccaccgtgctggtttcgtccaggttttgcagctgtgtattcagctcggccttgagcgtggccagcagcgccttgccggaatcctgggtgaggtctgcctgagtcaaggcatggaacaacgcccgtgactggttcacaaaccgctggttggcctcgatcagggtgctgttcagcgtttccagcgtgacaagttcggctggcaattccacgggaagccgggtttgggcacgcagatcaggggcgatttcaagtaaatgtgtgcgaatgtcgtgaaacgtcggtaagtcttgaagggtactcggcgtgctcattggcactgtcctcatgctgatgaaatgaagcctcagcttgaggcgcggcctgggtgtgtcggcggtaattattcaagccaccgccatggcattgcattcaaaccgcacatggggattactgtgcgccgagccctgtttcgagaccgcccgccatgtttgaactctccgccctcgtcacctacgtcgctgtggtgatcggtctgttcctgatcccaggcccctcggtgttgctggtgctgacccgcaccgtgcaaggcgggcgcaaggtcggcatcgccaccggcctgggcgtggcgaccggcgatctgatccacacgctgtgcgcggcattgggtttgtcggcgatcttgatgacctcggcagcggcgtttaacgccgtgaagtgggtgggcgcggcgtatctgatttacctgggcgtgcgggcgttcatggccaaaaccggtccccacacacggcttgcgttgcccgccgtcacaccgcgccaggcgtttttccaggcagtgggggctgaggtgctgaacccgaaaaccgcgatctttttcctggccttcctgccgcaattcgtccacccggaatccggctcatcgctggttcagttcgcggtgctgggcttgatcttttcggggttgagtgcggtgtataccagtttgctggccatcgctataaggccgttgagccgtgggctcaaagggctttcgagattgcgtaggtgggaaggtaaaatcatcggcacgctgtttatggggctgggcttgaaagtcgccttccagcagcgttaatcagcgcgatgtcagggccagggccccgattctcacaacggagtaactccctgacccgcccgcccaacacgtccaccgcaaagggtttggtcgatgggcttggtggggtagaaaggttcgaatacatgggtgcagcctgttaatctgcggcgtttacacgccagggaacctccaatgtcattcaccaaacgcgacagcgcccgactcgagcgtcgcctggtcacagccctcaccaacgcttgcgaaaccgctaaggcagaaatcccaggcttcgattggctgacccacaccgtcgactacgccgcctttcctcaaagcctgcgggtgacctgggtgtttgatacccgtgccaacaaggaccacgccctggcaaccggcgccgaccagcgtatgcgtgagctgactgccgctgcgttgcaggacgccgaagtggcgccggtaaatatggatcgctgcgtgcgcttcgactctgagcaagactgcaccgcccagcatggcggcgattggcgacggcgattaggctgatgccacttcaagtccagccagctcccacagtggatgtgccgtgtttgcctggaagccaccgcgtaactactgaataatgccgcctcgcctttcttcgataaggacatcccctgtaatgaagttgcccgccctcctcctggctgctgccgtgctgccgaccctggcccatgctgacgacgctgcgctgaccgacacactcaaagccttcacccgctgcgacgcgagcttcttcagcagtttgaacactcaccgcgatgcatggcaggcctatgcgccgctccagcaagaaaagcagttcacctggatcgcggtcagaaaccgcacagaccgcaaggccagccaggtgccggtcagcgcgccgcccatcgcggggttgaagctgttgtcgtatgccgatgaagtcaccgacctcggcccattggggctctactattactggggcttcgtggtggacggcggcgtcgacgaggtcgcccagcgcctcgcgccactgctggaacaacgcggcgcgctgcaaaaaggcgagaaggaatacaccctcagcgagctcaaggtcggtaacggctggcagtcgatcaaaccccaaccgggcaaggcgccgggcacccgccaggttgaacgcgtgttgattgtggagccggaaggcaagtcaggcacgcaatcgcgcgtcagctgttcggtacagggcggcgtgaatgccgggctgctggcgcagttgcgtccggacatcgcgccggtcgactacccacgcacccacatcgaaaccagcttcgccgaggtcgaggtaccggccagcgtacgccagcgcctcgactcccccttgctgcaaccgaagttcaagacgttgaactacagctacctgtccaagaaaggcgatggcagcaaagaccttccgacctcggtcaccttcaaggccgagggtggcttgctggtgaaaaacgaagcctatggcaataccttcaacgttgatcgcctgacgcaagctgacctgattcagttgaaatcgaaaatgaatggcgtgggcgacgggcgcgtgctgcaaacccgcgaggtcgagctgaacctgccgaccagttgggcacccggccagaccctgagcacccgcctgcacatggtaaacgtgccggcccggccaaccgacaaaccctacgaaaccaccctgaactgcaaggtcggtgaacgcatcccggcacgccaggtgtttgcctccttgaccggcgacgccatcaaactggcgtgcgaccagggcgactacaagacctcacgcgtgtttatcgaggacctcggcgtggcgctgacgctggagtcgacgtcgagcgaaacccattatgtgaatgaaattacggcggttgaggtcgtgcgctaggacctgtcggcgttttcgcttaagcactttgcgaacatctaaaaagcagcgcgcagcgcctggtgtggcgagcgggcttgccccgcgttgggctgcgaagcagccccaaaacagtcgctgaatacggcctgacacaccgcgtttgccttattggggctgctgcgcagcccaacgcggggcaagcccgctcgccacaggaggtccgcttgccacaggagatccgctcgccacaggaataacgcctactttttatttggcaaacgcgtactcgccgccctgctccaccgccttgcggtaagccggccgagcctggaagcgttttacccatgccgcgaggttcggataggcctgcaacttgccctgggccatggcgatttcgccgataaaactcatctggatatccgcgccgctcagctcgtcaccgaccagatacggcgtatccgccagcacatcgttcaagtagcccaagtagttggccagctccgattcgatgcgcggatgcaacggcgcacccgcctcacccaagcggccgacgtagaggttgagcatcagcggcagcatcgccgagccttcggcgaagtgcagccactgcacgtatttgtcgtaggtagccgtggccggatcaggttgcaggcggccttggccgtggcggcgaatcaggtagtcgatgatcgcggcggactcgatcaacacgagcgagccatcttcgatcaccggggatttgcccagcgggttgatggccttgagttcaggtggcgcgaggttggttttcggatcacgctggtagcgcttgatctcataaggcaggccgagttcttcaagcagccagaggatgcgttgcgagcgcgagttgttgaggtggtggacggtgatcataaaagctccgctgaacaagagtgggtatccaggtaagagactacgccgttgtggtggagtgccatggattaattcgcaaccatggcccacaacgacgcgccgacgccagtgatgctttccccggcaatcaaccccgccgctgcggtaatggcgaagcgttcggtcacgctcggccaacggcagctcaccagccacgtcagcaccgcgccgagggccatcatcagcgacaccgaagccggcagtacgaaggccaggcccaacgcggcggcgctgggcaagtagcgagcacgatgggcgggcaaggtgctgtcggcaatccccagcagcacgccaaccgcccccgccaggccaatggcccaacgaatgctcaccgacaatgaatccagcccatgggtcagggtttgcgccacggctttccaggtggcgaccgcaggcgccggccattcttcggtgagcaacatgctttgcgggtcgggaatcaacgccaggtaggcaaacacgccgacgatgctgccgacgaaaatccccaggatttgcgcgatcacttgcttgcgcggcgtggcgccaatcgctttgccaaccttgaagtcgttcatcaaatccgtgcattgccccgccgaaccgccggccgtattggcactcatcaggttgatcggcacctgccccggcgcgacgatgccaaagctcagttgcgacagttgcccgatcgcgccaatcggcggaatgccggtggcgcccaccacccgcgcggccacggcagccaggcagatcgccaggggaatggtcagcaaggccatccacaggttgatcccgaacaacagcgcctggaggctcaccaccaacgcaatcgccagggcaaaaccggcggcgggcccggccttggggatcgcccacggcgtgccgccagcgtccttggtggacttatgcaacgccaacaggcggatcgccagcgaagccagggtcgagcacaccatcaggctcacgccgggccacaacaaccactcaaccagcgcggcaaactgcgggccgctgctgccggccggcagggtcaccaggccttgcgccagcaaccacgggcccagcccgccccaggcgagcaaggcaccgagcagcagggtcaggcccacgcgaatgccgatgatgccgccaaagccgagcaacagcagcgacgggtcggcggtaaaggtcaggcgttccatcgcggcgctgggcgaccagcgcgggaaggcccacaggaaggtgtccacccacttgaccagccccgacagcaaggcggcgctgagcagcaccttcaagcgggtcgcggcttcgcggccgtggttgtagatgtgcagcagggtttccagggtggccatgccttcggggaacttcagcgctttgtcattgagcagtgacgggcgcaggtaccaggcgatccagatcccgagaaagctcaccgaaaacacccaggcgatcatcggcaacgcttccagcgtgttgcctgtgagcaaggtgtaggccgggatcggcgccaccagcccaccggagataatcgaggcggcggccgaggcgacggtctggttgatgttgctttcgtgcagcgtccacggcagttgcccggggttgcgcctggccaggccttgccagatggcatagccgaccagcagggcgatgatcgacatgttgaacgaccagccaatcttgagcccggcgtacacattcgagggtgtcagcaggatgcccaacacgatcccggtgctcaccgcgcgcaggctcagttcgcgttcaaccggggcgttcaggacgggcgttggcggggtcgaaggcatgcggattcctttcggcaagtgaacagggcgacctaataagtgagccctgttggcgccgaaggttcatctatccgcgcggtggtttcacagcccgctcgccacaggaggcatttcagctcaggcgaaaccgcgcggtgttttcactcaacgcccggctgcctttgctcaaggtatccgccgcctggtttaccgcccgcgcgccgtccagcaagcgcccggccgcctgatcgacctgctggatattgccgctgacctcatccgccgtcgtcgcctgctcttcaaccgccgccgcaatctgcgccagggtgtcggtgacgttttgcacggcgccggcaatttcgcccaggcgcgtgcccaggccggtgacggactcggcatcggtgagcgcctggtcgcaggcggcgcccatcagcgtgaccgcctggctgaccgtcgcgcgcaggctgtccaccgtgccggcgatttgcgccgtggaggcttgagtgcgttgcgacaggctgcgcacttcatccgcgaccacggcaaaaccacggccctgctcgccggcgcgggcggcttcgatggcggcgttgagcgccagcaggttggtctgttcggcgatgccgcgaatggtatcgaccactgactgaatctgctgcccttgctggctcacctgttccagcgcgttggcggtgtcggtcaggcgctggttgagttgctgaatgcttgccgtggtgcgctggctgtcgcggctgctgtcctcagcaatacgacgggtctgctgcgcactgcctgaggcctgttcgcagcttttggcgacgcccatcgaggtggccgccaattgcgtggccgcggcggcgatctggctgatttggtgttgctggtcttcgacttcggtgagggtgctgcccgactgcgaattgagggtgagcacagcggagcccagttgctgggtttcatgattgaccccgagcaggctggtgcgtaactgcaccaccgcgacgttgagcgcggtgctgatcgccgccagttcgtcacgcccttccaccgccacctcgacgcacaggttgccgtcgcgcaaggactcggccagcgtggtgatgccactggcgctgcgccggatcgaggcttgcaggcagatgaacaagtacaaggccgccagggccagcaggctgaacgtcgccgccactggaataaactgctttagcgagcggtcatggtaataactcaagcgctcatccagcgagtgcaacgactggctgcgcagtgcacccaacgcgccgagcatgctgtcgacactgcggtcaaagcctgtggtgtcgagtttgatggtgccgccaaacacgccgtcgtccagcgctttgagttcgttgtcgagcaattgcaggctggtgtcgtattgcgccgtccacggctcgattcctgggtacggcttggctttgagcgacgtggcggccttggccaactgatctcgcgcatcgccgatacggccacgcaggtcgcgcatctgcaaacggctttgcaaggtgaactgccccgaggcaatcgacgactgcccgacactggccgtgcggccgatgcgttcgatcaggtccggcgtgtgctgagtagaaatctgcatcagcaggtacgtttccagccaagggtcaaggatcagcccggcgtcctgggtgatctgctcgcgcagggtttgcaacgcggtcagggcggtggtgaagcggtcatagccgtccggccaccagcccacggcacgcagggactgggtgtccatgcccttgaccgtggcctgcaacgcttcgaaacgcgccagagtgtcggcactggcgttctgggcctttaacgagtcacccaaggcttgcaggctttgcagaatgattggactgccggcatcgaccttgtccatcgccgctttggccgcagcggtaggcgtgtgcaggatatccagcgccttccagcgcgccgcctggttgcgctgcgcggtgagctggccatccagcgtgtccagggccaatagctgatgaacgccggactgctcgctggaaatcaccgccaatttgtcgcgatagtcctggccgatcatccacaggctcccggccaggggcagcatgaacaggaaaaacagaatctggaacttgcgcgcgaaaccgaaacggcccagcaggcggatacccggtgataaaagactgtgcatcgccgaccactccccaaaacaacctagaactgactagaagcaaaatgccatgtcattgattgggaaggcactagcaagatacgggccgttggtagcaggccgcgaaataggcggtttggcaaccgggccatagcgtggagtgcgcgaaaatggggcgaaagcactcagcaggatgaagaaggctgtaaccgtcggggacgagatcgatcgcattccaaaacacctgcaattacaggcatcctatcgcccacgcacctatcgaacttcaaggacaggcagattcatgtggaaaacctggctgcaacgcgcttacccacgatccgctccacccgttccccatcagccgcagcagcagccaacagcagccgctaccactggtgactggcgaacgcttatcagcagctgggatggattcgaccgcgaagcgggcctgcacgcagttcggctggaacactcgagcgagcggctgtccgcaattatcgtgcgactcaatgactgggtacctcaggttcgcgaagcggccagacaggcttttgatgactacctgaaccccacctacgccgcgtcgctgatcgcgcagcttcccgcgatactcgcgcttgaagatcgcaagcgcgacgatcatcgcgtcaccctcagcaagctccatgcgctgctggcgacgcctgaatgcctgccactgtgcatgccagcgctgcacactcagcgaggccccagcgcgcgattgctgtttggggtgctggctcattccatgacggacgatgaactggaaccgtttctgatcaccagcttgcatcaccctgacttcagcgtgcgccggctggcactgggcaaggcgatggaactgccggaagcggcggcccatcgcgccatcgccttcggcctcaccagcaacagcagcattctcaggcggctgtcgttcctggaagctgttcagctgcaaacaggccgcactcaactgatcgaagactttctgaccgatccatcaccggcgaccagatccacagcactgtgggccgcgaaaaagtatggcgtcgacccggcgcctctccttaacaggcacctgaccggcaaaaaacctgaaacgaaagcccagtggctgggtgttctcgggctggcgcaagacctgagcgtaccggcgcctgaacagtggctgtcagctgcactggaacaaaacagcggcgctgttcgttcgctggtgttgagtattgaaggcgcagaccggcccgcacggcttatcgccgcgattgcggatccgtcccggcaggtttttgaggcaggcgttgcggggctgcgtccccagccttggagcgttatagcctcggcgtttacccgccaacttgacgcgctctgggcaacgttgtctgcgactcgacgcctggccctgctcgaactgatgcccaaatggactcaggccggattcctgctgagtcagcttcaacgcaccccggaagatcccgcttcattagagcaaatcagcgcctgggccgatgctcagctctatgcgattaccgatcgagaaacgccgaaaagtgagcgtgaccgggtcattgaacaattgaccgtgctggaggcaggcggagcaatgccggcgggggccattgcaaggctgacatgaggcatggcgctgtaataccttgcgcccggataacccaatgataacggctggaaaaggacatcccttgaacaagaaacaacgcgacgccatcagtaaacttctcagctacatactgcgccacgcgcccgaatccataggtgtcgtgctggacagcgatggctggaccgacgttgacggcttgatccacaacgccaaccaacacggccatgccttcgatcgccaagccttgctcgacgtcgtcgagaccaacgacaaaaaacgcttcacgctctccgacgacggccagcgcatccgtgccgcacaagggcacagcaccgggcaggttcaggtgcagcatgtcgagaaaacgccgcccgctcagctctaccatggcacggccagccgcttcatggctgccatcgaagcgcagggtttgaaccccggcagtcggcaccatgtgcacctgacggacaaccccgaaaccgcgctggccgtcggcaaacgctatgggcagccggtgctgctgacggttgatgcactaggcatgagccaggcgggagccaagttttaccaggcggacaatggcgtgtggctggtggagtcggtgccggcgacctatttgaccagcatgtactgactgaaattattgatgtgatcgtccaggttgtcctccagcatcatccggtactggtcacagaaatacttcagcatcgcctcccgcgcagcggccatttccgcgccggacttgaagttgcgcgcactggcccaggcattgaagcgcgtggtgccgaacatcatcgaggcgctgacctcaccgaggttttcgcaggtcttgagctgctcgttcgacagttcgatatgtgcatctgcacggtcgtagaaagcttggtcagtggtgtcggccatggtggagttcctgggtaagcaaataatggcggctattggagcatatcctggccccacagcgcagagacgatgacctcttcagcgccagcttcgatgaaggcagctccgaaaacgcccctctatctcacgcatcattgccgcttctttgcccgtcacaattggggttccacgccgttaaaccaacggcgtcaactgactcaactgctcaggcgtcggaaaacccaacgtgcgatagcgcgccggatacaagctcgccggcgccagcaggtcacccaatttggcctcaagctcatcccattcaaccacctgggtctgggcgctgccatcgggctgaagttgaaccaacgcgacgcggtcggtcttgggcaacaaggtgtcgacggtttctgtccagctgcacatcgagaaggtcttgccgttgctgtctttcaactcgaacagcgtgtaagacgcaacaaacacatcgattttctgctcgtcgtggatcgtgtcgagttgctctttctgcacgtggtaattgccttgcagcagcatgtgttcgaggctcgccatgcgtgccttgagtgcttcatcctgagtgacgaagggcacgatccgttgatcgtcgtaggtatagacctggctggaaaccacacgcccggcttccatggccttgaagctgacctcgaccatatgccgaatgccctcttcatccttgtcaccggtcaccatcagaatgtcgcgggtcgggatcatgaacactggccggcctttgatcgaggcgcgttgcaagacatccggcaacagcacgcggctggtgtcatagccgtcgttccaacggccgacatagagccctggcacaatttcatcaaacgcatccggggtggcttcgcgcaggttactcaccgccaccgccagcgcctcgtcgaggctcacaccccagttatcctttggcccttcggtaagggtggacgtggtctcggggtagtccaccgccagcaaggtcacacagtctttgcccaaggcctggtggacggcggcgtacggcgcgtcccagccttcggtgcgcacctggtgcaggcgcacttcttcgagcatcgccaggttacggatcaccggccgtaacaacggcctgacgtcttcgaaggtttgcggcgtttcctttctgtagctgagcagcgtcgatacataacctttcaacacctcagctttgtgcgccttgtcggcgctctgataatcgttaaacgcgttatgcaggttgaaatagccgccaccgccatgcttgagacgaaactctttgggcacgtactcaagaggctcgctgaaaccggctgcacgcgcggccttgatgaccttctcagcgaaggcgtcttcggtcagggggcggttgaagagtttgtcgagcagggagccgaacatgcgcagagtcctccatgaagtgcgggcggtccatcatgggcggtgcaagagagcgcgtaaagcacctgcccgggttgtgtgacccagatcacggcgggcagttcacgccagcaattgcgtaatccaccgcgcctgttgctcgatttcctgcaatttcgcctgcgggaccgcctggcgcgcctgttcgaagctggccagggtcttgtgcttctggcgcagcatgcgctgccatttggccaggaacaccgggctgcgggcctgcatttgcagcgggccgaagtacagctgttcggcggtgtaagtcaccggctcagcgcgttcggcgacgatgatttcgtaatagaagcgattttcctgcagcaactcttcaagcaggatgcggtaaccgttatccatcaaccactggcgcaagggttgctcgccgccgttgggttgcagaatcaggcgctcctggccgctgaggtgcgccttgccgctgtcgaggatgtcacggatggtctcgccgcccatgccgcagaggctgatcgcggtgatctgatcgctgggcttgagcgccgccaagccgtccgccaggcgcacggtaatgtgttgttccaggccgttgtcgcgcacggtgcgctcggcggcgtggaacggcgtggctgccacttcccccgccaccgccgccgcgatcacgccgcggcgcatcaaggccaccggcaggtagccgtggtccgagccgatatcggccagacgcgcgccggcgggtacgtgcgccgccacgcgctccaggcgcatggacaatgtgtgttcgttcaacgcgtgttccttatcacaacaaaattactcacccgaaaaccgatcccggctgttggtcaggtgcaacaccatggcggcccgtgcggcgtccgggtcctggcgcttgatcgcattgaagatcgcctcgtgctccaggttcgccaattgccccagcttggcgaagtcggccccgccgcgttcggcgcccttgacctgggtgcgtgggatcatcgcattgcccaggtgcgacatgatttcagtaaaaaaggtattgccggtggcttcggcgatcagttgatgaaagcgcttgtcctcttccacgcaactgtcgttgttcgccagggaagcctggtagtcgtccagcgcttcgcgcatgcgcaccagttgctcatcactcctgcgcaccgcggccagcgccacggcttgtacttcaaggccaaggcgcagctccagcatattgcgcacgctggcgaccgtgtccacgtgcaagcgcaagccttgctgggcatgttgcgccagcacaaaggtgccgatgccgtgacgcgtctccaccagcccggatgcctgcagcttggaaatagcctcgcggaccaccgtccggctcacgccatgctcaagcacgatggtggattccgacggcagtttttcaccgggcttgagttgcccgagcaggatgcgctgggtcagcgcctcgaccacaccctgggccaggttggtggagcgtctgcgcacgagggttccgttttcaatgggcattgctggggtccacggggttgggctgggacgagcttaacaccctgtttggtggtgacgctgggttgattcgaaaaacacctaacttgtatgacaaccaatcttaaccaccttgtactccaaatcctggcgccttcgcttgcccgatgaatatcgggccttgtcaactcgataaaagcagcattaaaaccaacaaaaacagggtaaataaccaaaatactcattcagccgttgcgcttatgagaacaaatacacgcggcgctggattgcgaactcaagaaatccacttgtatgatgtctatcaacaaaacacacaaacccgcataaaaataaatcaggggagttttgaattgtgaacaattcaaaccatgcatctgccgcttcacccagcgactcaatcctcacgcgcgccgtgagcaaagtgaagggccatgtgctcccactgttcgtgatcatgttcatcctcaactacattgaccgggtcaatatcggcttcgtgcgcacgcacatggagcatgacctgggcatcggcgcggccgcctacggcctgggtgccgggttgttctttattggctacgcactgtttgaagtgccctccaacatgctgctgcaaaaggtcggcgcgcgtatctggctgacccgcatcatgttcacctggggcatcgtcgcgaccttgatggcgttcatccagaacgaaacccagttctacatcctgcgctttttgctgggtgtggccgaagccgggttcttccctggggtgatctactacttcacccgctggctgcccggcgtagagcgcggcaaggcgattgcgattttcctcagcggctcggcggtcgcctcgctgatttccggcccgttgtcaggcgcgctgctgcagatcgaaggcttcggcttccacggctggcaatggatgttcgccatcgaaggcctggcctccgtggcactggggttctttgtgtggttctggctggattccaaacctcacgacgccaaatggctgacccgtgaggaacaggacacgctggtcggcgccatcgaccaggaacagcgcgagcgtgaagcgctgactacggtcaaaccgacgatcggcaagctgctcaaagaccgccagatcctgctgttctgtgtgctgtacttctgcattcagctgacgatttacgccgccaccttctggctgccgagcatcatcaaaaagatgggcgacctgagcgacgtgcaggtcgggttcttcaactcgatcccgtggctgatttcgatcatcgccatgtacgccttcgcgtcgttgtcgggcaagttcaagttccagcaagcctgggtcgccgccgcgctgttgattgcggccgcgggcatgttcatgtccaccaccggcgggccgatcttcgctttcgtggcgatctgctttgcggccatcggcttcaagtccgcctcttcgctgttctggccgattccccaaggctacctggacgtgcgcatcgccgccgccgtgatcgcgctgatcaactccatcggcaacctgggcggctttgtggcgccaaccaccttcggcttcctggaacagaccaccggctcgatccagggtggcctctacggcttggccggcacttcggtgcttgccgcgatcctggtgttcttcgccaagacgtcgccggctgccgtgttgatctctcccagcgttgtgcccaccggcaccgccatcagcaaacctctttgagcttactcaggaaatcgccatgaatacccctgtagtcacccatttccaagtcatcccggtggcgggccacgacagcatgctgctcaatttgagcggcgctcacgggccattttttacccgcaatatcgtgattctcaaggacagcagcggcaacaccggcgtcggcgaagtgcccggtggcgaacgcatccgcgaaaccctcgaagacgcgcgcagcttggtggtcggccaacccatcggccagtaccagcgcatcctcaaccagatgcgcagcacctttgcctctcgcgacgccgccgggcgtggcctgcaaacctttgacctgcgcatcaccatccatgccgtcaccgccatggaagccgcgctgctcgacctgctggggcaattcctcgaagtgccggtggcggccctgctcggcgaagggcagcaacgcgatgcggtgaaaatgctcggttacctgttctacgtcggcgaccgcacagccactgacctggcctaccgcaacgaggcagacgccgatgacgcctggtttcgcctgcgtcacgagaaggccatgaccgccgaatccgtggtgcgcctggccgaagccgccaaagccaaatacggtttcaacgacttcaagctcaagggcggcgtcttgagtggcgatgaggaaatcgaagcggtcaccgccctggccgaacgcttcccggatgcgcgcatcaccctcgacccgaatggtgcgtggtcactcaaagaagccatccgcctgtgccgcgaccagcaccacgtactcgcctacgccgaagacccctgcggcgcagaaaatggttactcgggccgtgaagtcatggccgaattccgccgtgccaccgggctgaaaaccgcgaccaacatgatcgccaccgactggcgcgaaatgggccacgcgatccagttgcaatcagtcgacattccgctggccgacccgcacttctggaccatgcaaggctcggtgcgcgtggcgcagatgtgcaatgaatggggcctgacctggggctcgcactccaacaaccatttcgatatttccctggcgatgttcacccaggtcgctgccgccgcaccgggagacatcaccgccatcgacacccactggatctggcaggacggccagcacctgaccaagcaaccgctgaaaatagaaggcggctacgtgaaggtgccgaccaagcctggcttgggcgtggacatcgatatggacgcggtcgccaaggcgcacgaagtgtacaaaggcatgggccttggggcgcgggatgacagtgtggcgatgcagttcctgattccgggctggcgcttcaataacaagcagccgtgcctggtgcggtaaaaacttcagaatagccccagtcaatgtgggagctgtcgagcttcagcgaggctcgatagctcccacattcgatctgtgttgttattacatcagggcttttcggctactgccggcttagccctccccgcctgattgatagctatcggctgcaccgtcagctcgacgcctaacgccagcatcagcttgtggatcgtctcatagcgggtcttggagccgcctttcagggttttataaagactctcccgattgacccccgccgcctcagccaccttgtttacgccctgggctttggcaacctcggccagcgccttcatgaatacctgcgggtcttgcgccttcatgctttgcgcgagataggcactgataacttgcgggctgtcgagaaagcgcgacgcctcgtaaacgctggtgccggatgtatcaaggtcgaggatcggcatgtcctcgggtttgaatttcgattcgctcatttcattgacctctcagggcatcgaggatctcttttgcccgtttgattccccgctgctggtcggttttatcgctgccccataacatcaggtaagcgctgatcccagtgcgtacaaagtaaatcctgtaaccaggcccgacgaaaacacgcatttcgctcaggccttcgccgacgggctcgcagtcaccaaaattgttgtcttcggcgcggtccaggcgcgtcagaatggcggttttgccccagatatccttcataccgtcgagccatgtatcgaactccggcgtcctgccgattacgttggtcacagattcacatgtagcctactggctactacttgccgatgctagttaattttttggcccggtgtataccggagtaaaaaacctagcccagcccacgcataatcagcgtgtcgatactgtgagcacttctttcccttacgtttaaagcgcccgatcaaacagcggggtcacgtcatagcgctgcttgagcatctgcgcatccaccagaaaatctgccgtggcctgggcttcgctgacaatcgtcggcgagatcggcagcaccttgatcgcatcgcgcttgaaccacactttggcaatctctggcgcagattggttggccttcgaccaggcctcggcgtacgcgtcgatatggctgttgctccacacccgagcgcgggtcaggcgggcgacgaaatccttgatgatcgcgcctttctgcgccagcgccggttcataggcgacgatgtaggtcggtgcgctcatcaggcccttggcgttgcggatcaaggtgctgccctctttctcctgcagcgacacatagggttcccaggtgccgaacgcgtcgatgtcgccctgggtcagcgccaggctggcttcggccggcagcaggtatttgaaggtcacgctgctgcgcggcacgccggcttcgtcgagggctttgtacgccagctgctggctccacgagccgttccagatcgcgacggttttgcctttgaggtcggccaccgactgaatgcctttgcgcgccacgatacccacgccgtcgaggctggtctgggtgctggcgaccaccttcaccggcgcgccgttggccgccaggctgatcaccggcgtgtcgccgacaatgcccacgtccaacgcgccgctggcaaccgccgaagccacgggggagccggtgttaaagcgcttgaaatcgattttatacggcaagtctttcaactcgcccgacagctccagcacgatgcgattggagaagaactggtcgcccaccgtcagcgtcagcggttctgccgcccctaccgaggagccatgcaacgagagagaggccaggcccagcagggcaagcaggtttcgacgattgatcataaaggaatccacagagttgagggctgactcaaccatctgtgggcgtgcagtctggtgatgagagcaagggtttggaggtcgccaagcgtggcgcccgtagaagctaacgcaataaaagcgccgggtttaatactgttgcgcactatcgatagaaccactgcgcagcaccctagctatttttcgtattaaaaactttgccacccctgagttagggtgacgtcaccagaccactggaccccagcacctgagccactttctgcaaggtccattgcatgtcgattcccgcgttgaatatctggggcactgcgccctccgcccgttacgaacaactggctgcaccgtttcgcccactctttgcgcagatcctcgcccacgccgccgaggccgatcagacccgcgccagcctggcgacggtgatccagcaactgaacgccctcggcttgccgcgctggcgcttgcccgccagttacggcggccaggacgcgagctttgccgaactgcttgcgctgctcaccgagctgtccgccgccgactccaacatcacccaagccctgcgcgggcattttggtttttgcgaggacgtgctctgcgccaaagacctcgactggcgcgccaagtggctcgaccgactcggccagggcgccctgctctcgcccggcagcactgaagtcggcagccaggcccgtggtgacttcggcacccgcctgcaccgcgatgccgacggcggcctgcgcatcagcggcaaaaagttctacaccaccggcgcgctctacagtgacttgatcaacaccgtggccaccggtgaagacggcacggtgtacagcgtcgtcgtcgatctcaaggcgcctggcgtgaacatcgtggatgactggaacggcttcggccaacgtctcaccgccagcggcacctgcatcttcgacaacgccccggtggaagacgacctgcgccccacccaccaacgcttcggctacggccagtcgttctaccagatctaccacctcgcgaccctcgccggcatcgcccgtcgcgcggcgttaagcggtgcgcaagagctcagccagcgcgccaggaccttcaccaccggcaacgccgatagcgccgcgcacgacgtgcagttgctgcaagtcatcggcgaagtggccagccaggcctacgccgcgcatgccatcacccagcaagcggcgcagcgcctggaccagacggcgcagtctgtaatcgcccataccgagccgctgcacgatgacgacccgcaggtggcattggcggagttggaagtgtgcctggcggtgaacccggtggtggatgccacactcgcggccaccactgcgctgtttgacgcgctgggcgccagtgccacggccagcaacaaggcgctggaccggctgtggcgcaacgcgcgcacgctggcgaaccacaacccgcgggtgtacaagtcgcgaattgtgggcaattacctggtgaatggtttgctgccgccggcgcagtggcgggtgggtgtggccaaaacctgatcaaacaacacagagcaaatgtaggagctggcttgtgtgggagctggcttgcctgcgatggcatcacctcggtttaactgcaagaccggggcgtctgcatcgcgggcaagcccgctcccacatgtgacagggattggtcttactggctcacaaacgcaaccacctgcgccagcatccgatcacacgccgccaactgctccacgctgatgaactcatccggcttgtgcccctgctccatgcttcccggcccgcacaccacggtcgggatgcccgcctgatcaaacaacccgccctcactgccaaaagccacggtgccgtagtcccgcgagccgcagaactgcgcgacccactctgccgcctggctttccaccgaagttgccaggcccgggtagctcgacaactcactgaaactgatcgcgcactgctcgctcaccgcctgcatcgccggcaacagggtttgttcggcatagccgcgcaactgctgcgccacccgccagggatcctgcgccggcagcgagcgcacttcaaaatcaaacgtgcaattttgcgggacgatgttcagcgctttgccaccgtttatcacgccggtttgcacggtggaaaacggcggggcaaagcgctcgtcaagctgatccggcaccttgaggctttcaccgagccgcaccaattcactgatcaaccgcgcggcgtattcgatggcattcacccccgacggcgcatacgccgaatggcacgccgcgccctgcacttcgcagcgcatcgccaacttgcctttatggcccagcaccggcttgagttcggtgggctcgccgatcacacacagcagcggcttaaccggttgcgcgtgaaacctttcgatcagcgagcgcacacccaggcagccgacctcttcgtcgtaggacagcgcaatatgcaccggcatgcgcaacggcgcttgcaccagcgccggcacgcacgccagcacacaggcgatgtagcccttcatatccgccgtgccacgcccgtacaacttgccgtccttttccgtcagttcgaacggcgccaccgtccagcgctggccgtccaccggcaccacatcggtgtggccggacaacacgatgcccggcacctgcgccgggccgatagtcgccagcaagttggccttgctcttttgcgcgttgaacaccagttcgcacgccacgccatggccttgcaggtacgtgcgcacaaagtcgatcaaggccaggttggattcgcggctggtggtgtcaaaacgcaccagttgcgccagcaattcacggctgctgctcatcgatcatctcccggcacggcgtaacccggcgcgtgttgcgggttgatggcgcggtcgatgtagtcctgcagttggctgcgataagcctgccagagctggtcgagggcgccgatcgggtcttcatcggcccagtccacccgcaggttgacgatgggccacaacaggtcgtcgaccacgatcaacgccgccgaatgcaccgggcccgcctcgccgcccctggcctggccgctgtgcatcgccgccagcagacggtctgccaggtgcccggacgcattttcgaacgcacgcaccatggcctcgatcacctcaggattagcgagcatgttccccgccgccacgcactgctcgccactcaccgccgcatgaatgccgagggtttgcgcgccgctgaaatgtgcggttcgaccttggctatcaatcaccgtcacttggcgatattggctatggtcctgcccggccagcagcgcttccagtgcctcactcggcgccatgccctgctccagcctatccagcatctgcgggcccaaactcggcaacgtgatgttctgcgaagccaccgcacccacccccggacgcaaccacgggcaacgtgcgccaacagcaatgcttgaagagctgatcgcaatacccaactggccagtctcggcgcagcgagcgacaacggaaaacgtcataaaaagccctcagtcgagcaccgaagggtcggcgtcgatcatcaattgcttcatttcttcaaagtgctgccgcgaaaaatccgcaatcccttcccagccgcgtgcagtcttttccgccacttcatccgacaacacccgcagcggctgcccggtggaccacgccgtcaccaggatctggcaggcgcgctccagggtccagatatcgtcgtaggcttcgccgatcgacgtggccgtcaccatcacgccgtgattgcccatcaacaggcggcttttgccgtcgagcaaaccggccaggcgcgcgccttcggcctcggtgtcggccatgccgccgtacagctcatcgacggcaacgcggttgaaatagcgcgcagtgttctgatcgataggcgggatatgcggcttggccaggcacgccacggccgtggtgtagatcggatgcaggtgcaacacagcgcgggtttgcggcagtaaccggtggatctgcccgtggattgaccaggcggtggcatccacattcgggtggtcggcgcagccagggtcatcggcgttcaacagtaaaaggtcactggcccgaatgcgcgaaaaatgcttccacttcgggttaagcaaaaactgtttgccatccgccgacacggcggcgctgaggtggttggccaccgcctcgtgcatgccgacatgggcgatgatgcgaaaggtcgccgccaggtcgatgcgtgcctgttcttcaagggataacgccatgaatctgtctccacagggcgcggccgcagcaggctgcggcacgcgcggtaggcttacttgggcatcagcgcgtcgatgtcggctgcggtcggcgcttcaaagttgtacttcttgagcaacgcggcgtattccggggtggcgcggtatttttccagcccgtcgagcaaggctttcttcacgtcgtcgttgcccttcttcacgccgaagccgttcagcaccgggtagatcaagctgtcggaagaaatcaccacgcggctgccgagcttgtcgatcacaccacgggccacggcggcgtcggtgatctgcgcttcgacggcgtgagccagcaaggcctgggtggtttgcgggtcggtgctgtattcgctgatctggatcggcttcaagcccttggccacacagtattcagtcgacaacttgttcatctgcgccagccaggacgtggcgcccatggagccgatcttgtggccgcagaactcttccggcttcttgggctggaaggcgctgtccttgagggtcaggatcgactcgccgcttttcaggtaagggatcatgtcgatgactttgacccgctcggcggtgatgtacatcgacgagttggtcacatcgaagcgcccggcttgcaggccggtgatcaggttgggaaagcgcgtgtcgagggtctcgaccttgcgccccatgaccttgcccaggccgtccatgaattcgatatcgaaacctgccggcttgttgttatccatgtactcatacgggaagaaggtcacgtcggaaccggcgatgatcttgccttcctgctggaacgccgaagccgccaacgaggtcagtgcaaccgcggcgcccagcaggcacacggcgaaagggcgaagacttttttgagacgctgtcatggtcattacctgcaagggttttagggggttaggcagtcgcggaatcctggccggcctgttgcacgaaaaacgacgcgccacggggtttctgcggcaagcgcagctggttgtcggtggagcgcaccaagccactttcttcaccagccaccaacaggccggcgtgtgcactgggcagcgggttttcgccaaatggcagcgcgtcttcagcggcatagacgctgatgaacaacgtgcgcggcagttcggtctcgttagggctggaagcgtgcagcaaacgcgtgtgcataaagcacacggaaccggccgggccgtagcaggcaaccggttgctggcagtgttcttcgaccacggcgtcgtccaccgagccggtgaaacgctggttctgccagtgcgaccacaacgggcctttatggctgccggggatcacattcagcgggccgttctgcggcgtcacttcgctgaccatcagcaaagcggtgacgatgtcgtcgttgctgtggggcgtgaacaaaaagtcctggtgccacttcacctgggtcgcggtgtgcggcagtttcgagttgatcttgctgtgatgaaaacgcgcgccgccagcgcccaccaactgcgcggaaatcgccgccatccgcgagtgcaacgccacccgctcatacaccggggaaatctcggtgggcgaactcacccggcgcaacgatgggtgatcggcgcgatggtcgccttccaggtcgaagcgcgcgcggccatccacggtagcgccccagccttggtcgtggctgcggctctcttccacccattggtcgaagtcgtgttgcagcgcggccacatcgtccggcgacagcacgccttccaccaccaggaagccgtcgcgccggaattgttcgatttgagcttgctcgatcattttagggtgtcctgaacgttaacgagatcacgccagcgagacgtccttgaggaacgcctccacgcgtgggttgtggccgctgcgcagggcctggggcgtgtcatcgcaaaccacgcggcccttctccatgaacacgatgcggtcggagaccttgaaggcgaagttcatctcgtgggtgacgatcaccatggtgatgccctccccggccagggcttcgatgacctgcagcacttcgttgactttttccgggtcgagggccgaggtcggctcgtcgaacagcatgatttgcgggcgcatcatcaaggcgcgggcgatggccacgcgttgttgctggccgcccgacaattggtgcgggtacttccaggcgtggtcgagcatgccaaccttgtgcagcagcgcgtaggcctgttgcttgagcgcgtcggtgcgccccaggcgatggtatttcggcgccatcaacaggttgtcgagcacgctcaaatgcgggaacaggttgaagctctggaacaccatgccgatgttcaggcggtgctcggcgtgctcaacgtactggggtttctgcgcgccgactttgttgagatgaatgaacggctggccgttgatgttgatctcgccattgtccagttgctcaaggccgttgagcaggcggatcagggtggtcttgccggagccggacgggccgatcaccgacaccacctcacccggctggatctgcaaattgaccgagcccagcacctcgatattgttataagccttgtgcaaccgcgtggcgtccagcgccgaggcgccggtgctcgccgggcgctgcaacgccgtgcgctgttgcgtggccagggccagcaccgccgcgtccggcacgcgggacacgttgcgctggttgacgtcgagaaagcgctccaggcgtttgagcaggaagtcgaacacggtgacgataaacacgtagaagaacgccaccgccgccatggtttcaatcaccaggaagttctgcgaatacaggcgctggccgaccatcaaaatctcggtcagcgagatcaccgacaccagcgaggtcagcttgacgatggagatgtattcgttggccagcgacggcaaggccacgcgcaacgcctgggggatgaccacacgccattgggtgccgaagaacttcaagcccagcgcccgcgccgcttcgccctgccctttgggaatcgagagcaaaccaccgcgatgaatttcagccacgtaggccgtctcgcagatcaccagcgccagcaagccggaccagaacgggtcggccaacacggtggaggtgccggggagcgcctggggcaagttgtagataaagatcagcagcaccagcagcggcaggctgcggaacaaccagatatagccacgggccggaacgctgagcagcacgtgcctggattgtttggccagcgccagcagaaagcccagggcgatgctcaggatccaggtcagggtgctgagcttgatcaccgtccacgtcgcacgccagaactcggggtcgctgagcaaaccaaacatgtagtgccagtcgaatgtcatcgtcgcggtgccttgctgaaaaaagaagttgatctgcatcgatgggatgagagtcgtggggacgggggcttagggtcaattcgtaaaacccggctcactgggtaggtagaacctatgcaacccaaaaaccccaaaactccactgtgggagctggcttgcctgcgattgcggtgggtctgctggtccatcaggcacagacagaccgctttcgcaggcaagccagctcccacattggatgggtgttgttcatgaggccgcagggtcaggccaaaagggtgcacagctgagcgagcggcgcagcccacgccaccttttggtgcaacctcaactcaccccactcaagacccgcaccgcatgcgggtcaaaaaagctcggcggggccatgccggggatgtactggtcggacacaaacaagcggcaacgctcggcaaacgccgacaccacgcgcgacaactgggtgttgctcgccgtggcataccccagccgcatcggccggtgcgagccggccaggcgcaggcggattacccgtttgccatcctgggacatattcaatttgggccgcgcattcgcaaaggaatagccaatgccattgccgaccattgcgcgcaccgtttcgaggttggtggagcgcatgatgatgttcggcgtagtgcccgcctgcatgaacaggctgaggaaatagtcgcggctccagggcgtgtcgagcagcaccaccgggtaggcttcaaggtcttgcatgctcaccgccggcaagctcgccagcgggtgatactcgccgaccatcacatacggcggcaggtgcgccaggggttggaaatcaatgtcggggctggtcaccaggtcgtaggtcagggcgatatccagctcgccgctgcgcagtttctccagcagttcctcgtggttgccttcggcctgggtcaggcgcacaccggggaaagcgcggccaaaaccaaacaccaattccggcgtgatcatcggcgccaacgactccaggcaacccacccgcagcggcccgcgcaccgtgttcaacgactcggaagcgatggtgtagaggttggtcatctgctccagaatcagcttggcctcttgcatcacctggcgccccaccgccgtgagcgaaatgccctgggcgtggtgccggataaacagctgaatgcccagctccgcctccatatgggtgatggccgccgagatcgacggcgacgacacatggatgcgttcggccgcagcactgatgctgcccgcctctcccgacgcaacgaaatactccagttgacgctgagtaatacgactgagcatttcgcctgcccctcaacaatgactgtaccgggggtgttgcagggttcgtgccgggtcgcgcgccagccgatgacctgcacgggcttcggtttttcctaagcactaccccgcgcaaatgctggtttcgcgcggtcggggccgatgtgaagcttgttttatcccgcgtccgatgagttgcccgccatgcccacccacacccgcatccgtatgttcaacaccaagcagacctaccccaaccaggcgctggacaacgacctgtgccaggccgtgcgcgccggcaacaccatctatgtgcgcggccagatcggcaccgacttcgacggcaacctggtcggcctcggcgacccacgcgcccaggccgaacaggcgatgaaaaacgtcaagcaactgcttgaggaagcgggctctgacctgtcgcacattgtaaaaaccaccacctacctgatcgacccgcgctaccgcgagccggtgtatcaggaagtgggcaagtggctaaaaggcgtgttcccgatctccaccgggctggtgatttccggactcggccagccggaatggctgatggaaatcgacgtgatcgccgttgtgccggatgactggaccgcatgaaggcggtgattgcccgtgagccgggcgggcctgaggtgctgcactgcgtagagcgcccggtgccgacacccgaagccggcgaagtgttgatccgcgtggcggctgctggcgtcaatcgcccggacctgatgcaacgcagcggcgcgccgattccgcctggcgtcaccgatgtgctcggcctggaagcggcgggcatcgttgtcgcggtaggccgtggcgtggacgagtttgcccctggcgaccgcgtgatggcgctgctcaacggcggcggctacgccgagtactgcgtggcacaggcggcgcattgcttgccggtaccggtggggttatcccttcacgatgctgcaggcgtgccggaagcagcgtttaccgtgtggcacaacctgtttgaactgggccgcctgcgcagcggcgacagcgtgctgatccacggcgccgccagtggcgtcggcagcttcgccgtgcagtgcgcgcatgccgctggagcgcgggtgatcgccacagccggcggcgcgcagaaagtcgcgatgctgcaagcgcttggcgtgtggcgcgcggtggatagacacactgaagatttcgtcgaggtggtgaacgactgcaccgaagggcgcggcgtggacgtggtgctggataacgtcggcggcccttatgtcgcgcgcaaccttgcagcgatggcgctgggtgggcggcatgtgagtttgtccttcctgcaaggcgcaaaaatcgaactggatttacaggtcttgatgcgcaaaaacctcagcctcacctcctccaccttgcgccccaaaagccacgccgaaaaagcccgtttggcggtgtgtattcgctcacggtttttaccctggctggcgtctggcctggtccgcccgcagatccacacgcagttgcccctgcttcaagccgccgaggcccaccggctgctggaggccaacgccaacgtcggcaaagtcgtgctgaccgtcgcgcaataacctggagcgcaagccatgtcccaccgcgtgtttttcctcaatggccccaacgccaacctttacggcctcgacaaaaacggcacctacggcagcgaaagcttcgccagcatcgaagcacgctgccaacgtcatgccgccgagctgggcctgagcctggagtttcgccagagcaaccacgaaggcgtgctggtggactggattcaagaagcgcgtttgaacgccgacgctgtcgtgatcaacgccgccgggctcacctacagctcggtgccgattctcgacgcgctgctggccttcgacggcccgatcatcgaggcgcacatgagcaacatctggaagcgcgagagttttcggcatcactcctacgtgtccaaggcggcaacgggagttatcgcggggctgggggcgctgggttatgagctggcactcacggcggtggccacgctattgaaaagccaatgagccgcctcaccgtgcgaccgggttgctgcacgacgtcatcggcactaccgacaccggcagcattgaccgcgcgtgcactggcatcaatgccgtctgcggtacgggccgcgacgctcagttggtgggtgctggcggacacatgggcgacatcacccagttgaagcgtgcgcgccgagttctctggaagggcttgttggcgttgcgccaggtctggtcgcagttgtgcgttgatagaaacggccgtggagtggccagtgcctgcgccggttcgttcctgggggcggcctgccgccacataggcgtggccgcaaaaaggtggcagatttatttaagcgacaaagcccttcaaaaaaccaaacaaatccgtcctctttttacttatttggcgagaaccaaatatcatcagccgcatgaagtgtggcacttcctgctccttttacgcctaaatatcagcgccgcccagtttcatacttaagcaaaccttgctcctcacgcgaatgcaaataaatggccatgcgctgcgcttcgatgccatcaaaaaggctaagtgcgagcagattctctgaagaccattccattaatggtttcatggtctcaatctctagcatcaatgcttcgcgtatagttttatcgtgggcaccaaaccacaccctgaaggtggtttgccctccatgctgaataactcgttggactacaaaatcttcattcgtttctacttcgtcgcctagagcaatgtcttgagcaaagaaaggaatacaacacagaataaatctgtgagcggctgttttccgcccccataactgttcccattcgttacgtccatccttggttccaagatgagcgacaaatatgaaattggcacgatcacgccaaacaggcgctttatgaacagcttcatattctccggtctgatacttcatatatatcctctactcatttaccagtgggaaggaggcgattcaccacgatatcctagcgggggattgacaggaaactcgtgcgccttttgacgcgttgcagtgtgggcacgccatttgagcattttcccgtgtagcgtctccccctctagcctttggaatcgcatgatcaacttgtgtaaatagggtcagaccctgaggagtccccgatttttcttactgaaaataaagaagtttgaatattgaagaggcctgcatgagtcggcaacttggtttgcaccacacagaaacaagaacacgaacccatgcaggccatccgatttttacacagagcgctcgctcaagcactgccttcaatccattctcgccgtctgacaacgctgaagagttgtgtcagttcgttattgcaaggccgtcgcctaacgctgacagcgctgggacgttttatgccagggtaggcgtatccaaaacatgcgatcaagcgagtggaccgattgttgggtaatcaacacttgaggacagagcggtcattgttctactgggtgatgctgcgggcgttgttgggctccttgaagcacgctttaatcttggtcgactggtcgagaattgatgcgtctggcgacgcctttttgttgagagccgcggtcccgtttgcgggacgctcgtctcctatttatgaaagcgttcatgagcgcgagagttgccccaaatatcaaagtcgcctgctcaaaacgttggctgcattaccacctgaaggatgcgttccagtcctggtcactgatgcaggtttccggcgtccctggatgaaggccctagcggcgcagggctggtattacgtggcccgtatacgaaatcgtgagctctatcgccgcgaagaacatgactggcagcctgtgaagaatttatatgctttagccacttcatcacctaagtcattaggccgtgtagagatgacccgtagcgcacctcacttcatagatttgtactgcatccgtcattcagccaagggtcgcagacaccaacgcgtcacgggctcaatcgcaagaagcaagctcagccggcagtctgccagacgtgagcgtgaaccgtggttactcgccagccaactgaaggaagaggagtggaatcctgcaaaaatcgtggcgatttataagcgccgtatgcagatcgaagaaggctttcgagatgtaaaaagtgagtacctgggattgggcctgaatctgcatcgaagccattgtccaaagcgcatcgaagtgctgttgttgattgccgctttggccaactacctcatcttcttaacggggttgcaggcgcgggaggaccaatcggagcgacgctatcaaagcaacagcctcaaagatcggcgagtactttcattgtgacgattaggtttggaatactggcgcagttgcaccgattttagtggccgagaacacctagaaatattggaacatgatctgcgtgatgaggtgcatcatcaggcgcagagcttggagtaaatttgtggggatccctcagggtctgactccgttttgccgtccaccgcgccacctgttgcttttgaacctaaccagcagctgtaaaaaaatgcttatctagatcaacgggaagaaactgactaggtagaatttttgacgaaatatctctgctaagcagctttaaaataaactcaacacagccgaagttgtagacctcctcttctccctgatccgagctatgaatagcaactttccatgaatctggttctccatcaaccaaccaaacaaaagtttctccattatccgttaccgcccaaggaagaaaggaaccttccgcagggtaatctggtcttggatagtccgataaaaactcctgcctcattacagcgtatgcgcctataaagtatttgcttttttcaaagttcaaatttggattttttgaaaacgggtctaacacccatacgaaatcgtctactgctccacatccgtaaattgatatgaactgtttaaaatcattcggtaaacgcggacctcccgcagattcaaaggtcgcccaggccgcattatcaaaaattcgctgagagggtggcgaaagaaggctaatcaacttatttatcattcttacttaactccactcacgttcgaaattgatacatcaagcgtaaaaccgcctgacccacgagcagacaacgttacaccgattggtattgggtttgtacctgtataaataggcaccaccctatagcttactgtttcaccactctgcactgcgcccctgacttgacgctaaaatgaactcatatttggatgatttgcgttgcgctggaaaagtgtcaccaaatttcttgcatcatcaccagtccctcctagtgaatttgcaagcaaatgtcctcgctcatggttagcaggctgcccctcaaaacctggagggcgaatcgctgggttagcacttgaaccggctcccaaagaatcctccctaagaactgctgtaaccccattaggtcgatcaagtgagtcaagctctccaagaattacattgcttggggcatttggacttggcttggcaagcggtgggcagctgctttctggaattgcttttgcaccaaaggtaagcgactaaagtcgcttacctacccaaaagttacatatcaacgcctaatttgtcagctacctccctcagtcgcagagaaacctcaataatctcatctttacttaggccgcaatatgtcgaaagagactcatctggaatattttgaattagagccaatccacacgaaacaaaatatctaagctctcttggtgtgactttcagatcaataaagtctagttcattaactggctcattcattttttggggacctgagatttaatatagttatcccaaccgacaccaccttggtcaggtctgaacgcggtagcctcacctctctgcccccgaattacaatagtcttagttgagctatcgagatagtacatcgttccatcaacggattggcggcgatcgatcgcagggttagaaacgatattctccacaaaattcttaaactggctttttgtgctgataccaagatcagcaaactcctgtcgctcaaccacatgtttctggaaagcatgtccacttgcgacctcttcagctaagagctgagagttgagtctgccttgattgatagcgctctcagccccagagctaccttttgcaccagatccatcctcattatacatattcccaggattgagctggtgccccggcgttacgtacggcccatcattttgcttcccgtccagctgcgttccaccggtgtgcggggtggggatagcaacattaccatcagcaaaaccaccactgcttggatgctcgccaatgatcttaataatgggtgtgatgtaactcaaattctcagggtcaagcgtgtgagccgggaaatctgttcccagcaaaagctcccatatacctatggaaaccctgatttgtttaacggcatctttaccggacttagcagctgactcaacaatggaattcgcagcgatgcgcgttctttcctgcaccgtcgcgtccgatgcaaccaaaacggcaccgacagcaaccacgaccgcctcgaccgcgggtgcagtccatacgagattttgtgcacccgttgccggtttattcaaactggctagaaggctcataatgctcagcgctttattggggtcatcacccgcaatctgagtgagcttatcaaccaacgcttggttttcaggtgcctgctctttttctgtaatgccctcgatcactttattgattgccgctgcgcgatcttccgcatggcgactacccacctgcctgactaacgcgttagtggctacaagtgtggatacatcgtcaggattcactcctagagcgaaggctgtgcccgcgctaaaaagatcaaccaacaggtgaattgtttcctcagtccggtctccatatttatttgcatccgtcttccattgcgcaatcgttgcagccgggttagccaccacggttaaggacgagttcgtaacgtaaagctccgtacgtttctctttgtctttagtcacttcataggacttatcgacatcacggttcagaccggcgacagcggatgtggcatccgtagcatcacgaacgatgatctcccctgcgcctacggtcgaccgaactgattgctcgcgctctttgtcgtacttccagccagaagcactccagcctgtctgaccggccttacccttgcccacttggcttgggtcttgggtagtactggcaccgcttttgtaggtgccaccgacattcaggtaataaccatgctcgttatctttgcccgcgatatctctgaacccaagcgtgccggtgtccagcttgaggttgccgttgtctgacgcaatcagcgccccatccagctgagtatggttttctgtgcgaatgtctaccttgtctcgcccagtgactcgagtctggtcttctacccagttggttttccctgtggtctggccataaccgactgagccgctgacgccagcgccagggccgatagttaccgttgcactgatatcgaattccttgcctttgaccttaccggtgtcaggcacagacgatacgttcaggtcgcgtccaacgcggccgatgacctcgtcaccacgcaagtcggcacctgcgatattggtatctcggccgctgttgaaaccgaggcggtctcccgcatagagataggcgttttgctgggcctgtttctctctctcaaggtcacccctgcccatgctgacgctgacataaacaccagcgcccttttcaccgccaaatgtcagcccgacttcaccgccaccactgcttctggtgctttcgctgtcgctgtcgttgtgagcagcaccgatgttcaggtcattgtcggccttgagatcaatgtctcggcctgatcggacttgagtgccaattaggttcaagtcatgacttgccttcaggttcacatcccgaccggcgtccaccacggtcggtgtcgatgtctggtggctgccctcttcatccgcaacaccatgactggcgccgacgcccagcttgagcccgccactggtgcccccatggatgccggcccaactttggctttgcgtgtcgtcttggttgatgctgcctttggcgacatccaggttgatatcacgacctgtgacgttgatatcgcgtcccgcacttaactgaccacccacgacggtgacgtcgttattggccgtcatagtcaggtccttcccggctttgagggtagacgaccggttgctctcttcaatcgactgcgtgcttgtactttggctgctgttgccaattttcaggtcacctgtcgtgccagccaaaaactggccaacagcatccactcccctaagcgtactggaacctttactgacgttatcttcgcccttacctgcaccgcttaccgcatccttggtactgccgtagttgtgattaatggaagcgctaatgccattgcgctctttttccacttgctgctctaccaacaaacgctcacgcgcggcgtcaatattgatattgcgacctgctttcaggtcgatatcattggcggccgccaagtcagaaccacgctggttaatatctcgcttggcagtgatcgccaagttttcacccgcgctgatctggcttgccgctgcagtgtcttgctcaagacggtttttttcggcattgcgatcagtaccggcaaagaacgtcacaccattggcatcactggatacacccacccccgtctgtttcgacttcgcccaatcgcgctcgctcttggagttctgcgccgccaccacattcacgtcgcggcccgcattgaggcttacgtcacgcccagcgctgataccgctgcccaccaggttgatgtcacgttcggcctgcaacgtcgcatcgcgatcggctgatacctggctgcccacactggtgctgctttgggcttcctgaccggcttttttggcggaggagatggcgatgaaaccgcccgagatcgaaccggttttcctctcgtatttctcactacggctatacgccgtgtcgttggccgagatcaggttgatgtcgccagtgtccttgaccaggcccgctctcaactcggtgtcgttctgagcgctgatctcactcgcccgcaaacgcacatcattccccgcagccaccaccacgtcattgccggcctccaactcactgccgacttggctggcggtggttttcagctggctcttgccgcttttcgacagcccgaggaacccggacttggtcttcttgctgtaggaaccgtgctcctcgacacccgacagcactgcgatatcgcccgtggcgcccagcaacatgtcgccgccggctttcaattggctgccgatcacggtgacgtcgcgcccgccttcgatgttcatgccgccatcggcttttttgctggcgttgatggtaaggtctttaccggcttcgaccacggaggcaacgttggtgctgtcgtagctttcacgttgttcgcttttgctgcgaccgaacgagcctttgctctttttcgagtagaacgaagcgtcttcgtcgagtgccgagaggatgctcacatcgcgctgtgcctcgagggcgacgttgccgccaccggcaattcggctagcggtcagttccagatccttgccggcattcaacgacacgtcgccgccggcggtcagcacgctggagacttggctgatgtggtctttggactgtgtgactttcttggacttgctggaggaatgctgctcatcggcagccgaggaaacgctgaggttttcagtggccgtaatgctcaggtcgcgcttggcgtcgatgcggctggcgatggcgctgaagtcgcggcctgccgagactgtcaggtcacggccggcttctacgctggcactgttttgtgtcacggtttcggtgcgcagccggctgcccatgttgaagccatcgcgctgctcaaccgcatcgatatgcacatcgcgaccggcggtgatgagggtgtcgcgcccgctttgcagcacaccaccggtgttggccacgtcgcgcccggcactcagggtcaggtcattcgcggcctctatgcgtgacacgctgtcgaggtagtcgcgacgcgtcgcggtaccgccacctgtgctggtcacggcgcgctcgttgatcacatcacccttgagggccgtgagcgtgacgtcacgcccggcaatgatgccaccagacttattgacgatattgttgccggccagcaggtccagacgattaccggcttcgatcacgccgctgttggtcaggtcgttgccggctctggctgaaaggttgttggtagcgcgcagggtgccggcgttctccaggttttccccggcgatcaggttcaggtcgttaccggcgatcaaggcaccgttcggcgcaagacggttgtcggcctgggccatgtaaagcaccggcaccaacactttctcaccgttcactgaatgctcttcgagccagacgatgtcgtgcgtcagggcggcaacctgctgcgaggtcaacgacacgcccacggccaggttcagctgttgcttgctgctgatggcgttatccatcaagtacttgaacagtttttcgtcggtgttctggccgtcgataaaatgctgccccgtgcgcgcttgcacggcttgcttgatcaagtgttgctcataaagcccgtcgcccaggcgtttggcactttcatccgggttgtagcccaggcccgccagcaggtagtccgagctcatgaactgtttcaggtcggtgagcaccgggttggtttcgaccaggtatttgtgcggttgggacaccggcccggtgggcgtaaagccttgcacacggctgacggtctggctggcgaccgaggaggtttgcgcgcctgcgtcgagtgggttagcgaccaccgtggccacttgcgttgggcgattgccttggctttgtgtattgggcgtgccggctaccggctggatgcttggcatcaccggggtaacaccgggaatgttcactgtggggcgcgagaggtcgctgggtgtagtgacctgtatgcgcgtatcacgctcagtcagcgccaggtttggctggtcaccaggcccgctgaccttgaccgtaggcagtgtcgaacctgcggacggattttggctgttgatgccatccccacgggcgatctcaccggtggtgatctggccaggcgtccagacgccgccgttgtccacatcggtggccgcagagacgtcaaacgccgtggcgctggcggtgacgccactgacctggcgcgctgtcgagcccaattggcgagtcgcggcgctctgttgatcgacttgggtcaaatcgaaggtacgcgtcgtcggtgctggttgtgcgtccttgcgttgcgccaggccgaggctggcgccgcccatggtccagctttgcgggccagtgttggcctgtgccgcctgggtgccgtcgaccgcttgggtactgaggtggaaaaggccgtgggtaccggtcggcaggctgaactcacgcagtgtcagcgggttgacttgctgtttggcaaggtcaggcggcagttgcgcagcgagttgcaccaacaccgttgccgggccggtgctgatagcggtttcttcatggcgcgcggcgcgttcggccaaggccgtgaacggtgtttcactgctgttgaccaaggtcttggtggcggtgatgttcaccgcgccaccggcctggatgatcgccggcgccagtgacgccccggcggtcgataccagggtgtcggcaaccagtgggaacgccgacaacgcaccgaccggcaagcttttagggccgccctgcgcgttgtacgggtctacgacgctgcgtttgaaacgccagtaagtaccgttggacgcggtcaacctccaggtacgggtgcgcgtgccggaaccggacgtcgcacctttgttggtgagtgtgtccgccgtgatattcatgtccgtgccggcagccagggtgctgtattcgttgagcacgttgtttgcggcgatgtccattcgcccgttcgactggatagtcgaggcagccgaggtgttcagcagctcactttgataattctcggtgccgacaaagtcgacgacaaaactgccaccactgcagtcccagcaaatggtgccgagcgagccgccactgcccgggatttctttggtctggaacacatcccgacggttagtcaggttggccaccttcagcgacatatccccgctggactggatgctgccggagacgttctccaggcggctggctttgctcacgccatcacggccggcaacgtccaggcgcccaaggctgtagatatcgccgtattgattggtgatcgagtcgctgtgcaccgtcatgtcgttgccgctgaacagcaagccatgatcgttgagcagggttgcgctggtcagcgttaccttttgcgctgcgcccagggtcccgtagttgttcaggccacctgccgcgaggttgagagtggccgcagaggtcaggcgcccacggttactgagctggccatcaacgttgatcaccgcatcgccgccgctggttatcttcgcgctgttactcagatccaactggcctgcgtgcaggttgagggtgccctggctggtgactttgccattgcccgtgtaggcgcccgccaaatcgagtttcaagctgccatcactggcaatcaagccgttattgacccagctgccgcccttgccttcaaggtgcgtggaggccaacagctgcccggtttcggtctgggtaaagttattgacattcacattcaagcgcccggcctggatgacgctggtgttggtccaggtgtcagcgttcagggtcaggccgccacgggtgacgatggtgccgccggcaccggtgacattgggcagggaaatatcgaaattgccctcgcccatgtgcagcaattgcccgccgctgttctggaagctggcagcggccagggtcaggtcctggttggcggtttctactgcgccgttgcggttatcgaacaggctgccgatctggaattgcgtggcacccgtgcggcccagcgcgcgtagcttgccgccctggttgtcgatggcattggccgccaccgtcagggtattggtgctttcgatcaggccattctggttagtcagttggcccgtgaggcccagtgctatctggtcgccggcgatctgcccgttgctgttgtcgaggttgtcaccctgaacccgcatcaggcccttggcatacagcgcgccttgctggttattcagggtggcgagggtcaacagcgcgtcacccgactgcgccgcaatgtggccaccctggttgtcgagctggccggcagtgagcagaagccgctcaccctggatcaaaccgcccttgcggctgctgctctggtcataaccaatacgcatcacaccgaccacgccggcgtcgatgtcacccttgagggcggcaagcacaccgccacggttgtcgaaattaccggctttgagctgcacgtcaccggtctggctgacgatgttgccgccctggttatcgaggtcgccattgacctcgacacgcaacccgctttgcccctgcaacttgccttgcgcgttgctcaggccgaaggctttgatgcgcaggtcgccctcttggctgtaaatcaaaccatcggcgttgttttgcaccatagcgctggcatcaatcgccagtgggcctttggcggcaaccgtgccgccttggctgttgttcaggccacccatgaccagtaacaggcgcccttggctggcgagttggccgccacggttatccacctcgatagcctgcttgagcaccagcgccccggtgccggcgatcttgccgttgacgttgcccaggttaccttgcaggtcgagcaccaggtggtcgttgcccatcagcgagccgccggtgttgatcaggttgccccccaatacgttcaggttgcgcattgccgtgatactgccggcgctgttgtcgaggttggccgcgctcaggtccagtgttgagccgctgtcgatcaagccgccttgggcgttgctcagcaaaccgatcacattcagggtctgctgcgcgccgctggaaataatgcctttgtcactgttgtccaggctggccgcgctgacacccaagcgtccctggctgaccagtacgcctgcgccgctgttgagcaagccaccactgaggcgcaggtcgaggtcgccgttgcggctggagagcgtgccgccagtgcggttgtccaggctggcgccggcgttattcagcccctgccaacccgatatcaggccaccgcgattgaccacagcgtcggcattcaggctcagtacttgttggctgatgagtgtgccggcgctgttgtccaggctacgcccgctcaggctcagggcactttggctggagatctcgccgccctggttttgtgcgtcgcgcagacgcttcaaggtcaaaggtcccttggcgaggatcaggccttgacggttgtccaggtcaccattggccaggtccacggtcaggcgctgatcactgatcagcctgccgctgcgcagtgccaatgcgctgaggttgaggtcgatgtcgcccttggccgacacctcgccaccgtcactggcgtccagcgcctgggcattcagcgcaaggctgccctggctgttgatcaggcctttggcgctgttgtccagggcctgggcattgagcgtcaaggcgcgggtgccgagcaagctgccgccctggttattgaggtcgccgctgttcaccgtcagtgtttgtgcggcgttgatcaggccgtgttgctggttattcagcagaccggtgctggtcaattcgaggtcgccacggctggtgagcgtaccgccgctgttatcaacagaggctgcattggcactcaggctggcacctgcaaccaaccccttgacgttggtgagtccctggtcgatacgcaaggccaggccttggttactgagcagccggccatggctgttgtccaggttgcgcaccagcaggtcgaacgcctggccgctggagatttcaccgccttggttgttcacgccattgagacgattgagcaccagcgacccgttcgcgttgatcaggccttgctggttgttcaactgcccgttgttcaggtccagtgtcaggcgtgtattgctgaacagcttgccgccctgctggtcaaggccatcgacgctggccgtcagggcctgggcactgccgatgctgccagcggcgttgttcaacaggccggccttcaggtccaaggtgtcgccgctgttgaggcgagcgttggtattgtccagcgcaccggtggttactgagaccgcccctttgccactgaccaaacctttctggttgtccaggctggcgctgcgcagctgcaacgtactgtcggtcaccaactggccgtcttggttatccaccgcgcctgccaggtccagctccaacgcttgagcgctggaaatacggccttggcggttgatcaggttggcggcgttgacattcaggcgcccttcactgctgagcacgccctggctgttattgagctcgccgttgagttccagttgcaaaagttgctgggcaagcaacgtgccgttgctgttgtccaggttctgcgccgtgagcatcagccgctgggcattgagctggccgtcgttgcggttgagcagtttcgccacggtcaggctcaaggcttgcccggccagcacacgaccgctgtcgctgttatccagggtttgtccggtgaagcccaggtcgccattcgtggacagctcgccgccacggttatcgacattgccgacctgcagtttcagcactttttcggcgcctgtcaggcctttgcggttgtccagggacgtgccctgcaacgccagctcggtggtgctgataagttgaccgccccggttatcgacttggtcaatcgtggccgttaccgcggccttgcccgtcacatcaccggcacggttgtcgagccgcgcggaagacagcagcaacgcgccgtcggcgatcagcgtaccgcgctggttgttgatcaactggtcggcggcgacgtccattgccccgtggctgctgagcaggccatcgctgttgtccaggctggcggcacgcgcgttgatcgaggctgcgctgatggtcccgtgggcgttgcctaacgcctctttcaccagcagcgtgaggccctgattgctgatcagcttgccggtggcgttattcaggttgcgagccgccagggtgaacgcttgttggctggaaatctcgccgagctggctgttgtttacatccgccaggtttttgagcatcaaaagcgggctattgatcagtccggcgacgttggtcaactggccatgattgaggtcaaggtcgagccgggttttgctgaacagttcgccaccctgctggtccagcccggtcactgtggccgtgaggttgttgtcactggcgatacgcccgctgttgttcagttgggcggccgagacgtccaggcggtcggcactggtgatacggccactattgttcaaggcgccggtggtcagcgtcagcgcgccgcgactgttgagcaggcctttggggccgttgtcgaggctggcactggtgaggttgaggctggcatcggtttccagaatgccgccttcgttggcgacagcgccgccgaccgccagcgtcagcgctgcagccgaagacactgcgccgcctgtgttgttgaggtgggtgctggtcagttgcagcgtgccttcgctgctgatctggccctgctggttgtccaactgcccgttcagttcggtgccgggaatggctgccagcgcaatgctcagggattgctggcctgagaaggtgccatggctgttgtccaggcgcgcgccgttgaagtggttatcgcgggcaaacaccagcccttgggcctggttaatcacctgagccacggccagttccagcgccgtaccggcgacgagtttgccgccgctgttatccaggcgctggcccttgaagtcgatgccgctctggctggaaatttcgccggcgcggttatcaacggcgtcgaccgtcagtttcagcgcttttgtagcgcctaccaggccgccgtcgcgattgtccagcgaggtgccgccaaggttcagctcacccagggcaaccaactcaccgccttgttgcgccagcacgccgacgctgacctgcaggtcgttctggctggcgatacggcccgccgcgttttgcacgttatcggccgtcagtcgcagcggccccacggcactgatcaagccgttttggttacgcagctgttgcccggcgtacaccaatgccgccttgctgctgagcaaacctttctggttgtccaactcagccacattgagttgcaggtctttttgcgcgaggaccacgccgctgcggttgtcgacattagcgctgtgcaaggtcagcaggtcctggccgatcagccgcccttcgcggttgtccagctggccggtgtgcagttccatagcacccttggccaacacccggcccttggcctggttgtccagtaacccgtcaacggttgcgctcaattgaccgttgctgaccagttgcccgccctggcggttatccaggctggcggtgtgcacgtccaacaacgtgccggcacccactgtgccgccctggttgttcaccgcgcccttgaccttgaggcccaggctcacatcaccaagcacttgccccttggtgttgctcaagctggctgcatccagctgggtgtgccctgcgctgacgatctcgccctggtcgttcagcagatcttgctggacggccacgcgcgtgtccaaggtgctgctgacgctgccttcgcggttatccaggcgcgaggcttcaagcccaatcccagcggctgaaatcaagcctttgacgttgagcaaggcgtgttcgactttaagggtcaacgcctggtcgctgagcaggttgccgccgctgttatccacggtgtcggccgtgagggtgaaggcttgtgtgctggagatctcaccgttgcggttgtcgacgtctttgaggttcttgagcagcaacatccccggtgcattgataaagccatcggcgttgttcaacagcccatgctgcatgtccagagtcagttcactgttgctgtaaagctcgccgccaccgcgttggtcgaggctggtcacactggcgtcgagcgcctggccactggcgatacggccttcgaaacggttgtcgacgctgctcgctttgaggttgaggcgatcggcgctggtgacacggccttcatgctggttgagcagcacacccgttgtcagttgcaatgcgccgtcagcgatgatgtgcccttggctgttgtcgacactggcgccgttcacggtcgcggtgccggcactgagcacttcaccgttctggttagtgatcgcaccctgggtgcccagcaccagcgccccgccgctgctgatacgcccaccgctgttgcccaggcttgcactgcgcagttgcaacccagcatcgctgcggagcacgccttgggtgttgtcggcgtgctcggccaggctcacgtcaaggttgcgcttggcgtagaggttaccttgagcactgttgtccaggttgccggccttgaggctgacgtcctgttgccctgaaatcaggcctttaagctggttgttcagcctgtcgagcgtcagttggagtgtgccgttagccagcacacgcccgccgttactgttgtccaggtcatgccctgccaacgtcaactcggtcacgctggaaacttcaccgccacggttgttgaccttgccaacggtcacgttcatggccttgcccgaattgagcaacccgccctggcggttatccaacgcgtcgccctggacctgcagttggccaaccgaggtaatgctgccctcgcggttatccagtttgcccacgcgcagttgcgcatcacctttgctggtgatgcggcctttggcctggttatccaggctggcggcattgagctgcacaccgtcgccggccgcgaacagcccggcttggttgagcacgttggccgagacctgcacagtcaaggcgccttcgctggtgagcttgccggcgctgttgtcgaggctggcggcattcaccgtcaacacctgcccggcagccaaggtaccttgggtgttggtgatgaccccctgactggtcaaggtcaactggttgtcgccttggagacgaccctgagtgttatccagtgctgccactttgaccgtcgagcgctggccaagcagttcaccatggcggttacccagcatgccctcgacgctgaggttcaagtcagtggcagcgctcaatttgccgccctggttgtccaggctggcgctgttgacttgcacggcggcgccggcaatcaggccacgggtgttgtccagcgcctgggcgatacgcaagaccagggcttgctcgctgagcagcttgccgcccgtggtgttcagggccgttgccgccagctcaaaggcgtgcgcactggagatttcgccaccctggttatccactataccgagttgcttgagcagcaactgcccaggcgcgctgatcaagccaccctggttattgaggtgaccgccttgcaggttcaggctcacatcggcctggctggagatatgccctgcgcggctgttatccagcgccgtcagcgtcatccccaactgcgtgccgctgcttacgcgcccgccctggttgctcaacgtggcggtagtgatctgcagcgcatcggtgctggacagcgtggcgtcatcgttggccacagcagaggcatcaatagccagacgcccatcactgaggatcgagccttgcgtgttattcaactgaccgctaagcactaaacccagctggcgtttggcagacaggctgccccccgcgctgttatccactgcctgacccgcgatgtgcagttgctgggcggcaatccggcctttgagtgagttgtccatgttgacgacattcaattgcagctcagtaccggcgctgaagagccctgcttggttgagcatgttcccggcgatgcgcgcggtcagtaacgcgtcgctgctcaagttgccgcgacgattatccaggctggcgctgtcgagggtcacgctttgcccggcggccaacgtaccggcctgattgctgattgcgccccgcgtgtgaagcgcaagcgtcgatccagcctgcacttggccctgatcgttattcagcacgccaagccctaatacgaggtgtttgccgagcaacttgcccgcgcggttatccagttcggcatcgacgtgcaggttgaggtcgtctaccgcagcgaagcggccggattgattgttcagggtgccggcctgaacctccaaagtcttggccgttaccaggcctttggtgttgtccagagcacgggcgatgcgcacactcaacgcttgctcgctgagcaacttgccgtcgccgttgttaagttgatcggcgttcaggtcgaacgcctgcacgctggaaatttcaccgttttggttatcgacactgctcaattgcgtcagcagcaactgccccggcgagttgatcaagccgccctggttgttcaggtgaccatgattgagattcaggctcaggtcgccttggctgaagagttgaccaccgctgctgttgtccaggctccccacggtcaactgtgcgccagcgtcggcgcgcaaacgtgcagcttggttgacgagcgcgccgctcactcgggcgttcagtcgatcacggctatgcacaaggccgccctggtcgttgatcaaactggcaacgtcaatatccaggccgttggcggtaatcacgccggcgccgttgttcagggtttgcgcgatgcgcaggcccagcgcctggtcactgagcaattttccgctgcggttatccatgctgtttgcggccagttgaaaaccatgcacactggaaatctcaccgctgcggttatcaacgctattgaagttgttgaacgtcagctggccgcccgcgttgatcaagccgctggcgcggttgtcgaggtggccgttgctcaggtccagtttgacgtcgttgttgctgtaaatccgaccatgatcatgctggtcgaggctggtgacgcgggcattgagggcgttggcactgctaatcgagccgccttggctgttattgactggccctgcaaccagatcaagcgcgccaccactgatgagtgcacccctattttggttattgaaggtgccggcattgacctgtgcgccagtgccggattcgatgaggccctgctgctggttgtccagcgtaccggcaatgttcaaccccaggctgccctggctgctgacgatggctgactggctgttgttcagttgcccggagtcgatctgcaggtgctgcccagcggccaggcgaccggcctggttattcagggtcgcgtcggcgctcaagcgcagcgcttggcccgaggagatcaggccagcgacgttatccagatcatcgacgtgcaaggtgacgtcggactgactggagagctcgcctttgcggttgatcaattgcccgacgttagcgcgcagcccgcggtcgccggcgaccagcccggcctctgagttgagcagccgaccggcattcagctcaatgcttgcagcactcagcacgcggccttgttgctggttatccaacgttgcggcgctgaccttgagctggtttttcgcactcagggtgccgccctggttgctcagcgttccatcgacattcagtgaaaggtcgcgactggcaatgagagtcttgccgttgttgttcaactgcccggcgctgatttggatgtcgccctgcgcgttgcgtgtttggtcggcgttaacgccagcttcgatgatgccgttgttggtcaacgccccgccgctttgcaactgcacgcgatcacgcgccaccaggcctttttggttgatcagtgcgccttgggtctgcacattcaaggcactgcccgccaagaccggtccctgtgcctccacgcttgcggcttttacgtttacggcgccgacggccgaggtctggcccatgactacgttgccagcggcatcaatctgaatatcgccgccagccaccatgtcacccgacagccgcacgccgacaccggcctcggtgcccaccagcttcaccgcgcccacatacatgccgcccagcgccgaggagtcaatcgccaaatccggcgcctggctgccgtctgctgcgcgtgccgtggcattcaacgtgcggccgtcgacgtcgttgcgaccggcgacgatggtgagttttttcgcctggatctgcgcgttgatcgtggtggcgcgggtgatgatttcgaactggtcgacgttgcgcgcgttcaagccggcgccttcaatggcgacgctgcctttatcgacttgataacggctgatctggccgttttcgatcaccgctttaccggtggtgagcgtggcttg

SEQ ID NO: 45 - DNA, 105480 bp, Pseudomonas poae FL10F
atgggttccgcccttacggcgggtcacttttggaaaagagcccggaatgccggcccagccaaaagtaaccaaaagggctcttgccccaccactcggcacctcgctcacgcttcggtgtgccctcactccggctttggagcgggggccgccgcgatgggccatccttggcccagcgcggctaaaccggcgtcctgccggtttacccccgctccaaagcctgcgttcggccagcgtggtttaacggggcgcctaagagcaagatcaacatcaaaagcaagagcacggcggcctggtagccgacctgagtggttggatcaaaagcaaggccgaggcggcctgacagccgacctgatcctggaggctgcactcaatcaaatgtgggagctggcttgcctgcgatgcaggcacctcggtgtgtcaggtgcaccgggttgatgccatcgcaggcaagccagctcccacagtttgtttacctcagttccacaggccgattttttccagttcctgcttgaagttgtcgcgggtgatcaatgtcacttcatccatggcggtgtacttcggcggttccttgccggtggtgacccagtcgaacatcatcttcgcggtgttgtagccttcgatgtgcgggctgggcagcattgagccgaagaagccgctgttgggctttttcagttcgccgatggcgtcggtgccattgatgccgatgccgatgacgttggccgcggcaaagccggccgtttcggtggcgcgtacgccgccgagcacggtgttgtcgttcatgccgccgatgatcaggttcttggcgccgccgggcagcttgaccagtgccgagttggtggcgtccatgctgcctggaacatcgagggtcttggcggcggtgaacaggatgtggtccttgggaaagcctgcgtcttcgagggatttgaccgagccgtcggtgcgttttttaccggtgtcgagctcgttgaaggtgttgatcaccgcataggtgtccttccagtcccagccgcgttttttcgcttcagccgccatcgcggcgccctgcttctggccgacttcgaacgccgccatgcccaggtacggcacgtcctccataaagttgcccttggcatcgacgaagcgatcatccaccgcgatcactttcaggccgttggcgcgggccttggcgacaatcgccgggcccagcgacacgtccggtgggcagatcacaaagcccttggcgccgttggcggccaggctgtcaatggccgacaaggttttctcgccatcgggcacggcgattttgatcacggtgaagccatgttccttgccggctttttcggcaaacgcccattcggtctggaaccacggctcttccgcctgcttgaccaaaaagccgatcttcacttcctcggcggccagcaacaggccgctcaagctcagcgccgacaccgccacagcggcgcagcagagggaacgcaaaccacgacgacgattcatacgggtgactccttgttgttgtttttcgggtcttgggttatccggcaaagcgatgacagggtgtgccgggcacctccacctcgatggccagcaacgcgccgtccaacgggtgatcgagtgggctggtggcactggtgatgtagagggtggtgaggttcgggccaccgaacacgcaactggtggggcggctgacgggcagttcgatgatgcgctcgacttcgccgtccggcgtcaggcgcagcaggcaactgccgtcccagcgcgcgttccagatatagccttggctgtccagcgccgagccgtccgggccaccgcgtgaatgcgggccgaaccacacctgcgctgggtcaagctggccgtctgcctggatcgcgtgccggtagagcgtggcgtcgaggctgtcgccgaaatgcacctgggtgccctccgcgttccacagcaacgtattgggaatgcccaggccatgcagcagcggcgtgacctgcgcatcggcgtcaatacgaaacagcccaccggagcgccgcgtgatgggcaggtcttcgccctgctcgccgatgttgttctgcatggtgcccagccacaggcggccctgggcatcgcagcgcgcttcattgccacggttgccgggttgcgggtcggccacacacagcagggtcagggcttcggtttccaggttcagccggtagacgccgctgctcaaggtcaccagcgcatcaccgctctcacacggaataaacgccgagacatgctcgggcaactgccagatctgcaattgcccctgcataaaccgcaacgcctgtttgccggcaatattgacccagtacagcgcctgggtcggcgcgtcccaaaacggtgcttcgcccaactgcgcacggtgtgcggtgacagcggtacacgacataaaacctcctgttttttacagcgcctcgcgcgacggagtgccatccaccagccgctggatacgcaacgggttggcgtttttcaacgcgtcgggcagcaggctatcagggtaattctgcaagcacacggggcgcaggaagcggtcgatggccaggctgccgaccgaggtgccgcgcgcgtccgaagtggccgggtatgggccgccgtggaccatggcgtcgcagacttcaacgccagtcgggtaaccgttcagcaggatgcggccaaccttctgctccagcagcggcgtcagttcagcaaactgctcaaggtcggcgggctcgccaatgatcgttgccgtcagttgcccgtgcaggccgtgcaaggcggcgctgagttgggcttgatcggccacttcgacgaataccgtggtcgggccgaacacttcttcctgcagcaccgcatcgccgtcgatcagcaaacccacgtcggccttgaacagctgcggctgtgcctggttgcccgcttgggcattgcccgccaagtgctggatgccggggtgcgcgagcagcttttccaggcctttgccataactgctcaaggtgccggcgttaagcatggtttgcgctgcttgagcgccgatcagttgggccacctgctgagtgaacgcggtgaattgcgcagaggcaatgccaatcaccaaaccagggttggtacagaactggccacagccctgcaccaccgaggcggtcaggtcgcgggcgatggtttcggcccgtgcctgcaaggcctggggcaatacgatgaccgggttgatgctcgacatctcggcaaacaccgggatcggctgcgggcgcgccgccgccatgtcgcacaatgcgcgaccacccttgagcgagccggtaaagcccacggcctggatcgccgggtgcttgaccagcgcctcaccgacgccgccgccgaagatcatattgaacacgccggccggcatctcagtggcctcggccgcgcgaataatggcatcggcaacccgctcggcggtcgccatatgcccgctgtgggccttgaacaccaccgggcaacccgccgccagcgctgctgcggtgtcgccgccggccgtggaaaacgccaggggaaagttgcttgcgccaaacaccgccaccgggcccaggccgatgcggtattggcgcaggtccgggcgcggcagtggctggcggtcgggcaacgccctgtcgatgcgtgcgccgtaaaaatcaccgcgacgcaacaccgtggcgaacaggcgcatctggccgctggtgcgcccgcgttcgccgttgatgcgcgcggcaggcagcgcggtttcgcggcagaccagcgcgataaaatcttcacccagcgcgtccagttcatcggccactgcgtccaggaactgcgcgcggcgcgacgcactcagcgcgcggtatgccgggtaagcggctgcggcggctttggcggcggcgtcgacctcgtccggggtggcctggtagaaggtttgcgccaaggcttcgccggtgctggcgtcgatgctttgcagggtcacgctacccttggcgctgcgttggccgccgatgtagttgtggccgagaaacggggtcatgttgatctccttaaaggctgatgacagtgccgggttcgaacgccgattcggcgctgccgaccgtgttgatcagcggcgcgccgaactcggcctggctgatctcgaacacatcgcccggttgcgtgcgtataccgtcggcaaatgacagcgtggcggtgccgaaaaaatgcacatgtacatcgccgggcttgaggaactggctgtatttgaaatggtggtactcgaggttttccaggctgtggcacatattggcctcgccgctgaggaattcgttccgccagatttcctcaccgttacgcaggatgcggctggtgcccgccaggtgctggggcaattcgccgacgcgcaactccgggccataactgcagctgcgcagtttggagtgggccaggtacaggtaattcttgcgctccatcacatggtcggaaaactcgttgcccacggcgaaacccaggcgatagggtttgccgtcgtggccgattacgtacaagccgccgatctccggctcctcgcccgcgtcctcggcaaacggcggcaccgggaatgcctggcctgggcgcacgacgatgctgccgtcgcccttgtagaaccattccggttgcacaccggcctggccggaagctggcttgccgccctccacaccccatttgaagatgcgcatggtgtcggtcaaagcgctgtcatcagcggcgtgctggtgcatcttgtcacgcgccgaggcactgcccaggtgagtcaggccggtgccgctgatgagcatgtgggccgggtccgggtggtcgaggggcggcaggactttcaggtcggcgagcaaggccgcgtaatcgtagctgtcgcccaggcccaagcggtcgacctgttgctgcaacttcacgcccgcctcgatggccaccagcgccaactcgcgcacgctgcgggccgtgcgcacttctctgagtttgctgccttccaccacgccgacgcggcgctcaccgttacgcaattcgaactgaactaaacgcatcaattttctccaggattaagtccgcgtggcgccacgcgcactggcggcgaattgatcggcgggcagcacgtgcttgcgttccagcacacggtagaccacgccagtcagcaacaggccaaacagcatcaccgcggccaggaagtacaaacccgaggccaggttgccggtgtattccttgagcgcgccgatcacgaacgggccgatatagccgccgaggttgcccaccgagttgatcaacgcaatgcccgccgccgcactggcgccggcaaaaaagcgccccggcaaggtccagaacaccgccgtgcaggaaaacagcgcgaacgccgccaggcacagcgcggccatctgcagcaccggcacactcagccaggcgctgaaaaacaggccgatggcgcccagcacatagagcacggcgaggtggccgtagcgatcattcaagcggtcggaactgcgcgggataatcagcaacccgacgatgccgaagatgtacggcaccgccgagacaaaaccagtaaccaggtcactgccgccgaactgcttgatcagcgtcggcaaccacaggcccaggccataaatgctcaaggtgaccggcaggtagaacagcgccagcagcaacacgcgtttgtctttgagcgcgtgcagcgggttgccgtggcgggtctggccgtaggcttgcaagtctttgttcagttcgccggtgagccagtttttttcgtccgcgctcatccacttgacctgctgggggccgtccggcaggaagcgcagcactggccaggtcaagagcaaggccggggtgccgatcacgataaacagccactgccagccgtgcaggccaaggatgccgtccatgcccagcaagccgccggacacggggccggtgatcatcattgcaatcggttgggacaggatgaacagcccgaggatcttgccgcgatggcgcaccgggaaccactgggtgatgtagtacagcacgcccggaaagaatcccgcctccgccgcgccgagcagaaagcgcatcacgtaaaagctgtgcggtccctgcacaaaggccatgccaatggtgatggcgccccaggtcagcatgatgcgcgcgaaccagcgccgcgcgccgaagcggtcgagcatcaggttgctgggaatctcgaacaggaaatagccaatgaagaacagcccggcgcccaacccgtaggcggcatcgccgatgccgacatcggcgcccatgtgcaacttggcgaaccccaccgccgaacggtctacgtaggcgatcaggtacagcaggatcaggaagggaatcagtttcagcgtgatgcgccgtataagccgcagttcctggctcatgggggtcgatctccgattgttgtttttatagaagctcgggggccgccgccggtgaaaatccgccagggtcatgcctcattcaggccgactatatagtatgactatttgcaaaacaactcttccaaaccctcgattttgcgcttatgtttaagcgcatatagaacatatagtcatacaataagagagtcgatcatgcctgataaaaagcccgccctccgctctgcccagtggtttggcaccgccgacaagaacggtttcatgtaccgcagctggatgaagaaccagggcatcgccgaccatcagtttcatggcaagccgatcatcggtatctgcaacacctggtcggagctgacgccgtgcaacgcgcatttccggcagatcgccgagcacgtcaaacgcggggtgatcgaggccggtggcttcccggtggaattcccggtgttctccaacggcgaatccaacctgcgccccaccgccatgctcacccgcaacctggcgagcatggacgtggaagaggcgattcgcggcaaccccatcgacggcgtggtgctgctgaccggttgcgacaaaaccaccccggcgctgctgatgggcgcggccagttgcgacgtgccggccatcgtcgtcaccggtgggccgatgctcaacggcaagcacaaaggccaggacatcggctcgggcacggtggtgtggcagctcagcgaacaggtcaaggccggcaccatcaccctggatgacttcctcgcagccgaaggcggcatgtcacgttcggcgggcacctgcaacaccatgggcaccgcctcgaccatggcctgcatggccgaggcactgggtacttccctgccccacaacgcggcgattccggcggtggatgcgcggcgttatgtgctggcgcacatgtccggcatgcgtgcggtagagatggtgcgcgaagacttgaagctgtcgaagatcctcaccaaagaggcgtttgaaaacgcgattcgcgtgaacgccgccatcggcggctcgaccaacgcggtgattcacttgaaagccatcgccgggcgcatcggcgtcgaacttgacctggatgactggacgcgcatggggcgcggcatgccaaccattgtcgatttgcagccgtccgggcgcttcctgatggaagagttctactacgccggtggcctgcctgccgtgctgcgccgcctcggcgaggccaacctgatcccgcacccgaacgccttgaccgtcaacggcaagtctttgggcgaaaacacaaaggactcgccgatctatggccaggacgaagtgatccgcaccctcgacaacccgatccgcgccgacggcggcatctgcgtgctgcgcggcaacctcgcgccgctgggcgcggtgctcaagccttcggccgccagcgcggagttgatgcagcatcgtggccgcgcggtggtgttcgaggacttcgacatgtacaaggcgcggatcaacgacccggaactggacgtggatgccaactcgatcctggtaatgaaaaactgcgggcccaagggttacccgggcatggccgaggtcggcaacatgggcttgccggccaagctgctggcccagggcgtgaccgatatggtgcgcatttccgacgcacgcatgagcggcacggcctacggcacggtggtcttgcatgtggcgccggaagccgccgccggcgggccattggcgacggttaaggaaggcgactggatcgaactcgactgtgccaacggccgcctgcacctggacatccccgatgccgagctggcggcgcgcatggccgacctggcgcccccgcaaaagctgatcgtcggtggctaccgccagctgtacattgaccatgtactgcaagccgaccaaggctgtgactttgactttctggtgggttgccgtggggctgaagtcccccgtcattcccactaattgggatgctatgatgccgcctatttagccagagcctcccgttcgttatggatcaccagccgcccaagccgcgcaagagcatgcatgcccagatcgttcaggacttgggcatgcacatcgtttccgggcgcttcaagcccgaagaacgcctgcccatggaagccacgctgtgcgaggagtacaaggtcagccgctcggtgttgcgcgaggcgacgcgggtgctcagcgccaagggcctggtgtattccaaaccgcgggtgggcgccgtggtgcgcccgcgcttgaaatggcacttgctcgacccggacgtgttgtcctggctgatgcagaccacgcctcacagtgagtttttcaacaccctggccggcgtgcggcgcatcctcgaaccggaaatcgccgccatggccgcgaccaccgccaccgacgaagacatcgccaccatcgaaaaagcctacctgggcatggaaaccgccaccacccacgacgcgctgttgcaggccgacctggacttccaccgcgcgattgccgacgccacccgcaacgacctgctcgcctacatgtgcaacatgctgtcgttgccactgcgcgagtcgatcaacatcaccaaccgccgccccgacatccagggcctgagcctgccgcgccacaaggcgatcctcaccgccatccagaaccgcgacgccctcggcgcccgccacgcctcgctggtgcagctggatgacacgcgggtggcgctggacacggtgatgaatgtgctgacgccgctgtagatccatcgtctacgctcaggaggtcagttcgaggaaccgaccatgtgcggacgactctcgcagtaccgtggtattcatgactttgtggcggccttgagcatgcccaatgcgctgctcaacaacgtgggtgagccgccgcttgagcgctacaacgttgcgccctccacgcctgttgccctgctgcacctggaaaatggcctgctgcatgccgaccgtgtgcgctggggctggcgcccgcactgggccaaggaccgcgcgccgccgatcaacgcgcgggtcgagaaagtcgccaacggcccgttctttcgcgcgatctggccgcaccgtgcgattgcgccaatcgataattggtttgaatgggtggacgaaggcggcgcgaaaaaacagccctacctgattcgccgccgcgacggcgcgccggtgctgtgtgcagccatcggccaactgcccgatgccgatgaaggtacgagccttgacgatgggtttgtgattattaccgccgacagtgctggcggcatggtcgacatccatgatcgccggccggtggtgctgaaccccgaattggcccgcgaatggctggacccggcgacaaaccggggccgtgccgaacaaatggtgctgttccagggcgagccgcccgaggtgtttgaatggttcagggtcgacagcgcggtgggcaacccacgccacgacggccgccacgtgatcgagcccgtcgcctactgagcaacctccaccagcgaaatcagccgcggctcaatgccagcctcaacgatctcaagcaccgcgagcgtcaccggcagcttgaaccgtcgcctgccggcgctgccggggttgacgaacaaggttgcgccgcgccactcgatcaagggcttgtgcgagtggccggtgatcaccagccgtgtgtgcggttcgagtaaggctggcacgtcggcaatgtcatgcacgagcagggttggccagccattcaaatcaatcttcagatgttccggcacctgctgcgcccacgcggcgtcctggtcattgttgccgcgcaccgcgtgcacgggggcaatctgtgcaagctgctcaagaatctccggcccgccgatatcgcctgcgtggatgatctgctcacagccttgcagcgcctcgacggcttcaggtcgcagcaggccgtgggtgtcggaaatgacgcctactttcataggttctccttaataatgtagacattgaccgcgcatgccttaaacgattcaggtcgctggcgaacctttccccccaaaccagcgtccgagctaaggcattgttgctcaccgctcgccgcgaggtcctcgtttgaaagccgccatcatcaaaaaataccgtctgatcatcaagaccatgggctatgtgggctgggcgttgttctggctgttgctgtgggatgtggccgtgacggtggacttcatgctgtttctgaccaccaagatcaatctgccgctgatgcccttgacgctgttgggttcggcgctggtggtgctgatcagttttcgcaacagcagtgcttataaccgctggtgggaagcccgcacattgtggggcgcgatggtgaataactcgcgcagctttgcccgccaggtgctgaccttgctggacgacccggacgccgacgtgaacccggtcaaggccaccttgctgcgccgtcatgtggcctatgtgaattgcctggcggcgcacctcaagggccaaccatgcccggatgaagtacgcgcgtttatcccggctgaggaattcgcacgcaatggcgccaccaacaactttgccaatgacatcctcaccggttccgcagcgttattggcccgtgaatacaaggccggtcacctcgacagcatccgcctggcgcggctggagtcgaccctggtggacttgtccaacgcccagggcggcatggagcgcatcgccaatacgccgctgccctacccttacgtgtatttcccgcgcctgtttatctcgctgttctgcctgatcgtgccggtcgggctggtggaatctctgggctggttcacgccgctggcgtcgacggtggtgggctttatgctgctggccatcgaacgtatcggcaccgacctgcaaagcccgtttcattccagcgaacaccagatccagatggaagccatctgcgaaaccatcgagaaaaacctgcagtcgatgcagcgtgatgcgctgggtggggagcgtattggttgagcggtcgcggtttccggcatttttagcctcgcatcaagaaactataagttacggctccaatggaactccatcaaacgtaagggccactacgcacgcatagcatcaagtaatattttctatcattactggactattaagcgggcacttaccctaggagttttgcgttgaacatatccccttcaccctggacacccacaacctacccattacctggcagtaacccggcgccattggagacccctcagatcgacacgccagttttaaatcgaaaaaaacgtggcgtggcagataaagatgctctttggccgcagcactctacgattagagtgtctttattaggcatgacggaagagcaaaaaaactttacaaaaaaacaaatttgcaaatgggcgccgcacatcaatttgtgcattcaatttacagatcgcccagacggccatattagaattaaagccgacaacaacataataggtggctactcggatatcggtaaagattcggcgagcgacgaagaggcctcaatggtagtaggtttccgagacgggttgaacgcgttcgccggcggtactataacgcatgagttcggacacgccttagggttgaagcatgagcaccaacaccccgatacaaaccttgactttaatgcggagttaatacacgagcgtgcagtaaaaagcatcccggatgtaaccctggaagaagtgaaagtcaacgtcataggaaaactgcctcgcgatacagtggtaacgtcaccctacgaccgaaattcaattatgcattacaagttcagcaaagaagagctcaacggcggagagcccgtaccggaaataaatgaactttcaaaagatgatataaaattcattagctcactttatcctaaagtttactgcccaccccgccgccgttcaggttttggttttttccccccgccaaccgcttgaagcagtcatgcaaggtgtttttatgtgctgtgctcgcaagccagcactcaatcaagggaggtgccgccacccttaaccttgcataaccgcggtcaacctacgcttgatcgcggctgcacaacccgggcgcacgcaattgggtcgaagccatggcgtgtggtttgcactaccgccgggtggaagtctgagaacctatcatttttaccagtgcacctgacgtaccgttttcgctagcctgtagcgcatccaatcccaaggagttacagaacatgcaggtacgcgaaggttatgccgatttccgtggctatcggacgtggttccgggtcaccggtgacctgaattccgggcgcctgcccttgatcgtcgcccacggcggcccgggctgcacccatgattacgtcgacagcttcaaagacctggccgccaccggccgcgcagtggtgcactacgaccaggtcggcaatggccgctccactcatttgcccggcgcctccactgatttctggacggtggagctgttcctggaggagctggacaaccttgtggcccacctgaagatcagcgactacgcgctgctcggccagtcctggggcggcatgctcggcgccgaacacgcggtacgccagcctaccggtttgaaggccttgatcattgccaactcgccggcgtcgatggatctgtggtgcacggcggcgaatgaactgcgccaggcactgcccgccgacgtgcaggcgacgttgctgcgccacgaagccgcaggcaccaccgacagtgccgactaccacgccgccgcagaggtgttttacgcacgccatgtgtgccgtattcaaccggtgcccgccgaagtcgagcgcaccaatgtcgccatcgaggaagaccccaccgtctaccacgcgatgaacggccccaccgaattccacgtgatcggcagcatgcgcaactggaccatcattgatcgactgtcgcgcatccaggtgccgacattgctgatttccgggcgcttcgacgaggctacaccggccactgtgcagccgtttgccgatggcatcagcgacgtgcgctggcagattttcgagcagtccagccatatgccgcatgttgaggagcgcgaggcgtgcatggcgtgtgtgggtgggtttctcgcctcagtggagtgaagatctaacctgtgtaatgtggcgagcagcctttctgtggcgagcaggcttgccctgcgttgggctgcgcagcagccccaaaaccaaacactgcgctattacaggcagaccgcggtgtttctattggggccgcttcgcggcccaacgcagggcaagcctgctcgccacagttgcgtcggtaaatgcagggtgaaacctcaagggcacgcgtcaggcgattccaaaccgccgtgcagaaaaccctgcaggcccacgcgtcatttgaccacgccccatcttcaccgcacttgtaatagtctattgcaggactctaatgtactaactggttacttatcttgctaacattcgacctttagtcactcacattcgagtcctgtcgacatgaaacgagcatcccgcgccgctggcgcctcacgatatctcttgctgggactgggcattgtcattgccctgctcggcgtggccctggccgttggcggcgccaaactggccagcctgggcggttcctggtacttcctggtcggtggcgtggccatggccgtttccggcctgctgattgcccggtgcaaaccggcgggcgcgtggtggttcgcggcctttctggtcggcacggcggtgtgggcggtggcagacgtcgggctggtgtactggccgctgttctcgcggctgttcatgtttgcggtgatcggcgtggtggtggcgctggtgtacccgctgctggccggcaagccggcacgtggcgcgtatggcattgctgcggtattggcggtaggcgtggcggtcgcggcaggcaatatgttcgtggcgcacccgagcgtggcgccgaccggcaaaggccctggcatcacgccggtggcggcggccgatgcgcaaaaagactgggcgcattacggcaataccgaaggcggcagccgctttgcagcgctggaccagatcaaccgcgacaccgtcaacaagctcaaagtggcgtggacctaccacaccggtgacgtggccatcagcgacggcaacggcgccgaagaccaactgacgcccctgcagatcggcaacaaagtgttcatctgcacgccgcacaacaacctgatcgccctggataccgacaccggcaaagagctgtggaagaacgaagtcaacgccaagtcggcggtatggcagcgttgccgcggcatggcgtatttcgatgccaccgcgcccatcgcccagccgacccagccaaacagctcgccaatcgtggccgccaacgtgccggccggtgcgcaatgccagcgccgtctgctgaccaacaccattgatgcgcgcctgatcgcagtggacgccgacaccggcaaattctgcgaagacttcggcacccacggccaggtggatttgaaagccggcctgggcaatgtgccggacagctactaccaactgtcttccgcaccgttgatggccggcaccaccgttgtcgtcggtggccgcgtcgccgacaacgtacaaaccgacatgcctggcggcgtgatccgtggtttcgacgtgatcaccggccagatgcgctgggccttcgacccgggcaaccccgaagacaaacacgcccctgcggccggcagcacctacgtgcgcagcacgccgaacagctgggcgccgatgtcttacgacccgctgatgaataccgtcttcctgccgatgggcagctcgtccaccgacatctacggtgttgaacgcacccagctgaatcacaaatacggcgcctcggtgctggccctggacgcctccaccggcgcagagaagtgggtgtaccagaccgtccacaatgacctctgggacttcgacctgccaatgcagccgagcctgatcgacttcaccccaccgggcagcgacaaggcggtgccagccgtggtgatcggcaccaaggccgggcagatttatgtgctcgaccgcgccaccggcaagccactgaccgacgtcaaggaagtgccggtcaaggccgcgaacatcccgaacgagccttactcgctgacccagccgaaatcggtgggcatgccgcagatcggcgcgcaaaccctgagcgaatcggacatgtggggcgccacgccgtacgaccagttgctgtgccgcatcgacttcaagggcatgcgctacgaaggcctgtacaccgcgccgggcacggataaatcgctgagtttcccaggctccctgggcggcatgaactggggcagcatttccactgacccggtgcacgattttatcttcgtcaacgacatgcgcctgggcctgtggatccagatggtgccgtcgcagaacaaggcccaggcctcgtccggcggtgaagcgctgaacaccggcatgggcgccgtgccgctcaagggcacgccgtatgcggtgaacaaaaaccgcttcctgtcggtggccggcatcccgtgccaggcgccgccttttggcaccctgaccgccatcgacatgaagacccggcagatcgcctggcaagtgccggtcggcaccgtggaagacaccggccccctgggcatccgcatgcacctgccgatcaaggttggcctgccgaccctcggcggcacgctgtccacccagggcggcctgatctttatcgccggcacccaggatttctacctgcgcgccttcaacagcggcaacggtgatgaaatctggaaagcccgcctgccagtaggcagccaaggcggcccgatgacttacgtttcgccgaaaaccggcaagcaatacatcgtcatcaccgccggcggcgcacgccagtccactgaccgtggcgactacgtgatcgcctacgccctgccataaccccgtgttcgcgcggtgcctcccccggcaccgcgctttttgtctggaaaactacgcatgacccccacttctcatctgcccctcggccgcctggtgctgggcctggcgtttgctgccgccctgcccgttcaagccgacgacaccaccttgaccggcgactggggcggcttgcgccgtgaactcgacgagcaaggcatccgcttcaccggcgactacagcggcgagaccgcctacaacgccgacggcggccaacatcgctcggcgcgctactcgcagaacatcaagctgggcgtgcagttcgacctgggcaagctctacggcttgaacaatggcgaccgcatccagctgaccatcaacgaccggcgcggcaacagcgcctctgaagacctggtgggcaaccgcctgccgatccaggaaaactacggcggcctctacacgcgcctcaccgaattgagctacgaacgcacgctgtttaccccggcgctgaacgtcaagctcggttacatggccatgggcaatgacctcggcggcctcgacagcggcatcctgtgcaacttcatgaacgccggtttctgcggccacccgctgaacatgtccggtggcagcggctggaccaactacccgaacgcgcgcctcggcgcacgggtgaaatacgacttttcgccgcaatggcaactgcgcgtggcggcgttcaatgtcgacccgtcgagcaacggcaattccagtcgcgcctggcacttggggcccaagcacacctccggcaccgtggtgccgattgagctggtctacaaacacgcgggcacgctgccgggcgaatacaagctggggtattactacgacagctccgacgtgaaacgcatcggcagcaacaaagaggtcagcggtcgcggcggccactacctgctgatcgatcaggcggtgtgggcctccgacgcatctgccgggcgcgtgctgcatgccttcggccaatactcggccgccagtgaagccgcttcgccgttcagcaagtggtatggcgcgggcgtggtgctgtacaagccgtttgaaggccgcccgcgcgacaccgtcgccctgggttatggccgcgcagtgccgaacccgcgcagccgggatgtgcaggagttggcggcgtttaaggccgggacggattatccgaacttgaacaatgccgagcagctgatcgagctcagttacggctaccaggccacgccgtggctgacgctgcgtccggatgtgcaatacatcatcgagccaggggcgttttcgggggtggatatcgacaatgcgttggtgctgggtttgcaggtcaaggcgctgttctaaggccattacgcggtaaaaaatgtgggagctggcgtgcctgcgatggcggtgtgtcagtcagaagatctgttactgatacaccgccatcgcaggcaagccagctcccacagttgatcggtggcgttagtggcatttggtcatggtttgtaaagggccagcaaggcgtgtcgcttttaattgcaggacgtttcctagacaatccctgccgccttgtgcctgttggaatcgatggctagtctgcgatccgtcactgctcatcagtgatcgggtttagtcgcccgaccctcatcacgtgcacggtcttccatcagttttatggtggctgtgcgcagggcaccttcgggtgcgccggattttccgtgatggccggtcgactaacctgcgtacagccgccacccattcgtttagtcgcgacgggtgtcgactcctaagtcattacggagttacaccatgaataaagtcgtccccgacccacccctcagttcagccaaagcccgcgccgccttcaaccgcgccatcgaccattacctgcccacccaaggtgtgccaatcgaagacttgagcttcgaagatgccctgctctacaccgccagtttgctcgacagcgcttctgccacgacactcaactgcagtgagcaactgccaagccccgagcgggcgaagattctggcggtgtggcatttgctggaaatggccaggacgacggtggatcgctctatcgagtgcctgaaccccgcccgttaaaaacagtgggagcactacggggctggcagttgaactcggtcaaattgtgggagcgggcttgctcgcgaaggcggtgggtcagtgacacatgagctggctggcacaccgccttcgcgagcaagcccgctcccacagttgatctacagcgttcttgagttacttggacaccggcatcgcaaactccgcgccttgttcgatgctctccgaccagcgttgcatgatcgacttctgcttggtgtagaagcgcacgccctcggtgccgtacgcatgcatgtcgccaaacaggctcttcttccagccaccaaagccgtgccaggccatcggcaccgggatcggcacgttgatgccgaccatgcccacctcgatgcgccgcgcaaactcgcgggcgatgttgccgtcgcgggtaaagcagctcacgccgttgccaaattcgtggtcgttgaccagcttgatcgcttcggcaaagtcgttcacacgcacgcaggccagcaccgggccgaagatttcttcgcggtagatgctcatgtcctgggtcacgtggtcgaacaaggtggcgccgagccagaagccattttccaggccgggttcggtgggcacatagtcacggccgtcaagcagcaactgcgcaccggcttgcacgccttgttcgatgtagccactgatgcgctccagcgctgcccgcgacacaatcgggcccatttcggcctttaaatcgcggccgtcggtgatgcgcaatgtcttcgcgcgctcggtcaaggcagcgatgactttgtcacccacatcgcccaccagcaccgccaccgaaatggccatgcagcgttcgccggcactgccgtaagcagcgcccatcagtgcgtcgacggttttttcgatgtcggcgtcgggcatcaccaccatgtggtttttcgcgccgcccaagccttgtacgcgcttgccattacgcgcaccggtttcgtagatgtattgcgcaatcggcgtggagccgacgaagctcacggccttgacgtccgggtgttcgagcagcgcatccactgcttccttgtcgccctgcaccacgttgaacacgcctttgggcaagccggcttcatgcagcagctcggccatcaacagcgacgcgctcgggtcagtcgggcttggcttgaggatgaaggtgttgcccgccgcgatggcgatggggtacatccacatcggcaccatcaccgggaagttgaacggcgtcacgccggccaccacgcccaggggctggcgcatcgtccagttgtccatgccccgcgagatctggtcggaatgctcgcccttgagcaggttcggaatgccgcaggcgaactcgaggatgtcgataccccggtcgacttcgccctgggcgtcggtgaagaccttgccgtgttcggcgacgatgatacgcgccaggtcgtccttgcgttcgcgcagcaggtgcaggtattcgaacaacacgcgggcacggcggatgggcggcgtatcagcccagctggcgaacgccgcttgggcggcggcgacggcttcacccacggtctggcggctggccagcgcgacgcggccggtcacttcgccggtggcggggttgtagacgtcctgatagcgatcatcgcgggaaacgcgctggtcgttgatgtagtgctcaatcgtggtggtcatggcaggtatcccaggtgggtagcgttggaacacacgataggctttcggtttgttccaaaccagagcagaatccagaactgattgtcctcataggcgaacaatagcgtcatggaaaaatccgagatcgaagggctgtggacccacattcattggctgtcggtgctggaagagcacggcacctacaccgccgctgccgcacgcctgggcgtgagcaaatctgcggtcagccagcgcatgtcggacctggaaaaagccaccggcacgcgcctggtcacccgcaccacgcgcagcgtgcggctgaccgatgccgggctgtcattgacccgcgacgtgcgcagcgcctatgaacatatcgcgcgcagcttctcgtcggtgcgcgactctgccggtgagattcgcgggctggtgcgccttaccgcgccggtggcgtttgcgcgtcagcagttggtgccgcacctgtcggaatttttgcagttgtacccgcaggtgcgtatccagctggatgtgtcggatgccttgagttcgctggcggccgaaggttacgacctggcggtgcggcacggcttccaggtgccggaaacccatgtggcgtggaaactgtgcgacaccggctcggtcctggtcgctacgcgcgagtatctgcaacagcacggcgaaccgcgcgaacccggcgacctcactgcgcacaactgcctgtactacccacgcggcagcgaccagccggcctggaccttcgaacgcggcggcaagaaggttgaacgcgtgaccgtgcccatcgccggcagcttttcgaccaacaacagtgaggcgctgcgcgactcggcgctcaaccacctgggcatcgccctgctcccggacttcagcgcgcaggccgcgctggccagtggcaccttggtgcaggtgctcaagggctggacgctcaagggcgcgtttgccgatgagatttacctgatacggccgtattcgccccatgtgccgaaatcggtcagtacgttagttggctatctaaaggataagttgtcagacggcttcgggtttaacgggtgagtaataaactcatgcatacgacttaagcggaatcgttctcgacaaccacttataaataaacttcttatagccagcggcaataatccaaataaccaaccttcagaccttgtattgaacttgttacttgcgaaagccagtgacaacagcttcttgacacttaaaaaaaatccatacaactaattgtaaagcatggataaaactcgccacacgcgcggcgcttaaactccgcgttcaaacgcctgcctgcgcaaacttgcaaaaaaaccacaacaggctacgttcatgaataccgtaaaagccatcagccattacgcacacaaccagccgtacaggcgaggaactctattgctctgaaaacagcgcctaacactgacacggaacttagtcttaactctcaaaagggatgctttgatgaagcgcagccgcgggtatcgtgcgttctcgaaaaaggcgccagccgaacatttctggctgtcgttgtttggcttttcagtgctggtgattgccagcttcctgttgtttgaacaacagatccaagacttcctgattcacctcaacctgtaccaaccttccaccaccgcccaagcccttaacctggcactgctgctgatcgccttgctcgccctcgacgtggtgctgccggtgccatcgagcatggtcgcgttgctggcagtagcgatgctcggcagcctcggtggctacctggtgatttttatcgggctgtgcctgggtgccgcgctggggtacgcgctgggcgccggttacttgcgcttgctgtccggccgccttggcttgcatcagcgccagcctgggcagttggcgtatcggctgggcaccttgtcgctgatttgcctgcgcggtgtgccggtgctggcggaaacttcagtggtggccgccgggatgcaacgctacccgctgcgcgcgtttttgctgattaccacactggccaacgcgggactagcactggcttacacggccatcggcacgttgctgatcgagcagcacgcactgctggtgaccattctcgccagcatggtgttgccgctggcgtttgtggccggttacagcctgctcaaacccaagcccagtgtggaacagccactgcgcgggcgcttcgaggtcagttacgactacccggtgatcttcaccgaccatctgtttgatccgggcaacccgtgcctgcaccgcgagctcatcgcacaacacgctgcgccagtgacggtgatggtattcgccgatgaacaactgctgcacagcgccccagcgctcgcggaacagatcgacgcctacttcgccgcccatgccgacctgcagttaaaaaccgcgcccatcgccgtgccggccggtgaactgagcaaaacctcacaggtgctggagcagctctacagcgacatgctgcaacacggcctggaccggcattgctacgtgctggccattggtggcggcgccgtgctggacgcggtgggctacgcctgcgccaccttccaccgtggcatccgcctgatccgcattcccagtaccgtattggcccagaacgacgccggcattggcgtgaaaaacggcatcaatgccttcggccagaagaacctgctgggcgccttctaccccgccaccgccgtgatcaatgacttccagctgctcaccagcctcacacgtcgcgaccagatcgccgggctggccgaagcggtcaaggtggcgctgatcaaggatcaggcgttcttcgagtggatggagcaacacgccgacgccctcgcccacttcgagcacagcgccagccgctacgcgattcgtcgctgcgccgagctgcacctggcgcacatcaccggggcgggcgacccgttcgaacgcggcaacggtcggcccctggattacgggcactgggccgcgcacaaactggaaaacctcagccaccaccggctgcgccatggcgaagccgtcgcggtgggcatggcgctggacgggctgtatgcgaatgccttggggctgttgagcgatgccgacacgcaacgggtgatgcgcttgttgcgcacgctgggtttcaacctgtgcccgccggagctggccttgaaagatgcccagggccgctcaccgctgttgctcggcctggaggagttccgccagcacttgggcgggcaactgtcgatcccgatgctcaaccgcatcggccagtcggtggacctgcatgaaatcgacagcgcgacgatgcaggcggcgttgcaacggctgtcgagcgcaagcgatgcagcgctgaccctgggcgagggttacgcataatgagcccgatgaaaacctggatgaccctcgggcgcgtctccaacttgcccacggtgtggaccaacaccctggctgccgccctgctcgccagcagcgccggcgcattggcaccgccgtcgtcgctggtgtgggggttgctgctgatcacgctgtcgttgctgtacctggccggcatgctgttgaacgactggctcgacgctgactgggaccggcagcaccacaacccgcgcccgatcaccctgggcctggccagccgccagcaggtgggccgggccacggcgctgctgctgatactcgccgccgctgcggtgctgggcctgagccgcctgatcgacgagccgcattggctgctcggcagtgtgctgctgctggtgggttgcatcgtcggctacaacctgctgcacaaaaagtacgcccacagcgtgtggctgatgggcgcctgccgctcggcgctgtacctcacggcggcagccagcctggcggtgccagcggagccgatctggctgtgcgcgattctgctcggggtgtacatcagcggcctgacttacctggcccgccaggaacatcgcaaccagttgatcagccgcctgccattgctgctgatgctcagcccgctggccctggcgttctattccaacacgctgtggttctggccggtgttgctgctgtggcttggctggttgggctggcattactggaaacacctggccaacccgcaacagcgccaggtgcgtgcgtttatcggcgcaggcctggccgccctgccgctgttcgacgcgctggtgctggcggtggccaaccagccgctgggcagcctgttgtgtgtgctggtgtttttcctgcttccccactttcagcgttggatcaagccgacatgaacatgcgccaggatggcctcaccgaacaccttcaagccctgaccgagcaactgaatgccagcgaactggcctggtggcagcaggcgcaggcacagcttgccctacaacccagcgcgaccacggcggcgttgttgagtggccagtgcaagcgtcacctgccagcacctgccgtcacgttggcgcgtgggttgctgctggcccaagcactcgaacacaccccggccgccgaacagatgccgctgttgcaccagctgttcctgtggggtgacgatcaggaaaaagccgccctgctcagcgccctcgattggctcgacagcgacgggttgtgcgtggcgctggccttgcaggccgggcgcaccagtaacccgcaggtgtttgccgccctggccctcgacaccgcctacccgtcacgccattactcggagcgcgcgtttcaccagttggtgttgaaggcgctgggcatgggcctcgacatcggtcgcctggtcggcctcacccaacgccacggcgtcacgctcaatcagctggccctcgacctgctcgacgaacagctcgccgccgcgcgcaccgtgtcccccggcctgcccaaagtgatcgccttcgacctgctcagcccggcgcaactgcaacgcttgcgcggcctgcgcctgccgccggaatggcacgcctacctgaactgacaccgcccaacgccgcccttttccttgacgaggattcaccatgctcaagtacttcgatccgcatattcatatggtcagccgcaccaccgacgactaccaaaacatggccgccgccggcattaccggggtgatcgaaccggcgttctggcaaggccaggcgcgcaccagcgtcggcagttttatcgactatttcgacacgctgctgggctgggaacgctttcgcgcgagcatgttcggcattcatcacttctgcaccatcggcctgaaccccaaggaggccaacgacctgtcgattgccaatgaagtgctggagattttgccgcgctacctggtcaaagacggcgtggtcgcggtgggcgaaatcggctacgacgacatcacgccggaagaggaccgttttctcgccgcgcagctggaactggccaagcaattcaacctgccggtgctggtgcacaccccgcaccgcgacaaggtcggcggcaccaaacgcaccctggcggtgattcgcgaggtcgggatcgccgagcacctggtgatcatcgatcacctcaacgaactgaccttgccactggtgctcgacagcgagtgctggcgcggccattcgatctaccccaacaccaagatgtcggagcagcgcatggtggcgctgctcaaggaatacggcaccgaaaaaatggtggtcaacagcgcggccgattggggcatcagcgacccgctgaaagtgcccaagaccggccaagcgatgttggcggcaggcttcactgaagcccaggtggaacacgtgctgttccataacccggtggacttttttgcccaaagcggccaactggacaaggccttggtcagcacgccgctgccgattgaccagcgcaagcaatggcaggaaaactcggccctgcgcggccaggacccggtggtcaaatgagtgtcggcagcggctggacggccgcgcaggtcgggtattgcagcaacgtgcacccgacccgagacctggcggggttaagcgcctccatcgagcagcactttcaaggcgtgcgcaggctgcgtgggctgcatgaacaagacagcggcctgtggatttgcgctcacgcggcggcgcaactacaggaacattcggcgcgtgcgcagtttctggatctgctcaatcagagcggcctgcgcctgacctcactgaacgggtttccctatggcgaatttcatcagggcgcggtgaaagccgaggtctacctgcccaactgggccgagccgcaacgcctggcctacagcctcgacctggcgcggatccttgccgacgccttgccgcccgattgccgccaaggggtgatttccacggtgccgctgggctacgccgccacctggacgcaagcgttacaagcgcgcgccgatgcgcacttgagccaactcaccgccgccctcgcccgcctgcatggggaaaccggcaagaagatcgtgttctgcctggagatggagccggactgcgtgttggaaaacaccgagcaggccatcgcgttcttccagcgtcggcaagccatcgaccctaaccatgcctacctggcgctgtgttttgatgtgtgccaccaggcggtgatgttcgaagactgctaccagtcgctgcaaaggctgcatcaggcgcgggtgccggtgggcaagattcagctgtccaacgcgatgatttgccgcctgccgcctgaagctgacccgcgccgtgcaaccgtgctcgccaccttgggcagctttgccgaagccacttacttgcatcaggtcaaagccctggatgcccagggccgcttgcgcgcctggccggacctgcccgctgccctgcacacctgcgccgggttcagcgaactgcgcatccatttccacatcccgctgttcagcgaacacctgctgctgcccgaactcagcggcagccaggtagccctggcgcagacgttcgattacctggcggcgcatgctgattttcgcccggtactggaagtcgaaacctacagttggggcgtgctgcccgctgagctgcgacccgccaccgagcccgcccaactggcgggcattgcggcggaattgcgctgggtcgaagagcaattgcgccaacgcaacctgttacgcaccctggcgcaggaggcgtacgccgatgccctctgagcaaccgctgctgctgatcaacgtggtcgggctgacgccgtcgctgctgggtgacgcgacgccgcatatcaacgccctgctcaagaccgcgcagatggcccatctgcaaccggtgttccccgccgtgacctcaacggtgcaggcttcgattcttaccggcgcgccgccgtcgcagcacgggattgtcggcaatggctggtactttcgcgaccaggccgaggtgcgcttctggctgcaaccgaatgcgctgatccagggtgaaaaggtctggcacacgctcaagcgtgcgctcccgggctttcgctgcagccagttgttctggtggtacaacatgtatgccgacgtggacgccgccatcacgccgcgcccgcactacccggccgatgggcgcaagcagttcggcctgtattcgtcaccgcccggtttgcatgagcagatcgaggcgcaaatcggcgagttcccattccccggtttctgggggccggcggcgggcattgcgtcgagccgctggatcgtcgagtgcgcgatggccgagttccagatcagccgcccgcacctgcaattgatctacctgcctcatctcgattacagcttgcagcgcgtggggccggatcacccgtcgattgccgaggaagtgcgtgccatcgacagcgaggtcgggcgcctgctggacttcgccgaagcgcacggcgcggcggtgatgctgctgtccgaatacggcatcgaagccgtcacgcaatcggtgtcgatcaaccgcgtattgcgcgccgagggcctgctacacgtgcgccaatccctgagttgggaattgctcgaccccggcgcgagtgcggcgtttgccgtggctgaccatcaaatcgcgcatgtgtatgtgaagcaggcgcgggacatccctcgggtcaaagccttgctgcaacgccagcccggtattgagcaggtgctggacaaggatgaacagcgcgcctggcagctcgatcacccccgcagcggcgagctggtggccgtggccgcagcgggctgctggttcgattactactactggctggacgcgcgcaaggccccggattttgcgcgcaccgtggacatccaccgcaagcccggctacgacccggtcgagctgtttgtcgacccggcgattcgcttccccacgctgaaagtggcgcgccgcctgctgcagaaaaaacttggctttcgctattacatggacctgatcccgctggacaccacgctggtccgtggcagccacggccgcctgccgagcagcgtgcagaccggccccttgctgatcaccaattgtgatctgacgttaccgcaacagcttgcggcgacggcagtgaaacaactgctcctggaacatttcctggggcgcccacacgctgaactggccaatgccaaggagcttccatgcggcgagccttatctatcactgtcctgagcgcactggccggattggcccatgcccaaggcgcaaacacgtcgtttgactgcacggattttctgcagtttggcggcaatatcgacaagacccgaaccacctttacccaaagccccgagactttggcctggaactggttcgtctgcctgaaccaacccgctgcctcgcaaagcgccgatctggtctgggaaaccatgaagccttccgaccaggtctacctggccaacggcgcgcaaccgctgccctacgcccaacgcgtgcccgtgccggccgccgtgctgacgcaagcccaggcgatgggcatgaacgccaatcgcacctttcacaacctcaacgccacgcaacaggtggacgggctgatcctggaaatgggcggccaggtgccgcccgcccagcaaggccaggccgtgcgtttccagctgttgatggggccggacaccttcaactacatcgtgcagcagaaggtctacaacgtgaatggccaggccgcgctgaccagcgacttgaacttcccctccagcgcctgggagttgaaggccgcctggctgtggatcggcaacaacccgacctatcagcagcaactggccaacgatggttactacatagcccagacctactaccaacagggcaaccagtacgtggtcggctatgccgcgctgagcggtttgcatgtgatcaacaaactcaaccccgactgggtgtggaccacgtttgagaaccgcaacaacagcaagtacaccgtgaccaacgcggtcccgcccacgccgatgaccaacagcaccgggccgacggcggcggcgcaaccggtcaatagcagctttcaggcgagttacccgacgctggcgcaatacgagctgatcggcgtgcagtccaacaccacgcccaccctgctcgccaactcccagctggagtcggccttccagagcatgtcttcgtgcttcgcctgccacggcaccgccgcgtattcaccgaccaagggctacttcaatttcgccctcaaacaacagggcggcatcgtctaccccaccgccgcactgccggcttccgactttgtcgggtatcacaaactggactttgtctggtcgctcaaacgcgcccagtggcaacgctaaggagcatgacatgagcgtattgaatttcccgcgtatctatctgggcggccatatgttctggaacccgccgaccgccaacaacaacgatatgtacccgctctacgatgcggtgaaaatgcagatgaactggccgttcctgaaggccttcgacatcacgccgttgaatgccgccagcaccctgctgccgtggacgattgcgccgttggcgccgtccagcgtgcccagctatgtgatgcaagtgcccggtaacgccgggcagttgagctcgccgatgattcccggtgaatggaatctgttcggcgacaacgcctgcggcaccgtgagctacaaccagacccagtcggtgatcaccggcggcgagttgcccaacggcggttatgtaagccaggacccgctgatcaaccagagctatcagctgctcggcaatccgttcggcggcgcaccctcttctccagcgcgctttgtcgatgtgagcccgtggcagaacaccttcaccgcgctgtacttcgacaagctggtgctgggcaatgcgcaatgcggcctgacgctcaaccgcgagcaccgcatgctcgaccgtttcctcaatttcaattgggccaacctcggcggcctggcctacgtcaccaccacttggcagacgtgttttcccaaggcaaaccttgaatgggtgatcggcaattcggctctgctgcaaaacctgcaggcgcagatggcgcaacaaaacgccaagggcttgatgttccgctttaccacttacctgacctgctacgacaagaacggcatcttcaacgactacccgcctatcgacacccacagctctacgcctgcggcccaggccaaggtgcaggccatgtatcaacaggcgctggacaatgtcggcgatattttcttcaaccccgcctacagccgcacggtgggcagcctggggctgtggtttgaggatgagttccccaccgccccggcaggcaggcgcctggtgccggccgccaaggtgccgatctacaaaacctcaccgggcaccaccagccaggtgcaactgggcgtgatctcggcccaggcccatggcactaccttgtccctggacctgggcaacgccttcccgttctatcccgtggacagcaaagccgacatccccgtcgccgccaaataccaggccggcaattaccagattggtatccgccagggcacgcaattcagcccgctggccagcttcgggtatgacgactaccagcaattggcgttcgacaagcgcgccggcatcctcgacctgccgctgaccgtgcaagcccaggcacagctgcaaaccggcaccctggaactgcaacagcaaggcaccacgccgatcatcgctgcgacgcagcaactgtggaccgccgaagtggtgcagagcgccgggtttatcgacgtgggcgacaccaagaccctgcaggtcatggtgcaatacgacggccagccggcgccggagggcacggtgttgtgggtggccgaatacggcaatgcctacatgctgtgcaccaccgattactacctggcgttcagcaacgcggcggacttcacgctgttctacaacgacccgcagaacccggcgaacaacagctcgaacctgccgcagttcagcggtgccaaggccgtgcctggccagatcaccgagggcaccgggcgccagctcatggccacccggctggcggtgtcggccgatcagacgacgccggtgacttaccagcaatttctgccgacaccggccgctgtcgccttgagcccaacgctcacgttcgccaacccgattgccatgcaaggcacgctgcaagacccgttgaacagcccggtgaactacagcctggcgcagatcaagaccgacgccaatggcatcgccaacctgaccgtcactgcccaggcgccggggtttccgaccttgcgtttctttgtgcaggacggccagcaggcgccagtgattccgttcagcttcccactcaaccaggcctttaccgacttccttgcacccctgcgcgtgctgccgcaggaaccgcagatgcagcaggacttcgtgaatgcctggaacctgatttatcagcgtgaagacgccggcaaattgatctgggagaccttcatctacccgttcattttgcagccgttctattacctgtacccgatcatgagcaagtacatgccgctcaataacctgacgcgcatcgagggcgccgtcgaccagttgattgtgctgatcagcaaggcgtaccaggaggaaagcaccctggcgatgccgatcacccgcgacatgccgcaaagccgccgcgccgtgctggagctgtgggcccaggcgctggtgaagcgcaattacccgcccgtgccgctgagcatgactaactaccaataaccgccacacaggaccaccgggtgacgcagcggatgctgcgtcaaccctgaccacaaggacgtatcgccatgaaaacactcgtgagtgtgatgttaatcgggctggtcagcttgtcggcccaggcgcgggaagcgcctgagccgtcggcgctagccacccagctcaactgccagccgcccagcagcgcaccggcggccaacgccagccaggatcagttcgaccactacagctggcagctgtttatcgccttgaactggccggcccaggatgggcagcgcggcacgcccaattgcaacaagcagcccggcgaccccggctacaccgtgtggcaaacctacaagaccgtgagtgaaattttcttgccgggcgccgccaacccggggccgtggaacagcccgctgactgccaggagcctgggcatcatcaacattgcggcgctgaaaaacagctcgctggtcaactccatcgaccaggcggtgggcggctggctgatcgaccaggcgggcaacccgacctactacgatatctcggccaaccaggcctcctacaactacatcgtcggcaataccttctacaacgcgaatgtggtgtccaaggccagcaccatcaactttcccaatggcgttatcgaggtcaaatcgagctggcggatcctcaccgcccgtgacaatgccagccattacctgacgcagtttgcgcgggtggcgcggttcaacagccaggggcaacgcatcggcgttggcgaggcgtatttgggcttggtgggtttgcatatcatcaccaaggtcaatggttacccgcagtggatctggtcgaccttcgagcaggtcgaaaacgtgccgcccaaagccaaggtaaacggccagtgggtcgaccaacccgtggcgggcaccgcctactcctacttcaatgccgccgcccccgccgccgcgctcaaccagtcgccctgcaactggcagacccaaggcgcgcaactggtgtgcgtgcccaaacccggcaccaccttccagacacccaacccgctgaaccgcgtgacaccgatcgccgatgtcaccggctgggtcaacaacaactaccgcaccaaccccggcctgcaacgcagcgtgttgaagtactaccagttgatcaccacgcagcgcccgttgctgccgaacaacccgagcaacccgttgggccagccgaccccggcactctcggccaacgtgaccatggaaagttatatccagcccaacagcagctgcatgaactgccactccatggcgacgccggtgaagagcccgttcaggtccgatttctcgtacctgttcaaattcgccaacccaccgtttacccctcacgccacggacaaggaatagaccatgagcatcctcaacggaccacgactgaatttctggggcggcatccgcacggacgtgagcttgccgaacaattcgccgaccattcctttcaatggcaatgatgactggccgctattcgacctgaccacctcgaccctggcgccgggcgcgcagtcgtataccgacgaccagctcaacagcatgatcaacgcgcccaccggcaactactacaccgcaggcggctggaaccactacggccagcatgtggtggacatgcaaaacgccttgatcagttcacaaggcaaccccggcagcgtcagcaccacgggtgaccaggtcggccagccggtgtacctgctcggttcggttgacccggtgaccggccagggcccggtgtccgggccgatgatggtcgacctcgatcccagcgcctcgaccaccacgcagatttttgtcggcgggctgcaaatcggcagcaacgacaatatccagctgctgattcgctgcaatgcggtgtgcagcagtttcgacgtgaccacccgcgtgctggagccggcgaagatggacgcaccgggctcgtttcacgccagcggcacgtttcagctgacgtttccattgagcagcatcgtcagctggaacaagaacagcagtggcctcaaggcgatcatccaggcgccgggcgcaaccggcatcgtcttgcggtttgtgatgttcgaaatgtgcccgcagatgaccaccgcgcaactcgacgccgattacgccgccggtaaatacacgcccaacccgagcatcggccgggtcatcggcacactggccccggcgtttgccggtgaaccgctgagctgccaaccgggtcggcaattggtcaacacgaacactaaaaatgcggcttatgcggcggtcggcaataccggggtgctgagcctggacatggtcaacgtgattcccaagcaaacctttcgtgccgtgcgcgacgacatcaccagccccatcgggccgaatgcgaactatgggccggtgacgatttcagccggcaccacgccactgctgaccctcaacccgaccgccagcccgttggtcaattactacgtgtatggcggcatcgtcgacctgcccctggatatgagccagcagcaaaccgtcaagaccgcaccgctgaagatcactgcccccaacctcgtcgcgggtaagtcgcttaacgccaccgagtcgatctaccgggtgtatgccgaccagcgcaacgtgtacctggaggattaccccaacggcctgacgatcaacttgcaagtgcgctacctgggcgggccggtgccgaatgccacgagcatcaggctgggggccagtgcgccgggggtctacgatcagaagcaatacatcgacttcctcaacttcccgccgtcgctgacggtgagcgccggtcagcaggcggtgagttttccggtcacgctcaaaccgggcagtgccgcccaggcggggttcgtcgcgctgacctgcacggccaatggcgtggacgccggcgcgtttttcaccaactttcgcaagtacgcgcagaccgatttcggcatcgccaggggcagcaccatcacctggcaacaggtgtaccccaacgtgctgcgttttcactacctggccttccccgccatgtcgcgctatgtgccgctgaaccagcccgacgcgatcatggcggcgaaaaacgccatcctcgcgcgcaccgctgacgcctacaaaggcaccacgctgttcatgccggtggtgcgctcgatgtcccccgcgcagcgcgcactgctgcgtgcctatctcaccggcagcccatggcaaccgccgcaataggaggcaaacacgatgaccctgcatattcccgcccaacctatcgacaacctgcgcccgagcacctttatcgctgaaggcctgctcaacccgcgtggtgtgtgcctgcaagccgatggcagcctgttgctggccgaagccggctcaggcctggcggacgcgccgttcagcggccgcatcagtcgcctgcgacccgacccgctgcagcctggcgcctacctccccggcgaggtgctcgccgagggttttcgcagcatgaatatgcaggcgcgcatgctgcgagatgaaatcatggggctgtcggacatcgcctgtggcgacgggcgctgcctggccagccagaccgattatgtcgaaggttccaaactgctcgacctgcaatacagcccgcccgagccagtgtttcacagccgcggcaacctcaatgcgctgtgctaccacccgacgcggcgcagttggttggcggtcaaaccggataccaaccagttggtcgaatttcgcagcggcgaggaggaacaggtactggcgcaactgccggtacttgatcaaggccaggaggcggtgcccgtgaccctggtgtacgagtcggaaacggacggagttttgatcagcctgttctccggcgaactgcacggcgagcccgcgcgtaaaggcatcgactttgccgactttgccgggcaggtgattcgcgcccacccggccagcggccagttggaggtggtgatacgcggcctgcagctgcccaccgggttggcgtggtgcccacacggcaacctgctggtgctggagctgtgcagccacctgcaacaaccgctgacgccagactggaatggcgcgcccctgcatggcggttttacccggttcagcgggcggttgttgcgctgcgacctgcacaatcaccaggtggaagtgctcgcgcgcggcctggatacgccgtccaacctgtgccgcgtgccgggcgccgtgctagtcagcgaaggcatggggttaacgggtcgaccgctgccccggcccgacaacaccgtggcgccgttgacgggcaggctgcggcgggtgcagctgtgaacctataccgcatcctctaaccgcaaaacggtcgaaggcccggcacgaaaagacggattgtgcttggccgcttccagcatatgcgcagtcgcgtggtgggcctccagtgcagcgttggaggcccacttctcgatcagcacaaagccgtcggggttgccctcaaccgggtgcaggtcgtattgcaaacagccctgctcggccctgacgtgaggggccagccgttcaaacgcggcgagctgctgcgagcctttgccgggctgggtagtgataatgaccacaagccgcacttcatctgacatgcacacaccactgcgtaagttggataaggaatgcgcacagtacgtgagctgaacgcatcgatgcaaaaatctgcaaatgccttgtgcatttcacgcggttttcacagtcgggcgcctagtctggattcagctcctaagcgaacacctttaagcccgcgcccccatcgtgggcttttctttgtctgcgatttgggtcgcaacgacgtccggcctcagccgataaaaatgctttaatgcggccgcgatcaattacctcggcatcggctgtcgatgctggggtgatgtagtgcactggtcgatgaagcgcccgggctgtactcaagcagagatggacgctccggacatgggccattggtcgagcccattcgtggtgccgctcccgcgctgattgctcttcgcaggagacaggcatacggcattttttgctacgtggagcggctttcgttacgattttgttgtttttttacgcccttcccgttctttcgttcgtattggtggtgaataaaccagacgaccaaaagcaggcctgccaagccgaaaatcaatagcaacagctctattgcgggaccttcgtgtgaaaacatttttcgttcctcgtcctgaagtcgcacaacccaaaaaggccgcacccgaaattattcgtaacaattcaaacattttcaggttagcgatcaaaacgccaggtggcaacccgcaatcgcatcgaaactattgatctagacgggttgcctatgaaacaccagcattgcgaaggccttcgcaggcgagggaaatgctttaatgctcgcccgctcacagcaaatggaattggcctgatgaacaaatacctcctgtattcgctactggcactggtcgcgggatgcagcacggggccttatctgcacccggactcttcaatcggtgaaaacgccctgcttcaacgcacgtgccccggccccaaagcggcgatgagcgttgcgccgttatctgaggcgctcaattgggttcacgtgctggtgtatgtcgcgccaccggacagctacagcgggtacggcaaaccgcgctccgttgagaccgagcttcgtgtgttcggccgtctctacagaccgcgccagctcgatcaggacgtagcgctgtgggtcagtgccacgtcaccactggtcaccgtgcaattggcgtcgggaaagacctatcaggtcagtgtcgagtttctgaaaaccggctttgacccaaagaagctatccagttccgacctcaagggcacgcccctgggcaaaggcgatatggacgacttcaccctgacctttccggatattttcgtgaacggcgaaaaagtccccatggcgcccattcacttcaagaaacgtgaagagcgctatgcaccggtgttcaattgctgagttgatccctcacaacgtttaattgtcgggatgctcactggcgaccgaatcggcagcatccacatccgacatgtcctcttccaggggcgcatcgtcctccggcggcaatttaaccgcttcgtcatcacgccgaggatcatggccggtttcattgtccgtgccgcgcgtgacggcttgctgggatagattgcctggggctttctcgttgatgtccatgctggctctccactctggcgcgcggaaaacccgcgcttaagtttgagaggcggcaccgcttgcgaagtgcagagcattagacgaatggtttccagagaaggcgcttcaagcacgcccgacgaacagtaaaaatgtgcagcgtcggcccatcaggtgcgaacagcagctttccttgccccactcgcgctgagcattggcgccctgtatagaggcagcatttttgacattgccgacagggagacagccaaatggcatttctgacagacactcaactcaaggaaatgggcttcaagaagctgggcaagcaggtaaagatcagcgacaaagcctccctctacaactgcgatcaactttcaatcggcgacaacagccgcatcgatgatttttgcgtgatctcggggaaagtaacccttggccggaacgtgcacatcgctattttcagcaacgtggccagcggcgagtcaggtgtgaccatggaggacttttccggcctggcctacggctgccaagtgttcactcagtcagatgactactcaggtaaaacactgaccaacccaaccgtccccagcgtctacaagactgaaaccaaaagcccttcccatatcggtcggcacgtgatcataggcaccaactcaatcgtgcttccgggtgtaaacctggccgagggatgttctgtaggcgctatgaccatggtgaccaaatccaccgaggcctggggcatatacttcggcattccggccaagcgcataaagaacagaagccgcgacctccttgatcttgaagcggagtaccttgcttcggaaaaggattaatccatagcgaattcacccggcccgtcagcgtgctacggccctggcgttggcttggcgcattcacctcaccccgacatcattggcgtacacgcgtgggccctgcctgaaagtttcgtggcgccaatagaataaaaaccccagcagctagctccattcaatataaacagctgtgagaactgacagttacctccctgctgaaagcggcgtacgttcaaaacgcaaccgcagcccctaaatgaatagaggcacacacagcatagggagatgaacatggatcacaatccaatgggtatggacccggtcgattccgaaaacgacccgatctttaacgcaaccactcaaaaatgcaacgtggtcgacccacgcaccggtctttttgaggcctatttccgattgagctcgataaccgccaacaacggcaatgggccggtgattgatctgagcctttacaatacgccagtggtcaacaataaagcggcgctgggtgatggtaatttttacgccatgacccattatgatcgaacccataaaaagttgacactgcacacgggcgaagtactggaattatttccagacgtaaggctaaaacatccagctgttattgtaacttggttggatacccgtggcgaaagactgacggtgctcaccaagggaggcagaaaagaaacgctcgcacggatgaaagacacagacttttatttgccggaatatttgaccaccgatggttataacagtgtgagttttacctggagaaaaagagaacaacaaataaatggcaagtcttattttcaggtcctgttggccagcatccaagaggagcccggccgcaccctgctcaaagtcgaatatacccccgccctcccagatacaacaccggcagttgagctcgtcaagtttatcttctggcctaatgatgcagcaaaaatcctgacttataccctgaatatcaaggattacgccctgcagtcagtgagtttgggagatgacattcagacgaccttagagtatgacgagcatcccacatgcggctggctgttgaaaaagatcaaaaccttcgatggcctcgaagaaacggttgaatacaaagacaatgggctgaagttcaaagataacccgaagctatcggatttgccctgcgtcaacacgcacaccttgacacccactgggggcgggacgcctgttatcacaacgtatatctataagcttgatgacgatgatgcgtacagaaccaccatgagtgaaggcgtacccgcaatccgcactacggtttatcaatacgataaagaccataacgtcaaatcagaaaccgtaacccagggtgctgccgaaaccaaaaaagaatacgacacaaaattagttaacagtgcactgacccaactcaatatcaccaccacttacaaaaaagcaaatagaagccgtgcggaaaaaattgcaaatgaactactgactggcgccgccctgcggagcaatgagcaaaatgatctttttactaaaattgagtattttaacgtcgacaaaggttatttagactcattaatggatgacatttttaatgcatccaaaaaagatccgggggacagaccgcaaccacaatggcgtaacaaggatgctggcagtgattttgattttgcctatgtttccgccgaagtgcttcgtataccgccggacctattaaagaaattgctccccgatctgcccctcctccgcaaccgcaatttcgccgttcagcagttgaaagctcacagctacaccactgtgcccggaatgagtcaaggaaagttgcgcagtacattgcaagtcaatcttgccagcaatgacctgacccgtaagtttgccgacgccgcactgaccggcaaggaatacacatactacctggaggacggctttcgcaaagggcgcccaaaaagcatccgccagtccaccctcaaaaacagcaccctggaaccgacggtgatcgaacccttgcgcactttcgaatacgctctgggaggctcgggcaacaccgaactgaccaccacgaccaccgatacggatgaccagggcaaccaacgcactgcctcggaaactctcagcaccctcaacggcagccttattcgccaagtcgacaccgacggcaaccgtaccgagtacacctataacccatttggccaactggctactctcacggtgtgcgcgcaaagcccgacctatcgccaagtcactacttacacctacccggcgccgggccaggtgcaaattaccgaacccaacggggaaacgcgtttgagccagtacgatggccgagaccgtttggtgagtgaatacctgattgaaggtgaccaacaaaaactgaccaaaaccgtcagctacgaccgtatcgggcgtgaattacgtaccaccttttatgattatctttcctatagccttagcgtcagccattggcaggaaaataaatacgatgactggaaccaggtctgcggcatcacgtacagcgacggccggcaggacttcgatttctacgatcccgtcgcgttgacgcgcacgcagtggacgggaaaagccaccgacaagcacgctacagtcacctcctttaacacggataagacgatcaaaaaaatcgaatggaaaggtgaggatggcaaggtctaccaaacccagacagccagctacagccatttcaaactggtcacgcggctgcacaccgacggcgagctgggcgaaaccaccattgattacacctacgatggcagcggccgcctgctgagcgaaaaacatagcgaaaaagccaaagggttactcgcgccaagccttgtctacacctactactacacctaccccaagcaatggctgctgcgtgaggccgaacaggtggacattgagtttgacggcaaacgccagcgcctcggcaaacgcaccttcgacagttggggccgagtcacgtccatgacgcgcggtacctgcaccgaaaccttcacttataccggcgccagcaaggtgccaacatccaccgagaccgctgaaggcagcgtcctgcagcatgaatacatcaaggaactgggtaaccgcctggccaaaacccgaaccgctaacgccggcgagcaaaagagcttcacttacgcctacggaacacagggtatcgcgacggccagcgaaggcgagcatttgctcgagtacacccatgaccgctatctacacgtgacccaacagcgcgtaggaccgcagccagaccaaaccaaagaggtgctctcgaactattcgatgggcgggcgcgcgaacgaaaggacagacacgctaggtaataggacggtgtttcaatacaacgtgacggggcagcgtatagccgccgacagtcgttattttagaagcgatcatagttacgatgagcaaggacgacttcggctggaaacaattaaaggctccctgagccggaacgatccgaccatcagcttcgctgcgaattacacctacgattcacaacaccgggaaaccagccgccaatttacactcagcggcaaagttgacctcacgctggcgagcacctactacgccgatgacaaattgaagtcggtgcagctcaaacaagggagcactgtgctgggctcgcgcagcctgacctacactccgggcgggcgactcaaggcctgcaccaccaccggtgtatggcgaccgaagacgcccaagaacaaagacatcgacaagcaggagtttacttacgacgcattgggtaatgtcaccacgtgtatcaccactttcggcaccgagaagaataccgcgatctacacctatgacggcttgaatggtctccgcctgaaaacgctgaaaaacgatcatgcggactaccccaccgcgctcgccaccttgagttatgacctggccgggcagatgacccaggaccataccggtaaaaagtacacctatgactggctggggcgattgacccaggccgggagtacccggtacagctacgacccctcggaccgtttgatgacccgcgagcaagacggcgaacaaacccaactgatctatgacgggctcaacgtatgtggcgagtattcacttgggagcgatgatgcttatcgcaaccttaaccctgggagctcgggctgcacggtgcagcagatcaaacgctctggggtggtgagaacgctgtttgaactgcgtgatgccaatgggaccgtgtgtgtcagctacgatatgagcgccgaaacctttaaacaccacgcttatacagcatggggcgagcatttttccgacaagcccgactcgatgctgggcttcaacggcgaataccgcgacgccgccactggccagtccccgctgggtatggggtaccgctggtatgacccgcagaaaatgagtttcgaaaaaatggacactttaagcccacacggagacggcggcccgaacatgtatggctactgtgccaacggcgatcctgtcaattatcaagacccaaccgggcaccaagacgtgcaggcccaatggacggccgtttatggaggtacgcagcctcaagcactcgggttcggacccggacccgcaggcgcagtgatcagcgccatcatttggggagggcttggcatactcacaaccttcctgtcgggcggtttagcgttcccgttgttggcctcgttggccgcgctttcgcttggcgcagcgctcggatcagcactgaccagcgagtccaatcccgagttgtccaagacgctgggctggatatctctgggggcgggagcactcggtggcctggcctcgttggcgggaaaaacggcgacgctctccttatacctggcgcgaaccgctcttgcggctgccagaaacctcgtgggtaaagcggttcccatcgcaacaatcgcactcagacatctgggacagctcaacggccttgggcgtttaagcttgaaggcgcgattcttaaaggatattggattcaacgcaaatgcgctgacattcaaggaagtcataaaaagcttcggcgccgctgagatcaatacaatcatcttcgtcctcacggggtcttttgggaatgcgaacacgtttgagcctggccccctcagagttaccaatacccttctttcagacctcacatgggggccttgggggcagttcatgaaaatatggtcgaacgtccgacgctgactgagtgcctgcctcaaaccttgacaagaacaagaaggcggggccccttgccccgcctcacagcctcagtacaacctgcgcacagatgggctataaaacccaaatcgcaggcaaaaaaaatcccgcagcacctaggtgcgcgggatttccttttatgtttggcgggaaaccagggattcgaaccctgggaacgctattaacgttcgccggttttcaagactgccgactaatctatgcgaaacagccacttagcctaaaataatttccacaactgagcacccgtagcatctctgaaagccaagcggcgcaaggggtgcataccgagttgcggaaatgatttagccccctccccggcgtcctgccgaccgaacaccaaacccataaccgctacagctcgtcgcctcaaatcgcgtcacgatcaaacctcgattactgtacacatatacagtatttagattaaccaccatgcaccacatcgacgaagacacctccgcgtggctcggctgccctacgcccctggaaatgtacaaacaccagtgcgccctgctggaggacgaactaacccaagcccaggcactgctgagcaacgcacggaagaatatcgccgggctggtccagatgaatgatgcactggccaccggcaaggccaaagcggaagaagccctgacggctgccctggtcgagatcaacgcgctcaaagagaaatgctccgagcctgccatcctcggcatgaaactcgttgccgaacagcgcgactatctgctcagggagaatcagcggctgctggtcgagctcaagaaagtcaccgagccacagccatgatgtaagaatgacagaggcgattagaaaaggcggcgcctgccacccttccatgaagcgattgggtttgtcatttttgcaatcctttgcaatgcgagcttggcttataggtgatgctaactttcgcggccttaaatgcatacaaagccacattattcataatgtgactctctaaatgaggcttatccttttaaatctggaaaatcgggagcagaacccgctatgaattgatatcattgcactaccagtaccttacaagttggcctataaacctctgatttatcgagcccgccttcgcaggcaacacccttcaaaaggagggtttgcgaagcgaaagaactgaacagtaattcccacagggacgattcaaatatgagcgcattaactctcttcgtgatgacggaaaaaggcctaactttcatcacgcaggccgtacaggtgtacaaagagattatctcggaagtagtcatcggccaagatagtgcagtattgaacgactactccagcgaaattgccgctgtatgtgatgcagccaatgttaaatttagcttgcgagcggacttttcgaagatcaccagcgaatacgcgatggccgtatcctggcgctggatgatcaatcatccgcccgagaaattgattgttttccacgattctcttttgccgaagtaccgaggcttcgcaccgctggtcaatgcgctcatcaatggtgaagagatggttggggtttcagcgatattcggcgcaacggaatatgatcgtggcgatatcatccaccaaacgtctacggcgatccgatacccgataaccatcgctgaagcaatcaaggtggttggtgactgctacctgagcaccggcctgcaggtaatgaaggctattgctggcggcgagacactgaaggctacggaacagaatcacgagcaggcaacatatagcctgtggcgtgatgacgaggactaccacatagattggagccaatcagcgaaaaaaattcgccgtatgatcgatgctgtaggctctccattcaaaggcgcacattgcttgatagacggtattcccgtgcgcatccttgcggccgaagaccttgctgatgttcagatcgaaaacagaaccgccggaaaggtgatatttgttgagggcggcttgcctatagtagtgtgcggtacaggcctgctgaaagttaccgtatgcgtagccgacgaaaacggtgaaagcatgctccctctgtctaaatttcgagctaggttcacctgacaggattcagcgcgctataagcctgatgtacgcttggcacgcgcgcagggcgatcacggcgttatccccatcgtcggtgatggcgataattctttgagcatgcgctgggtcaagttgggctcgacgggctgcatgaaccacgccgacggcgccggggatggaaggcacgttgcagccactggttgcgtccgcggcgtcgagaaggactgatagccgcagctcagtagtagcaaggtggtcacgcagcagagcctggttacgctgggcatcggataattccttggtgtgttgttggtccagaatggcgagctgttgctcggtggccaggcgcttgtcctgctccgccgtctgctgacgccaggcctcgacggtgattgcgtccagctccttctggtgcgcgatgccctgctccgcgaactgttgggcgagttgcttgcccaggcgccagtactgaacctgccaggtagcgccagcggtgatagccatcagcaccacgatcagcagaatcaggccagccagcttgtgcaccggcgtcatgccagcaccttcagcgcattttcgtacagcgcctggcgatcgcctggcctgtgagcccgccatggatgcgtttggtgatcttcacgaactctccctgatccgcgagcgtgttcagcccgcgcgtcgaccagaaccaggcagctgacatcgctgcgtttttgggtagttcgagcagctcccggcttagtgatcaggtccaaccccaaagcctcgccgcacgaagcatagttcgcacggccggtaatctggatcaggccgcggccacggtacttcgatccatcccctttcacggtgttacccaaatctacgcggccctcatagccggcctgctgagcggtaggcccccagatctcgcgcacgtaacgcaactggcccgactcgtgcccgacctgcgcgatgaaggcgcaagcccgtggcgtaccgacgatgccgtaccggttcatggcagtgttcggcgcggaaacaaaaacgccagcgcgcgggcgcgcgtcggagttgactgccagaatgcgacattgatcgaggcgctggaccagtacccggacgccgccgatttttacatccagaagccacagtgctggaacggcaacaacctgatttggctttgtgaggacggagtattcaccagcgatctgtcgaaggctgtcgtggtgcctagagctcacaccgtgatccggatcggcaagctcggtcaatcaggcgcagtggtctggcccaaaccctacatcgacgcccactcccggcgccttgttgagcgcgacgacgtgaatatcaaagacgccctgcgcggcaccggcatcaagctggccaagccgaagaagcccaaaatgatgatgttcaattgtgacggatgcggccgcttcatcagtgacgcccagcgctatcgggaagaccgtcggaactgcggaacaagcaacatgccttgaggagcatcaacgcgcacgcttaatgctgccctgctgcatgaactgttcgaactcagcaagcatagtgaccgccgtaaactgcagcttcccgtactgagcggctatctcgtcggtctggaatggccagtttttctcgtagaagttttccgccgctaccgccgcttcatctttcgcgatttgaagatcacgaacacctgcttcgtagttgtactcacgcacacctacctccttgatccggctccatgccggtcacccgtaataccccatatcaacgaatcacgccagccggcgaggatcccctatgtctacctacaaaatatccgggactacggtagtcggcttttccggaggccggaccagcgcctacatgctgcgccaggtactggacccaatgaggacctgagacatctggtcgtcaccttcgcaaataccgggaaggagcatccagtcatcctagactttgttcaggaatgcgccgagcgctgggccgtaccgattgtttggctggagtttcgcgacgatgacgcgggcttttcggtggtggattacgccactgccagccgccagggcgaaccgttcgaagccctgatccgcaaacgcaagaacctgctcaaccctttgactaggttctgcaccatcgacctgtaaatccgcattattcacaagtacctccgcagcctgggcctttcgaccgaggaagcgccggtggacatgatgaccggcattcgtgccgatgagccacggcgcgtcgtgaagatccgccatcgcaaaggcacgagcgaaagcaagtgggccacgatggacatgccgctggctgacgccggtgtcggcatacaagacttgacggacttctgggcaggtcaaccgttcaacctgatgctgtcgacgatcaacggccaaatccttaatggcaactgctacctttgtttcctcaagggtgccaagcaggtctattcaatcatcgctagcgaccgccccaaagcagcctggtgggcccggatggaaagcgaggtggtatccggcggcaagttcaccggtgatggcgccagattccgcagcgaccgcccaagctaccagcagatgctcgactactcagacacccaactcgacatgttcgccgaccacgatcaggccattgcgtgcttttgtggcgactggtgccttatgtacccttattcccaacagtttggagccaaggccgaggatcatagtcagccctggagtctgctgttgcaacgaggttttcgagaagtaaacctatgaacatagccatcccaaagtcagcatcactaaattctaaaaagggatactctggattatagagccctacaccatcgacaaaaatcatattagtaataccggtaatattcttatctttattgcatctatcatgaaggttctataacgacgatttaaacccatacaagcaacataccggataatgactattaccgcatgacaacttacctttctttgccattctgaggccatcgtcgttcttagggctcatactccagagcaacttcgaaaattggtcaagagccttcccgtcaaccacacttttaacctccaagaccctgagaaccgaatcaaatgcataaataccatttccgcccaactccaatatcggaggcatggtccttttgtcgtaaatcaacaaatcaacttgggggctttgacggccccatttatccaatatgacccctgaccctatgccgaactgtaccggcaaaaacaactcaaatatttctttaacaaatgtttctctaaagcttcccttctcgccattatgggcaagccccccagtagcaagaaacatcgttctcagttcttgaacctttgccctaaacaactcactaaaaatcgccatttatattccaactttaaaagcttccctagaaaatactatttaagcgaaatacctcaacttcttcgaggtgtactcatgcaaaaactattctggcacttgctcgcaatgctgctcgcgcgcccggtagaagtgggcagaactcgaagcgaaggagaaaccagccgacctgacaatgatgaaggaaatcttcgacaggtatgagcgcgacgtcattacgaaaaaaggcgagcgcccccagaaagacaatctggccgagctaaaacagctgcggcccaccttcgactgcgcgcccatcgactctataactcccgcaaacatcgcgggttatcgcgatgcgcgctcggcaaaggtcagggcgaaccgcgaaatcgccctactctcccacgtattcaacatggcgcgggaatgggggctgaccgaacgggaaaacccatgtcaggggatcagaaaaaacaaggagacaccccgcgactatttcgcaaatgcagtggtatgggatgcggtctacgggatggcagagcctgaactcaaggaagcgatggatctgggctatttgaccggccagtgacctgcggacgtgatcatcatgcgcagcgacgatacagagggagattactttctggtgacgcagggcaagaccggcctaaaactgcggatctcgatgcgcacggaggccggggagaacagcttagggcgtttgattagggaaatcacatagaggaattcgaaccactcttcaaaatacctgctaatcagcaaacatggtaagaggatgacgaaggggatgctgcgcttgcgctgggacaaagcgcgcgagatggcttgcgagaaagctatcgaacaaggagatccgacgctcgctgcaaagattggtgggtttcagttccgggatattcgacccaaagcggcgtcggaaatcgtagatatcggcgatgcaagcctgctgctggggcatagcaatcaggaaatcacaaagcgcgtttacaggaggctcggcaccactgcgaagccttaaaaatagcaaggttatggaacacttccataatagttatggaacgcagagcaaatacgagcacgccgcgaccaaaccccagaaacgcaaaagccccgctttcgcgaggcttttgtgtatatcttggcgggaaaccagggattcgaaccctgggaacgctattaacgttcgccggttttcaagaccggtgcattcaaccactctgccaatttcccttttgcatcacaggattataatagcccatcccgtgtcagcgggcgccataatacccgaatgaaacacactgtcaaactcttgccatcgcttgttacagggcgtctgttatgatccttgcgactgaatgtttcaaaactgaaggagtgtcgccatgcgcgaacagaattacgcagtgaatggtcacgcgcaggctgagcagcttgaagtcagccgcgtgttgcgcaatacgtacggcttgctcgccctcaccctcgcattcagcggcgtgatggcgtatgtagcgcagcaaatgcgcgttggctacccgaatatctttgtcgtgctgatcggcttctacggtctgtttttcctgaccaacaagctgcgcgactcggcctggggcctggtgtcggcgtttgccctgaccggtttcatggggttcatcctcggcccgatccttaaccgttacctgggcatggccggcggcgcggaagtggtcagctcggccttcgccatgacggccctggtgtttggtggcctgtcggcctacgtgctgatcagccgcaaggacatgagcttcctcggcggtttcatcaccgcaggcttcttcgtgctgctggcagccgttgtcgccggcatgttcttccagatcagcggcctgcagttggcgatcagcgccggtttcgtgctgttctcctccgtgtgcatcctgttccagaccagcgccatcatccacggcggtgagcgtaactacatcatggcaaccatcagcctgtatgtatcgatctacaacctgttcatcagcttgttgcagatcttcggcatcatgagccgtgatgactgattgctagcgctataaaaaatgccccgtatcgtgagatacggggcatttttgtttgcgcaggttcagtacctgttgggttccatttccagttcaaccttgaagcgctcggcaatgtcctgctggatacgcagcgccaggttggcaatgtcgtgcccggtggctgatccatagttgaccagcaccagcgcctgcagcttatgcacgcctgcatcgccctcgcgaaagcccttccagccagccttgtcgatcagccagccggcggcgagtttcatctgcccgtccgcctgcgggtacgccaccaggtccgggtactgcgcctgtagctctgcggccagcgcctgggacaccagcgggttcttgaaaaagctcccggcattgcccagctcagccgggtccggcagtttttcgcggcggatgctgcagatcgcccggctgacgtcgctgggcgttgcctcggtgatcccctgcccggccaggcgctgctgcaccgggccgtagtcgagtttcaggtggctggcgcggctcaacgcaaagcgcacgcgcagaatcaaccaacgcccggtctcgtgcttgaacaggctgtcacgataagcaaagttgcactcttgcaggctgaaatcgcgcagctcgccggtctggcggtccagggcggtcaggccggcaaacacatccttgatctccacgccgtaggcaccaatgttctgcatcggcgcagcgccgacggtgccggggatcaggctgaggttttccaggccacaaaagccgtgttccagggtccacagcacaaacggatgccaggcctcgcccgcttcagcctcgaccaccacgtgcaggccatcatcctctaacacgcgaatgccctgggttgccatgcgcagcaccaacgcctggatatcctgggtcagcagcaagttgctgccaccgccgatcaccagcagcggtaacgcgtgggcagccgcgtaggccacggcttcgcgcacatcggcatcgctgtgagcctcggcgaacaactgggcgcgcacatcgatgccaaagctgttgaatggcttgagcgatacctgcgcaagcacctgcaaggtcataaccgccccttcaattcgatcaccaataaatcacaggcgcgctcgatcaggtcgaggaccttttcaaagccttgttcgccttcgtagtaagggtccggcacctcgtccacctccgccgcaaaacggcgcaggaacaagtccagctccgccttgccctgcgccgggcgcagcgccttgaggttgcgcaggttgctgtggtccatggccaggatcaggtcataacgcgcaaagtcggcgcgcgacacttgctgggcccgctgcgccgacaggtcataaccgcgcaccagggcggcacgctggctacgctggtccggcgggttgcccacatgccagtcgccggtgccggccgacgcgacctcgacctggcccgccaagcccgcttcgcgcaacttgtggcgcaacacgccctcggcggtgggcgagcggcagatattgcccaggcacacaaacaggacttccatcaagcccccagcaggcgacgcacgcgctcaaggtcttcctgggtgtcgacgccggccggcggcgcttccagcgcatcgcccacatggatacgcacgccgtgccacagcgcacgcaattgctccagggattcggtgttttccaaccagcatgggccccagctgacgaagtcatgcaggaaaccggcgcggtaggcgtagatgccgatgtgacggcggtatggcacgccctccggcaatacgtcagggtgcttggcgaaggcgtcgcgcgcccagggcagaatcgagcggctgaacgtcaacgcgaggccattgatgtccgtgacaactttcaccacgctcgggttgaacaacgtgtcgatgtcttcgatgggctcgctcaaggtcgccatgcgtgcttcagcgtgggctgccaggttggcggccacctggtcgatcacacacggcgggatcaacggctcgtcgccctgcacgttgaccacgatcgcatccggcgccaggccaagctgcgtggcgacttcagccaggcggtcggtgccggagttgtggtcttcgcgggtcagtaccgcttcagcgccaaaacccttgcaggcttcgatgatgcgcgggtcatcggtggcgaccactacccgttcggcgctgcttttgcaggcctgttcccacaccagctggatcatcggcttgctgccgatcaattgcagcggcttgcccggcaggcgggtcgatgcgtaacgggagggaatgataacggtaaaggcggtggtcatttatccaggcgctcatcggtggtcagggtacgggcttcgctctcgagcatcaccgggatgccatcacggatcgggtacgccaggccggcgcccttgctgatcagctcggttttgtcggcgctgagcttgagcgggcctttgcagatcgggcaagcgaggatgtcgagcagtttggtgtccatgagtatttcctggaaaaagcggttaaggcaaaagtcgggcgggcagcaggcgcatcagttgtgtgtcgaaccaggcgacgaatgccggcgacggcaccgcgtccaccgcaaggtaccaccagtcaggctgggcaaaggcgcggcacttcaccgcgtccttttcggtcatgaccaagggtaatgacggcgtgaaattcaggacgtctgcgctgtagggcgcatggtcggcaaacgcatggggtattggccgccagtgtagcgtttcaagggtattgaagaaacgttgcgggttaccaataccggcgactgcgtgcacctgctggcctaccggaaaatgctcgggcgattggcgctcagcggttttcaagttgatcagcgccgtgggcaacaggcggaaagcaaaaccaccctcgcgatccgcggcggcaccgttatagagcaccgcatcaacgctttgcaggcgctcctcgggctcgcgcaaaggcccggccggcaggcaatggcggttgcccaagccacgggcggcgtcgatcagcaccagctcaaggtcacgggccaggcggtaatgctgcaggccgtcgtcggagaggatcaggtccagcggctcgctggcgagcagggccttaaccgcgcggctacggtcaggatcaatcatcagcggcacgccgctacgttgcacgatcagcaatggctcatcgccagccacttcagggctatggctggcctcgacccgccatggcaactgcggcggtttggcgccgtagccacggctgaccacgccaacgcgcaagccactgcgccgacaatgctcgatcagccacagtatcaacggcgttttgcccgtgccgccgacagtgatgttaccgaccaccaccactggcaccggcgactggtagatctggccctcgcccgccaggaagcgcgcacgcttgcgctgcaccacacggcgatacaacgattcgagcgggcgcagcagcgccagcgccggatgaccctcgtaccaggctttgagcaaacgatcggagatggccatcagggttgcgtcgccgcctcaacggtggtcatgcgcaaatgggtgaagccgagcttgccggcggcgtccatcgcggtgatcacggcttgatgctgggttttgccatcggcactgatcgacagcggcatttgcgtatcaccgccggactctttctgcagggcatccatcaggctgttgagatcgttcttctccagcaactggttattcaccgaaaacacgccgtcagcgctgatggcgatgtccagttgcttgacttcctgatcctcggccggcgagccgcttaccgcttccggcaagtcgacgcgcaactgggtttgccgggtgaaggtggtggtgacgacaaaaaacagcagcaggatgaacaccacgtcgatcaacgacgccaaattgatatcgacattttcccgttgcttgcggcgaaacttcacactcggccctcgacaaaatcgacatcacgatcgccctgcaccacttccaccagcttgatcgcttcctgttccatgccgaccaccagctcgtcgatgcggcgctgcaggaaacggtggaaaaacaccgagggaataccgaccatcaggcccgcagccgtggtgatcaaggccttggagataccgccggccagcaccgccgcattcgtggtcatgccagagcccatgaacgagctgaaaatatcgatcatgcccagcaccgtgcccagcagccccagcaatggcgccatggcggcgatggtgccaagcgcattgatgtagcgctccatttcatggatgacccgggcggcggcctcttcgatgcactctttcatgatctcgcggccgtgcttggagttggcgaggccggcggcgaggatttcacccaagggcgaattggcgcgcagttccttgagcttgtctttgtccagttgcttgttcttgatccagccccacacctgccccaatagatgctcgggggtgatgcggctggcgcgcagggtccagaggcgctcggcgacgatgccgagtgcggcgatggagctcaagatgatcggcaacatcatccagccgccggatttgaccaattcccacacagtgaatgtcccctcgaaaaagtgcgccactttaccatataggttcgccggcggggctcgtcggccacagacccgcccgtcgccggcctctgccaatggtaacgtcgggttacagtagcgcttcgcgccagaaacggcgttgactgcgcgcaacaaccggggcttgaaaggcgcccagttgcagacgtacggcgccctgctcggcgctgtcgtagacacggctgcccaaagcccgataacgctgcatcacctgtggatgcgggtgaccgaatgcgttgccacggccacgtgaaatcagcaccgacttgggcgcaagctgctccagaaagggcccggatgaagagctgcgactgccatggtgcggcgcttgcagccaatcggtcggtacggccaaggctgacgcgagaaaggcgtgctcggcagcgcgatcaatgtcgccggtcagcagcaggcgttcgccattggcctggacccgtaacacacaggatttcgggttgctgtcagtggcacccggccacctccataactcgaacaacacgccatcccacgcccattgctcaccactgacacacggctgaaccgcaagcaatgctggcaacccttcgacctcgccacccacgacccgcttcaccgccagcgcgcgggcgaccgctgccgcaccgcccgcatgatcggcgtgagcgtggctgatcagcatcatgtccaacgcctcgaccccgagcttcctcaaggctggcaccaccacacgttcgcccatgtcaaatgcccccgagcgcggcccggcgtcgtacagcaaggtgtgatggcgggtgcgcaggatcaacgcttgcccctggccgacgtccaattgcgtcacctccacctgcccatgcggcaccagttgcctgggtggaaaaacggccagcaacagcatcggccaacccagcagccggaacggcacgcctttgggcaacagcaataacactgcaccggtcaggctcacccaccaataacccagcggcacctcggccggtatccaggccgggctttgccctgccagcagcgccaaacccctgaacagcccatccagcgcgccgccggccaaccacaacaggcccggcccgaccaacggcaccgccagcaacgcagtgcccagcaatgccagcggcaacaccacgaagctgatccacggcaccgccaataaattcgccagcggcgcactcaggctgatcggcaaccccagcaccagcaaaaccggaaacaagccaatcgcaatcagccattggggacgcgtccacaactgccaccagttccaggcgcccaggcgcccgctgaacgcgagcaccagcaccgcgacggcggcgaacgacaaccagaagcccggttgcaagctggccaatggctccagcagcaatacagcattgaatgccagcaacaacggccaccacacgcccaaatgtcgaaagcgcaaacgccacagcagaaccagcccgaccatcacacacgcgcgctgcaccggcacgccgaaccccgccaataagccgtagcccagcgcggcggcaaacgccagggcgcacgcccatggcagccacggcaaggcgcggggccagcagccgtaacgcgccagcccggccaccaagccgtagatcagccccgccagcaaaccgatgtgctggcccgagatcaccagcaggtgcaccgtgccggtgtcttgcaacacctgccagtcctcagtgcccagccccgagccgtcacccagcagcagcgctgccaaacccgcctctcggccctgggcatcgacgctgctcaggcgctgccggaggctgtcgcgccaggcattgcgggccggcgccaggcgttggccatctttcaccgagccggttgcgccaatgcgctgggccagtagccaggcttcatagtcaaagccatgaaaattgagcaacccagacgggcgcttcaacgtgaccgccaggcgccaacgctcgccactgttcacctgcgggccaccatgccaggacacgcgaatgcgcttgggcagttgagccttgcgcgagcggttgtcggtcaactcgaagcgtacaccggtgcttgtctgttgcggcagcccgactacgcgcccctctacccaacgcgtctgaccatccagtgcaggcgtaaggcgatcatccagggccgactgtgcgctaaggcaggcccaactgatccccagcaggaaaaacgccaacggatgggtacgaaaaggcagcagcatcaatgccacaaccgacattgccagcagccaaccgatagaaggcagcgctgggaaaaatcgcagcgacagtaggccaagtccgagggcaaacatcccagttctcatgaatcatccttttcaagtgatccatcagtcttagttggcccacccgcacggcctatgatgttttgtcacaaagtctgaattttctgtttatagaatgcgggcatacttgcccctcgaactgacctggaccccttatgccccggcgcttattcaaacggtacatgcccgaccccacaagtatccgggaacacaagtccttacgatttctcggcaagttgctgcatgaccccaacctctggcacctgaaccggcattcagtggcacgtgccatggccgtcggtttgttcgcggcgttcatcccgattccgttgcagatgttattggcggcggtcctcgcgattgccgtacgcggcaatatgcccattgccgtcagcctggtgtggctgaccaacccgatcaccatgccgttcgtattcgtcggcacctacctgaccggcgcctggctgatgaatgtgccgccgcgcagcctccccgacaacctgacctgggaatggatcagcagccagctgagcacgttgtggcagccgttcctgttgggctcggtggtctcgggcctggtgttgggcgcactggcctattgcctgaccatgggctattggcgttggtgggtcgcgcaccagtggaagaaacgcaaacagcgtcgcgcgtgacggtcacaagtgcccttctcctgatcgtcaataaaccccgccaccccgcaccacgcctccacaggcacgcatagcctgctccgccaatcgcccgaagattgccgcataacattaatttgcgagattccaggccgcgcaaatggctacactgcgcaggtggcgtgggccggatgcctgcgcggatgattgatatcaatgtggtagcaggagagtggcgtgcttagaagaatggggataaaaggccgcgtactgttgctgaccttattaccgaccagcctgatggccctgttgttggggggctatttcacctggatgcagctctcggagttgcaaacccaattgctgcaacgcggcgaaatgatcgccgagcagttggcgccattggtggccccggccctgagcagcagcaataccgacttgctcgaacgcatcgccacccaatccctggaacaacccgatgtacgcgcagtttcattcctcgcgccggaccgctcgcccctcgcacacgcgggcccgaccatgcttaaccagccaccggtcggcaacagctcccacctgctgcagcgcaccggcaatgacgccacgcgttacctgctgccggtgtttggccgccatcgcaacctcgccggcgaactgatcccggacgaagccgaccgcctgctgggctgggtcgaagtggagctgtcccacaacggtatgctgctgcgcggctatcgcagcctgttcgccagcctgctgttaattgccatcggcctgatctgcaccgccgcgctggccctgcggatcagccgcacgatcaattcgccgatcggccagatcaaacaggccgtggcccagctcaaggacggcaacctggaaacacgcttgccgccgctgggcagccaggaactggaccagctcgcttcgggcatcaaccgcatggccgaaaccctgcaaaatgcccaggaagagttgcagcacagcatcgaccaggccacggaagacgtgcgccagaacctggaaaccatcgaaatccagaacatcgagctggacctggcacgcaaggaggccctggaggccagccgtatcaagtcagaattcctggccaatatgagccatgaaatccgcacgccgctcaacggcattctcggtttcactcacttgttgcaaaaaagtgagctgtcgccgcgtcagctggattacctgggcactattgagaagtccgcggacaacctgttgggcatcatcaacgagatcctcgacttctcgaaaatcgaagccggcaagctggtgctcgacagcgtaccgttcaacctgcgcgacttgctgcaagacaccctgaccatcctcgcccccgcggcccatgccaagcagctcgaactggtcagcctggtataccgcgacacgccgctggcgctggtcggcgacccgttgcgtctcaagcagatccttaccaacctgatcagcaatgcgatcaagttcacccgcgaaggcaccatcgtcgcccgggcgatggtcgaggatgagcaggaagacagcgtgcaactgcgcatcagtgtgcaggacaccggcattggcctgtccaaccaggacgtgcgcgcgttgttccaggccttcagccaggccgacaattcgttgtcacgccaaccgggcggcaccggcctgggcctggtgatttccaagcgcttgatcgagcagatgggcggcgaaatcggcgtcgacagcacgccgggcgaaggctcggaattctggatcagcctgagcctgcccaagacccgtgacgatgttgacgacctgccttctgcgccgctgcttggccggcgtgtagcggtattggaaaaccacgaactggcgcgccaggccctgcaacaccagttggaagattgcggcctggaagtcaccccgttcaacaccctggaaagcctgaccaacggcatcaccagcgcgcaccagactgaacaggagattagtttggccgtgctcggcgtcaccgccaatgacattccgcccgagcgcctgaaccaacacttatgggaccttgagcacctgggttgcaaggtgctggtgctgtgcccgaccactgaacagatgttgttcaaccaatctgtgcccaaccccaatagccaattgcaggccaagccggcctgtacgcgcaagctgcgccgcgccctagccgacctgatcagcccgcgcccctcgcgcagcgaacccggcgagccactgtccagccgcgcaccgcgagtactctgcgtggacgacaacccggccaacctgctgctggtgcaaaccctgctcgaagacatgggcgccaaggtccaggccgtggaaagcggttacgccgccatcgacgccgtgaagcaggaaaccttcgacctggtcttgatggacgtccaaatgcccggcatggacggccgccaaagcaccgaggcgatccgccaatgggaaagcgagcgccacgggacgccgttgccggtggtcgccctcaccgcccacgccatggccaacgaaaaacgtgccctgctgcaaagtggcatggacgactacctgaccaaacccatcagcgaacggcaactggcccaagtggtgttgaagtggaccggcctggccctgcgcaatcaagggccggaacgcgtgaccgacggtgttggcagtggtgcgcaactgttggtactcgaccatgaggaaggcctgcgcctggccgccaacaagaccgacctggccgccgatatgctcgccatgctgctggcgtcgctggaggccgaccgcctggccattaccgtcgcccgcgaagccaacgacaacaacgccttgatcgaacgcgtccaccgcctgcacggcgccacccgctactgcggcgtgccgcaactgcgcgccgcctgccaacgcgcggaaaccctgctcaagcaagacgacgccaaggccatggccgcgctggacgaactggacatggcgatcgcccggctggccagtgaggcgcgcgtcagcgcttgaaccctcttagcaggtgacgggcttgtgtgggagcgggcttgcccgcgaaggcgacaggtcaggcagtacatgagttggctggcccaccgctatcgcaggcaagccagctcccacattttgaccgcattgttcatgttggaacccggccaactgtgggagcgggcttgcccgcgaaggcgatgggtcaggcagtacatgagttaactggcccaccgctatcgcaggcaagccagctcccacattttgaccgcatgctcatgttggaacccggccaactgtgggagcgggcttgcccgcgaaggcgacaggtcaggcagtacatgagtcgcctggcccgccgctatcgcaggcaagccagctcccacattttgaccgcacgctcatgttggaatccggccaactgtgggagcgggcttgcccgcgaaggcgataggtcaggcaatacatgagtcggctggcccaccgctatcgcaggcaagccagctcccacattttgaccgcatgctcatgttggaacccgctcccacaggagtaatatatttaatgagtaagagcagggagcttttttgatgcgcgtgattcttttcagcagccaaacctacgaccgcgacagttttctcggcgagccgctgccggcgggccttgagctgcaattccaacctgcccggctcaacctcgacaccgtggccctggccgaacaccacgaggtggtctgcgcctttatcaacgatgacctcagcgcgccggtgctggaacagttggccgccggcggcacacgcctgattgccctgcgctcggccggttataaccatgtcgacctgcccaccgccaagcgcctgggcctgaccatcgtgcgcgtgccggcctactcgccgcacgcagtggccgagcacgccgtggcgctgatcctcgcccttaaccgccgcctgcaccgcgcctacaaccgcacccgcgacggagatttcagcctgcacgggctgaccggtttcgacttggtgggcaagaccgtcggcgtggtcggcaccgggcagatcggtgccaccttcgccaaaatcatggccgggttcggctgccagttgctggcgtacgaccccttccccaacccgcaggttctggccctcggcgcccgttacgtgagcctgcccgagctggtcgcccaagcgcagatcatcagcctgcactgcccgctgactgccgacagtaaacacctgatcaacgcccgctccctggcccggatgcaacgcggcgcaatgctgatcaacaccgggcgcggcggcctggttgacacgccggcgctgatcgacgccctcaaggatggccaactcggctacctggggctggacgtgtatgaagaagaagcccaactgtttttcgaggaccgctccgacctgccgctgcaagacgatgtgctcgcgcgcctgctgaccttccccaacgtgatcatcaccgcgcaccaagcgttcctcacccgcgaagccctggcagccatcgccggcaccaccttgagcaacatcgccgcgtgggccaaaggccagccacaaaacctcgttgaaggatgatcagcggtcacataccaggctcatgatgagcaggcacccgtgataggatgccgcgcctatttggaggatccatggccgaacacgatttccgcttcagcttgctgagcccgcaacacaccctgatcgaatgccgcgccctggtgccgggccgttatcaaatcaccggcaatgggggttcgatcaagcatggcgacgtgctgatcgtcaccctgcgcggcagtaaaaccctgtcgatgcgcctgaccgtcgaaggtgatgcgcgctactccatccgcccggcgggccagtgggtcgccatggcccaggggccgaaattcggcgagctggaaattcatacctggaaggtcaactgcgacagctgcgacagcgtgctggagtttgaattcgcggtagaaaccaagctgaccaaagagcccctgcaaccggctgccaacgcgcgcatccaggaactgggctgggtgagcatgggcgacaagcaccgctgcccgaaatgccagcaggcggcacaatgaaaggcctgcttctgctcgcggccgttggcgttggcctgatgggctgcgccggcgatgccgtgaagctcaagcaggatcacagctacgtggtggagtggattggtgagcgcccgctgatggattacgcgcacctgaccgtcaccctcggcgccgatggccgcgcctacggcaatggcggttgcaaccactggtttgcgccgtacaccgtggatggcgacaagctgagcttcggcaagatcggcagcacccgcaaactctgcgccgaggcgttgatggagcaggagcaccgcttcttccaggccctgcaaggcgtcgagcgctgggacatctcccccctcgaacagacgcgtttctggcccgctgaaggcaagccgattcggctgtggcttgaagagggctgatactcccaatctgcggatgggtgggatctaaatgtgggagcgggcttgctcgcgaaggcggtggatcagtcagctaatgtattgactgacacactgcattcgggagcaagccccctcccacatttgattgggtacaactctctagccgcgcaaggccttaagtttcgcgagcaccccttgtgccgtctgctcgcccatcaactgctcacgcaccttgcccttgtcatcaatgatgtaggtcaccggcagcgcctcgctgcgcggaatatcgaaaatctcctccgggttctgcgccagtacggtgaacttgatccccagcttctcgctggcggccttgagttcttcaccctgcacattgtcgaagttgaccccgaacacccccacgttctgccctttaagctgctcggccaaggcattcaattccgggatttccgtgcggcacgggccacaccattcggcccagtagttaaccactacccattgcttgtccaggcgctccgacgcgactttcttgccgtactggtcaacgccgtagtcgttaccgcagccgctgagcagcagggttgtgatgatcgccaatgcaccgatcagtcgccttgtcatggggtaatccttcgcaaaaaaatgaacgttggctgcgacctatcgcctcttacggtttaaggacgggacgctgcgcaggtagaatacccgccaccttacgcaagatgcgacccgcacatgaccgatctgacgctttatcacaacccgcgctgctcgaaatcccgcggtgcgctcgaactcctggaagcccgtggcctgacgccgaccctcgtgcgctacctggaaacgccgctgaatgccgcgcaaataaaggccttgctgggcaagctgggcatcagcgcacgccaactgctgcgcaccggcgaagacgactacaaaaccctcaacctggccgatgccagcctcagtgaagcgcaactgattgttgccatcgccgagcatccgaagttgatggagcgcccgatcctggaaaccgccgataaagccatcattggccgcccgcccgaaaacgtgctggagctgctgccgtgaccgcgccgtatgtgctggtgttgtattacagccgcaatggctcggtcagcgaaatggcccggcagattgcccgcggcatcgagcaaggcgggctggaagcacgcttgcgcaccgtgccggcgatctctaccgagtgcgaagccgtggcgccgagcatccccgacgaaggcgcgctgtatgccagcctggatgacctgaaaaactgctcgggcctggccctgggcagcccgacgcgcttcggtaacatggctgcgccgctcaagtatttcctcgatggcaccagcaacctgtggctcaccggtgccctggtcggcaagccggccggcgtgttcacctccaccgccagcctgcacggcggccaggaaaccacgctgatgtcgatgctgctgccgttgctgcaccacggcatgctgatcaccggcctgccctacagcgaacaagcgctgctcgacacccagggcggcggcacgccgtatggcgccagccaccacgccgggccggacggcaagcgcatgctcgaccaacacgaaatcaccttgtgccgcgccctgggcctgcgcctggccaccaccgccacgctgctggagaacggccgtggccagaaagcctaaggtcctgccgccccaggcgtggctggaaccacgcgtgaaggtggcacgcacgctgagcctgctggcgtttcttggcctggtcacgctgctgtgtgtgtattacctgtttatcgccgacctgcacggcgcacgtccgtgggtgatcctgctgatcgagttggtgccgctgctggtgctggcgccgggcatgctgctgggcagcgcacgcgggcattcgtggctgtgctttgtggtgaacctgtacttcatcaagggcgcgctggcggcctatgacccgaaccggcagtggttcggggtgctggagatgctcgcgagtctggcggtgttttgcacggcgctgctgtatgtgcggtggcggcaccagttgaatcggcggttggctcaagcccagggtgtctgatagtcagtcatcgcaggcaagccagctcccacatattgaccgcatgttcatgttggactccggccaactgtgggagcgggcttgcccgcgaaggcgataggtcaggcagtacattagttggctggcccaccactattatcgcaggcaagccagctcccacatttgatcgacggcgcggtcaaaatgtgggagctggcttgcctgcgataggatcaactcggtcttaatggttgaccgtgtaagccagcatcatcgacaactggcacatcggccgcccactttcggcgtgccactggttaaacgccccttgcaccgcggccaaatcccgcaggctggtcggcgctttgtcgacgatcttctgcgcattcagcgccgccaccacgtcatagctcggtacaaacgtgtccttgccgaccatgcgcaaaaagcgcggcgccgacagcccgcccaattggtggccgtgcttgatcaggtacttccataagccaacgatgtcggtcaccggccactcggcgataaatgcgccgaaactgcccttctcctgctcgatgtcgaggatcatctgcgcattgcgcggcacgctcttgagcttgcccaggtgacgaatgatgcgcgtgtcctgcatcaagcgctccaggtgttcggcgcccatcagcacgaccttttccgggtcaaacccaaagaatacctgctcgaacgccggccacttggcatccaccacgctgtgcttgagccctgcgcgaaacacgcgcagcgccagggtcgagaggtagcgatcgtcgctgatcttgcgcaattgcgccggggtcttgggtacaggcagatgggcttccaactcggccgctgaaccaaagcggttcagacaatattcgtgcagccacttgtaatcgcgcatgccctctcctgggatttgaattgaaaacggcgcccgtaagcgccgtctttcagagcgttgaaaagtgttagaggttcacaacattgacgaagcgcgaagcggcgctctcatcgattttcaggctggtgaagtcaaacaggttgcggtcggccagctgcgacggctgcacattctgcaggctgcggaagatgctttcggtgcggcccggggtcttgcgctcccagtccacgagcatttccttgaccacctggcgctgcaggttttcctgggagccacacaggttgcacgggatgatcgggaactgcttgaagtcggagtaggcctggatgtctttctcgttgcaatacgccagcgggcggatcaccacgttgcgcccgtcatcggcgcgtagcttgggcggcatggccttgagcgagccgttgaagaacatattgagaaagaaggtttcgacgatgtcatcgcggtgatgacccagggccatcttggtcgcaccgatctcatcggcaaaggtatagagcgtgccacggcgcaggcgcgagcacagcgagcaagtggtcttaccttccgggatcaactccttgaccaccgaataggtgtctttttcgacgatgtggtattccacgcccaactctttgaggtaggccggcagcacgtgctcgggaaagcccggttgtttctggtccatgttgacggcgacgatctcgaacttgatcggtgcgaccttttgcaggtgcagcagcacgtcgagcatggtgtagctgtctttgccgccagagaggcagaccatgactttgtcgccctcctcgatcatattgaaatcggcgaccgcttcaccggccaggcgacgcaggcgtttttgcagtttgttctggttgaccgtaagagtgcccatggcgcttggatccgctagaggtgtgtgacgaaaagccgggtattttaccttcatgaccgaacgagttccaatgtgggagctggcttgcctgcgatggcggtatcccccaaacaattaaattggctgacccaccgctatcgcagacaagccagctcccacagtcgaccgagtcgttattgacagacctcaccgcgattagggccaatgtttacagcgcaatttgctctaaagccccacagtttttccggtcatcacttcctatactgcgacttgaggtcgcacaactatccaggacctttgaggccatttggcccgtgggcgctccgatggggggcgatagaaataacgacaggagtgactggcatgatccatcacgtcgtggggctgtttacccatcccgaccaggaatggcgggaaattcgtggcgataaagaagaaagcatcggccacatgtacctcactcacaccctgattctcgcggcgatccccgccgtctccgcctttatcggcaccacccgggtcggctgggtcatcggcagccgcgcgccggtcatgctcacccaggaaagcgccttgtggatgaccctcatgtcatatgcggccatgctcggcggcgtggcggtgatgggcgcgttcattcactggatggcccgcacctatgacgccagcccgagcatggcgcgctgcgtggcgttcgccacttacacggcgacgccgctgtttatcggtgggctggcagcgctctacccgcatatgtggctggggatggtcgtgggtacggccgccatctgctacacggtgtacctgctttatgtggggctgccgacattcatgagcatcgacccggacgaaggcttcctgttttccagctcggtactggcggtaggcctggtggtactggtggcgatcatggcatttaccgtcatcgtctggggcttgggcgtaggcccgatctatacaaattaatctgctaaaaccgtaggcaaagccaccgcaaggtggctttgtgcgtgatgcacgaccattcggcgcctgacagattcggaaacacctgcttttgcggcatactggacgtctctggagatatggtcagcatgcccgagcaactcaatacccgcgtcgaagattgtttcctgcaagccgaatcctttttcaaacgaagcttcaaacgcccccaggtcagcctcaagctgcggggccagaaggccggtgtcgcgcatttgcacgagaacctgctgcgtttcaacccacagttgtaccgtgaaaacagccaacacttcctcaagcagaccgtggcccatgaggtggcgcacctgatcgcccatcaattgtttggcgaacgcatccagccccacggcgaggaatggcaactgattatgcgcggagtttacgaactgccgccggatcgctgccacacctatgaaatcaagcgccggcaagtgactcgctacatctaccgctgcccgtgtgccgacagtgatttcccgttttcgtcacagcgtcatgcattggtgagccagggccggcggtatttgtgtcggcggtgtcggcatactctggtgtataccggggaaactcgggtggagtgagtgcccccatcgcaggcaagccagctcccacagggtcaagaggtgggagctggcttgcctgcgatagcgcccgggcagtcaaccaatcactttggcctgccgcaattctgatatgcgctgagcactgaagcctaactcagccaacacctcatcactgtgcgccccaacggccacacctatatgccgagcctgcggcaacccctctgaaaacttcaacgggcaggctatctgcgcctgagtcgagccatcaccccttggcacctggctgaccagctcccgcgccttcaactgcggatgctccagcgcttcgctcaggctcaacaccggttccacacacgcatccacgcccgcgaacagctcacacaactcagcaaagctgcgcttctcgaactcaacctgcagcgccagcttcagggctttttgctgctcggggttgggggacaggccttgcgccgccagctccggtcgccccaatgccgcgcacaactgctgcataaacgccggctccaggctgccgaccgacatccagcgcccatcccgggaacggtagtaatcatagaaactgccgccgttgagcacatgggtttcccatgcaggctcgaccccacacgccaggtaacccgcaccggccatggcgttcaggctgaacgaacaatcggtcatgctcacgtccaggtattggccgactccgctgtgctgccgcgcaatcaccgccgccagcaaccccactaccgcgtgcagcgagcccccgccgacatccgccaattgcacgcccagcggcagtggcccactgccctggcgcccggtatggctggcgatgcccgccagcgccaggtagttgatatcgtgcccggcgcggtccttgtagggcccggtttggccgtagccggtgatcgacacatagatcagccgggggttgatcgccttgagcgccgcatagcccaatcccaagcgctccatcacgccggggcgaaactgttcaatgagaatgtcgtagtccttgaccagctcgtgcacgatcgccaacgcctcggcctgcttgaggtccagcgccaggctgcgcttgttgcgattgaggtaggcgtggctcgccgacgtgccccggtcatggggcggcaacacgcgcaacaggtccatgcgcgtcggcgattcgatgcgcaatacctcggcgcccatgtccgccagcatcaaggacgcaaacgggccaggcagcaaggtggaaaaatccagcactttaagcgacgccaagggacctgacatgggcactccatttcggtttcgaatgcccacagcgtaggcaggcttggtgctaccggcaatcgtcagaacgatcagcgacagtgaccgttttgatcacggcgggctttttcgcggcggcggctttatcattggcccacgtttgcttgcagagtgctccatgaagtttgccattgctgtgttttccgccgcccatgcgccctcctcgcgccgcgccttgctgttcgctcaggcggcgttggcgggtgggcatgagattgtgcggctgttcttttatcaggacggcgtctacagcgcgtccaacaacatcgttgcgcctcaggatgagcaagacattgcccgccaatggcgcgagtttgtcagcacccaccagctcgacggcgtggtgtgcatcgccgccgccttgcgtcgtggcgtactcaacagcgaagaagccacgcgctatcaacgcagcgcggtgaacctcgatgcgccgtgggcgctgtcaggccttgggcagctgcacgacgcggcccagtctgccgaccgcctgatttgttttggagggccgtgacatgtccaaatccttattggtgatcagccgtcaggcaccgtggtccgggccgagcgcgcgtgaagcgctggatatcgtgctggccggtggcgcctttgatctgccgattggcctgctgtttatggatgacggcgtgttccaactggcgccgcaccagagcgccaaggccgtgcagcaaaaagacctcagcgccaacctgcaggcattgggtctgtttggcattgacgatgtgttcgcctgccaccacagcctcgccgaacgcggcctggcgccgcccgccagcgcccagccgctgagcagcacagaaatctcccagctgattgaccgttacgaccaggtgattaccctctgatgtcgactttacatgtggtgtctcactccccgtttaccgacggccgcctggccagttgcctgcgcgtgtgcggcagcgccgacgcgatcctgctgtgcggcgatggcgcttacggcctgcataacccggccctgcaaacccagggcgtgaaggtgtttgtgctggccgaagatatgcaggcgcgcaatctgccgctgccggactgggccgacagcgtggactacccaggttttgtgcaactgtcgattgactacgacaaggtcaacacctggctatgaacaccctgaccgtcggttcacgcacccttgagctggataaggacggctacctcgccgacctgaatgactggtctgccgaggtcgccgatgccctcgccgccgccgtaccgctggaattgactgcggcgcactgggaaatcctcgaactgctgcgcggcttctatgcagagttccagctgtcgcccgccacgcgcccgctgatcaagtacaccgccttgaagctgggcccggaaaagggcaacagcctgcacttaaacacactgttcaacggcactcccgccaaactcgccgccaagctggcgggcctgcccaggccgacgaattgcttatgaccgactttgccccgctgacccttgaaacccctgccgagcacccgtttgcgcagttcgtgcgcatcctgggcaaaggcaagcgcggcgcgcgcaacctcacccgtgaggaagcccgcgaagccatgggcatgctgctcgacgaaaaggtcgaagacacccagctcggcgccttcctgatgctgctgcgccacaaggaagaaagcccggaagaacttgccggcttcaccgaggccgtgcgcgaacgcctgaacgccccggcgctgaatgtggatgtggactggccgacctatgccggcaaaaaacgccacctgccgtggtatctgctggcggccaagtgcctggcgcaaaacggtgtgcgcattctgatgcacggcggcggcgcccacaccgcgggccggttgtacaccgagcaactgctcgaaggcctgcaaatcccgttgtgccgcaactggcagcaggtcgagacggctttcgagcaaggcaacctggcgtttattccgctgggcgattgggcaccgcagttacaacgcatgatcgacctgcgcaacaccctgggcctgcgctcgccgatacattccctggcgcgcctgctcaacccgctgaacgcgcgttgcgggctgcaaagtattttccaccccggttaccagggcgtgcaccgcgacgccagtggcctgctcggtgacaatgtgattgtggtcaagggcgatggcggcgaagtcgagatcaacccggacacgatcagccacctgtacggcaccaccggcggcgagagctgggacgaagaatggcctgccctctccgcccaacgccacgtcaaacctgccagccttgagcctgaacagctgaaggcgctatggcgtggcgatgtcgaagacagctacccgcaattggctctgatcgccaccatggccctggccttgcgcggcctcggccacccacgggaacaggccttcgagttggcccagcagtattgggacgcacgggacagatcgatttaaccgatcattagcgcccggtctttgcgcttttagttcgaactcatccctttagactgggctccaacgcttattagccgaggagccagtcatgggtttgctgatcgaaggacactggaaagaccagtggtacgaaagtagcgcagacggcgcgttccagcgcgaacaggcgcaacggcgcaattgggtcaccgccaacggcgagcccggcccaagtggcgacggcggcttcaaggccgaagccggccgctaccacctgtatgtatccctcgcctgcccctgggcccatcgcaccctgattatgcgcaaactcaagggcctggaaagcctgatcgatgtgtctgtggtcagctggttaatgctggaaaacggctggaccttcgacaaggcccacggctctaccggcgacaagctcgatggtttcgattacatgcaccagcgctacaccgccgacactgccgactacaccggccgcgtcaccgtgccggtgctgtgggacaagcagctcaagcgcatcgtgagcaatgagtcggccgagatcatccgcatgttcaacagcgcgtttaacgggctgaccggcaacacgctggacttctaccccgaagggctacgcccgaccatcgacgcgctgaacgagcgcatctatcccgccgtgaacaacggcgtgtaccgcgcaggcttcgccacctcgcaacaggcgtacgaaagcgcgtttgatgacgtgtttgccgagctggatcacctggagcagcatttgggtgagcaccgttacctggccggtgagtacctgaccgaagccgatgtgcggctgttcaccacgctgattcgttttgatgcggtgtattacagccacttcaaatgcaatttgcggcggatcgccgattactcgaatttgtcgaactggctaagggagatgtatcagtggccgggcgtggccgagacggtggattttgcccatatcaaggggcattactacgcgagccaccgcacgattaatccgacggggattgtgccaaaggggccgttgcagaggtttgatgcagggcatgatcgtgagcggctgagcggtaaagctgtgtggagctgatgatcgttcccacgcgcagcaaaggaatgcagccctggacgctctgcgtccgctcttaaaagcacgacgcggagcgtcataggaggcattcccacgcggagcgtgggaacgagcagtgtcagacctgagactgcgcgccttcaaaccacttcagcttctcacgcaacaccaccacctcaccgacgatcaccagtgtcggcgcatgcacttcatgctccgccaccatgcgcggcaagtccgccagggtgccagtgaagacacgctggttggacgtggtgccttgctggatcagcgccgccggcgtatccgccgctcgaccgtgcttgatcaactgttcgcagatgatcggcaaaccgatcaagcccatgtagaacaccagggtctgcgacggcccaaccaagtcatgccaaggcaggtccgaggtgccgttcttcaaatgcccggtgataaagcgtaccgattgcgcatagtcgcgatgggtcagcggaatcccggcatatgccgcgcaaccactggccgcggtaatccccggcaccacctggaacgggatgccatgggccgccaactcttcgatctcttcgccaccgcggccaaagatgaacggatcgccacctttgaggcgcagcacacgcttgccttgcttggccaaatccaccaattgctggttgatctggtcttgcggcacggcatggtcggcgcgacgcttgccgacatacacacgctcggcatcgcgacggcagagttcgagaattgccggtgcgaccaagcggtcatacagcaccacatccgcttgctgcatcaggcgcagggcgcggaaggtcagcaggtcgggatcacctgggcctgcgcccaccaagtacacctcacccggcgcatgcggtggcttgccgttgactttctcgaccagcaaacgctcggcttcatcaccctgcccggccaactggcggtcggcaatcgggccttggaacacctcttcccagaacgcacgacgctgctgcacgtccgggtacaaacctttgacctgggcacggaaacgcgccgccaacccggccaactggccatacgtggacggaatccaggtttccagcttggcgcggatcaggcgcgccagcaccggcgcatcgccgccactggacacggcaatcaccaacggcgaacggtcgacaatcgccgggaagatcacgctgcacaaggccggcgcatccaccacgttgaccggtacgcagcgacgcttggcatcactggacacttgcgcgttcagtggctcgtcgtcggtcgcggcgataatcagggtgcaaccgtcgaggtcggcctcctgataaccgcgcaaaatcagttccccgccactgcccagcaccagctcacgcaactggtcttcgatctggggagcaaccacccgcagcaacgcaccggcgtcggccagcagccgggatttgcgcaaggcaatctccccgccaccaacgaccaacacacgactgccgcgcaggttatgaaacagcggcagaaattccatttagccgatgacctcaacgcccgccatgtacggcttgagcacctcaggcacacggatcgaaccgtccgcctgctggtagttttccagcacggccaccagggtacggcctacggccaggcccgaaccgttgagggtgtgcaccagctccggcttgccggtttccgggttacggaaacgcgcctgcatgcgacgcgcctggaaatcgccgcagttggagcacgacgaaatctcgcggtacttgtcctggctcggcacccacacttcgaggtcgtaagtcttgacggcgctgaaacccatgtcgccagtgcacagcgccagtacgcggtacggcagctccagcagttgcagcacgcgttcggcgttggcagtcaggccttccagggcttccatcgaggtcgacggctcgaccacttgcaccatctcgaccttgtcgaactggtgctggcggatcatgccacgggtatcacgccccgaagcgcccgcttcactgcggaagcacgggctgtgggccacgaacttgatcggcagttgcttggcgtcgaggatttcgccggcgacgatgttggtcagcgacacttcggccgtcgggatcaggtacaggtcggcttcgccgtcgcggctgatcttgaacaggtcttcttcgaatttcggcagctggctggtgcccatcagcgccggcgcctgcaccaggtacggggtgtaggcttcttcgtaaccgtgttcgccggtatgcaggttgatcatgaactgcgccagggcacggtgcatgcgtgcaatcgggccgcgcagcaaggcaaagcgtgcgccggacattttggcggcggtttcgaaatccaggccaccggtcagttcgcccagggcaacgtggtccttgatctcgaaatcaaaagccttcggcgtgccccagcggcgcacttcgacgttgccgtcttcgtcttcgcccaccgggacggattcgtgcggaatgttcgggatgcccagcaggatcgaatccagctcgctctgaatgccttccagctcgaccttgccgtcggacagctcggtgcccatgcgctcgacgtccgccatcagcggcgcgatgtcttcaccgcgctgcttggcctgaccgatggatttggagcgcgcattgcgttcagcctgcagtgcttcggtgcgggtctggacggtcttgcgctgttcttccagcgcttcgatgcgcgcaacatccaaggcaaagccacgggatgccaggcggtccgctacgtcctgaaggttgctacgtaacagtttggaatcgagcatgtcggtctctcgtttatcaaagtttggtcaaggacaggccagcccaggtggcgagcagcccgccgaacacgctgatgcccaagtacccgaaggcaaccagggcttgcccgctttccagcaagcgtatcgtgtccagtgaaaaggatgaaaaggtcgtcagaccgcctacaaagccgacaatcaagccggcgcgaatctcaatcggcacttccgggcgcaacaggaaccagccgtacaacagcccgatgatcaagcaacccaccaggttcaccgccaaagtcgccgcataaaaatgcttcggccaattggcgctcacccacgtaccggtggcgaaacgcaataatgtaccagcgatgccggctacggacacggcaagaatcgtcttgagcactactttctccgctgtttggggctgaggcgatcgagttgggcgaggtgattgagtttttcgccgatcttcagctccaggccacggggcaccggctggtagaacggctgcggctcaagctcatcggggaaatagtcttcgccggccgcataggcgtccggctcgtcatgggcatagcggtattcatcgccgtagcccaattgtttcatcagcttggtcggcgcgttgcgcaggtgcagcggcacttccagcgagccgtgttcggcagcggcgcgcagggccgacttgaagcccatgtacaccgcgttgcttttcggcgcgcaggccaggtaggtaatggcctgcgccaccgccaactcaccctccgggctgccaaggcgttcctgcacttcccaggccgcgaggcacaggctcagcgcacgcgggtcggcattgccgatgtcttcgctggccatgcgcaccacgcggcgcgcgaggtacagcgggtcgcagccgccgtcgatcatccgcgcaaaccagtacagcgcgccatccgggttggaaccgcgtacggatttgtgcagcgccgagatctggtcataaaaggcttcgccgcccttgtcgaaacgccggcgggtgtcaccgagcaggctttgcaacaggtcgacgccgatctcactgttgtcgtcggccaggtcggacgcgttctccagcaagttgagaaagcgccgaccgtcgccatcagcggcgctcagcaaaatcctgaagccttcgtcgctgagactcagctggcgcttgcccaaccccttgtcttcgcccaaggcgcgctgcaacagcttgcgcatcgcggcttcgtccaggctcttgagcacatagacccgcgcccgcgagagcaaggcattgttgagttcgaacgaagggttttcggtagtcgcaccgataaaaatcagcgtgccgtcttcgacatagggcaggaacgcatcctgctgcgacttgttgaagcgatgcacttcgtcgacgaacaggatggtgcgcttgccgtattgcccggcttgctgcttggcgacctcaaccgcctggcggatctccttgacccccgccagcaccgccgagaccgtttcgaagtgcgcatccgagaccttcgccagcaaccgcgccagggtggttttacccacccccggcggcccccaaaaaatcatcgaatgcagcgcaccctgctccagggcttcgcgcaaaggcttgccgcgagcgagcaggtgttcttgcccgacgtactcatccaggttggtcgaacgcaagcgcgcggccaagggttgagcaatcgggtcacttcgaaacaaatccatgggcagcgcttgaaacctctgggcagtttattcctggatcacgtcggcacccttggggatgacgaacttgaacttggaggcatccacaacgccgttggccttgaccgcggagaacaggatatcggtgcgctggccgacgctgtcgatcaggcgcatgttattgatcacgccgttaccgaacgacaattgcaggctgtcgaacagcgtgtccttggatttcggcttgagggtgaactcaatgacgttgctggtttgcttggaggtgatatcaaagctatcgctgattttcgacacatcgcccgacagcagcagcgccggggtctggttcaagcgcgggtcgagcttcttgatggtcgcctgttccaggtccgggtcccataatgtcactttctggccgtcggagacgatggtctgctcgttcggcgcgtcggttttccagtaaaacaggcctgggcgctgcacggccatttcaccggcggtttcctgcaactgggtgccgccgccatccagggtcaactgggagaagcgcgcagtcagggtcttggattggtccagcaggttggtcaggcttttgacggaggccggatcagcgtgggccgaaagggcggtcaaggccagggccggcaacaacagcatgcggataagacgcatgggagtcctcattgagtcgttagggcgtgccgcgtgctgccacgcggcacgggatcagtcgcgcatctgcccgggggcgatgacttcgcgcgagccgttggtgttcatggcggtcacgacgccggcgttttccatggcttcgatcatgcgggcggcgcggttgtagccaattttcagtttgcgctgcaccgcagaaatcgaggcgcggcggctttccagcacgaaggccacggcttcgtcgtacagcgcgtcggtttcggcgtcatcgtcgccaccgctgctgccaccgtcaaagccactgccggcttcttcgacaccggcgaggatgtcgtcgttgtattccggcgcgccgcgcagtttccaggcttccaccacgcggtgtacttcgtcatcggaaacgaacgcgccgtgaacccggatcggcaggctggtgcccggcggcatgtagagcatgtcaccatggcccagcagctgttcggcgccgccctggtcgatgatggtgcgcgagtcgatcttgctcgaaacctggaacgccatgcgcgtaggaatgttggccttgatcagaccggtgatcacgtccaccgacggccgctgggtcgccaggatcaagtggataccggcagcacgggccttctgggcgatacgcgcgatcagttcttcaaccttcttgccgacgatcatcatcatgtcggcaaactcgtcgaccaccaccacgatggtcggcagcttggtcagcagcggtgcttcgtcatggatgctttcgcgcttgtacagcgggtcggtcagcggcgtgccggcgtcctgggcttccttgaccttggcgttgaagcccgacaggttacgcacgcccatcttcgccatcagcttgtagcggcgctccatctcggcgacgctccaacgcaaggcgttggccgcgtccttcatgtcggtgaccaccgggcacagcaggtgcggaatgccttcgtagatcgacaattccaacatcttcgggtcgatcatgatcagcttggcgtcatccgggccggacttgaacaggatcgacaggatcatcgcgttcacgcccaccgacttaccggaaccggtcgtaccggccaccagcaagtgcggcatttttgccaggtcggtgattaccggcttgccgccgatgtcgtggcccagggccaaggtaaccggcgatttgaagttgtcgtattccggcgtcgacagcacttcggagaagcgcacgatctgacggtcttcgttgggaatctcgatgcccacggtagtcttgccggggatcacttccacaacccgtacgctggttacggccagggaacgcgccaggtctttcgccaggttggagatgcggctgaccttgacacctgcggcaggctggatttcgtaacgggtaatcacagggccaggatggatcgaatccacggagacttcgacgccgaattccttgagcttgatttccagcaggtggccgacagcggccagggattccggagagtaattgagttgtttcttttcagccgggtcgagaatcgagatcggcggcaaggtgccttccacggcgctgtcgacaaacaatggcgcctgtttctctttctgcacacgatggctcggctcgggcgccttgggcggcgccggggcgatcaccggcggcacctgcttctcgcggtccgacatgtgtttgctcagggcttgctcgcgctcgataaggcgttccttgaccttggcctgctcgcgtcggtccggcgtggtcggggccaccacctcattgacgcgggtatccacctcacgcagttgcgccaccatgcgcttgcgctcaacgcgagccgaccaccaacggttggcggcgccttggaacagctccagcaggtcgagggtgatcttgccggtcacgtccatcaccttgaaccatgacaggtcggtgaacaccgtgaggccgaacaggaacagcgcgataaacatcaaggtgctgccctggatattcagggtcttgcgcgccaggtcgccgaggctttcgcccagcgcaccgcccgcgcccgccggcaggccggtcggtgcatggaagtgaatatgcgccagcgcggcgccggacagcaccaggaacaccaggccgatcaaacgccaggagaacagccagccgctccactgccatggctcgtgacgctggcggaagatctgccaggtcttgatcgccagcagcagcgggaagatatacgcgaagtaacccagcaccataaacaggatgtcggcgctgtaggaaccggcggggccgccgaagttctgcacgtcttcgatcttgctgttgtggctccagccgggatcgtccttgccataggtgagcaaggccatcatcaggaacaggcacagcgcgccaatggcgatcagcgcgccttccttgagtcgatagtgcaggtgctggcgccaggcgggcacgactgctgctttaggtgtagcggcggatttcttcaaaacgggtcttttcctgcgcctttggcgcgtccatctgttgaatgactgcaaatactgcccaatccgagcagctgaaaattaaccaataccagtgaatctacgtttaacacccgctgatgtttgggtgaaatggcgacaacgccacaatggccgcattgtacgggtttgcgccgacgatgccacgcccttgcccatcaccggagagcatagacaattgaagtgtcacagcatgttcaatttgagcatgcattgtctttgctgacaaaggcttatgagctgtttttagcaatccaggcaagcttggcaaatggcctgcatggcccagccccgattacgaccgcacccacggagcagagttgcagcaacacgcgctcacgcttaaccgtgcggatatcggattcgggctggccccacggcgctgcgtcgacaataatcaccgttcttgcggcaggccacagacctgccactgccctccccttccgtaagcctggatgccatgctgacctggttgcaacgcgattgcctgacatttccgccgctggccaaggccatgcgcgaacccaatggcttgcttgccgccggtggcgacttgtcggccgaacgcctgatccaggcctatcgccacggctgctttccgtggttttccgaaggccagccgatcctctggtggtcgccagacccacgcacggtgatatttcccgacgagctgcatgtctcgcgcagcctcggcaaattgttgcgccagcagcgctataccgtgaccttcgaccaggacttcgccgccgtcatccaggcgtgcgccgcgccacgcagctatgccgatggcacctggatcaccgaaggcatccagagcgcctacctggcgctgcaccagcgcggctacgcgcactccgtggaggtgtgggaccagggcgagctggtcggcggcctgtatggcctggcgatgggccaactgttctttggcgagtccatgttcagccgcgccgataacgcctcgaaattcggcttcgccacgctgacccggcaactgcaggcctggggttttgtgctgatcgactgccagatgcccaatgatcacttgcacagcctcggcgcccgcgccataccgcgcagtgaattcgcggactttttgcgcaaccatttggatcaacccagctctggaccgtgggtttcctaggcgacttcctcgcacctggcttacacttatttcaacgcttatcccgagggttgatcatgaccgagctggcgcgcttgaagttttatgccactcaagcccactcttgcagctatctgcccgacgagcaggccaccacgctgttcctcgaccccagccagccgatggacgtgcatgtgtacgccgacctgtcggagatggggtttcggcgcagcggcgatcacctgtaccggccccactgccagaactgcaatgcctgcgtgccggcgcgcatcccgactgcgcagtttttgccggaccgcaaccagaagcgcatcctcaagcgcaatgccgacctgaccatcaccgccaccaaaccgcacttcagcgaagaatatttcgacctctaccagcgctacatcgaacaacggcatgccgacggcgacatgttcccgcccagccgcgatcaattttcgacgttcctggtgcgcgacctgccgttttcacgtttctacgagttccgcctggacggtcgcctgctggcggtggccgtcaccgatttgctgcccaacggcttgtcggcggtgtacaccttctatgaaccggccgaagaacgtcgcagcctgggacgctttgcgatcctgtggcaaatcggcgaagccctgcgccaggaactcgaagcggtgtacctcggatactggatcaaaaactgcaaaaagatgaactacaagacccaatatcggcccattgagctgctgattaatcaaagatgggtaacgcttaactagaaccccttggcttaaacaccctttttcgggcacaatgcacgccgcttttgcctggcgcagttgcaccgggccattcactggataccgagggctttactgcatgtcgaaagaagacagcttcgaaatggaaggcactgtcgtcgacaccctgcccaacaccatgtttcgtgtggagttggaaaatgggcacgtcgtaaccgcgcatatctccggcaagatgcgcaagaactacattcgtattcttaccggtgacaaagtgcgcgtcgagctgacgccctatgacttgagcaaagggcgcatcacctaccgcgctcgctaatcaagtcaatacaaagcgcccggttatgccgggcgtttttgtgtgtgcgtgatttaacagccataccttaaccctgtgggagctggcttgcctgcgatggcggtgggtcagataaagattttttcctgacagaacgctatcgcaggcaagccagctcccacaggtgacctcaattgctctagggggggaagcattccaggttcacagacagcaaaaaggcgcctttcggcgccttttgcttttcctgcaactatcgatcaggccatttcagccgtggtttcgaactcgaaggtcagctcgccgtccttcaggtcgatatgcaccacgccaccatggtcggagagttcgccgaacaggatctcttcggccaacggccgcttgatcttgtcctggatcagacgcgccattgggcgagcgcccattgccgcgtcgtagccaccttcggccagccagttgcgcgccgcgtccgtcacgtccagctgcacgcgcttgtcttccaactgcgcttgaagctcggtaaggaacttgtccaccacgcttttgatgacctcatggctgaggcgaccaaactggataatggtgtccagacggttgcggaactccggcgtgaagctcttcttgatgacttccatcgcatccgaagagtgatcctggtgcgtaaagccaatcgaagcccgcgcagcggtttcagcgccggcgttggtggtcatgattacgatcacattgcggaaatccgccttgcgcccgttgttgtcggtcagggtaccgtggtccatgacctgcaacagcaggttgaagacttccgggtgggccttctcgatttcatcgagcagcaatacgcaatgcggctgcttggtgattgcctcggtcaacagaccgccctggtcaaacccgacatagcccggaggcgcaccgatcaggcgcgacacggtgtggcgctccatgtattcggacatgtcgaagcggaccagctcaatgcccatggccttggccaactgccgcgccgcttcggtcttgccgacgccggtcgggcctgcgaacaggaacgagccgacaggcttgtccggcgacttgaggcccgcacgcgacaacttgatcgcggtggacaacgcgtcgatcgccgcatcttggccgaacacagtgagcttgaggtcgcgctccagattacgcagcagctctttgtcggaactgttgacgtgttttggcggaatccgcgcgatcttcgccacgatgtcctcgacttgctgcacgtcgatgcgcttcacgcgcttctcgaccggctgcaggcgctggtaggcacccgcctcgtcgatcacgtcgatggccttgtccggcatgtgccggtcattaatgtaacgcgacgccagctcagccgcggcacgcagcgcctcatcggtgtactcgatgccgtggtgcgcttcgaaacgccccttgaggccgcgcaggataccgatggtgtcttcaaccgaaggttcggacacgtcgactttctggaagcggcgcgccagggcacggtccttctcgaaaatgccacggaattcctggaacgtggtcgaaccgatgcagcggatatcacccgacgacagcagcggcttgagcaggttcgaggcgtccatcaccccaccggatgccgcaccggcaccaataatggtgtggatctcatcgataaacaggatcgcctgcgggcgttttttcagctcaccgagcaacgccttgaagcgcttctcgaaatcgccacggtacttggtcccggcaagcaacgcgccgaggtcaagggagtagacgacgctgttggccagcaggtcaggcacctggttatcgacaatgcgcttggccaggccttcggcgattgcggttttacccacacctgcctcgcccaccagcaacggattgttcttgcgacgacgcgcgaggatctgcgctacacgctcaacctcaagctcacgccccaccagcggatcgatccgcccctggcgcgccagttcattgaggttgctggcataggcatccaatggattgcccgaagaagaagactcaccgccctcgtcgtcctgcatatcctgctcaccctcggaatgatcgccgtgcccaggcaccttggagataccgtgggcgatgtagttgacgacatcaatacgggcaacgctctgctgtttcagcaggaacaccgcctggctttcctgttcgctgaagatcgccacaagcacattggcgcctgtgacttcacgcttaccggagctctgtacgtggaaaacagcacgctgcagtacccgctggaagcccagggttggttgggtctcgcggtcctcgtcatgcacggggatcagcggcgtggtggagtcgataaactcctgcaggtcatgcttgagtttgtcgaggttggcgccgcacgcacgtaaaacggtggcggcagcttcgttatccaaaagtgccagcagcaggtgttcgacggtcatgaactcatgacgcttcgaacgagcctccttgaaggcaagattgagggtgacttcgagctcgcggtttaacatagcttcacctcatacccaagtggtcggcgttaaccgtccttctcgatttcacagagtagcggatgctggctttccctggcgtactggttaacctgcatggcctttgtctcggcgatgtcgcgggtaaacactccacatactgctcgtccctctgtgtgaacggccagcattaccttggtcgccaactcgcggttcaggttaaaaaacacctcgagcacttcgaccacgaaatccatcggtgtgtagtcatcattgaacaaaaccaccttgtacatcggcggcgcctgtagggcaggcttcgcttcctgaacagcaatgcctgcagaaccgtcatcatcgtgttcctgatccggacgatcctgattgaatgttagtcgaatctggctgtttgcatgcatggaaagaaaggttcgtcagtggttcaaatacagtggtgggggcgacctgtcagaatttcaacactgaccgtatggtcgccttgactatcggcgaaacggtgttacaaccaatagagcccacagtgggtaaaaaaggtccgcgcagtcaaccttatttattcgggttaggacggataaactggatgatactccagtgatggagtctggtgcagagggatatggttatgtctggcgtcaagatcggaaaggtcaaatggttcaacaatgccaaagggtatggttttatcaacgaagaaggtgagaccgaagacctctttgcgcatttctcagcaatcaccatggaggggtacaagacgctgaaagcgggccaagcggtgcagttcagcatcgttcagggtcccaagggcctgcacgctgtcggcatctgcgcagcatgcgtggccgaacctggaaaagcccacgacgacactcacgacaaggggctcaagactgatcaacccactcaatcaaaaaaccaacagccggcctgatcagcgcttgaacaactaaaaaaccggcggtcctgattcatcagggccgccggtttttttatcgcctcagacttacatatgcgaaatcaacgcatcgccaaacccggacgacgacaccaacttggcgccctccatcaagcgctcaaagtcataggtcacggtcttggccgaaatcgcaccattggtgcctttgatgatcaagtcagccgcttccgtccagcccatgtgccgcagcatcatttctgccgacagaatcaatgaacccgggttgacctgatccttgcctgcatatttgggtgcagtaccgtgggtggcttcaaacatcgccacggtgtccgacaggttggcgcccggcgcaataccgataccgcccacctccgccgccagggcgtccgacaggtagtcaccgttcaggttgagggtggcgatcacgtcatactcagccgggcgcagcaggatttgctggagcatcgcatcggcgatcgcgtccttgaccaccacattcttgccggttttcgggtttttgaactgcatccacgggccgccgtcgagcagggtcgcgccaaactctttctcggcgatgccgtaggcccactctttgaaggcaccttcggtgaacttcatgatgttgcctttgtgcacaatggtcagcgagtcgcggtcgttatccactacatattgcagggccttacgcgccaggcgctcggtgccttccttggacaccggcttgatgccaatcccgcagtcctgatcgaagcggatcttggtcacgcccatttcttccttgaggaacttgatgaccttgatcgcctccggcgaaccggccttccactcgataccggcgtaaatatcctcggagttctcacggaagatggtcatgtcgacgtcgccaggcttcttgaccgggctgggcacaccttcaaaccaacgtaccgggcgcaggcacacatacaggtcgagctgctgacgcagtgccacgttcaaagaacgaatgccgccacctaccggcgtggtcagtgggcctttgatggaaaccacgtaatccttgaccgcatccagggtttcctggggcaaccaggtgtcctggtcgtagacttgagtggctttctcgccggcatacacctccatccaggagattttgcgcttgccgccgtaagccttttcaacagctgcgtcgaccaccttgatcatcaccgggctgatgtcgacgccaataccgtcaccttctatataagggatgatcggttgatcaggaacattgagagaatggtctgcattgacggtgattttgtcgccgactgccggaacctgaatcttcttgtatcccatgctgaactccatctatggattgaacatctggctgcgttcgagcctactccagataaatggcgactgaaacctcgcgccatgctcatttgcatcgaaaacagcataatttgtcgcctacaagcctgaaagcaaaggcaaaatcgccaatcttgagcacatcgtgccagcgtggcgacagattgacgcctgcgacctttagaccaatggacgacacaccttttgtatgaaggctcggcgtaagcatagcgacctatgtataatgccgccgctgacccaagagtcacgacggcggaccgctctagaacaacgccctccgccagaaagcaggactaatacaatagtccacccgcttgacgctcgactgatgcaacccaacatcaccgcgaagaaacctcgacatttcgctcatggatgactttgaacgaacgcgctccacccggcgcatctcgagtttctgcgcacgctttcagcaaagaagagagttaatccgaatatgcccacccgctcgaagatcatctacaccttcaccgacgaagccccggccctcgccacctattcactgctgcctatcgtagaggccttcaccgcttccgctgatattgccgtggaaacccgcgacatttccctcgccgcgcgcatcctcgcaagcttccccgagcaactgggcgccaaggctatcccggaccacctcgccgaactgggcgacctggccgttacgcctgaagccaacatcatcaagctgcctaacatcagcgcctcgaccccgcagctgcaagcggcgatcaaggaactgcaggcccagggctacgccctgccggactacccggaaaccgtaaccaccgacgcggaaaaagaaacccgtgcacgttacgacaaggtcaagggcagcgccgtgaacccggtactgcgcgaaggcaactccgaccgccgcgcaccgctgtcggtcaagaactatgcgcgcaagcacccgcacaaaatgggcgcctgggctgccgactccaagtcgcacatcgcgcacatgaacaacggcgacttctacggcagcgaaaaagccgtgcagatcgaagccgctgacgctgtcaaaatcgagctgatcgctcaagacggcaccgcgaccgtcctgaaagagaagacctcggtacaggccggcgaaatcatcgacaccgccgtgctgagcaaaaaagccctgcgcgcgttcatcgccgctgaaatcgaagacgccaagaaacaaggcgtgctgctgtcggttcacttgaaagccaccatgatgaaggtctccgacccgatcatgttcggccagatcgttgccgagttctataaagacgccctgaccaagcacgccaccgtgctggagcagatcggctttaacctgaacaacggcatcggcgacctgtacgctcgcatcaaggccctgccggccgaccagcaagcgcagatcgaagctgacattcaggcggtctacgccgctcgcccatcgctggcaatggtcaactccgacaaaggcatcaccaacctgcacgtgccgagcgacgtaatcgtcgacgcctcgatgccggccatgatccgtgactccggcaaaatgtggggcaccgacggccaactgcacgacaccaaggcggtgatcccggatcgctgctacgccaccatctaccaagccgtcatcgaagactgcaaggccaatggcgctttcgacccaaccaccatgggcagcgtgccaaacgttggcctgatggcgaagaaagccgaagagtacggctcccacgacaagaccttccagatcaaggctgacggcgttgtccgcgtcaccgacagcaagggcaccctgctgatggaacaggctgttgaagccggcgacatcttccgcatgtgccagaccaaagacgcgccgatccaggactgggtcaaactggccgtcaaccgtgcccgcgccagcaacaccccggcgattttctggctggaccccaagcgtgctcacgacggcgtcgtggtcgagaaagttcaggcttacctgaaagaccacaacaccgaaggcctggacattcgcatcatgtcgccggtcgacgcgatgaagttcaccctggagcgcacccgcaagggcctggacaccatctcggtgaccggtaacgtgctgcgcgactacctgaccgacctgttcccgatcatggaactcggcaccagcgccaagatgctgtcgatcgtgccgctgatgaacggcggtggcctgttcgaaaccggcgccggcggttcggcaccgaaacacgtgcagcaactggttgaagagaacttcctgcgctgggattccctgggcgagttcctggccctggccgcttcccttgagcatttgggtgtcacttacaacaacccgaaagccctggtgctgtccaagaccctggaccaggccaccggccagttcctcgacaacaacaagtcgccatcgcgcaaagtcggcaacatcgacaaccgcggcagccacttctacctggcgctgtactgggctcaagccctggccgcccagaccgaagacactgcactgcaagcgcagttcggcgaactggccaaaaccctgaccgacaacgaggcaaccatcgttgccgagctgaacgcggtacagggcaagccagtggacatcggcggctactacgcgccgaacccagagctgaccagcaaagccatgcgcccaagcaacaccctcaacgcggctattgccaagttgaagtaaggttgtaaggatgcaaagaagccccggccccgtgccggggtttctgtttgtgccccctatttcatcgaacaaacccgatcaaatgtgggagctggcttgcctgcgatagcggtgggtcagctgcatccatgtcaactgacagactgctatcgcaggcaagccagctcccactgatcgagcttcttcagtcactgcacactgaggcacctatgacctggcaaccccacatcaccgtcgccaccatcgtcgaagacaacggccgcttcctgatggtcgaagaactcaagggcggccgcgccgtgctcaaccagcccgccggccacctggacccggacgaaaccctgaccgaagccgccgtgcgcgaaaccctcgaagaaaccggctgggacgtcgaggccaccggcattgtcggcatctacctgtacaccgcgcccagcaatggcgtgacttaccaacgcgtgtgcttcaccgccaacgccctgaaacaccacccggactatcagctcgatgaaggcatcgtccgcgcccgctggctgacccgtgacgagctgatggccttgcgcgacgactggcgcagcgagctgatcatccgctgtatcgacgattatttggccggccagcgccacagtctcgaactgatccgcccttctctttagccttgcgggcgcgagcctgctagaatcgcgtcctttttcaagacacccgttgaaaccctatgcgtgatccagccccttctgacacacaaaagaagcgcgtcatcgtcggcatgtccggcggcgtggattcttccgtttccgccgttctgctcatggagcagggttatgaggtggaaggcctgttcatgaagaactgggaagaagacgatggaacggaatattgcaccgccatggacgacctggcggacgcccaggccgtgtgtgacaagatcggcatcaagctgcacaccgccaacttcgccgccgagtactgggacaacgtgttcgagcacttcctggccgaatacaaggccggccgcacgccgaacccggacatcctgtgtaaccgcgagatcaagttcaaggcgttcctcgactacgccatgatcctcggcgccgacctgatcgccacaggccactacgtgcgccgtcgcgacgtcgatggccgcaccgagctgcttaaaggcctggacccgaacaaggaccagagctacttcctgcacgccgtcggcggcgaacagatcgccaagaccctgttcccggtgggcgagctggaaaaacccgaagtgcgcaagattgccgagaaacacggcctggccaccgccaagaaaaaggattccaccgggatctgctttatcggcgagcgccgcttcagtgacttcctcaagcaatacctgccggcacaaccgggcgagatcaaaaccaccgaaggtgatgtcatcggccgccaccatggcctgatgtaccacaccatcggccagcgccagggcctgggcatcggcggcttgaaagacgccggtgaagagccgtggtacgtgttggtcaaggacctggaacacaacgtgctgatcgttggccagggcaatgaacacccgttgctgttctccggcgcgctgctggcctcggacatctattgggtcaaccccatcgacctgagcagcccgcgccgcctgaccgccaaagtgcgttaccgccaaggcgaccagccctgcaccctggaaaaaaccgctaccggctatcgcgccacgttcgatgacccgcaacgcgcggtcacgcctggccagtccgtggtgttctatgacggtgaaatttgcctgggcggcggtgtgattgaagtcgccgaaccctggagcaaatcggcatgagcccgacccaggagcagttgaccgcactcggcggggttttcctcgccgcggtactggtcgacaagatcgccaagaccggccaggtcaccgaggccggcctggcgtgcatgctcggcagcctgctgatccgcgaccccaaggacaccctggaggtgtatggcggtgacgacctggcgctgcgtgaaggctaccgcgcgctgatcggcgccctggagcgcgaccccagcaccttgcagcgtgagccgttgcgctacgccctgtcgatgctcggccttgagcgccaactggccaagcgtgacgacctgctcgaaaccatcggcaagcgcctgccgcaaatccagtcccaggtggaacacttcggcccggcccacgagaacgtgatcgctgcctgtggtgcgctgtaccaggacaccctgagcaccttgcgccagcgcattcaggtgcacggcgacatgcgcaacctgcagcaaccgaacaacgcctcgaaaatccgcgccctgctcctggccggtattcgttcggcgcggttgtggcgccagttgggtggccatcgctggcagctggtgatcagccgacgcaaattgcttaaagagctttacccgttgatgcgcaacgaataagtcgcagcaacccacttttttatcgcctcacgcgtaatacgccggtcagttggcaacggatcggcggattttttcatgtatgatacgcgccccatttcgttgcccgactgtccgagaacaccccatgcagctttcttcgctcactgcggtttcccctgttgacggccgctacgccggcaaaacccaggccctgcgccctattttcagcgaatacggcttgatccgtgctcgtgttctggttgaagtgcgctggctccagcgcctggccgctcaccccgctatcagcgaagtgccggcgttttccgccgaagccaacgctgtattgaacaccctggcggaaaacttctccctggagcacgccgagcgtgtgaaagagatcgagcgcaccaccaaccacgacgttaaagccatcgaatacctgctcaaagagcaagcggccaagctgccggaactggccaaggtcagcgaattcatccactttgcctgcaccagcgaggacatcaacaacctgtcccacgccctgatgctgcgcgaaggccgtgatgacgtaatgctgccgctgatgcgccagaccgccaacgccatccgcgaactggcgatccgttttgccgacgtgccgatgctgtcgcgcacccacggccagccggcctcgccgaccacgttgggcaaagaactggccaacgtggtgtaccgcctggagcgccaaatcgctcaagtcgccgccgtgccgctgctgggcaagatcaacggcgccgtgggcaactacaacgctcacctgtcggcctacccggaaatcgactgggaagaaaatgcccgcgccttcatcgaagacgagctgggcctgggcttcaacccgtacaccacgcagatcgagccgcacgactacattgccgaactgttcgacgcgattgcgcgcttcaacaccatcctgatcgacttcgatcgcgatatctggggctacatttccctgggctacttcaagcagcgcaccattgccggtgaaatcggttcgtcgaccatgccgcacaaggtcaacccgatcgacttcgaaaactccgaaggcaacctcggcatcgccaacgccctgttccagcacctggccagcaagttgccgatctcccgctggcagcgcgacctgaccgactccaccgtactgcgcaacctcggcgtgggcttcgcgcacagcgtgatcgcgtacgaagccagcctcaaaggcatcagcaagctggagctcaacgagcagaaaatcgccgctgacctggacgcgtgctgggaagtgttggccgagccgatccagaccgtaatgcgccgctacaacatcgaaaacccgtacgagaaactcaaagagttgacgcgcggcaagggcatcagccctgaggcgctgcaaactttcatcgacggcctggacatgccagccgcggccaaggccgagctgaaactgctcaccccggccaactacatcggcaacgcggtggcccaagcccagcgcatctgatcagcgcaagccctcttgagacgcccggccgcgccgggcgtttttattccagtgtgaaaagtgctttctttcaataggttacacatgaatcctgatatccctcttcaacttctgggcggcatcacggcacgggaattcctgcgcgactactggcagaaaaaaccgctgctgatccgccaggccatccctgacttcgaaagcccgatcgacgccgacgaactggcaggcctggccctggaagaagaagtcgaatcgcgcctggtgatcgagcacggcgaacgcccgtgggaactgcgccgcggcccgttcgccgaagacgccttcagcaccttgcctgagcgtgagtggaccctgctggtgcaggccgtcgaccagttcgtgccggaagtggccgagctgctggagcactttcgcttcctgccaagctggcgcatcgacgacgtgatgatcagctttgccgcacccggcggcagcgttggcccgcacttcgataactacgacgtgttcctgctgcaagcccaaggcaagcgcaactggaaaatcggccagatgtgcaactccgaaagcccgctgctgcagcacgccgacctgcgcatcctcgccgacttcgatgaatctgaagaatgggtgctggaaccgggcgacatgctttacctgccgccgcgcctggcgcacttcggcattgccgaagatgactgcatgacctactcggtgggcttccgtgcgccaagtgctgctgaagtgctgacccacttcaccgacttcctcagccaatacctgaccgatgaagagcgctacaccgacgctgacgcccaaccagtcagcgacccgcatcagattcagggcgatgccctcgaccgcctgaaaagcctgctggccgagcacatgagcgatgagcgcatgttgctgacctggttcggccagttcatgaccgaaccgcgctacccggaactggtggccggcgaagaattgggcgaagaagacttcatcaacagcctggaaggcggcgcgatactggtgcgcaacccaagcgcgcgcatggcctggtcggaagttgacgacgacgtgctgctgttcgccagcggccagagccgttatctgcccggcaagctgcgcgagctgctgaagctggtgtgctcggccgacgccctgcacagcgacaaccttggcgcatggctcgcggacgaggatggtcgcgacctgctgtgcgaactggtcaagcaaggcagcctgggatttgccgatgaataagattcgcgtacgtgtcgcggactggcgaaaggatatcgacgagattcggcgcattcgtgaagcggtatttatcgctgaacaatcggttccacctgagcttgagtgggattcggacgacgccgacgcggtgcatttcctcgcgttcgaaggcgattttccgattggcaccgcacgcctgttggccagcggcgaaatcggccgcgtatcggtgctcaaggactggcgtggcctgaaagtcggcgacaagctgatggacgccgtgattgggttggccgagcagcgtggccagaccaaacagttcctcagcgcgcaggtgtatgcggcgccgttctacgagcggttgggtttcaagatagtcagtgatgagtttcttgaagtcgggattccgcatgtggatatggtgcgcgggggctgatccctgtggcgagcgggcttgccccgcgttgggctgcgcagcggccctaaacaccagacgccgcgttctttctgaaagaacgcggcgttttttattggggccgctgcgcagcccaacgcggggcaagcccgctcgccactaaacttgcgacccgccaggccgacaaactggcactatcacgctaaatgactcgcagagataacggacatgtccctacgcaccctgctcaccgccctcctcctgactgccagcgtctcagccgtggccgacaccgccgtcgtcaacctgaataatcgcaccagcgccgacctgctgccggtggcgcagaacttcatcggcaaggacggcagcgtcagcgcctacggcaaccagctcattgtgaaagccgaccctggcaagatcgaagacctgcgcgccctgctcgcgcagctggacacccccgccaagcgcctgctgatcaccgtcgacaccaacgaaaacaaccagcagaacaccggcgacagccagacccgcatcatcagctacggcaccgccagccgtgacggcggcatccagcagatccaggccagtgaaggcgtgcccgcgctgatccaggtgggccagagcgtgccgctgaccaccacccagcctgacgcctacggccgtccgcaaaaccagacccagtatcgcaacgtcacccaaggcttttacgtcaccgccagcgtcaccggcgagaccgtacacctggccatcagtaccaaccgtgaccgcatgagccaggaacgtcccgatgtagtgaacgtgcaaagtaccgacacaaccgtcagcggccgcctgggtgaatggatcccgctggccggcatcaaccgcgagactcaggccgacaaatcctctacaacccgcagctactctactcagggccgcgatgacctgactttgcgggtcaaggtcgacacgctgaactgaagcaccaaaaactgactgatgagtcgtcttagactaaagatgtagtgctttgaaaaaagcactacaaaacatttgacgatccaaaaaagcctgtgcatgatggcctcgctcccgctaatcaggggccctggcaagggccttcggatcgccgctctaagctacccacctgagccgattcgtgtctgtaccgcccacaaggtgtgtttgactttggttgcgactggaacgaagttgtcccgagggacggaagctaaccaggtaacccggctacacactgatggatcgtacagaggcccacgatgcccgaagaccgttcgcagtttgcccttacctgctcaactcccccttgagccattcgttcatcccgtcgccttccccgccaaacccgacttgaccgcctaagcttctggtcagcgagcagccatcaccacgcactgaatacgtggctggcaaatggaattctccacctagacctatgcgacgaggtttttccccatggcactgacacgcgaacagcaaattgcagcccttgaaaaagattgggctgaaaacccacgctggaaaggcgtaacccgcgcttattccgctgctgacgtcgtccgcctgcgtggctcggttcaacctgagcacacctttgcaaaactcggcgccgaaaaactgtggaagctggtcacccagggtgccaagccgtccttccgccccgagaaagatttcgtcaactgcatgggcgccctcactggcggccaggcagtccaacaggtgaaagccggtatccaggcgatctacctgtccggctggcaagtggcagcggacaacaactccgctgaatccatgtaccccgaccaatcgctgtacccggtggactccgtgccaaccgtggtcaagcgcatcaacaactcgttccgccgtgccgaccagatccagtggaaagccggtaaaggcccgggcgacgaaggctacatcgactacttcgcaccgatcgtggcagacgctgaagccggtttcggcggcgtactcaacgcctacgaactgatgaagagcatgatcgaggctggcgctgccggcgtgcacttcgaagaccagctggcttcggtgaaaaaatgcggccacatgggcggcaaggtactggtgccaacccaggaagccgtacaaaagctgaccgctgcgcgcctggcggctgacgtggccggcacaccgaccatcatcctggcccgcaccgacgccaacgcggccgacttgctgacctccgattgcgacccgtacgaccagccattcgtaaccggcgaacgcacccaggaaggtttctacaaagtgcgcgccggcctcgaccaggccatcgctcgcggcctggcctacgcgccgtacgccgacctgatctggtgcgaaaccgccaagccggacctggacgaagcgcgtcgctttgctgaagcgatcaagaaggaatacccggaccaactgctgtcctacaactgctcgccttctttcaactggaagaagaacctggacgacgcgaccatcgccaagttccagcgcgaactgtcggccatgggctacaaacaccagttcatcaccctggccggcattcacaacatgtggcacagcatgttcaacctggcgcacgactacgcccgcaacgacatgaccgcctacgtgaaactgcaagagcaggagttcgctgacgccgccaagggttacacctttgtggcccaccagcaggaagtgggcaccggctacttcgacgacatgaccaccgtgatccagggcggcacctcgtcggtgacggcgctgaccggttcgactgaagaagaacagttccactgagtgactgagtacacggccattgcggccccacggaagacctaaccgcaatgccgcacgatctaacgccccgactggttcggggcgttttttttggcctccggaaatgggtcgggttggaagctgaacgcaatcaaatgtgggagcggcggtgcgacgattcgacttgctcgcgaatgcggtgtgtcagacagctcatgtgtcactgacccaccgcctccgcgggcaagcccacagttgaccgggttccaacttgaaaatgcggtcgaaggtgggagctggcttgcctgcgatagcggcgggccagccagctcatgtatggcctgacacgccgccttcgcgggcaagtcgaatcgtcgcaccgccgctcccacagttgacggggttaccgcctggaaaaatgcggttgaaggtgggagctggcttgcctgcgatagcggtgggtcagccgactcatgtatggcctgacacgccgccttcgcgagcaagcccgctcccacagttgaccgggttccaagttaagaatgcggttgaaggtgggagctggcttgcctgcgatagcggtgggtcagttgacacatgtatggcctgacacgccgccttcgcgggcaagtcgaatcgtcgcaccgccgctcccacagttgaccgggttccaacttaagaatgcggttgaaggtgggagctggcttgcctgcgatagcgatgggtcagccgaatcatgtatggcctgacacgccgccttgaacactcaaactgcactcggtcaacgggcgccgacgtcgtcagcatccagcaagcccagccttaactgccagggctttgcttgatgcgctcccacgcagcggcaaccgcctcggcgctgtcggcctttattcgggcgagattgcgcgggtactccacaccggggttttcagtgaagcgcgtggcggtgaattggccattgctggcgcgcaggatgtagccgctgtccaggcattgcgccgaggcaagaaacaccacccccggcgtcacccagtccggcttgagttcatccggttcgtcggtcacgccccacatgcgcgtcttggccaccggtgagatcgcgttgacgcgtatcccggcctcggcgccctcatggctcagtgcgttcatgatgcccagttgcgccatcttgccggcgctgtaggccaccagcccggtttgctcgtattgcgcgtacatggcgcggtcggaggtggtcaggatgacgcgcggcgcgctggattgcagcaggtgcggccatgcgtgcttgcacaaccacagcggggcgtagaggttgatgtccatggcgcgctgcaggaacgcggcgtcgaggtcggcaatgttctggtaaccgacccagccggcgttgtggatcaggatatcgagccggccgaatgccttgatcgcataggcgattaatttccggcagccctcatccgtggacaagtcgccgccatgcgccaccaccgtcagcccttcggcgcgcagcgcctcggcagccgcctggaccaccgacgcatcggtgcccgcgccgaccttgtcggcgccaatatcgctgatcacaacccgcgcacccgcaacggccagcgcctttgcataactgagccccaacccacgtgcgccgccagtgatgatggcggttttaccggtaaagtccatgtgcttgctctcctgttcagcccaccaccctaacaacccgtgcaggccttgttcaatgctgtaacactttgcaagcaatccccattcacggctgtcgaattatttcctgcccccagaagccatctggtaaaacccgagcttcgctttcgtcctggaaccttcatgtcttctcgttttatggctcgcctgggcctgcgctggtttcccctgctgtgcatggcactgttgatcgtcggcttgccggtgggctgcgccgtgctgcaacacaaggagcgcgagctggtgttccgcatcgagccgggcactgccgggtggtttaccggcctgcccaaggcggtgcaggaattcgatatcaaacccgccagtttcaagtcggggcagaaccttcacggctggtggtacccggcagacaacaaggacgcgccggcgatcctgtacctgcacggcgtgcgctggaacctcaccgggcagtttttccgcattgagcaattgcacgccttgggcttctcggtgctggccatcgactaccgcggtttcggccaaagccacggcgatttgccgtcggaaaccagcgtgtatgaagacgcccgaatcgcctgggagcgcttccaggtgttgcaacccgaccccgccaaacgcctgatctatgggcactccctgggtggcgcggtggccatcgacctcgcggcagcgttgagcaagcagacacccgtgccggtacgcgggctggtgatcgaatccaccttcacctccctgggcgatgcggccgctgcggtggccaatacttcgttaccggtgcgttggctgctgtcgcagaaattcgattccatcgacaagattgccgacgtgcatatgccgctgctggtggtccatgggctggccgaccaatacgtgccgccgcgcttcagccagcaattgtttgacgccgcccaggaacccaagcggctgttgctggtgccaggcgccacccataacaacagcatgaacctggccgggcgcagttatgcccaggcgctggataacctgatgcgcgccaaggcgccggcacaggttgttacgcactccacaggccgtgatggcgactcgtaaaactacttttcggcactgggttcgcgcttggctgtcaagcgtaaaccctgcccatactggcccgcgttgaaagttgatcaaatattaaccgagggttaaatcgccatccctgccgggccttcgcaaagttatccacagagatacccacggttttcgtggacaactctttttacttttttacgttttttttgctcagtaaacccctgtgggaaagctacccggcagcaaaatgtcgcggttcacatcgcgtatatcgttatagccacacagcgccatcgtcacgtccaactcacgggcgatgatgtcaagggccttggtcacaccggcttcgcccatggcccccaaaccgtacaaatgcgggcggccgatcatcgtgcctttggcgcccagcgccatcgccttgagcacgtcctggccagaacgaatgccgccgtcgagccacacttcaatctgctcgcccaccgccgcaacaatcgccggcaattggctgatgctcgacggcgcgccatccagctgacggccaccgtggttgctcaccaccaacgcatccgcgccggaattggccgccagacgcgcatcttccacatccaggatgcccttgataatcagcttgccgccccagcatttcttgatccattccacatcgtcccagctcaggcgcgggtcgaattgctgggcggtccacgacgacagcgaactcatgtccgccacgcctttgacatggccgacgatgttgccgaaaccacggcgctgggtgccaagcatgcccatgacccagcgcggcttggtggccatgttgaggatattcggcagggtcagtttgggcggcgccgacaagccattgatcaagtccttgtggcgttggccgagaatctgcaaatcgagggtcagcaccagcgcatcgacgccggcagccttggcgcgctcgatcagctgctcgataaacgcgcggtcgcgcatcacgtacagctggaaccagaacggctggccgacgtgttcggcgatgtcttccagggaacagatgctcatggtcgacaaggtgtagcgcaggccgaacctggcagcggcacgggcggtgaggatctcgccatcggcgtgctgcatgcccgcaagccccgtgggtgccagggcaaccggcatggccatgtcctggccgatcatgctggcgcgaatcgagcgttcgtcgatattgcgcgccacgcgttggcggaattggatgcgggcaaagtcactttcatttgcccggtaggtgctttcagtccaggagccggaatcggcgtagtcgtagaacatccgtggaacacgtttttgcgccagcttgcgtaagtcttcgatggttgtgatcaacgacatctaggtcacctctccctgaactgagcccagagagtaaccgcccatcggctgcgtaaccagtgattgcgtttaggtcggcagaagcctaatctcgcacaaacccgcataaagacgcacaaacatgcaaaacactcatcaagccatcgacctgccctccctacgcaaacagaaaatcctgttgctgttggagcgcgacggcaaagtcacggccgctgaattggtcgatcactttgccgtgtcccaagacaccatccgccgcgatctcggcgaactcgccgccgccggcctgttgcaacgcgtgcacggcggcgccctgccccggcccaaagacaccggcaaagacttcttcacccgcgttggcgagaccaatgaggtcaagcgtcaccttgcacggctggcggctgaccgcgtggaagacggccagatcgtgctgttcgattccggttccaccacgctgcagattgcccagtccttgccacgctcgatccgcctgaccgtggtcacgccgtcgccgatgattgccatcgccctggccgaccatcccgatgtaaaggtgattctggctggcggccaacttaaccccgctaccttgtccaccagcggtcaggaagctgtgcgcctgatccagagcatcaaggccgacctgctgtttaccggcgtgtgcgccttgcacccgcaagtcggcatcagctcgctgcatttcgatgaagtggccgtcaagcaagccctgctcgacagcgcctcccacgtggtggccgtgaccatggcggacaaactcggcgcggtggaacccttcgtggtgggcccatgcagtcgcatccacacgctgatcaccgagtggcatgtgccgagtgtcgaggcctatgagcagttaggtttggaagtgctgcgggtcgaggttgagtagcggactgtgtattgtttactgtggcgagcgggcttgccccgcgttgggctgcgtagcagccccaaaataggcgctgagttttatcaggaaaacct

SEQ ID NO: 46 - DNA, 104605 bp, Pseudomonas poae FL10F
gctacgagttttgcttgctctgtgtacttacccatgacgcccccaaaggttgtgtccagcctttgggggtcagttcagagcgtgggaacgatcaggtcacgcgccgggttgccagccgccgccgagcgctgtcaccagccccacgctcgcctgcaattgccgcgtctgcaccgcctgcaacgtcctctgtgcctgcaacgctgccgtctgcgccgttaccacgtccaggtaacttacggcgccggcctggtagctgttcatcgccagcgattgcgtgtgctgcgccgcatccgccgccgcctgttcatcctgcgcttcctgttgcaaatccctgagctgcgccaggttgtcttccacctcgcgcacggctttgagcacatggctgcggtactgcgccgaggcctcttcaaactcggctttggcctggcgttcattggcactcaaacgcccgccgtcaaagatcggcaaattcaccaatggccccagcgcccaataccgattgccggcggacagcaggttgccaaccccttgcgtctgcccgccgagcaatccggtcaagctgaagtccggataccacgccgctttcgccacgccgatattcgcattggcggcaaacacccgccgttccgccgctgcaatgtcggggcgacgttgcagcaggtggctcggcagctgcgatggaatcgccggcagcgcaatcaattgctggcttggcggcaacgtaaagttgctggctgccacgcccaccaattcgccaatcgcatgctcggtcaggttgcgctgcccgcgcacttcatccagttgcgccttggcttcggccagttggttctgcgcgcgagtcaggtccagttctgaagcgatctggccttcgtaacggctgcgggtcagttgcaacgcctggctgaaatcatccagtgagctgttcagaatccggctctgtgcatccagcccgttgagctgcacatacagcgtcgccaactggtgttgcaggctcaggcgcgctaccgccaaatcatcgccggaagcctgcgcctgggcatcaccggctgcgacctggttgcggattttgccccacaggtccaggtcgtagctcagcgagaaacccgcggtattgctgttgtacaccgacggctgtgtgtcgccgcgcagtggtcgcgagtccgactgccgctggcgcagcggctgcgcactggcggtgatctgcgggaacaacccggcgtgcagttggctggcatacgcctgggacgcatcgaagtgcgccagtgccgccgccaggtccgggttggccttgagcagttgctgttgcaggtcggtcaggcgcgaatcgttgtagagcttccaccactcgggcgccagttggtcggacggctgcgcgctgtgccacgggccatcgctggtctgttcgcgatagccggccggcaggtccaccgacggcaccttgtaggtgggcgccatcgagcagccctgcaatagcagcagcatcaacgccgccaggggtttaagccttgggcgcatgcgcacctccggtgtcggccagttgcacggggtcgccttcgcgcagggcgtcgggcgggttgtcgaccacgcggtcggcgggtttcaggccctggtcgatgaccaggcgttcgccgaggtcgaggccgatgtggatggcttgcaggtgcacgtggttctgcgcatccagcaccgcgacttgggtgccttgggcgcggaagatcagcgcgctggccgggatgctcacaccgtgggtgtcggccggaatcggcagcgtggcttcggcgtagtcaccgggcagcaattcaccgttggggttgtcggcgacgaactgcgccagcagcgtgccggagcggcggtcgatggcggtggaatcgccgatcaggcgcgccttgaagtgctcgccggggtgctcgggcacggtcagctcggcttcgaggcctgggtgaatcaccgccgcatagttctgcggcaccggcacatacaggcgcaactggtgggtgtcggcgatgttgaacagctccgggtcgctgtcggtgtcggccttgatcaactggccgatatcggtgttgcgcgcggtgatggtgccggcaaacggcgcgcggatagtcttgtagctttccagcgccgacagccgtgcgtagtcggcggcggcggcttcggcgttggccttggctgcagcagcgttggaggttttttcatccgcctcctggcgcgacaccgagtggctggccaacaggttttgccagcgtgtggcggtggtctcggccaggcgtgcattggcctgttcctgcaccagccgggcgtgggtttgcgccagttgctggtcgaggtcggggctgtcgatttcggcgaggatttgcccggctttgacctgagtgccgatatcggctttccagtccttcaagtagccgctgacccgcgcgtggatcggcgccttgctccacgcctccaggtgcgcgggcaggcgcagggtgtcgccggccacgttctgtttcggttggaacaccatcacttgcgggagggcggcggtttcggtccaggcgctgaccgattgttcgtgcatcgtgcgggcgtgcaggccgttggcgaccaacagggcggccagtgtcaggccgccgacacccatgagcatcagacgcttgcgcgagggtttgtgatcagacgacatgtgaagtttctccagcagctgcgcgagtagggtgacgaccgtggaccaggctgaagaccacgggtacaaacaacagggtggcgatggtggcgaagatcaaaccgccgatcaccgcccggccaaggggcgagttctgctcttcggacaacgccagcggcaacatgccgatgatcatcgccagggccgtcatgcacaccgggcggaaacgtgtgtaaccggcctccatcgcggccttcaacgcatcgccatgttcggccaggcgttcacggcagaagctcaccaccagaatcgagttggcagtggccacgcccatgcacaggatggccccggtcagcgcgggcaccgacaacgaggtgccgctgaggaacagcatccacacgatccccgccaacgctgcgggcaacgcggtgatgatcacaaacgggtcggcccaggactggaagttgaccacgatcagcaggtagatcagcaccaccgcaccgagcaaaccaaagctcaaaccactgaaggcttcatgcagcgcatcgatctgcccatgcaggctgatcaccgcgcctttagggcgcatggaagcggtgtcatccagcactttttgcacgtcgcgggccacgccgccgaggtcacggccttgcacgttggcgtacaggtccagggtcggttcgatgttgtagtgggtcaccacggccgggctttgcacgcgttcgatgctcgccacaccgccgaggatttgcgactgcccatcggcgccggtgaccggcaaggcttccagtgacggcaggctgtcgagacggtattgcggggttgcggcgacgatggaatacgacacgccgttggccgggttgagccagaaagtcggcgcagtttgcgagctgcccgcgagggaggcgaccatgctattggtcacgtcacgttcggtaatgcccaggccattggcgcgcatgcggtcgacgttaacttgcagcgacgggtagccggtggactgctgaatgcgcaggtcggcaatccccggaatgtgcgacaggcgccgctccagttccaccgcataggcgcggttttcttcatcgctgcgcccggagattttcacgtccagcggggccggtgcgccgaagttgaggatctggctgctgatgtccgccggcaggaacgcgaagtggctgccggggaaactttgcggcaaggcttcacgcaattttttcacgtagtcggcggtgggcgcgtggtcctttttcagcgtgacctggatatcgccatcctgcgggccgatggtgccgctgctgctataggccatgtcgatgccgctgagtgggatgccgatgttgtcgacaatggtgtcgagttcttcggccgggatcacttcgcgaatccgcgcttcaatccggtcgaaggcggcggcgctttcttcaatccgcgtgcccagcggcaagcgtacgtgaagggcgagggcgccggcgtcggtggccgggaagaagtcctggcccaggcttggcagcagcaggaacgaggcaagtacgcaggccaggaaaccgacgataaagcgcttgcgattgcccaacgcaaggatcagtaagccatggtaggtgtcgcggatattcgagaagtgccgctcgaagccctgctggaaattcagcaccgattgcagcacggcattgcgcggtttcttgtgctgctcaccttcgtggtggttgatgaatgcatcttccgggtggtgcccggcgccttgctccggcgtgtgcggcttgagcaggaacatcgccagcgtcggcaccaatgtccgcgaaaggatgaacgagctggccatggcaaagatcaccgccagcgccatcggccggaacaggtagccggcgatgccttgcagcaggaacatcggcacgaacacgatgcagatacacagcagcgagacgaacgccgggccgacgatttgcgcggcgccgtcgaggatcgcggtcttcaccgccttgccttgttccaggtgccagttgatgttttcgatggttaccgtggcgtcgtccaccagaatccccaccgccaacgccaacccgccgagggtcatcacgttgagggtttgcccggtgaccgccagcagtgcgatggccgacagcacggccagcggaatcgaggcggcaatgatcagcgtcgagcgccagctgccgaggaacagcaggatcatcgcactggtcagcagcgcggcgatgatgccttcctgggccacgctgcccaccgattgcttgacgaacaccgaggcatcacccagcagcgaagtcttcagcgacggcggcagggtttcgttgatacgcggcagcatctggcggatgccgtcgatgatcgacagggtcgagatgctgccgtttttcaaggccggcatcagcaccgcacggtggccgtcgacgcgcacgatgttggtctgcggcggcgagccgtcacgcacgtgagccacttggccgatggtgatcaacgcgccgtcgacggtcttgatcggcaggtcgttgagctcatcaatcgccttggggctgttgttgagcaggatcgtgtattcgttggggccgagtttggcggtgcccaccggaatgatctggttctgcagggccagggcgttgcccacgtcctgcgccgacaggcctttggcagccagggcttgggggtcgaggtcgagggtgatctggcgctgcttgccgcccattggcgtgggcatggccaggccgggcagggcgctcaacggcaggcggatgttgttctgcaccaggtcgcggatcttggcttccgagaggctggggctggagaacgccatttgcaggatcggcaccgtggaggcgctgtagttgaggatcagcggcggcgtaatgcctggtggcatttgtttgagcacggtttgtgacacagcggtcacttgggcgttggcggtgcggatgtccacgccgggctggaagaagatcttgacgatgcccatgccgggcaacgattgcgattcgatgtgttcgatgtcgttaacggtggtgctcagggagcgttcgtaggtgtagatcacccgaccggccatggcgtccggtgacaggccgttgtactgccagaccacagcgacgacgggaatgccgatatcggggaaaacatccgtaggggttttcagggccgccatcggcccgacgatacagatgaatatggccaacacgataaacgtgtacggcttttgcagtgcggtctttaccagcccgagcatgcgtgaacctccggagaacacaggattgcaaaccccggcagtcttgcccgacccacctaacacgcacctttcagccaggtgaaggaacatttagttagcggctgaagatcgtttcatatgtattcatttgttatacaaagggtggctctccaagcttgtcatccatcggacgcgacacatttgaacgtcgtccaacgcttttaactgatgccctttggagccctgccatgtcactgaaacccttgttgttgatccctgcccttggcgctgttttattgttgtcggcgtgcgccggcccgatccccaaggcggacccaagcgaagcgtggattggtctgaaagaggaagcgccaaatgacctgatggccgagcgcgtcgatggcaagcgcgtggatgacgggcgcttttttgaagtgacgccaggcgaccatcgcctggacgtgacgctgtttgaagaagagccgggcgacgacaaccagcaagactgccagggtcgcgtcgagtacaagcatttccaggcgggtgagcactacaccttgattgagtcgagcctgggcaccaccgtgcgcgccgtcctcaaggacggccacggcaaggaagtagcggcgactcaagacttcagttgcatgcctggctaggcgtggtgcaccgcagccttgtgtggcttggccggtgcagcgggtttgacgtgggggtgatggtgccgacgggtcacgcgcatgaccccccacaacatggcgccggcgactgccagccaaccgcagatcaacatcagaatcgttgttgcaaggctcattctggcctcctttcgccccgttcggggcacactcagtcttctcaatggacagtctagctacctgacggttgcctgctattgaccaatggtcgagtccctccaacttgtttgctctatcccgggcgtttactagcgcttgaggctatacccgcgttcaagagcaacctatgatcagggcccttaccggccgttgatcaagagagtagaaaattgcgttcgaacgttaaaacctccttgttgctggcgtgcgccctggggctcgcggcctgttccgggcacccgtcgaaactggcgggcctgccggagcgcgtcgaactcaatggcgtgccgacctttcgcagcgaggcttacctcagtggcccctcggctttagccagcatgctgtcgcaacaaggcattgtgatgacacccggtttgctcgataagcccctgcacttgccaggcggcgaggcggaccttgagcgcaacacgcaggtgctggcacgcgagtacgggctgatggtgtatccgctggataaccaactgacggcggtgctggcgcaggtggcggccggctacccggtgatggcgcggatcaacccgagcttctggtccgggacgcgctatgtcgtggtggtggggttcaatcagcagaaaagtacgctgctgctgcgctcgggtctggagcggcggctggtgatgagcttcagcgactttgagtcggcgtggaagagcgccggccattgggcaatcctgacccagcgcccgagccagctgccggccaatgtcgatgcgcagcgctggcgcgaggctgctaacgcgacggcgcaagccgggcaagagcaggcggcggcgcaggcgctcaaggtgttggcggaaaggaagtaacagcgctgaagatcaaacaggtgggagcagggcttctgtgagagctggcttgcctgcgatagcatcaatccggttcaactgaaaaaccgagttgcctgcatcgcaggcaagccagctcccacaaagaccagctccccacacaagctgggtttcaggttagatgtttgcgcttttaacgacgcacttctgcggcattcgggcggttcttcaggttcttgtcggccttatagcgcagcgcgacgtccggcactgaaccgctcttgccggtctcgacccagttgcgaatacgcccggcatcggcaaagtgggtgaacttgccaaaggcatccagaatcaccagcgacactgggcggttacccatgctggtcaccagcaccaggcagtggccggcctggttggtgaaaccggtcttggtcagtttgatatcccagttggcgcggttgatcaggtggtcggtgttggagaaacccaaggtgtagttgggtttgcggaacgccacggtcttctctttggtggtgctcaactggctcaacatcggaaatttgcgcgcataggccagcagcttgctcaaatcacgggcggtcgacacgttgtgaatcgacaggccggtgggttcgacgtagtgggtactggtcatgcccagcgccttggccttggcgttcatcgccgcaataaacgccgggtagccgcctgggtagtgatgggccaggctggcggcggcgcggttttccgacgacatcagcgcgatcagcagcatttccttacgcggcatttcgctgccgattttcacgcgggagaacacgcctttcatttccggcgtgtccttgatgttgatgtcgatgtattcgtccatgttctgcttggcttccagcacgatcaggccggtcatcaatttgctcacggaggcgatgggcaccacgacatcggggttgctggaataaatgactttattggtctgcaagtccaccagcatggcgctgccggaagcgatttgcagtttgctggtatcacgcggggcgagggtggtttcgctggcgtgcgcgaaggtgcctgtaaatgcaaaaaataggctgacaagagagagacgaattttcacgcggatgaactcgctaaaaagtaaggaaataccgttcgggaacggttttttgataaatgccgttacattttaggagtatggatcagaaactgtcgaatgttcttctagaaccggacgaaagtgcttaaaaactaagaaaaaacaggtttttttgcggccaataaaaagccctgcgataaggcagggctttttcagtacggctggttattagccgtgcagggtttctgcggcgtacagggtgttttccagcaggcaggcacgggtcatcgggccaacgccacctggcaccggcgtgatccagccggcgcggggcagggcggtttcgtacacaacgtcgccgaccagcttgccgtcttcctggcggttgatgcccacgtcgatgacgatggcgccttctttaatccactcacctttgaccaggcccggcttgccggcagcgacgacaaccaggtcggcacggccgacgtggccggccaggtctttggtgaatcggtgggtgacggtcacggtgcagccggccagcagcagttccatggccatcgggcgaccgacgatgttggaagcgccgacgaccacggcatcaaggccgtacaggtcgacgccggtgctttccagcagggtcatgatgcctttcggggtgcacgggcgcagcagcgggatacgctgggccaggcggccgacgttataagggtggaaaccgtcgacgtccttgtccgggcggatgcgctccagcagtttggacgcgtccaggtgttcaggcagcggcagctggagcaggatgccgtcgatggccggatcgtcgttgaggctgtcgatcaggtcggtcagggcctgctgggtggtgtcggaaggcaagtcgtaggctttggaaataaagccgacctcttcacagtctttacgcttgtgcgagacataaacctgagaggcaggatcgctgccgaccagaatcaccgcgagccctggcgtgcgcaagccttgctggctgcgctcggtgactcgtttggcgatctgctggcgcaggctggcggcgattgatttgccgtcgataagttgtgcagtcattacgcgtgattaaccatcgagagggggaagaaaagtgcgcgcattctcgcacgccaaggcgtgagggcaaaggcgcttggtccgcaaattgccctaaccccttaaataaaatgaatttttttcaaaaaagatttgacgggtttccggggcgtctatactattcgtcgcacttgtcgggcacagcctagcactggttaagaaggtcgagcagaattgttgtactgcaaggctggaagcacttagtttgtaatcctccaagagtacagattaataaggcgcccgtagctcagctggatagagcatccgccttctaagcggatggtcgcaggttcgagtcctgccgggtgcgccattaggcagctttggcacaagtagcgctagatggtgggcgtagctcagttggtagagcacgggattgtgactcccgttgtcgagggttcgatccccttcgtccaccccatattttgaaaggcgccagattaatcgtctggcgcctttgctttaagagctgcaagcgcggatgtggtggaattggtagacacactggatttaggttccagcgccgcgaggcgtaagagttcgagtctcttcatccgcaccaattaaagctttgccctgccgtcaggtggtgtgaggttcaacaaagaagatgttcgagttctttgttaatgcaatatggtgggcgtagctcagttggtagagcacgggattgtgactcccgttgtcgagggttcgatccccttcgtccaccccatattcagaaaaagcgccagattaatgatctggcgcttttttttgtgtcggaaatttccggtccttgtgcggcgaatcttgacgccaagaaaaaacaagcattctcaatgccttggcgttagaatcgttgccggttttgagcgtgtagaactgatccgcggctttatcagggtcagtacagctatttaatagcgaataacggcgcagtacctgaaaaagggctgtgccgtttttgtttaagggttttgagtttccggggcagggcgtttcgtcgtatttgtgtttctcgatgctggcgccgtgtcctccgaccttgcctgcgaggtcggacgccaagggtgtgtgcccacgcgcttctatatatagaaggcttgatgcagagccctggtgagatgagctgtatttgctaacaggatgaagtgcatgcgtgcacttgaacctataaatgacctgctgtttttccacccgttttcagtagggtgacttcttgagtttgacccactagaatgcatgcccttgattctggggtcggaaacggccggctaacgtctgtgcaacgaggaatatccatgcaagtttctgttgaaaatactactgctatcgagcgccgcctgagcatcaccgtgccggcagagcgtattgagactgcggtcaacaagcgtctgcagcagactgcccaaaaggccaaaatcgctggtttccgtccaggcaaagtgccaatgagcgaaatcaagcgtcgttttggtgccgatgcgcgtcaggaagctgtaggtgacgtgatccaggcttcgttctacgaagctgttgtcgagcacaagctgaacccggctggctcgccttcgatcgaacctaagtccctggaagccggtaaagacctggaatacgtcgcgactttcgaagtgttcccggaattcaccgttgccggtttcgaagacatcgccgtagagcgcctgagcgctgacgttgcggatgccgacctggacaacatgctggaaatcctgcgcaagcagaacactcgttttgaagtggctgatcgcgctgcccagaacgaagaccagctgaacatcgatttcgttggcaaggttgacggcgaagtgttcgctggcggctccgccaagggcactcagctggtgctgggttccaaccgcatgatcccgggcttcgaagacggtctggttggcgccaaagccggcgaagagcgcgttctgaacctgacgttcccggctgactaccagaacctggacctggccggtaaaaccgctgagttcaccgttaccgtcaacagcgtttccgagcctaagctgccagaactgaacgaagagttcttcgctcaattcggtatcaaggaaaccggtatcgaaggcttccgcaccgaagttcgcaagaacatggagcgtgagctgcgccaggccatcaagtccaaggtcaagaaccaggtcatggacggtctgctggctgccaacccgatcgaagtgccgaaggccctgctgtccaacgaagtggatcgcctgcgcgttcaagcagttcagcagttcggtggcaacatcaagcctgaccaactgccggccgagctgttcgaagagcaagccaagcgtcgcgttgtgctgggtctggtcgtggctgaagtggtcaagcaattcgacctcaagcctgacgaagatcgcgttcgtgaaatgatccaggaaatggcttcggcataccaggagcctgagcaggttgtggcgtggtactacaagaacgaccagcagctgaacgaagtacgttcggttgtgctggaagaacaagttgtggatactgttctgcagaaggctaaggtgaccgacaaagcggtctcttacgaagaagcagtcaaaccggcggaagcagcacaagccgactgattgtccaactcgttcgaaatacaaccataagccagcctcgcgctggcttatgcgttttcaagacatgactatttgggagtaactgcagagcatgttccgtaattcctatattcagcagaactctgatatccaggccgctggcggcctggtcccgatggttgtcgagcaatctgctcgtggcgaacgcgcctatgacatctactcgcgcctgctcaaggagcgagtgatctttctggtcggccctgtagaggactacatggccaacctgatctgtgcgcaactgctgttccttgaagcggaaaacccggacaaggacatccatctttacatcaactccccgggcggctcggtaacggcaggtatgtcgatctacgacaccatgcagttcatcaagccaaacgtgtcgacgacctgcatcggtcaggcctgcagcatgggcgcattcctgctcaccgcgggcgccgagggcaagcgttactgcctgcctaactcgcgcgtgatgattcaccagcctctgggcggcttccagggccaggcgtcggacatcgaaattcacgccaaggaaatcctgtttattcgtgagcgcctcaatacattgatggccaagcacagcgggcacaccctggaagaaatcgagcgcgataccaatcgtgacaacttcatgagcgccgaagctgcgcgcgcctatgggttgatcgacgcagtgatcgaaaagcgccccgcttaatataagcacctcaaaatagggctggtcggcgcgtccgaccaccgcgggcttgaaaaagcccgcataagccttcatcttgtgttgcaagcctatcggatttggatcgaacgaatgactgacacccgcaacggcgaggacaacggcaagctgctctattgctccttctgcggcaaaagccagcatgaagtgcgcaaattgattgccggcccctcggtgtttatctgcgacgagtgcgtcgacctgtgcaatgacatcatccgcgaggaggtgcaggaagcccaggccgagagcagcgcgcataaattgccttcgcctaaagaaatcagcggcatccttgatcagtatgtgattggtcaagagcgtgcaaagaaggttctggccgtagcggtgtacaaccactacaagcgcttgaaccagcgtgacaagaaaggcgacgaagtcgaactcggcaagagcaacatcttgctgatcggtcctacaggctcgggtaaaaccttgcttgcggaaaccctcgctcgtctgctgaatgttcccttcactatcgccgacgccaccaccctcaccgaggctggctacgtgggtgaagacgtcgagaacatcattcagaagctgctgcagaagtgtgactacgacgtagagaaggcccagatgggtattgtctacatcgacgaaatcgacaagatttcgcgcaagtccgacaacccgtcgatcacccgggacgtttccggtgaaggcgtgcagcaagccctgttgaaactgatcgaaggcacggttgcttccgtaccgccacaaggcggccgcaagcacccgcagcaggaattccttcaggttgatacgcgcaacatcctgttcatttgtggcggtgcgttctccggtctggagaaggttattcagcagcgttccacccgtggcggcatcggtttcggtgcggaagtgcgcagtaaggaagaaggcaagaaggtgggcgagtccctgcgtgaagtcgagcctgacgatctggtcaagtttggtctgatccctgaattcgttggccgtctgccggtcctggccacgttggacgagttggatgaggctgcgttgattcagatcctcaccgagccgaaaaacgccttgaccaagcaatacgccaagttgttcgagatggaaggtgtagacctcgagttccgtaccgacgcactcaaatcagtggccaagcgggcactggagcgcaagaccggtgcacgtggtttgcgttcgattctcgaaggcgtgttgctcgacaccatgtacgaaatcccctcgcagtccgaggtgagtaaagtggtgatcgacgaaagcgttatcgaaggcaagtccaagccactgtatatctatgaaaacagtgagccggctgccaaggctgcaccggacgcgtaagcgttcagctgtcgcagcacaagcaaggggcctttttaggccccttgtttttttaaggcggtttttcagcagttattttaaattctcgtttattcatgcgtttaactgctggcattgagcttgttttttttgcaagcagcccccatcttggtttcaagcttacttttcaactgtcatagaggcgaaatcatgaagacaaccatcgaattgcctctcctgccgttgcgtgatgtcgtcgtctatccgcacatggttatcccgctgttcgtggggcgcgagaagtctatcgaagccctcgaggccgcgatgacgggcgacaagcaaatcctgctgttggcccagaagaatccagctgatgatgatccaggcgaagatgccctgtatcgcgttggcaccattgccactgttctgcaattgctcaagctgcctgatggcaccgtcaaggtgttggtggaaggtgagcagcgtggtgcggtggagcgtttcatggaggtggatggccacctgcgcgccgaagtggcgctgatcgacgaagtcgaagcccctgagcgcgaatccgaagtgtttgtgcgcagcctgctctcgcagttcgagcagtatgtgcagctgggcaagaaagtcccggctgaagtcctgtcttccctcaacagcattgatgagccaagccgcctggtcgacaccatggccgcgcacatggcgctgaaaatcgagcagaagcaagacatcctcgaaatcatcgacctgtccgcccgcgtcgaacacgtgctggcactgttggatggcgagatcgacctgttgcaggttgagaaacgcatccgtggtcgtgtgaagaaacaaatggagcgcagccagcgcgagtactacttgaatgagcagatgaaggccattcagaaagaactcggcgacagcgaagaaggccacaacgaaatcgaagagctgaaaaagcgcatcgatgctgccggcctgcccaaagacgccctgaccaaggcgactgccgagctgaacaagctcaagcaaatgtcgccgatgtcggccgaagccaccgtggttcgctcctacatcgattggctggtgcaggtgccgtggaaggcccagaccaaagtgcgcctggacctggcccgcgccgaagatatcctcgacgccgaccactacggccttgaagaagtcaaagagcgcatcctcgaatacctcgccgtgcaaaagcgcgtgaagaaaattcgtggcccggtgttgtgcctggtcggtcctccgggtgtgggtaaaacgtcgctggctgagtcgattgccagcgccaccaaccgtaaattcgtacgcatggccctcggtggcgtgcgtgacgaggcggaaattcgtggccatcgccgtacttacatcggttcgatgccaggaagattgattcaaaagatgacaaaggtcggcgtgcgtaacccgctgttcctgctcgatgaaatcgacaagatgggcagcgacatgcgtggcgatccggcctcggcgttgctcgaggtgctcgacccggagcagaaccacaatttcaacgaccattacctggaagtcgactacgacctgtccgatgtaatgttcctgtgcacctccaactccatgaacattccgccagcgttgctggaccggatggaggtgattcgtctgccgggctacaccgaagacgagaagatcaacatcgccgtcaaatacctcgcgcccaagcagatttcggccaacggcctgaaaaaaggcgagatcgaaattggcgtcgaagcgatccgtgacatcgttcgctactacacccgcgaggctggtgtacggggcctggagcgccagatcgcgaagatctgccgcaaggcggtcaaagagcatgcactggaaaaacgcttctcggtgacggtgggtgccgacgacctggaacacttcctgggcgtgaaaaaattccgttatggcctggctgagcagcaggaccaggtagggcaggtgactggcttggcgtggacccaggtgggcggcgaattgctgaccatcgaagccgcggtgatcccaggcaaaggccagcttatcaaaaccggttcgctgggtgacgtgatggtcgaatccatcacagccgcgcagaccgtggtgcgcagccgcgccaagagcctggggatccccctggacttccacgagaagcacgacacccacatccatatgccggaaggggcaaccccgaaagacggccctagcgctggcgtaggcatgtgcacggccctggtgtcggctttgactggcattcctgtgcgagccgatgtggcaatgacgggtgaaattactctgcgcggtcaggtattggccatcggtggtctgaaagagaaattgctcgcagcacatcgaggtggaatcaagacggtgatcattcctgaagagaatgttcgcgacttgaaggaaattcctgacaacatcaagcaggatcttcagattaaaccggttaaatggattgacgaggtcctgcaaattgcgctgcaatacgcgccggagcccttgccggatgtggctccggagattgtcgcgaaggatgaaaaacgcgagtctgattccaaggaaagaattagcacgcattaatgcgattaagccgggtggcttccttgacagctttttagagcccttgttataaagcggctcttaagtgtctgtaggccattcagcactggtttttgctttcaccaaaaaacttagaatcatactcaatagatatataaggggacttagagtgaacaagtcggaactgattgatgctatcgccgcatccgctgatatcccgaaagctgctgctggccgtgcgctggacgcagtaatcgaatccgtcactggcgctctgaaggccggcgactccgtggtactggtaggcttcggtactttctctgtgactgaccgcccagctcgcactggccgtaacccacagaccggcaaagcactgcaaatcgctgctgccaagaaaccaggtttcaaagccggtaaagccctgaaagaagccgttaactaagcttcgctcaagccttacctacccgggtcagacgcaggtctggcctggcagcggagcggcagccgacccagttatccatcgggtcgccacggcctggggtgttggttcaaacccccgtccgctccgccagttacgagaaggcgcatcctcggatgcgcctttcttctatccggactctacccacgctccacggttgcctaatttttgaagatcaaccgtttctgggggacgcatgctgcaaaatatcagggacaattcacaaggctggattgccaagaccattatcgggatcatcgtcgcattgatggcgttcaccggtatcgaggccattttccaggcttcgaccaacaacaagcaggacgtggccaaggtcaatggtgaagaaatcacccaaaccgaattgagccaggccgtcgacatgcaacgtcgccagctgatgcaacagctgggcaaggatttcgatgcttctctgctggacgaaaaactgctgcgcgatgctgccctcaaagggctgatcgatcgcaaactgttgctgcaaggcgctgctgattccaagttcggcttctcggaagctgccctggatcaggtgatcctgcagactccggaattccaggtggacggcaagttcagcgccgaacgctttgaccaggtgatccgtcaactgggctacagccgtatgcaattccgtcagatgctgacccaggaaatgctgatcggccaggttcgcgcaggtctcgccggcagcggtttcgtcactgacgccgaggtgctggcattcgcccgtctggaaaaacagacccgcgatttcgccaccgtcaacatcaaggccaaccctgcggcggtgaagctcaccgacgatgaggtcaaggcttactacgaccagcacgccaaagagttcatgaccccggaccaagtcgtcatcgactacctggaactgaagaagtcttccttcttcgaccaggtcaccgtgaaggacgatgaactgcaggctgcctatcagaaagaaaccgccaacctcgctgaacagcgtcgtgccgcgcacattctgattgaagtcaacgacaagaccaccgacgcgcaagccaaggccaagatcgaagacatccaggcacgcctggccaagggtgagaagttcgaagccctggccaaggagttctcccaggatcccggttcggccaacaatggcggcgacctcggctttgctggtcctggcgtctacgacccggacttcgaaacggccctgtatgccttgaacaaggaccaggtgtcggcgccggtgcgcaccacgttcggttggcacttgatcaaactgttgggcgttgaagcaccccaagtgccatcgttcgccagcctgaaagacaagctgacccgcgagctcaagacccagcaagttgagcagcgctttgtcgacgcctccaagcaattggaagatgcggcattcgaagcctctgacctggcccagccggcgtccgatctgaagctgaccgtgcacacctccgcgccatttggccgtgaaggtggcgaaggtgttgcagccaaccgtgctgtagtcaccgcggccttcagcccggaagtcctggatgagggtgccaacagcaccgccatcgagctggacccggaaaccatcatcgtgctgcgcgccaaagaacacttgaagcctaagcaactgccactggaaagcgtctctgccgcgatccgtgcgcagatgaccaaggagcgcgccagcgcggctgccaaggctcacgctgacgagttgatcgccagcctgcgtgatggcaagaccccgctgaaccagccgatcgacggccaggcctggaaagtcactgaagcggctacccgtagcgcagaagggatcgagcctgcggtgctgcaagccctgttccgcatgcctaagcctgcgtccaaggacaagccgaccttcaccacggtaaccctggctgacggtagcctggtgatcgtgcgcttgaacggcgtcaacgaagccgctgcgcctacggacgaagaaaaggcgcaataccgccgcttcctcgcttcgcgtattggccagcaagacttcgcggcttaccgcaagcaactggaaaccaaggctgacatcaagaagttctgatcgatcgttcccgcgctctgcgtgggaacgccgccttggacgctccgcgtcccgctgtagagtgacgcgcagcgtcacgggatgcatgcccacgcagagcgtgggaacgatcagcccccggtctgtaaaggaccgggggcttttttttagctgcgtttcaggctgccaaccaaggccaacaccatcaatagcacgaccgcccatgcaaaggcgcccacgccccagccttgcagcaataccccatcaagtcgccatgcctcggcaaaactgcgcgtgtttattgaccatacgggcgccgggctttttcctgcaggcgccgttctgtaggcctgtgacgttttaccgacaggaatgcgcgcgccaaggcctcgttctgttgcacaataccgcccggactgttttcctcaggattttcaatgtcgacatcatttcacttgcgtagcctcgggctggcgctggtgctggcgggcgccgcgggctgctcgtcacccaagaccgctatttatgaacatgagaatttcgacgactccggtacgttctcccgtgattacccggtcagcgatgtggcggcctgtgaagcggcgcgacgtgcgctgttgagccagggttacattatcaccagcagcgaccccaagctggtggtgggtaacaagagcttccagcagaccggcgagacccatttgcagatcagcttcaacgtggtgtgtgccgacgatggcaaaggcaataaccactcgacgatgtttgccaacgccttgcaggatcgctacgcgctgaagaaggtcaacaactccgcgagcctgggtgtgggcgtgttgggctcggtgtcgatgccgattggctccaccgatgactcgatggtcaaggtggcgagtgagacggtttcggcgccgaagttctacgaccgttactttgcgctggtggatgtgttcctgccgcaggaagtgaagaaggccgagcacattcctgaaaagcccaaggctgagctcggggtgccggaacccaaggccgctccggttgcggagaaggtcgaggcaccgaaggacgcaacgccagcgcctgccgctgcgcaaccgttggcaccgcctgccgaggccgcaccgattgcgccacaggccgaacccgaaccggctccagcacccgctccgaccacgccgaccacgccgaccacgccgaccttgccggcgccgacagaggcgattccaccgctgccgacgcctgcgcagtaactcagaccgctacggggttcgccttgtcgacgttgatcccgtagcggttgatcgcttcactgacgttatcgcgcccgattacgccgtcatccgccagcgcctttaaagcggcgaggacgatgaagtggcgatccacctcaaagaactcgcgcaaggtttcccgggtgtccgattgcccgaaaccatcggtgcccagcgccacaaagcggcgggcgtggacgaaggggcgaatctggtcggcgaataatttcatgtagtccgtggcgaccaccaccggcccggtgtgcccggcgaggcattcctcgacgtagctgctgcgcggctcactcagcgggtgcagcaggttccagcgctccgccgcgtgcccgtcccggcgcaactcggtcaggctggtgacgctccacacgtcgctgtgtatgccgaagtccttggcgagcaagtcggcggcggcgatcacttcgcgcaaaatcgaaccactgcccatcagctgcacctgcgcttgcgggtggcggctcagcggatacatgcccttgagaatgccatcctccacgccttcgggcattgccgggtgcgggtagttttcgttgagcagagtgatgtagtagtaaatgtcctcctgctcgacatacatgcgtcgcatgccctcgcgaataatcaccgccagctcgtaggcaaaggtcgggtcatacgacacacagcacggaatgaccgaggacagaatgtggctgtggccgtcgtcatgctgcaagccttcgcccatcaatgtcgtgcgcccggccgtagcgccaagcaggaaaccacgcgcccgcgcatcgccggccgcccacgccaggtcgccgacccgttggaagccgaacatcgagtagaaaatgtagaacggcacggtcatcaggccgtggttgctgtaagacgtactcgccgcgatccacgaggaaatggcgccggattcattcaggccttcctgcatgatctgtccgtctttgctctccttgtagtagctcagttgcccggcatcctgcggggtatagagctggcctacagcagagtggatgccgatctgacggaacaggctttccatgccgaaggtgcgcgactcatccggcacgatgggtacgatcagcttgcccaggtgcggatccttgagcagcgtgccaaggatgcgcacaaatgccatggtggtggagatggcgcgctcgcccgtgtctttgagctgggtggcaaaggcgctcagttccgggatctgtaatgactcgacggccgtgtggcgcgcgggcacatagccgcccaaggcttggcgcctggcggcgaaataacgcgcctcttcactgtcggcggcgggtttgaggtaggggatttcgtcgagctggtcatccgccacttccagcccgaagcggtcgcggaaggcttttacggcctcggcgcccatcttcttcaactggtggttgatgttctggccttcgccggcttcgcccatgccaaagcccttgacggtcttggccaggatcaccgtcggctggcccttgtggcgcacggcggccgcgtaggcgttgtagaccttgtccgggtcatggccaccgcgtgagagtttccagatttcgtcgtcggacatatccgcaaccagtgccagcaactccgggtatttgccgaagaagtgttcgcgtacataggcgccgttctgcgatttgtagttctgataatcgccgtccacgcattccatcatgcgctggcgcagcaggccgctctggtctttttccagcagcgcgtcccagccaccaccccagatcaccttgatcacgttccaaccggcagcgcggtacaggctttcgaattcctggatcaccttggcattgccgcgcaccgggccgtccaggcgttgcaggttgcagttgaccacgaagatcaggttgtcgagtttctcgcgaccggccagggagatcgccgccagggattccggctggtccatttcgccgtcaccgaggaatgcccacactttgcggccttggtgttgcttgaggtcacggaactccaggtaacgcatgaagcgcgcctggtaagccgcggttatcggcccgaggcccatggacacggtagggaattgccagaagtccggcatcagccgagggtgcgggtaggaggacagcccctcgccagcagcctcgcggcggaagttgtccagttgcgcttcgctgatgcggccttccaggtaggcgcggccgtagatgcccggcgaggagtgaccctggatgtacaccaggtcaccgtcgaacgtatcggtgcgcccacggaagaaatggtcgaagcctacgtcgtacagcacggcggctgacgcataggtcgcgatatgcccacccacaccggaatgtttgccagcgcgcagcaccatggccatggcgttccagcgaataaacgcattggtgcgccgctcgatggcgaggttgccagggtagggcagttggcggtcaaccgggatggtgttgacgtaaggcgtggtcacccgcccgtagaagtctccatggcgcgcaacgtcgaaatccagcaactgatcaatcaggtagtgggcgcgcgggcggccttcggtggacagcaccgattcgatggactccagccattcgcgggtttcctgtggatcgtcgtccagtcttactgcgttattcggggtcatgtgaggttccagggtaggcggatttcaagcggcgagctccttgtgggagtaacgccaatgtagttgcaattgcaacgacatgcctgaatctagcgcgggatgagctactattgcaaccttcttgaaattccccggatggtgttgcatgtcgtcgaaagagcctgatgtatggttccgttttgtcagggcccacaggacggtcatccgtgaaatcgaacgccgtttggcgcaggcggacctgccgccatatgcctggtatgacgccctgtggggcctggaaagtggtcccgatggcacccgtcgcatgcacgaattggccgatgtgctggcgattgagcgctacaacctgacacgcctggtggaccgcctggaaaaagacggcctggtggtgcgttcgcgttctgacggcgacggccgtgcggcgtttgcctcgatcaccgacgcgggtcgggtgttgcgtaaaaagatgtggaccatctacgaaagcaccgtggacgagctgttcctgtcgcagatcgagcccgagcagcgccagctgtttgccgacaccctggagcgcacggcagggctggccgtggaggcaggcgtgcaggttcgaggtcgacgcaagatgtgaggcagcacaggcaaaccctgtgggagctggcttgcctgcgatagcggtacatcagcaaaagatgcagtgcctgacactgcgctatcgcaggcaagccagctcccaccattgacggtttctcccttcagttgagcgcataccgatccatcgccttttcgacctgccgcgcatcaatacatccctcatccaccaacgccctcaacgcacacaccacaatccagtaacggctgggcgcagacgcctgcaccgaacccgcgccgagcgcgacaaaccgcgcctccacatgcgccgccagctgatcgacaatcgcctgcggataaccggtgacggcgatcaccggcgcgctgctgccgctcaggcactcacgtaaatggcagctgtgcctgggcgctgtggggtgtagtcgattccagcgttcggcggcggccgcttcgcgcgccagtcgcgtgtagctggggcagctccacagctgcgccgtgatgttccagtcctgttccagcaactgtgcagcctcggcaacttccaccagcgcccggccggcaccgagcaatcgcacctgcccttggcgacgttggatcgggtacatccccttgagggcatcgtcgcgatcctgtgcatccagcgtcaccgcgctgtcctggtcgtgcagcgccaggtaataaaacccaggcttgccctcgacatacagcgtgcgcaaacccgccagcacaatcgcgcgggcttccgcgccggacgccgggtcatacggcgtgcagcgcgggtgggtggccagccataacggcagcgacggttgcgtgcccctgggccatgcggacggttgattttcgatgtcgttacacaggatgccgcgctgcgcggtctcgtccgacagtgcacataactgcgccgacgacgccgcgctgtgcaggtacaacatgggtttttcagcggtgttgcgtgcgaaccaaaccggccagccgcccacacggcgcgagcgtgactgaccgcggatcacccaggcctggcggctgagttccagggtgttggccatggtcatgaccgtgtacagcggcgaactgcttgagtgcgcagccgtgctgagtgcgtcaatacagcgttgggcggcatgggcggtagaggcgggcatgggacgagctccttgcaacagaggttcgtaccctaatggaaatgttgttgcaattgcaatgatttcaatcgcacctcaacacccaggtgctaaatcaaggcaacgctgctacgttttatcctgaagtgcaggaacgtcatggcgccgacattttttcgtcatcacggcactttaggctggctgtgcaggtcatttattggcagctgctttaaacccacgaggagtccaccatggacgattaccaagaagaactgctggagtaccacgcgtttgagttggatccgctggatccggttgatgacgccaccgagctgtaacaccgacttcaggcggaatgccgctgactgcggcgaaattcccctggggtctggttgttccaccgcctgaacgcccgttgaaacgcctgggctgaggcaaacccgagcaagtaggcgatctcgccgaacgccagctccgtatcgcgaatgtaggtcatggccaagtcgcggcgggtatcgttgagaatcgcgcgaaactgcgtgccttcatcggccagtttgcggcgcagcgtccaggtcggcagcttcaagcgtgccgccacttcttccaggtcgggttcccggccaccattgagcatcggcccgagcaaacgggtaatgcgctcgcgcaagctgcgggtgcgggtcaactgctccaattctgcttcacacaacttcaacaacagctgccaggtactcgggcaatgctgcgggttacgcagtgccaacgtgttttggctcaggcgcagttgattggcctcggcgccgaagctcaccgggctgtcgcccagcacgctgtagtgttcgctgtactcgggggcttcaaattcgatgtcgatgcgctgcgcctgcaccggttgcagcgccacgctggataactgctgcagccagccggcgatgatcgaatccaccacaaagcggttataggcgttgtacgggctgatggaatagaaccgcagccaggcgccttcggcatcctcgtgaaaactcgattgcccgcggtaattggagccgtacagcgcttcaaaacgggtcaaggcacgcgccgcttcacgcacattgggcgcttgtgcggcggtaacgcctgccagacctgcctggctcaaacggctgagctggcccatgcgcaggcccagacctgggtcgccggtcagttggatggctgcgtggcccaggcgcatatagcgcgggatcgacaagcgtgcgccggcttcggccaggcgtgccgggtcaaggccgtattgcaggagcagcggttgcgggtccaggccgtggctttgaatagcatccgccaaggtgtgcacgaaacccaccgacagatcgccaaggcgcaccggcttcaagatgctacaaccagatattcagcaggcgcgcgccacgggcaccgctgtcggcattgatttgcccgttgctgctgagaaagctgtgcccggcagtgcccagatcccagaactgcccgcgcaggaacacgctgatgccggcagtggcctggctgatcggctgctggctgatcagcgtgaggcgacgccaggcttcgccttcgctgagttcttcgggtttgaggctgatttcgggcggtgtcgaaacgcttttgaaaccgcgccatgggcggtcccacgtctcgcggccggtcacaaaggcaggcacggcgaccaattgcgcgccttgctcgttgagtttgcggtagttgtccgggtaccagctgtcgctgccgatcaggatgcccaggcgcccggccggggtatcgaccacgctgacgaggttttcatcgcccggttcgataaagccgcgctcatcgtagatcggatagaactggcgctgcggctggcccaccggcaagccatcggcgccaaataccaggctggcgttgtacagcgcgccatggccaatgtgcagttgcccttgttcgacggtcgggttgggcagggcgatggagccggccaccagcgtcacgccaaactctttggccagcccgccgaacagcacctgatagtcgcgggccatggcgggcgctttcatacgcaggtaggcgtcttccatgcggttatcgcccttggcgctgatccacgcgcgtgcgaactgcagtgggttgctggctgacagccagttcatcgcgtcctttaaatggaccgcttggtacagctcgttcttctcgccgctgagcatcagccaggtgccgatgtgttccggcagcacgacgatggtcttgctgttgatcaacccttggtcccgagctttttgcagataagccgccagcttcaggtgcaggcgttccaggctctggtaatccgcggggaacagctccggctggatacccagcaagttgccacgatcagcgggctggccttcgttgacggccaaagtgatgcgcaggtccgacaggtaatgcgccacagggcgctccttggtccagaccagatacgcggtggtggcggcaaccagggccatgacgagggtgaagcctagaagtttacgcatggggcaacagacaacagaccgtgtgcagggttcgccgactagggtagggcccatgcaccggcttgccaaggggcgctgtgcatttggatcaataacttgtcagtttcagtcattgagcggtagtccgctgcctcttagtctgtgggacataaaccgatggcaggccatttcgagccttccacgtcccgtgatgatccgttgtggagctgtaccatgaccgctgctgcctacccgcacctgctggccccgttggacctgggctttaccaccttgcgcaatcgcaccctgatgggttcgatgcacaccggcctggaagaaaagcccggcggtttcgagcgcatggccgcctattttgccgagcgcgcccggggtggtgtcggcctgatggtcaccggcggtattggcccgaacgatgagggcggcgtgtacgccggcgccgccaagctgaccaccgacgaagaagcccagaaacacaagatcgtgacccaggccgtgcacgaggcgggcggtaagatctgcatgcagatcctccacgccgggcgctatgcctacagccccaagcaggtcgctccgagcgcgatccaggcgccgatcaacccgttcaagcccaaggagctggacgaggaaggcatcgagaagcagattcaggactttgtcacctgctcgctgctggcccaggtcgccgaatacgacggcgtggaaatcatgggctccgaaggttatttcattaaccaattcctcgccgcccacaccaaccatcgcaccgaccgttggggcggcagttacgaaaatcgcatgcgcctggcggtggaaatcgtgcgtcgagtgcgcgaggctgtcggcccgaacttcatcattatcttccgcctgtcgatgcttgacctggtggaaggcggcagtagctgggaagaaatcgtgcagctggccaaggccatcgagcaggcgggcgcgactctcatcaacaccggtatcggctggcacgaagcgcgtatcccgaccatcgccaccaaagtaccgcgtggcgcgttcagcaaagtcaccgccaagctgcgcggtgcggtgcagattccgctgatcaccaccaaccgcatcaatacgccggaaattgccgagcagatcctcgccgagggcgatgccgatatggtctcgatggcgcggccattcctggccgaccccgagttcgtcaacaaggcggctgccggccgcgccgatgaaatcaacacctgcatcggctgcaaccaggcctgcctggaccacaccttcggcggcaagctgaccacctgcctggtcaacccgcgtgcgtgctacgagaccgagctgaactacctgccggtcaagcagatcaagaaaatcgccgtggtcggcgcaggtcctgcaggcctggcggcggccaccgtggcggcggagcgcggccatcaagtgaccttgttcgactcggccagtgaaatcggcggccagttcaatattgccaagcgcgtgccgggcaaagaggagttctttgaaaccctgcgctacttcaagcgcaaattgcagaccacccacgtcgaggtgtgcctcaacacccgcgtggatgtcgcgcaactggcggcgggcggttatgacgagatcatcctggccaccggcattgcgccgcgtaccccggcgattccggggatcgacaacgccaaggtgctgagctacctggacgtgatccttgagcgtaagccggtgggcaagcgcgtggcggtgattggcgctggcggtatcggcttcgacgtctccgaattcctcgtgcatgcaggcgtgtccaccagcctggaccgtgaggcgttctggaaagagtggggcatcgacacccagctgcaagcccgtggcggtgtggccggtatcaagcctgcgccgcacgcaccggcccgtgaagtgttcctgctgcaacgcaaggcctccaaagttggcgacggcctgggcaagaccaccggctggatccatcgcacgggccttaagaacaagcgggtgcagatgctcaacagcgtcgaatacctgaagatcgatgaccaaggcctgcacatccgcatcggcgccgacggtgagccgcaagtgctggcggtggacaacatcgtcatctgcgccggccaggacccgctgcgcgaactgcaggatggcctggttgccgcaggccagaacgtgcacctgatcggcggcgccgatgtggcggccgagctcgacgccaagcgcgccatcaaccaaggctcgcgcctggcggccgagctgtaaaacgccaaaaggggcggtgttagactaccgccccttttcattcagataccttccccgatgggccctttcgactggcttccccacgcaccgctcgaacctttgcagctggattggctgaccggcgtcgagttggctgtgttgcgcctggactgcatcgacccgctgatcagcggcaacaagtggttcaagctcaccgagcacctcgcccaggcgcaaatggccggtgccagcgggatcatcagcctcggcggcgctcactccaaccacctgcacgccctggcggcggccggcaaacgcttcggtttccccaccgtcggcctgttacgcggccaccctcaagacacgcccactgttctcgacctcaagaccttcggcatgcagctgcattggctggggtatggcggctatcgtgcgcggcatgaggcggatttctggctgccgtggcacgcacagtatccgcagttccatgccgtgcccgaaggcggcggtggaatggccggtgcattgggctgcgcggcactggtcaagcaggtgcgcgagcagttgggtaacctgggttgggccgattacgacgcgtggtggctggcggcgggcaccggcaccaccttggccgggctggcgctggcagaggcgggcgcgcatccggtgtacggtgcaatggccgtgccggacgatcacggcgttgagcaaaacgtgcaggccatcgtgcagggcggttatcaattgctggacgccagccgaggtggcttcgccaaagtcgatccgctattgctcgcatttattgagcacaccgaacaagcctccggcctgccgttggagccgctctacaccggcaaggccctgctggcgctcaaactccagatcgatgccggacgcttcgccgccggcacccgcctgatcttcgtgcacaccggcggcctgcaaggccgccgagggtttgaaatctagcgatgttcccttgtggcagcgggcttgcccgcgattgcggtctatcattcaacagatttggtgactgacccgccgctttcgcgagcgagcccgctcctacccggcatcatgcgcagcgccgtgttatcgcgcaggatgtaatggtgaacgatccccgccaatgcatgcagcccgatcagccagtagccgatcttgccgaacagcacgtgccagccttcaatctgcttggccagcgccttgttctcagcgatcaacggcggcaactcgatgccgtagaacatcaccgaatgcccctcggcgctgacgatcagccaaccggcaatcggcatgccgatcatcaatgcgtacagtgcaacatgcatcagcgtggccagcaggctttgccattgtggcggcgtcggcacgattttcggtgcaacccccaggctgcgtgcaaacaggcgcagccacaccagcacgaacacggtcaggccgaacataaagtgcatttcgacgatcaacgttcgcgcgccactgcctttggggaattggccgcgtaactctatgcaggcgtaaaccaccgccagcagcaccaccatcaaccagtgcagcgcaatcgacatggtgctgtagcgcgtatcggagtttttccacggcatcgctgtgttcctcactcatcagggcaaacctccattctttagtgacggagtcctctaactgtatgccggttttgagcgattcgcctggcgtaagtgccgttgttttgacctcaatcagtggctttgcggcatttcaccgcgggccaggcgctggttgatgtcggtgatcactgcaggcaggtcgttgatagtgtcgatcaagtagtgcgggcgcgagccttcgaacagtttctcgatgcgtttgcgctcgctattcagggcggcggcgtccaggtcgcggaattgctcataggtcaggcccagcgcattgcccgagcaggtgagggcgacggtccacatgccggcgcggcggccttcgaggatgcccggcacggtgtcgtcaacctttacgcaagccgccacatcgtcaatgcccagcgcgatgacgttggccagcgcctgggctggccatgggcggccgttgggcacttcgtcggtggcgaccacgtggtcggcgaagtagccgttggtggcggccagggcgacgactttgtccatgacctgcttggggtatccggagcaggagccgatcttgatgccctgcacacgcaggcgcgcaatggtgtcgagggcgccgggaatcagcgccgagtgctcggcgattttctcgatctgcaacggcatgaaacgctggtagatggcggttacgtcgtcatccgtcggcacgcgcccaaaggccttgcgataacgctcggccacctgcggctgattgcagagcgtgcggatatggtcccacttgcccatgcccatcgggccacgggcttcgtcgatggagacttgcacgtcgaactcggcgaaggcttcgacaaagatctgcgtgggggcgaaggagccgaaatcgaccacggtaccggcccagtcgaggattacggcctgcagggtgttggggttttgatagttcatggttgcgatccaaacgatgaaaggttgatgtgcatggcgtgcaacgcctgggcgatagcggcgacggcggcgcgcatgtcggcggcgtcgacatggccgatgcagcccacgcggaaggtgtcgacttcggtcaatttgccggggtaaaggatgaaacccttggccttgacccgttcgtagaagtccttgaactggtaacgcgggtcttgcggcgcatgaaaggtcacgatgatcggcgcctgtattgccgctggcagaaagctgcgtaggcccagttcggccatgccgtccagcagcgcctcgcagttggcggcataacgctgatggcgcgcgggtaatccgccttcttcgtgatattgcagcagggcttcgtgcaacgcggcgaccacatgcgtcggcggggtgaagcgccattgcccggtcttggccatgtagcggtgctggtcgaacaggtccatggccagggagtggcagttgccttcggcggcggccagcgcctgtttgttggcgaatatgaaacccatgcccggcacgccttccaggcatttgccggacgctgcgatcagcgcgtcgaacggcacttcgcgggcatcgatcggcagcgcgccgaaggagctcatggcgtcgatgatcaagcgtttgccgtgggttttcaccacctgggcgatgtccggcagcgggttgagaatgcccgtgctggtttcgcagtggatcaacgccacgtgagtaatggccgggtcggcgtgcagcaggcggtccacagcggccgcagtagtgggctcatcttcggcggtttcaaaggtactgaactcgcgaccgagtactgcgcagatcttcgccaggcgctggccgtaggcgccgttgatcagcaccagtaccttgccgtcacgcggcaccagcgtgccgatggcggcttcgacggcgaacgtgccgctgccttgcaggggcacgcagtggtggctgtcggcgccgttgaggatcgccagcaactgctcgcaaacactcgcggtgagttggttgaagcgctcatcccatgaaccccagtccaccagcatggcctggcgcgtacgggccgacgtggtcagcgggccgggtgtgagcaggatcggcgcggcggtggtcatctcaagtcctcgcaagtctcggggttgaatctacggcgcctaaattgcagtttggcttgtcatcaatcaaattgtttgttgttatgcgagctatcagtgaggccgatagctatgaacctgtttcaattgcgtgcattcgatgcagtggcccgcgagggcagctttacccgagcggctgcgcggctgtttatcagccaaccggcggtgaccgggcacatcaaagctctggaagagcactaccagattccgctgttgcgccgcacggcacggcgggtggagttgaccgaggagggcacccgcctggcggcgatcacccgcgcgattttcggcctggtggacgaggcccagaccttgctggaggccaatcgccaattgctcaccgggcgcctggaagtcgcggcggatggcccgcacctggtgatgccgatgatcgcccgtttgcgcgcgcattaccccggcatcaccgtcaacctgcggctgggcaatgcccaggacacgctggcggcgttgttgtcggaacacgcggacgtggcggtgctcaccgaggtggagccgcgcaatggcctgcacctgcaagcgctgagcgaatcgcggatctgcgccttggtgcccaccgggcacccgtggctcgccgacccggcgggcattcgcctggagcaattgcacgaggtgatcatggtgctgcgcgagcccagctcgattacccggcgcaccttcgacagcgcctgcgccagcgccaacgtccagcccagggtgttgctggagctcgacagccgcgaggcggtaaccgaagccgtcgccgctgaactgggcgtgggtgtggtgtcgtcgatggaggtcagccgcgacccgcgcgtgcatgcgattgccttgcagggcgacggcctggtcaaccggcatatgctcggttgtctcgagcgacgccgctcattgcgcttgatccaggcgtttttcgagttggcgtgttgacggttttttgctggaacgatttttttttgccctataaactctgcccccaaagcgccggccagtagacgtctcggcgcgatggacagaagagagtgagtcatgggcgcacagtggaaagtcaaacataaagaagcggcatcgaatgccaagggcaaaatcttcggcaagctggtgaaggaaatcaccatcgccgcccgtaacggcgccgacaccgcgaccaacgcccacctgcgtctggtggtagaacaggccaaaaaggcttcgatgcccaaggaaaccctggagcgcgccatcaaaaaaggcgccggcctgctgggtgaaaccgtgcagtaccaccgcgtgacctacgaagggtttgccccgcaccaggtgccgctgatcgttgagtgcgtgaccgacaacatcaaccgtaccgtggcggaaatccgtgtggcattccgcaaagggcaactgggcgcttccggctccgtggcctgggacttcaaccatgtcggcctgatcgaagcctcgccggacaccccggatgccgacccggaaatggccgcgatcgaagccggcgcccaggattttgaagacggcgaagaagagggcaccaccctgttcatcaccgaaaccaccgacctcgatgccgtgcaaaaagcgctgccggagcagggctttaccgtgctgtcggccaagctcggttatatctcgaagaacccggtgagcggtttgaccgacgagcagatggcggaagtcgaagccttcctggaaggcctggacaaccacgacgacgtgcaggatatgttcgttggcctggctggctgattaaacgcggttcactcatgtgggagctggcttgcctgcgatagcgctgtatcagtcactgaaaaggtgaatgacacggcctcatcgcaggcaagccagctcccacagttgcattgggtttcaccccaggttcagcagcgcttcaatctcttcaaagctcggccgcgccaacacatcaggctggcagcagctgttctgcagcgcgaccaacgcttcgtcgttgaacggcgtgtcgacgcgctccagcaactcccccagcaacaccccaaacgcccgtacttcaatgcgctgcaacgcccgggtttccacggtatccgcggtggcatggaacgacgccgcgccaaagtcgccgagcaagcagtcgccatcgacgttccacagaatattgtgaccgtacaggtcgccatgggtgatgccgtgccggtgcaagtgcgccgccaccgaggcaatgccccgggccatgcgcaaggccacttcagggctgaagcgcgtgctcgctgcgtagatgtcccgcgtgcacgacgccaggctcggcaaggcggcgaggttgcggtagctcgggtcgatcaggtccatcaccagcgcggcctgatcttcgggatggcccaccacgcggccttccaccttgatcaggttggggtgcaggccagcggcgatgcaggcctgcatttcatgcaagggtgaaccgtcgctggtgatcgcgcctttgtacagtttgaccgccacaggcaaggcctgcggcttccatagcgccttgcggatgatccccgaagcgccttcgccgagcacgtcgcccagctccagttccgcccaggcaatgttcggcgttgcgtcatgggcggctacgtccaccgccatttccaccgggttgccggcataggccagccaggtcaggctcggcagcgtcagcagccactcgggcaattgggtcaggcggttggaggcgatgcggatcagctccaggttgtggcagttgatcaggctgtgcggcagttccgtcagttggttgccggccagcatcagtttttgcagcagcggccgctcgcccaattcgctgggcaattggctgatgcggttatcggtgagaatcagccagcgcaattgcggcggcagggcggcggcgggcacgtggctgatctggttggccttgaagccgatcatgcttagcttggcgcactggcccaggcattccggcaacgcggtgaaggcgttatccgagcaaaacagcacacgcaggtgcgacaagcgatgcaggtcgtcgggcaggctgctcagggcgttgcccgtgaggttgaggatttccagcgagtcggccagttcgaagatttcccgcgggaattcggtcagcccgcaggacaggtccaggcgcgtggtgccggccaattggccggccttgagttgggcgagggtattcatgaacggcgcggtcactcggcaagagggcgtaaaaggcgctcatgataccgggtgatgcgcgggttgcgggcacaggctttgcaattcggcgctttgtaattgatgcaggcggctggcggtgcgggcaaggtcgatggcctggccttccaggcagtgcgccagcggctgttgaccgatcagcgtcaggcgtttgtcctggtcgtaaagcacatccaccaggttgataaaacgctgttgcacggcgattgggcattcggccaattgcggcagcccgtcgatgatccagtggtcgaagtcctggcacagcagcaggtaatccatcacggccgtgagctgttcgcaaaggtcgttgaaggtgaaaacgatggtcggcgcctgatggctgcgacaccgcagctggcggttgccgacttgcagggtctgcgccgggccatccacggcgggcagccccagcgcttcacgctgggcggcggtgccgggccatacatactgaccggcgctgaagcgctgctcggcatgcgcctggggcaggctgcgaaagtcctggggcgagctgacttccagcacgtccatgcgtgcggcgatcaggtcgatcaccggcttgaaccgttcgtggtacagcgggttgggcagcaacccctcgggggcatagttggaggtcaccagcacccacacgccacgctggaacaaggccttgaacagccggctgatgagcatggcatcgccgatatcgtgcacatggaactcgtcgaaacacagtacccggcaacccgccagcagttcgtccagggtgacacccaaggcatcgtcgtgctcgcggtgctggaacatgccgcgatgcaggcgcgcaaaaaacgcgtggaaatgcacgcgctgcttctcggcaatcggcaacgcctggaaaaacccgtcgagcagccagcttttgccgcgccccaccgggccgtgcaagtacaggctgcgcgtcggcgtgccggtgagcaggtgctcggtctcgcgggccagggcggcaattgcctgggtttggccggtgctgagggtgtagccctgctgctcggctttttgcttaaagaacgccgggataggcgaggggcccgaaggtacggtggttttaccgagcagacgccggatcaggggaagcacagccaatgcaagtcactctgtaatgcggtggtcgctcactttagggcgcccgttacgttttgaccaatagagaagggcgctgccagctatctcgaaacagcatgtcgcagctgtaatcctgtccagactggcagtttccccctgagtgactaacctcctacacagcaattacccctgtacaaaggattgggtgcagtgaagggacgagtggtattggcagtcatgggcacgatgctctgcagcacggttaacgctgcgcagctccaagtggaggtgcgcatcgacgtgcagcggggctgccagctggtgggcaccacccgcagtgctggcatcgagcagcttggcgttttggatttcggcagcggcccgcgtctggatgacccggccggccccttgagtgcggcgctgatcagccagcgccagccacgcctggaatgcaaccccgacacgccctatcaaatgcgcgtcgacggcggcctgcacggcggcgcaggcgaagtacgctacctgagcgccgcaaccccttcgagcaaacccattccctatcgtctttacgccgatgcagcgcggcgaattccgttgtccgtgaatgaaccgctgagcgggcgcgtgccggactccggctcggtcgacctgccgctgtatggccgcatcgaaccgctcaaagacatccccgccgtcggccgctacaccgacctgctcaaggtcacggtcacatggtaagccgggtctgggcccttgtggccatgggcggcctgttgctgctggcggatgacgcccaggcggcagcggtcaacgggcagatccacgcgcgtttggtgatcaccgccagctgcgaagtcagtaaaggcgtagaaagcgccccggtcagccccacgggcggcaccgcgatgctcgacttcggcagccaggggccgacctggagcaaccccttgggcgcaggcgtgaccgacggcagcaaggcgccgctgtcggtgtcgtgcaacccctcggtggtcagcagtttcaccgtgaccatcgacggcggcgccaacggcgacggcaccacacggcgcctgagcaacgggcgccagaccattccctatcggctatcggctgacccgctgggccgcagcgactacagcatcggccaacaacgcaatttcgtcgtgaccaagggcacacaagtaccgatcccggtattcggctcggtggtggcgaataccagggccctaccggccggcatctacacagacaccctgacggtgactctggattggtaaaccatgaggatgaacatcatgcatgcacttgtatcgaaagcggtttttccattgatggcgctggtgtgggtgtcgggggcgcaggcggcgaccgtggccggcaccgtcaccgcgacgctggtgctgaccagcagttgccaggtcaatggcgcggcggcgaccggcgggatgagcttcggtaacttgaacttcggtacggccaacagcctgttcaccgaagccgacggccaggtgctgggcggcggtggcggggcgttgtcgattctgtgttcggcgggcacttcgccgacgctgaccgtgtccgccggcgccaatgacggcaaatccaccggcggcgcccgcgcactctacgacggcgtggccaactacgtgccgtatgacttgtacaccgacagcggccattcgcagctgctggccatcggcggggtgatcaacctggcaccgagtacgggggttgcccaggccgtgaatatttacggtaaggccaatggcaaggccgggctgccggccggtacgtataccgacacggtcaacgtgacgctgacgttctaagggccatgaaccgggcggggtgggcggcgttggcggtgtgcatcggctggggcatgccggtgtcgctgctggcggtgaccagccaatcgttccaggtcagcgcgacgatcacgcccggctgtctggtggtcggtggcgggacgaactacggcagcctggtgttcggcacatactcggcactggcgaccagcacggcgtcggtcgcactcaccggcggcgtgaccctgcaatgtacgccgggggtggcgctgaacatgagtgtcgatggcggtttgcacaacaacagtggcaggcggatgcagctcaatagcggcaccgcccaagtggcgtatcagctgtttcgggacgcggcgttcagccagagcctgggcatcagccaaagcgtgagcgtgacctacgccaacgccgccagcatcaccttgccgatttatgggcgagtgcagttaccgggtaatacgcctggggggacgtacagcgacacgttgcaggtgcagctgtcgtggtaaggcgattggcaataaggagtgagacctatgtatgcagcttcccggcagtggtgggcagcgggtttaagcgcggtgttggggttggcggcggggcaggcccaggcggccagctcggtgctgatttggccgattgacccggtgctggaggccgatcaacaggccagcgcattgtggctggagaaccgtggcaccgagaccgccaacctgcaaatccgcgtgtttgcctggacccagagcggctttgatgagcagtaccagaaccagcgcgacgtgattggcagcccgccggtggcgaaaatcgagccggggcagaagcagttggtgcgcctgacccgtaccaaagaggtgccgccgggccaggaattggcctatcgcatcatcatcgatgagatcccttcggccacgccgcccgccgccccggccgatggcaagaccgccgccgcggtgcgtttccagatgcgttactcggtgccgctgttcgcctatggcccaggcctgtggagcaaggtcgacggcacccgcgatcgcgacccgaagggcgccggcaagccggacctgagctggaaaaaagtcaacattggcgggcgcaactacgtcgagatgcgtaaccagggcgccgtccacgcgcgtttgaccgatgccaccttcaagcagggcggccaaccgcggccactggtggaaggtctgatgggctatgtgctgccgggcgcgaccatgcgctgggcggtgccggatgggctgccggcggatcagccgttgcaggtacgtgtgaatggtgcgacgcaactggagagcctcgcgccagggcgataaaacagtgcggtagggcatggagcatgcccctggtgttaacggatggagatgtccattgatggacacaaagccttggtgagccatggtcgggctcgatatctatggcgatcggtgtgggtggtgagtggcttgtctggtctggcgtttgcggcgccgagtctggccgcgccgttgccgccccctcccagcagtatggaggctgttgccgatgctcagttgtttctggaactggtggtcaaccagatggacaccgggcgcgtggtcgccgtcaatcagcgcgccgggcaattgtttctgccggcctcggtgttgcaggagatcggcatgaagctgccaggcgaggtgggcgccgaggtcgcgctggaaaacctgccgggcctgcacaccgattacgacagccagggccagcgcctgatgctcacggtgccacccgcctggttgcaggagcaatttatcggcagccgcaataactacccgcgcacccaggccctgaccagtttcggcgcgttgctcaactatgacgcctacctgaacgacacggatgacgccggcacttacctcggcatcttcaacgaagtcaggctgttcgacagctggggcacgctgtccaacaccggccagtaccgcaccaccattggccgggagatggtcggcagcagcctcgacaatggctatcggcgctatgacaccacctggcgcttttccgacgatgagcgcctgctgacctacgaagcgggcgacgtgatcagtggcgccttgccctggagcacctcggtacgcctgggcggcgtgcaggtatcccgcgactttggcgtgcgccccgatctggtcacttaccccttgccacagttcgccggggaagcggcggtgccgtcgtcggtggacctgtttatcaacgggtacaaaaccagcagcgccgacctgcagccggggccgtacaccctcaccaacgtgccgtttatcaacggcgcgggggaggcggtggtggtcaccaccgatgccctcggccggcaggtgtcgaccacggtgccgttctatgtcaccagtacgctgttgcaaaagggcttgtcggacttctcggtggcggcgggtaacctgcgtcgcgattacaccgtgcgcgatttcggctacggccccggcgtggccagtggcacctttcgctatgggctctcggacgcgtttaccctggaaagccacgccgaagcctccggcgacctggccttgggcggtgtcggcggcaacctgcgcatgggcaatttcggcgtgctcaacaccgccgtcagccaaagccagttcgacggccgcaccggccagcagttgagcctgggctaccaatacagcaatcagcgttacagcctgtcttaccaacgcgtggaacgccgcgatgaatacgccgacctgagcctggtcgatacgccgtatgccagcctcagcaagcgcagccagcaagcgaccttgagcctgaacctcaacgacttcggcagcctcggcgtgggctatttcgatgtgcaggcggcggacgattcgcgcacgcgcctggtgaatatgacctggagcaaatcgctgtggcgcaacagcagtttttacctgtcggccaaccgtgaagtcggcgacagcagttgggccgtgcaggcgcaggtggttattcccttcgacgtctacggcagcctcagcgtgggcagtgagcgcagcaaaaccgggcaaagcctgcagcgcgtcaactacagccgtgcggtgcccgccgaaggcggcgtgggctttaacctgggttacgccagcggtgatggcccggcttatcgtcaggccgacctgacctggcgcctgcagtcggtgcaattgcaggccggcgtgtacggcaccagcgatgccgaaacccgttgggcggatgccagcggctcgctggtgtggatggacaaccaagtgttcgccgccaaccgcgtcaacgatgcgtttgtggtggtgagtaccgacggcgtcagcggcgtgccggtgcgctacgagaaccaggtggtcggcgaaaccgaccgcaacggccacttgctggtgccgtggaccagcgcctactaccgcgccaaatacgagatcgacccactgaacctgccggccaacgtacaggtgccgaatgtcgagcaacgcgttgccgtgcgccggggcagtggttacttgctggcgttcccggtgcgccgggtgcttgccgcgagcatcaccttggtcgatgcccagcatcaggagttgcccctgggcagccaggtgcgccatgaacaaagcggcgcgttggcggtggtcggctgggacggcctggtctacctggaaaacctcgcggcgcataacaccttgcaggtcacggtcggcgacggccagacctgccaggccacgttcgagctcgatacatcacaggagcaggtgccgctgatcgggccactggtgtgccaatgacataaaggagtgtgcgtgtgcgggtcaaggaatggctgttgcggttactgctgttggcgggcctgggtatgtcggcaccggtgcaggccgtgtgctcggtggtcgccaccgtcccggccagctttggcacgacggtgagttcgatgaccgtgcgtaccacctcccagcccagttcgaccaccaacggtggcttgagctgcacgcccgccgtactgtcggtattgacctccagcgaccatttttacgcaaccgttaccggctcggcgcaaggcggtttggtcgggccaaccggtgacgtgatcaactatacggtctacgccaacaacaccaccgcgttcccgatgacacgcggcacggcgttcgattttggcggcagtggcgggattgccgcgtcccttggcctggtattcgggcccggcacaaaagtcgtgccgttgtactttgccaccaccattggcagcaacgtggccgcaggtgtgtacagcgaaaccctgagtattttctggaactggaactattgctccggcatcggcatcggcgggatatgcctgggccgcgaggtcaacagtggcactaccacgctgaatgtgagcatgaccgtggtcaatgactgccagatcaccacaccgcccatcgcgttcggcagtgcgccggtggtcggggcgttttccaccgtcagcgggcaggccagtgtggcgtgcaccaagggcagcgcctataccgtgggcctcagcgatgggcagaaccccgtgagcgtgggcgggcggcggcggatggtgtccgggagtaattttctcgcctacgacatcttccagggggccggcaccacccgctggggcagcgtgggcgcggcacggcgggccagctccacggccgagatcaaccccggtaacggcctgggcaccggcagccaggtgttcaactacaacgccaaggtctacaccgaccagaccacgccgcccgctggcacctatatcgacaacgtggtgctcgatgtcggcttctagaacttcaacgtagtcggctgacccaccgggctgaccacggcgtagttgtagccgctgccggaccagtactcggcctgcaagccatcggcgctgcggctgccgcgcggcaggaagccgttttccgggcccggtgggcggatgtagaaactgatgcgccgaccttgcccgtcttcgtacagcaccatggcggcggcgccttgctcggtggtgagcaaacgcccgctcaccggtttgaaccccgattggctcaagtccggcaggcgatgggcctggttgaagtagcggtccagccaggcctgcatgctgccgctgtcctcggcgttgtagtcggcgggcatgatgccgtcctgtgcaaacaggcggaacgcctgcatcgcgtcggccatcggcagcatcgccggttgcgtggcttcacgggcgtgccagccgccaatgccgcccaggctgattgcgatcagcagcacggcggcgctggcgaagtggcggcgcgactgatgcttgatgcgctggcgaatcagtgccgggtccaactcggggttggcgggttgctgcaacgcgccgctcagtgacgcgcgcagcgcctgcgcatcttgttgccaggcgtgcacctgggcggcgacttccgggtgggccgccaaataggtttcaagcacgcggcggtcactctccaacagttggtgatcgacgtaggcatgcaaatcgcgttcgctggggggcaggctgatcatttgagtatccgcagggaagggctggcaatttcgccatcgctgagttgacgcaaggcttggcgcgccctggacaggcgcgacatgacggtgcccacgggcacctcaagaatagcggcaacctccttgtagcttaagccttcgaccgacacccagagcagcaaggcgcgctgttcggtattgagttgatcgaaggcttgcagggccgattgggccatcaccgtgcgctccaccgacggttgcgcgtcgtcacggccggtgaagaagtcgagcatgcgcgcgtagcggcgactgcggcgatgggcgtcgaggaactgccggtagagaatcgagaacagccaggcgcgcaggtcgccttcgatgcgtttgtcggcccaactgatgatcgctcgctcaagggtcgactgcaccaggtcgtcggcgctgctggcgttacgggtcagggacacggcaaagcgccgcagcctggggatgacttcacgtaactgttcgtcgagttcgtgcatggggctggtgtctggctaagtatgtaggtggaggacgccggccatcgtaggttattccatcagcggctgtaggaatgctgaatttttacgtaggagatatcggtaatgtcgatgggcctgtaatacccctcacgccgctcaatcaaccctcgtacctgccggaaacccttcggcagtgaccgaatgagggtgtgttcatgagtgtgtcaccaaccgataaagcagctttttccctgaatgcgctcggtcatctgcccgccgaacaacagggcaaattcgagcactgggggcgtggggcgtctgccacgccaagtcatggctgcgtgcatcacgctatcgaaatgcaggtagcgctcgcacctcaggcggtcgccgccgaatgggcgggccagcgtatcagctatgaacagctcaaccgccaagccaaccgactggccgcgcatctgatcgagcaaggcgtgcggcgcggcgacacggtggcgttgttcgttgaacggtcgattcccatgctggtggggctgctggcggtgttgaaggtcggtgccgcgtatgtgccgcaggatgcccggatcgtgccgccattgcagttggcgagggtgcttgagtcattgagcagcccgctggttctgaccctgtcgaacctgaaagattgcctgccctcggccgccatgcagagtcacctgtgccttgacgagttcctcgctcaagagccctgggtggcgcaggacaataaccgaccgttttctgcagccgacaccgatgacctgtgttttgtactgtttacctccggcaccaccgggcgccccaatggcgtgcgcgtaagccaccgcaacctgtgcaacgtgctgctgacggaacctgggcggatgggaatggcgcccggccgtaacgtggggcagattctcaatatcggttttgatatggccgcctgggaaatactcggctgcctggcgcagggcgcgacgctgctgatccgcggtaaggactttgcgcaaacggctgcgcgctgccatgtgttgatcgcaaccccctcgatattggcgacgctggcgcccgagcagtgtcctgatctgaaggtggtcgcggtcgccggtgagccctgttcccaggcgctggctgaccgttgggcagggcattgtgagttctacaacggttgcgggcccaccgaaaccaccatcgtcaacacgttgcatcggcatgcgcctggcgccgcgttgaccatcggcaggccaacgcccaacaacaccgtgtatgtgctcgatgccgaaggccgcgcctgcgaactgggtgcaacgggtgagatgtgggccggtggggcaggcgtgaccgccggttacctgaacaacccggcgctgacccaggagcgttatcgtccggacccgtttctgggcggggatgcactgatgtttcgcacgcgcgatctggggcgctggacgtttgatgggcagctcgaacacctgggacgggtcgatgatcaagtcaaggtgcgcgggtttcgcgtggaactggacgcggtgtcccgtgcgctggaggctggcgaaggctgtgcgcaagccgtcacgctcaagctcgacgaccgcaccctggtggcctttgtcgtgccggccagcgccaatgttgatgactgcaaacaccagtgtgagcagcagttggcgtactactgtgtgccctcggtgatctgcgcggtggagcatttcccgctcactgcccggggcaagatcgacaaggcattgctgttgcagcaggcgcgcaaacgccacgttgccaggcttgccctgccggcagaggaggccatgtatgtttgatcggctggcccaaattgtcgtgccgccgaagccgccactttggcggcgctggcgcgcaatgccgatattttcctattacaaccgtctcgttgcgttggtgttgctgggcaatatcgcgttcgtgctgctcgggctggattggcaaaccccgtccgtgcagaccctgtcgcagatggtggtgatcaacctgtcggtggcgatcctggttcgccagcattatgtgatcaatgcgttgttctggctggcaacgcgcgtaccgctgtgctggccgctgcgtatccggcgcagtgcggcgaaggtttaccacttcggcgggctgcacagtggcgcggcgctggccgcgaccgcgtggttcacggcgatgttcggtgttcagggcgcacggtatctgcagcaaccgggcaatgtgtcgtcggtctggatgtggctggccagcctgctgctgggcctgttgctgttgatggtgatcatggctcatccccaaattcgaggccggtttcacaacggtttcgaacgggtccatcgcttcgccggatggtcggcgttgctgttgttctgggggctgacgctgttggcgtcgattgaggaggacgcgcagttgttacgaagcggcgcgttctggatgctggtgttgctgaccttgagtatcgccttgccgtggctgcgcctgcgcaaagtcgcggttgaacatacgcggccttccgggcacgcggttattacccgcttcacgcacaccaccccgtttgccggttcctccaccacgatcagtcggcacccgctgttggagtggcacgcgtttgccaatatcccgacaccgaacgaggccgggtttcgcttgatcatttcccgggccggggactggacggggcgcttcatcgaggatttgccccgccacgtgtgggtcaagggcatcaccacggccggggtcgcccatgtggaaacgttgttcaagtcggtggtgtacgtggcgacgggcagcggcatcggcccggtaatgccgcacctgttggcggccaaggtgccgatccagttgatctggtccacccgcagcccgaggacgacttacggtgatgcgttggtggacgaaatcctgcgcgcgcagccgaacgcgctgatctgggacaccgatgaacgtggcaagcctgacctggtgcaactgacctacggcgcggtgcaggtgtttggcgcggaagccgtgatctgcattgccaatcagcgtttgacgcggcgcgtggtggaagaaatggaagccaggggcatacccgcttatggcgcgatctgggattcgtgatgcaagacgcggtttcagtacatcaatctatggaggtgtttatgaatgtaatagtcgagcgtcacggtcgggtagtgttggtccgtctgaatcgccccgaagtaaaaaacgcattgaactcagcgctgatgtcggagctggtcacctgtttgacgggcctggaccaggaccctcaagtcggttgttttgtggtcaccggcagtgccgagtatttcgccgccggggccgatatcagggaaatgagcggcaagtcgtatctggacatgctcaacgaagattatttttgcggctgggagggtttcaccaggctgcgtacgcccaccatcgccgccgtggccggttacgcttatggtgggggatgtgagctggcgctgatgtgcgacatgatctttgccgccgacaccgccaccttcgctcagccggaaatcaagctgggcgtgatcccgggcatgggcgcgacccagcggctgacggggttgatcggcaaggccaaggcgatggatctggtgttgaccggccggccgatgctcgcccaggaggcggagcaggcggggctggtgtcgcgggtttatccggcggcggtgttgctggaagagacgctggcggtagcgacgcagattgccgacttttcccgcacggccacccgggcagcacgtgaggctgtggggcaggccctggaggttggattgcacgatggcgtgcgtcttgagcgccggctgtttcatggtttatttgccacacccgatcagcaggagggcatgcatgcgtttctgagcaagcgccaggctgtgttcaatcaggtgtaggagatgcgcgatctgctctgagaataactacagtgaagggggaataaacctacgtgggattcgtctcatagctcttttccctctgtgctggagcttttcatggtagatcactcatcaccgccccgtccgccgctcagcacggcgagcctgatcgcacggctcgccggtatcggcgccgtggttgccgttgtagccggggcgtttgcctacgtcaacggcacgctcgacccacagcgcctgcgtcccaagacgttggtcaacgccctggaaaccaataacggcctgcacccgggcttccgccgcaaccatgccaaaggcgtgtgtgtggccggttatttcgagagcagcgctgaggcgcgcgcttactccagtgcccaagtgttcagcgaggccaaaaccccggtaatcggccgttttgccttgcccagcggcaacccttacgcaccggacagcagtgtgccgatccgcagctttgccctgcagttcagccaggccaacggccagcaatggcgcaccggcatgaacagcatgccggtgttcccggtgggcacacctgaggcgttttaccagatgctcaaggcgggggcgccagacccggccaccggtaagccgaacccggcgagcatgccggcgttttttgccgcgcacccggagacggcgccgttcctggcgtgggtcaagacggccaagccttcggccagttacgcgactgaaacctacaacggcatcaatgcgttctatttggtgagcgccgatggccagcgtcaggcggtgcgctggggcgtggtgccgcagagccaggatgcagcgggcgataccgcgccgtcgggcagtgattttctcgaaaaagacttggtacagcgcctggcttcagggccgctgcgttggcagttgaacatgaccctggccaaccccggcgaccctttggatgatgcgagcaaaacctgggccggtgaacacaaggtgctgaacgcgggcactctggtgctgcaaagtagccagccgcaagcggacggtgattgccgcgatatcaactttgacccgctgattctgcccagtggtattcaagcctccaacgacccgctgttggctgcgcgctcggccgcctatgccagttcgtatgtgcgccgcgccggtgaagtcagcccactgcacagtgcccatcaggagtcgaagccatgaatgttcaaccacaattttttgcgccactggcgcgtctgctgcattggctgatggcattgatggtcatcgccatgttgtttatcggcgcgggtatggcggcgtcggtgtcggaacgccatgagtggttgattcacctgcacaagccactgggcattgcgattctggcgctggtgattgtgcggctggtggtgcgtttttccacccggcaaccgccactgcccgctgatttgccgctgtggcaagcgctggcagccaaggcgtcccatgtggtgttgtacgggttgatgctggtgttgccgctgctgggctgggcgatgatttcggcggccggtgacccggtgatgctcagcagttcagtgcaattgccggcgctggtgggggccaatgcgccgttgtttgcgctgttgcgcaaggcccatggttacctggcttatctgctgtttctgacggtgttgttgcacttggcggcggcactgttccacgggctgattcgccgcgacggtgtgctgcaaagcatgaccggtaccaagcactgatggttgtggcgagcgcgcacgctcgctcgccacaacaagcagtcagcgcaagttgccgacgatatcggctacggtgctcagtacgtccttgcccagctgtttcgagcgctcacccgaccaaccggtcttcgggttgggcgcgtcgtcgttgtccttgaagggcatttccagggtcagcgacaggcagtcgtacttttcaccgaccgcattgcaggccagcgtcatgttggcctcgcccggcaggtcgcgggtgtaaccgtgggtggtctggaaatcacgggtcaacgcgctcaagtggctgcggaactgtttttccagggcttccagacgcggtgtgtagcctgggttgccttcgcaaccggcggtgaacacgtaggggatttcttcgtcgccgtgtatatcgaggaacaggtccacgccgtacgtttccatctgctgctggacgaacagcacttccgggctgatttcctggctggcgctctgccaggcacggttgaggtcctggcccatggcgttggtgcgcaagtggccgtggaaggcgccgtcggggttcatgttggggatcaggtacaggtcggcgacggacagcagctttttcagctcagcgtcaccgtcctgttgcagacgctcgatgatgccttccataaaccactcggccatgtgttcgccggggtgttgctgggcgatgatccagacgctgcgtcggccttcgccacctttgccgcggcgcagcagttggatgtcgcggccttcggcgcttttaccggtagccagcaattgggtgccggcccggttcacggcctgctcgatcagccaatcgtgacgctcacggctgtagggttcgaagtaggcgatccaggcgtgcttctcgcgggtttccaggctgatgtgcaaggtttcgccatcaaagcgcgtgggcacgcggaaccagttgatatggtcgtaggacgccaccgcgttgtagccgctccaggcgtttttgtaggaggactggctcgcgttgctcaggcgaaacgtgtgggtgtggcccacgtgcatgccttcggccttgaagtggaaccattggaaatgcgcgctgcgggtatcgggtttgatcgccagcagcaactgataggcgtcgctggcatccaggacctggatattgccgctgtcgaagtcggtgctgatcttgatggaggtcaaggccacggtcatagtcgggtcgcctgagtacgagaggtgtggcggatatcttacaaggagtcaggcaaaattctgatgcgaaattgttgcagaggggagggggcgtcgtccttgacgccgcagcagcttagaatctatgagattgattctcaagcgctatttcgcaaagatccgggctagagcgcccgtgcgactttcttttggcgatagtcttttgctaccatgcgcgccatcgagcaacacacagtcttcattagcctgaagccatgccagggaaactggcaaaaaaagacccggccaaagagccgggtcaaaaaccgtgattagcctgatgaggagatattccaagagtccgacctaaggtcccttggtctatcgactgatctcgcgatcagctgagcccaataataatcattatcatttgcaagtcaaatgtttttatccgtgggatagaaatatttttgcgcgctgccggttatgcgtttgcctgacccgctggcgcccgcaacgtctgctccaccatcgccttcgccatatcaatcaaatacaccactgaaaacgccaggtcccgcccgtcgccacggcggctgcttgccgactcataggctgccgctgctgcgctgcgcaacaggtctgaagcgtgaatcaacgcgtcctcatggctgatgccgggcttgatgtcgaaaaacggctcatccgcgaccggcgtgcacacatcttctttcaagtaatagtcgagtgcgcgccgggcggcgccgctgttgcgcatccccagcagttcgtcggtttcaggcgtgccgggcaggtgattcgggctggtcgtcatgagggcgggtactctgagtgaatgtcgaaaaccttccctcgataatagtacgaatcgtatttatgtcatttgatggattactacaaactgtttattgtcgtggcaaatacgcaacgtattgtctcgcccatggataactggatagcgttggtcaaagccaacatgaaagaccgcaaggtcacgcaggatgaactggccgaacgcttgggcatgtcccagggcggtgtcggccattggctcaacaagcgccgtgtgccaagcctggcggacatgaaccgggtgctcgccgagctggggttgggctacttggaagtcgcgctcgaaattcgccagaaagccgaagaggcgccggctctggaacatcactacaacccgtatttccgctacccggtcagcgactggaaaggcgtctgcgaaatacgtgaagaacgcccgacctacggcgccccgcgtttcgaactgaccgattaccacgcccgtggcgaagccttctggctgccggtgacgggcgacgccatgaccgcccccagcggcctgagcatcggcgccggcatgatgatcctggtggacccggccatcgatgccgaacccggcaagttggtggtcgcccaatgggccgacagccgccaggcaacctttcgccaattaagggaagaaagcggccagctttacctggtgccgctcaatcccacttaccccaagctgctgttcagcgacgattgccgaatcctcggcgtggtcgtgcaagccacggcgaagttttagcccgccgtttcaagctcgaccagggcactgccttcggcaaccatttcgccttcctggaaaaacagtgctttgaccaccccagcctggggcgcgcggatgctgtgctccatcttcatcgcctcgagcaccaccagttgcgaaccggcttcgactgcctggccgacctccaccagcacccgcacgatgctgccgttcatgggcgccgtgaggccaccctgatgggattggttagcctcaacggcggcaatcgggtcaaacaggctgacggcatgcatctcgccgtcccagcgcaggtacacaatgccctcgctgcgcaccgccagatgagcgcgacgcacgccgttgtgttcgatccacagctgctcgtctcgccactgcgcgttggcggcctctagcctcacccgccggttctgcccattgcagctcaaatgcagtgacacttcggcaggcagcccggtacgaaacccgcgcgtatcggcccacggaccactgtctgcgggcaaactctgcataaacgccgcgcccgccacctgccagaacgcatcgctcaattcacctggctcgggcagcagctcgtcctgataacgcgggataaatccggtgtccagctgcgctgccgcaaatgccggatgaccgatgatgcgccgcaaaaagcccaggttggtcttaagcccgcccacggcaaactcatcgagcatgctcaacaaccgcaggcgcgcctgttcgcggtcttcgccccaggcaatcaacttgccgagcatcgggtcgtagaacggcgatacggtgtcgccttgtgctacgccgctgtccacgcggcggcccgggcctggcgccgattcgcggtacagcgccaggtgcccggtggccggcaggaaatcattggccgggtcttcggcatacaagcgcacttcaatcgcatgcccgatcaacggcacctgctcctgcgtgatcggcagcggctcaccctgggcgactcggatctgccaggcgaccaggtcgaggccggtaatcgcctcggtcaccggatgctccacttgcagccgcgtgttcatttccatgaagaaaaactcgccacgcgcgtccagcaagaactccacggtacctgcacctacataaccgatggcctgcgctgcgcgtacggcggcttcacccatggctttgcgctgttcaacactcaagcccggtgccggcgcttcctccacgaccttttggtggcgacgttgaatcgagcagtcgcgctcattcaggtacaggcaatgcccgtgctggtcggcgaacacctggatctccacatggcgcggcttgagcaggtatttctccaccagcatctgcccattgccgaaggacgacagtgcctcacgctgggccgacgccaaggcttccgccagttggctgacgtcctcgaccaccttcatgcctttgccgccgccgccggccgtggccttgagcagcaccgggtagccgatgcgttcgcaggcatcgcggaaggtttccaggtcctgggcttcgccgtgataacccggcaccagcggcacaccggcggtttccatcaacgctttggcggccgatttgctgcccatggcgtcaatcgccgaggcgggcgggccgaggaaaatcaggcctgccgcttcaatcgcgcgtgcaaaaccggcgttttccgacaaaaaaccatagcccggatggatcgcctgggcgccgctggcctgggcggcggcaatcagcttgtcgatctgcaagtaactgtccgtggccttgctgccgcccaagtcaacacggatatccgcctcgcggctgtggcgtgcatcgcggtcgatggcgctgtggacggccacggtggtcaggcccatggccttggccgtgcgcatcacgcggcaggcaatttcgccacggttggccactagaacagtggtcagtgtgttcatgaacgaggctcctgcgcttgccagctgggcgggcgtttttgcaggaaggcgcgcaagccttcctggccctcggcgctgacgcgaattcgtgcgatggcgttttcgcaatagcggcgcagggccggggtgagggcaccattccccacttcgcgcagcaagtctttgctggcgcgcatcgcggcggggctgttttgcagcaggttggcaacccagtgttccacctgctggtcgagctcgccggccgggtagctttctgccaacaaaccgatgtcccgcgcacgctggccgccaaagcgttcggcggtcagggcataacgccgcgccgcgcgctcgccgatggcctgcaccacgaacgggctgatcaccgccggggccaggccgatacgcacttccgacaagcagaactgcgcgtcatcggcgccaatcgccatgtcgcagcaactgatcaggcccagcgcgccaccgtaggcggcgccttgcaccaccgccagcgtggggattttcagcttggccaggttgtacatcaactccgccagctcgcgggcgtcgtcgaggttggtgtggtagtccagctcggccgattgctgcatccaggccaggtcggcaccggcactgaagtgcttgccacgcccgcgcagcaccaggaagcgtaaagaagcgtcgccctgtacatggtcgagggcgatgatcagttcgcggatcatttcggcattgaacgcgttgttcttggcttctcgactgagccacagcgtggcaaagccacggcggtcggtaatcagttcgagggtgttgaaatcgctcatggggtacggctccatttacatgcggaacacgccgaagcggctcggctcgattggggcattcagcgaagcggacaaggccagggccagcacctcacgggtttgctgcgggtcgatgacgccgtcatcccacaaacgcgcactggagtagtacgggtggccctgagtttcatactggtcgaggattggctgcttgatcgccgcttcttcctcggcgctcaagtctgtgcctgcgcgttcggcttgctcacgtttgacctgcaccagcacaccggccgcctgttcggcgcccatcacgccgatgcgcgcattcggccacatccacaaaaaccgtgggtcgtaggcgcgcccgcacatgccgtagttgccggcaccaaagctgccgccgatgatcacggtgaacttcggcaccttggcgcaagccactgccgtgaccagcttggcgccgtgcttggcgataccgccggcttcgtacttctggccgaccataaagccggtgatgttctgcagaaacaacaggggaattccgcgctgacaggccagctcgataaagtgcgcgcctttttgcgcggcttcagcgaaaagaatgccgttgttggccaggatcgcaatcgggtagccgtgcaggtgggcaaaaccacacaccagcgtggtgccgaacaacgccttgaactcatcgaacactgagccgtcgaccaaccgcgcgatcacctcgcgcacgtcgaacggttgcttggcgtcggcggggatcaccccgtaaagctcttcgctgctgtacagcggcgctaccggcgtgcgttgcagcagctcgccctgtttgcgccagttgaggttggccacgctgcgccgggccagggccagggcatgctcgtcactgtcggcatagtggtcggccacgccggagatcttgcagtgcacgtcggcgccgccgaggtcttcggcgctgaccacttcgccggtcgcggctttcaccagcggcgggccggcgaggaagatggtcgcctgctggcgcaccatgatcgcttcgtcggccatggccggcacataggcgcccccggcggtgcacgagcccattaccaccgcaatctgcgggataccttgggcgctcatgttggcttggttgaagaagatccgcccgaagtgctcgcggtcgggaaacacttcatcctgacgcggcaggttggcgccacccgaatcgaccaggtagatgcacggcagacggttctgctcggcgatggtctgggcgcgcaggtgttttttcaccgtgagcgggtagtaagagccgcctttgacggtggcgtcgttggcgacaatcatgcattcgacgccttccacgcggccgatcccggcaatcaccccggccgccggcacgtcttcgccatacacctgatacgcggccagttggctgagctcaaggaacggcgaaccggggtcgagcaagcgattgatacgctcgcgaggcagcagtttgccacgcgaggtgtgccgctcctgggccttggcgccgccgccttgctgcacgtgggcgagcaggctgtgcagggcgtcgacttgtaggcgcatcgccgcgctgttgtcggcaaattccgccgagcgtgggttgagctgggtgtgcaaggtggccatgggcgtgctccttcagcgggtttcgttgaagagttcgcgaccgatcagcatccgccgaatctcactggtaccggcgccgatttcgtatagcttggcatcgcgcaacaggcggccagccgggaattcgttgatatagccgttgccgcccagaatctgaatcgcatcgagggccatttgtgtggcgcgttcggagctgaacagaatcaccccggccgcgtccttgcgcgtggtctcgccgcgctcgcatgcctgggccaccgcgtagaggtaagcgcggcaggcgttgagttgggtgtacatgtcggcgaccttgccctggatcagctggaactcgccgatgctctggccgaactgcttgcggtcgtggatgtacggcacgatcaggcccatgcacgcttgcatgatgccgatcgggccgccggccagtactacgcgttcgtaatcgagaccgctcatcaacactttcacgccgccattgagcgtgccgaggatgttttcttcggggacttcgacgtcatcgaaaaacagctcgcaggtgttggagccgcgcatgcccagcttgtcgaacttgttgctgcggctgaagcctgttgagtcgcgctcgacgataaatgcggtgatgccgtgcgggcctttttccaggtcggtcttggcgtagatcacgtaggtgttggcgtcggggccgttggtgatccaggtcttgctgccgttgagcacgtaatgatcgccgcgtttgtcggcgcgcagcttcatcgagaccacgtcggaaccggcattcggctcgctcatggcgagggcgccgatgtgctcgccgctgatcagcttgggcaggtacttgagcttctgttcgtggctgccgttgcggttgatctggttgacgcacaggttggagtgcgcgccgtaagacaagcccaccgaggccgacccgcggctgatttcttcgatggccaccacgtgggccaggtagcccaggccggcgccgccgtattcttccggcactgtgatgccgagcaagcccatgtcaccaaacttgcgccacaggtcggcggggaacaggttgtcactgtcgatttgagccgcgcggggcgcgatttccttggccacgaaggactgcacctggtcgcgcagcatgtcgatggtttcgccgagggcgaagttcagggacgggtaactcatggacaggcaccttaatgtgagctttgttgttgtgtggacgacgcgccaggggagggcgctcacctttacgttaacgtaagcttgcgttgcggcgctgtcaatcgtagtttacgtttacgtcaacctacaaaaaagacaacaggggtcgttatggatcaaccgaatcagagctacagccgtggcgctcaggacaagaccttgctggccatgaccatcggccaggcgttcgatcacacggtgacgcagcatgccgatggcgaagccttggtggtgcgccatcagcagcgtcgctacacctggcggcaactggccgaaacggttgagctgcacgcacgtgccttcctcgccctgggcatgcaaaccggcgaccgcctgggcatctgggcgcccaattgcgccgagtggtgcatcagccaaatcgccagcgccaagctgggtgtgattctggtcaatatcaacccggcctatcgcagcagtgaactggactacgtgctcaagcaatccggttgccaatggctggtgtgtgccgggtcgttcaagggctccgattaccacgctatgctgcaggaactgcaacccgacctgcgcgcgatcatcagcctcgaccccagcccgcccccagggtttatgccctggcagcaactggcagccctcggcgcaggcgtcccgcccgaacaactgcacacgcgccaggccagcctgcacttcgatcaagccgtcaacattcagtacacctccggcaccaccggcttccccaagggcgccaccctcagtcaccacaacattctcaataacggctacatggtcggcgaaagcctgggccttaccgcgcaggaccgcctggtgattccggtgccgttgtatcactgcttcggcatggtcatgggcaacctcggctgcatcacccacggcaccaccatgatttaccccaacgacggcttcgacccgctgctgaccttaagcgccgtcgccgaagaacgcgccaccgggctgtatggcgtgccgaccatgtttattgcgctgctcgatcacccccgccgcggcgagttcgacctggcgaccttgcgcaccggcatcatggccggcgccacgtgccccatcgaagtgatgcgccgggttatcagcgagctgcacatgggcgaagtgcagatcgcctatggcatgaccgaaaccagcccggtctcgctgcaaaccggcgcgaatgacgaccttgagcgccgcgtcaccaccgtcggccgcacccagccacagctggaaaacaagatcatcgacaccgacggcaacacggttgcacgcggtgagatcggcgaactgtgcacccgtggctacagcgtgatgctcggctactggaataaccccgaaggcacccgcgacgccatcgacgaggccggctggatgcacaccggcgacctggcgagcatggacgagcacggctacgtgtgcatcgccgggcgcaacaaggacatgattattcgcggcggcgaaaacgtgtacccgcgcgagctggaagagtttttcttcacccacccggcagtggcggatgtgcaaattatcggcatcccggatgagcgttacggtgaagagatcgtcgcctgggtcaagttccaccccggccatgtggccaacgcgctggagctgcaaacctggtgcaagggccgcattgcgcacttcaagacgcccaagcatttcaagttcgtggatgaattcccgatgacggtgacgggcaagatccagaagtttcgcatgcgcgagatgtcgatcgaggagctgaaaacccagcccaactgacaacccaaaaaccatgtgggagcgggcttgcccgcgatagcggtacatcagccacagatgcagtgactgatagacagctatcgcaggcaagccagctcccacataggtaaatggcagaaagcacaaaggggacccgaaggtcccctttaatttgtcgttgcgtgctctttttttattattgaggggcggtctattgttgtttttggcaaccgttaccctttaccgctgttttgggtgacccccatccggggtcaagagcaaacgtatttttttgagcgctgatctgcttcttcgttatcgatccaaccagtggtagctacctgaggtagttttatttttctctaaccggttgcgggtttcggcacgccgtaccctgcgaagcacatcttctccaaaaaaatctgttagctgcgtctctgccgtgttgtttttgttatgtcagagtcgtttcgtcttatttttattaggtttggcgctttttattcttgttatgcaatagagatagcagaaggcgtgccaacttttaaaagtcctttaaaatcaatggcttgattttttggtgtgcagtggcatagggcaaatcgggcaaaatatgttcccgtgttactcgttaagtaggcgtgcggtaacacattgtcacagcaatgctactcaacctgcgttacgcgccttggccacccgcgagccgctgggtcggccgagcacctggctgatttgctcgcccgcgcgaatcaacgcgtccaggtcgataccggtgtcgatccccaggccattgagcaggtacaccacatcttcggtggcaacgttaccgctggcgcccttggcataagggcagccgccgaggcccgcgatagagctgtcgaacacattgatgccttcgagcaggctggcgtagatattcgcgattgcctggccgtaagtgtcatggaagtgaccggccagcttgtcccgcggcacctgcgcgccgaccacctcgaacagccgccgtgtggcacctgccgtgccggtgccgatggtgtcgcccagggacacctcatagcagcccatcgcatacagttcacgcgcgaccgccgcgacctgttgcggggcaatctcgccttcgtaagggcaacccaacacacacgacacatagccgcgcacgctgacgccatgttgttgggccgccgccatgatcggcgcaaagcgctccaggctttcgctgatggaacagttgatattgcgctgggaaaacgcctcggaggcggccgcaaacaccgcgacttccttcacgccggcggccagggcatcttcaaaaccacgcacgttcggcgccagtgcaccgtaggtgacgccgggcttgcgctgtatctgcgcaaacacatcggcggagccggccatctgcggcacccacttgggcgacacaaagctgccgacttcgatgtagctcaagcccgcgtgagtcagggcatccaccaactggaccttatcggccacgctgatcggccgtgcttcattctgcaaaccgtcgcgcgggccgacttcgaccaggcgcacgtgtgaggggagggacatgatggctaccttgtggttattggccaacctggctgatggtctgcgccagggcctgggtgcagcgctcttcggcggtgtccagctccagcttcatctgttcgatatccagcagttgttgctcaagctgctcgcgtcgctcggcgatcttggcaagcatgctgttgagttggatatggttgccactgctggggtcgtagagttcgatcaattcgcggcactcggccagggagaagccgatgcgtttgccgcgcaggatcagcttgagactgaccttgtcccgcgccgaatagatacgctcctggccccggcgttccggggccagcaggccttgttcttcgtaaaagcgaatggcgcgggtggtgatgtcgagctcgcgggcgaggtcggaaatgctgtaggtcgtgctcatgggggcgctcaagaaggtcttggcgctaagctaatggcaggttgacgtaaacgtcaaggggcgctgcgccgcccatcgggggcaagccccttcccacccacagcttcaggtcaggcctgcttgccatccagcttcttctcatgcgccgtcacctgctggcacaactcgatcatctgctcacgcatccagcggttggccgggtcctggtcggtgctttcgtgccagtacaggtgggtttccaccggtggcacatcgttgaccggcaggttgaaccagtgcagctcatggcggcgggcgaagcgctcgggcacggtcatcaccatgtcggtctgctgcaacacttgcgaggccatcaagtaatgctgggagcgcagggcgatcttgcgctggatgcccattttgcccaaggccaggtcaacgtggcccaaaccgttgcgacggctggagatatggatatgtgtcagcgacaggtagtcatccagcgtgaacttgtccttgcccgccagcgggtggcctttgcgcatggcacacacgtagcggtcttccatcagcttgacgtgacgtacctgcgggtcggtgttgagcggcgcgtccacggcaaagtccaggcgcccggcagccagttccttggtggtttcgcggcgcttggacagaaaactctcgatcaccaccgtcggcgccaggcggcgcaggcgctggaacagcagcggcaaaatcaccgcctcggtgaggtcggtcatgctgatgcgataggtcttggccgcttgttgcgggttgaaaatccggctttcctgcactgatacccgcagcaacgacaacgcgttgcgcaccgggccgatgatgttctgcgccatcggcgtgggcaccatgccctgggcggtgcgcacgaacagcgggtcgttgaaggtttcgcgcaagcgcgccaacgcgttggacaccgccggctgggtgatgccgacgatctgcccggcgcgggtcaggttggcttcggtgtagatcgcgtcgaagacaataaagaggttgaggtcgaccttgctcaaattcatttcgttgcgctcttattgttaggtgttcatacgccgatcatatatcggtgatgaatgttaatacacgccgagaataggctaggtaaattatcaacgctgttctagcatcgattgcatgacctaaacaacctctcagagaagggagctgctcatggatttcgcctattcgcccaaggttcaggaactgcgtgaacgcgtcaccgcgttcatggacgcttacgtttacccggccgagccggtgttcgaacgccaggtcagcgaaggtgaccgctggcagcccaccgccatcatggaggagttgaaagccaaggctaaggccgaaggcctgtggaacctgttcctgcccgagtccgaactgggcgctggcctgaccaaccttgaatacgcgccgctggccgaaatcatgggccgctcgctgctgggcccggagccgttcaactgctccgccccggacaccggcaatatggaagtgctggtgcgctacgccaacgaagagcagaaacaacgctggctcgaaccgctgctgcgtggcgagattcgttcggcgttcgccatgaccgaaccggacgtggcctcttcagacgccaccaacatggccgcccgcgccgagcgccagggtgatgaatgggtgatcaacggcaaaaaatggtggacctccggcgcctgcgacccgcgctgcaaaatcctgatcttcatgggcctgagcaacccggatgcgccgcgtcaccagcagcactcgatgattctggtgccggtggatgctcccggcgtgaaaatcgtgcgcccgctgccggtattcggctacgacgacgcaccccacggccacgccgaagtgctgttcgacaatgtgcgcgtgccctacgaaaacgtgctgctgggtgaaggccgtggctttgaaattgcccagggccgccttggcccaggccgtatccaccactgcatgcgttccatcggcatggccgagcgcgcgctggaactgatgtgcaaacgctccgtcagccgtactgcgttcggcaagccgttggcacgtttgggcggcaatatcgacaaaatcgccgactcacggatggagatcgacatggcccgcctgctgaccttgaaagcggcgtacatgatggacaccgtcggtaacaaggtcgcaaaaagcgaaatcgcccagatcaaggtggtggcgccgaacgtggcactgaaggtaatcgaccgcgcgatccagattcacggtggtgccggggtgtccaacgacttcccgctggcctacatgtacgccatgcaacgcaccttgcgcctggcggatggcccggatgaagtgcaccgcgcggcgatcggcaagttcgagattggtaaatatgtgcctaaagaactgatgcgcagcgggcagtaagaccgagtcgcctgcatcgcgggcaagcccggctcccacaggagcatgcattccaacatgtgggagcgggcttgcccgcgatgaggccagtgtcagccacacaaaatctgcaggtcagtacacccaaacctccacccgccgattcttgatccgcccctcatccgccgtattcgccgccaccggcatctgcgcgccaaacccgcgaatatcgcgcagcactacgccgcttttaaccaactcgcgccgcaccgccatggcccgcaacttcgacagcaacgccgcccgctgcggatcatccttggcatcaccaaagcccaccagcgttacctgcttgtcgagcttggcgtggctgcggatatacgccaccacccgctgcaaatcctggcgggccttgttgtccaggctggcgctgccttcctcgaagcgaaaattcaccgtcaaacgctgcgcgtcacgggcaatggcttgatagtcctcgggcattgaggcgcgtggctccacgccgattgcttgcacttgctgggcaataaaaccattggccgccacaatcgcctggcccttgctgctctgggtaaagtccaccaacgccttggcccaggggttgcgccccgacggtggcaggtagaagtacaaacggcgtgacagcgggtaatcctcggtggcgatcaggctggtcaccggcaacataggctgcgaatcgccgtcgacaatcgccaccgccttggcctggcgcaccgacggcaggccgataaacccaatgccttgcgggtcatggctgaccgcatccgacaaggcttcgctggattcgaaacgctgtgcagaacttgcaaggggcttgccgcgcgggcgcagcaccagttccttgaatgtgtcataggtgccggattggtcatcgcgcgcatataaatgaatggcgccaccacggccgccgagtgcttcccaggtgctgacctcgccgttgaagacttgtgccaactgctcggtattcagcgtgttcagtgggttgctcgggttgaggatgatggccaggccgtcgatggcgatgacttgttcggcttcggggcttttcaggtcgccgaggggttcgaggtcaaccagttcgctgtccttgatcgggcgggacgacgcggccaggtcggcgctgccttttttcagcgccgtaaacccggtgctggaaccgtgggcggccacctcgatgatcaccggtttgccctggcgcgtcttgccgaccacacgctgttcattggcgccgtcgcccggctcgctgtgcaccgcctgcaagccctggtgttccatcagccccttgaccagcgccgggccaagcgccgcgccaatggtgttggaaccctggatgcgcaatgcggagccatggtcggggatgggcaggggtgcagccacggcgcagaggggcagggtcaacaggaacagaacgcgcagcatcatgccggcaccttcttaagccaaagggggtgccgggagattaagtcagttggatttcaacaatatgacgggtacacaacaaaaccaaaggtgggagctggcttgcctgcgatggcatcacctaggacattctgaaacactgaggtgcctgcatcgcaggcaagccagctcccacacaagccatctccgacattgagtcgcgtcagctcaactcaagccagatcggcgcatggtccgatggcttttccaaaccacgcaagtcgtaatccacgcccgcatccttcacgcggggcagcaagccattggacgccatgatcacgtcaatgcgcagcccacgcttgggctcatcctcaaagccacggctgcggtagtcgaaccagctgaaacggtcggccacgtccgggttcaagtggcggaagctgtccaccaggccccagtttttcaggcgggccatccactcgcgctcttccggcaggaagctgcacttgccggttttcagccagcgcttggcgttgtcggcgccgatgccgatgtcgcagtcttccggggaaatgttcacgtcgcccatcaccaccagcgcctgctcattgctgaactggctttccagcaggtgctgcaaatcttcgtagaagcgctgcttggccgggaatttggtcgggtggtcgcggctttcgccttgagggaaataaccgttcatgatggtgacagggttgccgttttcatcggcgaaggtgccccagatgaagcgacgctgggcgtcttcttcatcactggcaaagcctttgtgcacgctcagcgcctctttgcgcgagagcagtgcgacgccgtagtgacctttctggccgtggtaataaacgtgatagcccaaagcctgcacttcggccaatgggaactggtcatcatggaccttggtttcctgcaggccgatcacgtcgggttgatgcttttcaatcagcgccgccagctgatgagggcgagcgcgcagcccgttgatattgaaggagacgattttcatggtcggcagtccagtctggcaaaagggcgatgctagctgacaagtcggatgggggccagcgtggcggcagggcggttgcactgctaatgtctgggaacgactcgcgccgtacaagttcgtacccataagaacgccatcttttgagtggcgcccagggagattgactgtatgcctgacacttcgactgccaccgccgacattcgcctgctcaacagcggctattcgcgcgaggcgcgttccatgttgtaccaggcctatcggcatgagccgactttcgcctacatcttcgaggctgaacggccgggctatgaacagcgggtgcgcgccacggtgcgcgagctggtcaagcagcatttttttcagaaactgcccgccatcggcctgttcgtcaacgaccggctgattggcatcgccctgatcgcgccaccgcaacggcgcctgggcatcaccgagagttgggcctggcaattgcgcatgtggctgagcaccggtgtgcgcggtacgcggcgctacctggaataccatcacgcggtgctggcctgcctgccgagcgagtcggtgcatgtgctgccgctgttgggcattcatccgcaatttcagggtaaacactacggcgagcaactgctggaagccgtgcacaattggtgcgccgaggacccgcattcgtcgggtgtggtgctcgatacgggtaactcacgctacctggatttctacaagcgtcagggctatgaggaaatcggcgaagtggccataggacccgttttggaacatgtgtttttccatcccaatccccaaacgttacatgctgcaacggcttagacagaattattcagacaattccgggttcaaagagcctccctagctcgtgtagcatccgcgcctatgaagtttccaggaagatttaccagcggcttgattctgctgttcacaagctgcggcgcgttggcgcaaagcgaactggacgtgcggatcaaaccttcaaacgacgcgttgaaagccaacatcgaaggctatatcggcggggtcggcgatcgcgatgaagaagccttgcagcgcttcagccgtggcgccgaggagcaggctcgcaaggccgcccaggcgctcggcttctatcagccgcagatcgccagtgaggtcaggggcggcaagaacccgcgcctgaccctcaccatcgaccccggcgaaccggtgcatttgcgcaacgtgaccatcaaggtcgacggtgaggctgcgagcctcaaggcgtttcgcgtgcctgccagcgacgacctcaaatccggcgccgtgctcaaccacggccattacgaagacgccaagcgtctgatccagaaccaggcttcgcgctacggctttttcagtgggcgctttacccgccaaaaactctcggtcgaccccaaagcgggcgtcgccgatatcgaactcgtttacgacagcggcccgcgctacagcatgggcaaggtcagctttgccggcgacacgccgttcgatgaagagctgctgcaacgcatggtgccgttcaaaagtggcacgccttacgactccgagctgatcgccgaactcaaccagaacctgcaatcgagtggcttcttcgaggccgtgcgtgtcgacgccagcccagccgcgtcggccaacgatgtgatcccggtggccgtgcaactggaaacccgcaagccccgcaccatgggcctgggcctcggttattcgaccgacgtcggcccgcgcggcaaagccaactggacccgccactgggtcaacccgcaaggccacagttacggctgggaagccgaactgtcggcgccacgccagaacgtcggcctgtggtacgacattcccctggacccgccgctgaccgataaattgcgcttcgccggtggttaccagaacgaagaaatcgccaacaccgacaccctgagtaaattgctcaccctgggccccgaatggcacagcaaattgcccagcggctggacccgggtcatctcgctcaaataccagcgcgaagaataccgcctgggcaatgactcgggcctgagtaacctggtgatgccgggtatcaactattcctacctgcgcagcgacaaccgcatcgacccgcacaatggttaccgcctgatgttcgatgccaaggtcgccaaggaaggcctgggttccgacaccaacctgctttacggcacggcgacggtcaaaggcttgaccaccttgtgggataaccaccgcttcctcgggcgtgcgcagttcggcggcagcgccaccaatggctacaaatccgtgccgccgtcgctgcgcttctttgccggtggtgaccaaagcgtacgcggctacgagtaccagaccttgtcaccggagaacgatcgcggtgaccgcatcggcggccgctacatggtggccttgagcgccgagtatcaatattccatcgccgaaaaatggcggatcgcgacctttatcgaccaaggcaactcgttcaacaccctcgaaatgcccagcctgaaaaccggtgtgggcgtgggtgtgcgctgggtgtcgccggtcgggccgattcgtcttgacctggcccatgccctcgaagatccgggcggcattcgtttgcacttttccatggggcctgagctgtgatgcgtggtttgaaaatagcggggctggccgttgtggcggtccttgccgtggtgttgttggcgctgtggaccgtgctcggcacccaagcaggcagccgttgggccttgggccaggtgccggggctgacggtggaaaatttccagggccacttgggtggccagtggagcgccgatcatctgctctggcagcaggacgccagccgcgtcgaactcaacgcgccgaagtttgagtggtcaccggcgtgcctactgcgcatgaccttgtgcgtcaatcagctggatgtggagcaggtcagcctgcagtttccgcccagcaccgaggaaagcagcagcggtccgattcaactgcccgagttaaaactgccggttgcgatccagttgggcgacgttcgcgtcggtagcctactgtttaatggcagcgaagagctcaagggcctgcaattggcggcgcactggacggctgccgggatgcagatcgactcggtgcacctgcagcgcgacggcttggtgctggacctcgcaggcgttgtgcaaccaaccggcgactggccgctgagtgccacgggcaacctgagcctgccttacgcacccggtggcgcgccgtggcaagttgcgttgaaaatcgacggtgacctgctcaagaccctcaagctcgacgccgacagcagcggctacttgcccgccaagctcagcggcgagctgcaaccgctggtggagaacctgcccgcgcaactgcacatcaccgctgacgctttcaaacccagcgccgagttgcccgacaccctgcaactcaatcaactggacctcaccgccaagggcgacctgagcagcggttatcaactgctgggcaaggccgttctgccagcggaaaagggcccggtggacctgctgctgcaaggcaaagtcgacgccaagggcgcgcagatcgccggtctggatttgaccgccggcgaccaacaaaacctcaaactcagcgccaacctcgactggcaacaaggctttagcgctgacgccaggatcgactggctggatttcccttggcaccgtctctacccattgatcgatgagccacaggtcgccttgcgcaccttcactggcgaaatctcttataaagacggcaactacctcggcaaccttaaagccgacctcgacggcccggccggcaagttcaacgtggtcacgccgttcagtggcgacctcaagcaaattttcctgcccgagctgaaactgacggctggccaaggcaaggccgaaggccatctgaacctgcagtttgccgacggcatagcctgggacaccgcactcgacctgtcggcgttgaacccggcgtactgggtcgctgagttgccgggcacattggccgggccattgcgcagcaaaggcgaattcaaaaatgaacagctcaagctgaacgccgacctcgacctcaagggccgtttgcgtggccaagccgccgtgctggcggccaaggccgaaggtgcgggtgagcaatggaccctggccaacctggatattcgcctgggcgacaaccgcatcaatggcagcggcagcctgcaacaacgcctggccgggcagatcgatatcaagctgtcgcgcctcgcccaactgtggccgcagctgcgcgggcaaatcaatggccgcgtcgatgtggccggcacgttgaaggcgccgcaaggcaagctcgacctcaagggccagcagctggcattcgcggacaatcgcctgcaaaacctcagcctcgacgccacgctggataacgcccagcgcgcgaagatcgacctcaagggcagtggcatccaggccggtgagacccaagtcggcaccctgaccgccagcgcccaaggcgatatcaaaagccagaaagtccagcttgacctcgccgggccgttggtcaaattggccctggccttggacggcaacctggacaaaggtaactggcgcgggcgcctggccagcggtgacgtacaagccggtggccaggactggaagctgcaggcgccggcgaaaatcgaacgcctggccgacggcaagctgacgtttgccgcgcattgctgggtgtccggccccgccagcctgtgcggcgaagaccaacggctgatgccggaaccgaagctgcgctaccacctcaagcaattccccatcgacagcctggcggcgttcctgcccaaggacttcgcctggcagggcaagctcaacgccgacgtccaacttgacctgcctgacagcgggcccaagggcgtcgtttcggtcgatgccagtggcggcacgttgcgcgtcaaggacaaggaccagtggctggatttcccttacgacaccttgaagctggaaaccacgctcaatcccaagcgtatcgacacccagctgaatttccgtggcggcaagctcggcgagttgctggtgcaggcgcagatcaacccgctgccgaagaacaagccgatcaccggtaatttcagcctcaacggcctggacctcgcagtggcgcgaccgtttgtgccgatggtcgaaaaactcaccggcaagctcaacggcaacggccgtatctccggtggtttgttggcgccgcaggtcaacggcagcgtcaacctggttggcggcgaaatttccgggccggaactgccgatcagccttgaaggcttgaacgtgcaagcgttgattgccggcgaaagcgtgcagttgaatggcgcctggagcagtggcaaggccgggcagggcagcctcaaggggcagatcgactggggccaggccttggtggtggacctcagcctgcaaggctcaaaactgccggtcaccgtggagccttatgcgacgctggaagtggcgcccgacctgaaaatcagcctgaaaaacgacaagctggcgattgccggcaaggtgcacatcccgcgtggcgatatcaccgtgcgtgaattgccgccgtccaccgtcaaggtctcggatgacaccgtgatcgtcggcagccagaccgaagagggcaagccgccgatggcgatggccatggacatcgacgtggtggtgggtgaagaccagctcaacttcgccggcttcggccttaccgccaaggtccagggccaggtgcacattggcgacaacatggacacccgtggcgagttgtggctcaacgatggccgctaccgcgcctatgggcagcggctcaatgtgcggcgtgcgcggctgctgttcgccgggccgttggaccaaccgttcctggatatcgaagccatacgcgtggtcaccgaaccgtccagaaccgtgaccgccggcattcgcctgagcggcagcgccgaacagccgaccacgcaaattttctccgagccggccatgccccaagaggatgcgctgtcgtacctggtgctggggcgttcgcgcaacaacaccggcgaagacaacaacatgctcgccgaagcagccttgggcctgggtttgatgggcagcgccggggtgacctcggatatcgctaccaagctcgggatccaggatttcgacctcgacacccagggcaccggcaataacacctccgtggtcgccagcggcaagatcaccgaaaaactcagcctgcgttatggcgtgggggtgttcgaaccggccagcaccattgccttgcgttatttgctgagcaaaaaggtatacctggaagtggcaagtggcgtggccagctcgctggatatcttctacaagcgcgatttctaagcccttacgcagtaaaaaaatgtgggagcgggcttgctgtggcgagcgggcttgccccgcgctgggctgcgaagcagccccaaaacggctaatgcgctccccccccggataaacgcgctggcaggttcagggccgcttcgcgccccaacgcggggcaagcccgctcgccacggagaacggtggcgccccgtagaagttccatagatgccagctccgacttttatttgtatgccaagccttccgtcgcgaaattagcaagcaagctaataattccatttgacattcgctgcctaagcagtaacatcttgtcatacattcactgcctaggcagtaataaggtgacttccgatgccccacttcacccctgacagctttcgcaactgccacctcggcctgttgctcggccgggcggcgctgctcaaggaccgcattatcgacacccatatggaaccgcatggcgtcaccgccgcgcagttcaaggtgttgatcatcattgcccagtttgacgtcgacaccccggccgagctgtgccgcaacttgtcgctggacagcggttcgatgacgcgcatgctcgaccgtctggagcaaaagggcctgctggcgcgcaagcgttccgagcaggaccggcgccaagtgcagttggtactcactgaagacggccagcgcctggcagacatgctgccgcacatcggtgcgcagtcgatgaacgaactggccggcgccctggagcccggtgagttgcaaacgctggaaaaaatcctcacgaaaattctggtagctgccggtgacgccatcgtcatccagcgggtaggtaatcaatgaacacacgcgcacttagcctggtgctggtggcgatgagcatggccggttgcgccaacttcagcggcctcgacacccagggccaacgcctcgacgccaacaccttgcaaaccggcaaatccctcagtggcgtgacgctgtccagcgccgcgtggccgactgccgactggtggaaaagccttggcgacccacaattagacggcctgatccacgaagccctgcaaaacagcccggacatgcaagtcgccagcgcccgtgcccatcaggccgaagccgccgcctatgccgccgacgccgcacgcatgccaaccctggatgccagcgccggcgtgagccgttcgcgcctggccaaggatcaggacccgcgtggcgaaggcgatgcctacgccaccgtgcgaaatatcggcgccagcttcaattacaacttcgacctctggggtggccagcgtgccgcctgggaagctgccttggggcaggcacgtgccgccgaagtcgatcaacaggccgcccgcctgaccttggccgccaacgtcgccaaggcttacagcgacttgggccaggcccacatcgtgcgtgacttggccgccgacgacctcaagcgcacccgccaaatgctcgacttgagcaagcgtcgcctgagttccggcatcgacagccagtaccagtaccagcagaccgaaagcctggaagccagctcccagtcgcaactgatcgatgcggaaaaacaactgcaaagcgccaagatcgccctcgccgtattactcggtaaaggcccggaccgtggcaacgaactgacccgcccgaacgtgctgaaacccagcgccgttgcggtgccttcggtactgccggccgagttgctgggccgtcgcccggacctgatcgccgcacgctggcgcgtcgaagccgcaagcaagaacattgccgcgagcaaaacccgcttctaccccaacctcaacctgagcgcgagcgccggggccgagtcgttgctgggggacgcgatgtttggttcggccagccgtttcttcagcattgcgccgacgatctcgttgccgatcttcgacggcggccgcttgcgcgccgacctcgatgctcgcgatgccgattacgacctggccgtggcccagtacaacaaaaccctggtgcaagccttgggcgatattggcaacaccctttcgcaattgcgtgacaccggtcggcagatccaggcgcagcaacacgccgcggacattgcccagcagtcttacgacaccggggtgcaacgctacagctcggggatcggcaattacctcgatgtgctcagcatcgagcagcaattgctgcaggcccagcgtcagctggcgacgctgaatgcggcacagatcgatctgtcgattcaattgatgcaggccctgggtggcgggtacgacgccaaaaacgtggccgcgaccaccccagctacacgcacggaataatttgaggtaattgtcatggccactgccgaaaacacccaagcaaacgaacaacccaaagacaccaacccgcgcaaacgcaagatcatgctgattggcctggcgctgattgtcatcctcggcgccttgggcgtttggggctggtatgagctttacgggcgcttcaatgaaagcaccgacgacgcttatgtgaatggcaacgtggtggaaatcacgccgctggtgacgggcactgtggtcagcatcggcgctgacgatggcgacctggttcatgaaggccaggtgttgatcaacttcgacccgaatgacgctgccgtcggcctgcaaagtgctcaggccaacctggcgcgtaccgtgcgccaggtgcgtggcttgtacagcaacgtcgatggcatgaaagcccaggtactggcgcagcaagccaacgtgcaaaaagcccaggacaactacaaccggcggaaaaacctcgccgccggcggcgcgatttcccaggaagagctgtcccacgcccgcgatgacctgacctcggcgcaaaacgccctggccaacgtgcagcaacagttcaaaaccagcagcgcgctggtggacgacacagtgatttcgtcgcacccggacgtacaggccgccgccgcgcaactgcgccaggcttacttggccaatgcgcgcagcaccttgattgcaccggttaccggctatgtggccaagcgcaccgtgcaactgggccagcgtgtgcagccgggcacggcgttgatggcggtgatcccgctggatcagctgtggattgatgccaacttcaaagaaacccaactgcgcgatatgcgtattggtcagccggtggacatcgagtcggacatctacggcagtgacgtcaagttcagcggcaccgttgacagcctgggcgccggtaccggcagcgcgttcgccctgctgccggcgcagaacgccaccggtaactggatcaagattgtgcaacgggtgcctgtgcgtatccatatcaacgccgacgaactggccaagcacccgctgcgtgtgggcttgagcaccgtggtcaacgtggacctgcacgaccagagcggcccggtgctggcgcaacaggcgccgcaaaaggcctcgttcaccaccaacgtgtatgaccgccaattggccgaagccgacgccatgatcacccagttgatccatgacaacagcctcgccgcgcccaaggctgtgcaacgctgatgagtgctaacgcccccgcgtcctttacgccgccgagcttgttgatggccacgattggcctgtcgctggcgacctttatgcaggtgctcgacaccaccatcgccaacgtggcgttgccgaccatttccggcaacctcggcgtgagttcggagcagggcacctgggtcatcacctcgtttgcggtgagcaacgccattgccttgccgctgaccggctggctgagccggcgctttggcgaggtgaagctgtttttgtgggcgaccatcctgtttgtgctggcgtcgttcctgtgcggtatttccacctcgatgcctgagctgattggctttcgggtgttgcaaggcctggtggccgggccgctgtacccgatgacccagaccttgctgattgcggtatacccgccggccaggcgcggcatggccctggcgttactggcaatggtcacggtggtggcgccgattgccggccccatcctcggcggctggatcaccgacagctacagctggccgtggatcttctttatcaacgtgcccatcggtatctttgcggtgatggtggtgcgttcgcagctgaaaaaacgcccggtggtcaccagttaccagccgatggattacgtcggcctgctgagcttgatcgtcggtgtcggcgccttgcagatcatcctcgacaaaggcaacgacctggactggttcgaatccaacttcatcattattggtgcggtgatttcggcggttgccctggcggtgttcatcatttgggagctgaccgacaagcacccggtggttaacttgcggttgtttgcctatcgcaattttcgcatcggcaccattgtgctgatcctggggtacgcgggtttcttcggcatcaacctgatcctgccgcaatggctgcaaacccagatgggctacaccgccacttgggcgggcctggcggtggcgccgatcgggattctgccggtgctgatgtcgccgttcgtgggcaagtacgcgcacaagttcgacctgcgcttgctggcgggcctggcatttttggcgattggcctgagctgctttatgcgcgccggcttcaccaatgaggtcgacttcacccacatcgccctggtgcagctgttcatgggcatcggcgtggcgctgttcttcatgccgaccttgagcatcctgatgtccgacttgccgccggcgcaaatcgccgatggtgcgggccttgccacgttcctgcggaccttgggcggcagctttgcggcctcgctgaccacctggatctggattcgccgcgccgaccagcaccatgcgtacatgagcgagaacatgaccacctacgactcggcaacccgcgatgcgttgcaggcgcttggcggggcagggcacaaggcctatgcgcagctggaccagatcctcaccagccaggcgtacatgatgtccaccgtggattacttcacgttgctgggatggatgttcatgggcttgatcgtgattgtgtggctggccaaaccgccgtttgcggcgaaggccgggccggaggcttcggggcactgatccgcaacgcgtgaaatgcagtcaagagtgggagctggcttgcctgcgatacaggcacctcggtacatcagatacaccgaggcgatgctatcgcaggcaagccagctcccacaaaagcctgtttgcacatttgatgtgtgttgcggggttcaagccccaggcaacgccaactgcggattgacgaagtcaaacgccgacaacgcaaacccttgctcatccacctgcaacgcccaaccctgcttgtcccaatcgcccagcacaatgcgcttggccgcctggtcgccaatctgcaacttatgaatggcggggcggtgcgtatggccgtggaccaaggtgcgcacgccaaactgctgcatcacccttggcacttcctcgggcgtcacatcgacaatgtcgttggctttcatgcgcacctgggcagtgctctcgctgcgcagcttgcgtgccagtttgtgccgggtgcgcaagggcaggtgccgcaggacaaacaacacaatcgggttgcgcaggatgcgtcgcagcttcatatagccgacgtcgcgggtgcacaggctgtcgccgtgcatcaatagcacgggctcgccataaaactgcacgacactcgggtccttgagcaaggtggcgcctgccgctttgcagaacgccttgccgatcaggaaatcgcggttgccatgcatgataaaaatcggggtgccgctgtcgctcagctcgcgcagagccgcgcaaatcgagcgttggaacggtgtcatcccatcgtcgccaatccaggcttcaaagaaatcccccagaatgtacaacgcctgggcgccacgggcgcggccgtggagcaaatccagaaacgcccgggtgatatccgggcgcccctcttccagatgcaaatctgaaatcagcaatatcacccaacgatctcggctttttcgacgataacgtcttctaccggaacgtcctggtgaccggctttaccggtggtctgcacgcctttgatcttgtcaacgacgtcctggccttcggtgactttaccgaataccgcgtaaccccaaccctgcacgttcttgccgctgtggttcaggaaggcgttgtcggccacgttgatgaagaactgtgcggaggccgaatgcggctccatggtacgggccatggcgacggtgtacttgtcgttggaaaggccgttgtccgcttcgttctggatgcttgggcgcttgtctttcttttctttcatgccaggctcgaaaccgccgccctggaccatgaagttaccgattacacggtggaaaacggtgccgttgtagtggccagcattcacgtattcgatgaagttggcgacggtgatcggcgctttctcggcgttcagctcgatgacgatgtcaccgtggttggtggtcagtttgacttgagtcatgttcactactcttttcagggaattcgtgggtttggacgcccgggcgccgctaccggtttggcgaaacagcagccaaggcgcgcagtttagcgtgacctgcaggaatttcgaggtggttttttaccgcctgggtaattaatgcagcagttttgggccgcgctctgtcagtgtcttgacagcttcggctatcataagccctttgttttatcggccccacttccggccaagcacttcgtctgttcaaggatcctatgagcaagcccactgtcgaccctacctcgaattccaaggccggacctgccgtcccggtcaatttcctgcgcccgatcatccaggcggacctggattcgggcaagcacacgcagatcgtcacccgcttcccgccagagcccaacggctacctgcacatcggtcacgccaagtcgatctgtgtgaacttcggcctggcccaggagttcggtggcgtcacgcacctgcgtttcgacgacaccaacccggccaaggaagaccaggaatacatcgacgccatcgaaagcgacatcaagtggctgggcttcgagtggtccggtgaagtgcgctatgcctccaagtatttcgaccagctgttcgactgggccgtcgagttgatcaaggccggcaaggcctacgtcgacgacctgaccccggagcaagccaaggaataccgtggcagcctgaccgagccgggcaagaacagcccgttccgcgaccgttcggtcgaagagaacctggactggttcaaccgcatgcgcgccggtgagttcccggacggcgcccgcgtgctgcgcgccaagatcgacatggcctcgccgaacatgaacctgcgcgacccgatcatgtaccgcatccgccatgcccaccaccaccagaccggtgacaagtggtgcatctaccccaactacgacttcacccacggtcagtcggacgccatcgaaggcattacccactccatctgcaccctggagttcgaaagccatcgcccgctgtacgaatggttcctcgacagcctgccagtgccggcgcacccgcgtcagtacgagttcagccgcctgaacctgaactacaccatcaccagcaagcgcaagctcaagcagcttgttgacgagaaacatgtgcacggctgggatgacccgcgcatgtcgacgctgtcgggcttccgccgtcgcggctacaccccggcgtcgatccgtaacttttgcgagatggtcggcaccaaccgttccgacggcgtggtcgactacggcatgctcgagttcagcatccgccaggacctcgacgccaacgccccgcgcgccatgtgcgtgctgcgcccgttgaaagtggtgatcaccaactatccggaagacaaggtcgacaacctcgaactgccgcgtcacccgcagaaagaagagctgggcgtgcgcaagctgccgttcgcgcgggaaatctacatcgaccgtgatgacttcatggaagagccgccgaagggctacaagcgcctggagccgaacggcgaagtgcgcctgcgcggcagctacgtgatccgtgccgacgaagcgatcaaggacgccgatggcaacatcgtcgaattgcgttgctcctacgacccggaaaccctgggcaagaaccctgaaggccgtaaggtcaagggcgtgattcactgggtaccggccgctgccagcatcgagtgcgaagtgcgcctgtacgatcgtctgttccgttcgccgaaccctgagaaggcggaagacagcgcgagcttcctggacaacatcaaccctgactcgctgcaagttctcaccggttgtcgtgccgagccatcgcttggcgacgcacagccggaagaccgtttccagttcgagcgcgaaggttacttctgcgcggatatcaaggactcgaaaccaggtcatccggtattcaaccgtaccgtgaccttgcgtgattcgtggggccagtgattttctaaggaagccgttgtgctaacgatctacaacacactcagcaagaccaaagaagtcttcaagccgctggatggcaacaaggtgcgcatgtacgtgtgcggcatgaccgtgtacgactactgccacatcggccacggccgcagtatggttgccttcgacctggtgacccgctggttgcgcttcagcggctacgacttgacctatgtgcgcaacatcaccgacatcgacgacaagatcatcaaccgcgccaatgaaaacggcgagtcgttcgacgcgctgaccgagcgcatgattgccgccatgcacgaggacgaggcccgcctcaacatcctcaagccggacatggagccgcgtgccacggaccacatccctggcatgcacgcgatgatccagaccctgatcgacaagggttacgcctacgccccgggcaatggcgacgtgtactaccgcgtcgccaagttcatgggctacggcaagctgtcgcgcaagaaaatcgaagacctgcgcatcggcgcacgcatcgaagtcgacgaagccaagcaagacccgctggacttcgtgctgtggaaaggcaccaagcccggcgagccgagctgggagtcgccgtggggcgcgggccgtccgggctggcacatcgaatgctcggtgatgtccacctgctgcctgggtgagaccttcgacattcatggcggcggcagcgaccttgagttcccgcaccacgaaaacgaaatcgcccaaagcgaagccgccaccggcaagacctacgccaacgcctggatgcactgcggcatgatccgcatcaatggcgagaagatgtccaagtccttgaacaacttcttcaccatccgcgacgtgctggaaaagtaccacccggaagtggtgcgttacctgctggtttcgagccactaccgcagcgccatcaactactcggaagacaacctcaaggacgccaaaggcgccctggagcgtttctaccacgcgttgaaaggcctgccggccgtggcgcctgccggcggcgaagggttcgttgcacgctttaccgaagtgatgaacgacgacttcggcacgccggaagcctgcgcggtgctgttcgaaatggtgcgtgagatcaaccgcctgcgcgagactgatctcgacgcagcggccgggcttgcggcgcgcttgaaagagctggccagcgtgctcggtgtgctgcagatggaagccgatgacttcctgcaagccggcgccgaagggcgtgtggatgcggctgaagtggatgcgctgattcaggcgcgtctggcggctcgtaccaataaagactgggcggagtccgaccgtatccgtgaccaactgaccgcgatgggtgtggtgttggaagacggcaagggcgggacgacgtggcggttggctgatcaggcttgatcggtaaacgctgaatgaaaaacgccccgacgggttcggggcgatcgttcccacgctctgcgtgggaatgccaccgtcccgcttttggcgaacgcctcaagccctgagcatgttgacgcggagcgtcacgggatgcattcccacgcagagcgtgggaacgatcatttgggagcaagcccgctcgacgcgccagatctcagcgtcggactctccgccgataacaatgatgtttgtatccatcctggcctccagcctgtcccagaagattaagccacctgatatcgactctgaacaaacccattctgcgacgcgtacgtgccgacatggcgcagttcacgctcatggccaacctggctgaacaaaggaatcccttgtcccaacagcagaggaatacgggtgatgatcaactcatcgataaggcctgcttcaagaaacgcctgaatcgtttggccaccatcgatatacaggtgtttcatgccgcgctcggctaactgtttcacgagggtgactgcatccgccgacaccacctctaccttgccctgcacatgggcaggcagctccaccgattggcgcgagagggcgataacaggcatacgctcgtatggccattccggaaaggacaagactttttccagggttttgcggcccatcaccagcgcatcgaccgtggcgataaagccttcgtaggttacaccgctcaactgcgcggcttcgtactccggccgatgcagccactcgatgtcaccgtctggccgcgctatgaagccgtcgacgcttgcggcgataaagacagaacatttgatgtccatgaggggtaacactccttgaaaaatgcagtggctctattcaattcactataaacgtggcgttttctgatctcaatttcgtaagaccgttcagaaaattctgttttgttttgacgctcgcccaatcatggctttagatattcgccacgaccaaactcatgatgaaacgggcggtgatttgaatggattgtattttttgcagcattgtccgaaagacctctccagcccacattctgtgggaggacgaacaccatatggcgtttctgtcgatcttccccaacacgccgggtttcagcgtggtgatccccaagcagcattacggcagctatgcgtttgcgcagtcggataaggtgctggctgaccttgttgtcgccaccaaaaaaaccgcgttgctgatcgaccgggcctttgcggatgtggcgcgcacggggatgatgctggaagggtacggcgtggatcacctgcacgcgaagctgtttcccatgcatggcacggggcaggacagtgcgttcaagccgatcagctcgaaagtggataagtttttcgaagcctatgagggctatatctcgtcccacgattgtgtgcgggcggatgatggggaattggcgcagttggcggcacacatccgctctttcgcctgatacaaaaccaactgtgggagcaggcaagccagctcccacagttttagagggtgtgcgcctggtcgatcagcgccggctactgacctcagccggcacattgtccccggccatgcgcttgcggaacagtgcggtgcgcgccagcagcagcgtggtcaccggcaccgtgatcgccaacaaaatcggaatcaaccacccgtgcagcaccggcgcggatttgagcaccgaaaagtagataatcgacgccaacgccacgcaccacgcgcccaacgtcgaggccagcgccggtgggtgcatgcgctggaagaagtccttcatgcgcaacaagccaatcgcgccgatcagtgcaaacaggctgctcagcaccagcagcacggccacgctcacttcaacccataacggcatcattcaatcacctcgccacgcagcaggaatttcgccagggcgaacgacccgacaaagccaaacagtgcaatcagcagcgctgcctcaaagtaggtgtcactcgcgtaacgaatgccgagcaccagcatcatcagcatcgccaggatgtacaggtagtccagcgccagaacccgatcctgtgccgacgggcctttgaacaggcgcagcagggtcagcaccatggccagggagaacaggaacaggctgaccaggatcgcattggagagcagggcgctcattcgaagatctccatcaggggccgttcataggcgtgtttgaagtgctggataaactgcgcttcgtcatccaggtcgaagacgtggatcagcaaaacactgcggtccagcgccagttccgaccagacggtgccgggggtgacgctggtgatcatcgacagcacggccaggccgttggcgtcgcgcaggtccagcgggactttgataaagcgcgagcgcggtggccgcgaaccgcaggtcagcacgccccaggccacgtgcaggttggagatgatcacgtcacggcccaccagcaggaacaggcggatgatcacgccggggcggcggatgcggatcggcaacgggcgcaacggcgccatcagcaacggggcgagaaaacccatcagcgcgcccagcagcaggttgccggggctgaccgacaggttcaacaccagccacaacagccacaacgccagcgacaaccacggagcaggcaacagacgcttcatggctgcacctccagggcggcggccttggcttcagggctggggatcgggcgcgtcgccatcaccgccatcacatagtgttccgggttgttcaggctttcggcggtggcctgggtgtagcgcatcaacggctcggccttgaacgtcaggaggatgctcaggccgagcaggaagaagatcggcacgcactcgtagcggcgcagcagcggcgaggggcgctcttccggggtccagaagcgttggatgcccaggcgggcgaaggcgatcagcgaggccagccccgacagaatcagcaacgtcaccaagccccaggcggccgggcggatcggctcatccacggcgttgcccaggcccattgggttaaccaatgcgctcaacaggctgagcttgccgataaagccggacagcggcggcatgccgataatcagcagcgcacaggcgacaaaactcaagcccaggaaggccatggtccagggaattacctggccgaccacggctttctgttcgtcgtcgaggttcacgccagggcgcggatgcagcgattccatggccttgggcagtgcgtcgatttcctcatccaagggaagatcattggcggagcgcgaacgctcgatcagttcagccagcaggaacagcgcgctcaatgccagcgtcgagctgaccagatagaacaacgcgccagcggtcaggcttggctgggcaaaacccacggccgacagcaggatcccggcggacaccagaatgctcaagctcgccatacgctccaggcgttgcgccgccaccatcgccatcgctgcgcaaatgatcgtcgccatgccgccgtacaccagccagtcgcctccgaacagcgccgaggcaccggcctggccggagaacagcagggtccacaggcgcagcacggtgtacacgccaaccttggtcatgatcgcaaacatcgccgccaccggcgcgctggccgaggaataggcgggcgccagccagaagttcagcggccacatgccggctttggccaggaaggcggtcgccaggatcgccgcaccggcgtgcaacaggccacgatcagcctccggcacaagcgggattttcagcgccaggtcggcaaagttcagcgtgccggtgacgccgtagatcatcgccgcgccgatcaggaacagcgacgaggccagcaggttgatcgcgatgtaatgcagccccgacgacacccgcgcgcggcccgagccatgcagcatcaaaccgtaggacgccgccagcagcacttcgaagaacacaaacaggttgaacaagtcggccgtgaggaaggcgccgtacaggcccatcatctggatctggaacagcgcgtggaaactggtgcctgcgcggtcccagcgggccatggcgaacagcagcgcactcacgccgatgatcccggtcagtaccagcatcatcgccgacagcgggtccaccaccagcacaatgccgaacggcacctgccagttgcccggcaggtatacgccgatcgagccggggccgccttgctgggtcaagtacagcagcaggatggcgatgcccaggccgatggcgctggagaacagattgattttagccttcagggggcggcgtttttcgccgagcatcagcatcagcgcggcggtcagcaacggcagcaggatcggcgcgacgatcagttgattcatccacgtcattccttgggctcccggccgtctacatggtcagtgccggtcaagcctcgggaggccagcagcaccaccaggaacaacgccgtcatggcgaagctgatcacaatggcggtcagcaccaaggcctggggcagggggtcggtgtagttgagcaggtcttgcggcacgccgtccttgatgatcggttccttgccgataaacaggctgcccatgctgaaaatgaacaggttgaccccgtacgacagcaagcacaggcccatgacgacctggaatgtccgtggccgcaggatcaaccagacgccggaggccgccaggaccccaatggcaattgcgatgacttcttccatcaggcggctccttccgtagcggcaacggctttggcctggttgctcggtttgtgggcccgcacggattggtgaccgagggcggtgagcatcagcagcgtggaaccaacgaccatggcgtacacgccgacgtcgaagaacagcgcgctggcgacatggatatcgccgagcaccggcaggctgaaatgccaagtgtgggtggtgaggaacgggtaaccggcaaacagcgcgccaagcccggtgagggtcgccgagagaaggccgaagcccatccagcgcatcggccgcaggctcatttgcgcctcgacccactgggtgccggccaccatgtattgcaggatgaacgccaccgacatcaccaggccggcgacgaaaccgccgcccggctggttgtggccgcgcatgaacaggtagaacgacaccaccagcgcaatcggcagcagcagccgtaccagcaccgccggcaccatcatgaagcccagcgcggtatcgctggcctggcgtgggttgaccagatcagtcgccacgtccggtgccagttggcgttgttgtgcaggcagttgcatgctttctttggatgggcggaagcggcgcagcagggcgtacacggtcaaggccacggcgccaagcacggtgatttcgccgagggtgtcgaagccccggaagtccaccagcatcacgttgaccacattgctgccgccgccttcgggcagcgcgcggctcaagtagaacgaggaaatgtcgttgggtgtctggcgcgtcagcatcgcgtaggacagcaacgccatgccgccgccgaccacggtggacagcaggaagtctcgcaggcggcgaatgcgcgccttgcgcagcgagcttggcagtggcgagacttcttcgatccgccgtggcagccagcgcaggcccagcaggatcagcacggtggtcaccacttcgaccaccaactgcgtcaacgccaggtccggggccgagaaccacacgaacgtaatgcacgtcatcaggccacacacgctgaccatggtcagggctgccagccggtgatacttggcttgccaggcggcgccgagggcacaggcgattgccagcagccacagggtcacgaacacaatcgatccagggatttttggccggtcgccccagctgaggccgctgttgagcatcgggatcaacccggccaccaccgctgccgacaccagcaggaacagctgggtttgcaggcgcttggtgctgatgcgtttttcgatcctgcgcacaccgcgcatcatcaccaccaggctgcgctcgaacatgcgcttgccgttgaagtagctgatgacgggcgggtatttgaagcggccgcgcttgagttgtttgcgcagcatcaggtagagcaccacaccgccggacatggccaccaggctcatgatcatcggcgcgttccagccgtgccagatcgccaggctgtactcgggcagcacgccacccaccaccggcagcgcggcggcggcgaggatcgaaccgaccacctgggcggggaagatgcccaccagcagacaggtgaacaccagcaactcaaccggcgcacgcatccagcgcggcggttcatgcggtgtgtgcggcaggtcggtggcgggcgggccgaagaatacatcgaccgtgaagcgcaacgcgtaggcgacactgaaggtgccggcgatggtcgcaatcgccggcagggccagttccacccaggcggtcgaggtgatgaacacggtttcggcgaagaacatctctttggacaggaagccattgagcaacggcacgccagccatcgacgcactggcgaccatcgccagggtcgcggtaaacgggatcagccgcaccagaccgctgagcttgcgaatatcgcgggtgccgctttcgtggtcgatgatgcccgcggccatgaacagcgaggccttgaaggtggcgtggttgagaatatgaaacaccgcagcgacggcggccagcgggctgttgaggcccagcagcagggtgatcagcccgaggtggctgatggtggagtaggccagcaggcctttgagatcattttggaacatggcgcagtaagcgccgaggaggagggtgatggcgccggcaccgccgacgatccagaaccattcttcgctgccggacagtgacggccacaggcgggccagcaggaacacgccggccttcaccatcgtcgccgaatgcaggtacgccgacaccggcgtgggtgccgccatcgcgtggggcagccagaagtggaaggggaattgcgcgcttttgctcaaggcgccgatcagcaccagggccagcatgaccgggtacagcgaatgcgcgcgaatctgatcgcccgccgccagcacctggtcgaggtcatagctgccgacgatatgccccagcagcatcacgcccgccagcaaacacaaaccgcccgcaccggtgaccatcagcgccatataggcaccgcgcctagcatcggcgcggtggtgccaatagccgatcaacaggaacgagaacaggctggtcagttcccagaagaacacgatctggatcaggttgccggaaatcaccagcccgagcatggcgcccatgaaggccaggaaaaacgcgaagaaacgcggcaccggatcgtccggcgacatgtaatagcgcgcatacagcgacaccagcgagccgatgcccagcaccagcatcgagaacagccaggcgaacccatccatgcgcaacacgaagttcagcccaaggctgggcaaccacatgaattcttcgcggatcacgccaccatgggcgatctgggggtacagcagggcgacttgaatggtgccgaccaaggccacaaggccagccaacagggattcggtgttacgtgcgttgtgcggcagcaaggccgccagacagctgcccataaaaggcagaagcagtagaactatcagggacataggcttctaatctgcgggagtttgggatgcatcatacgtgccgctttctcgatcaccaaacggcaagatgtggcaggatcctacaaagtaagctgaaaaccgccgtttcgcattgtttcagcgggcccctgtccacctggcaccaccgccccctgtgggagccgggcttgcccgcgatggcgatccgacagccaccacaaaccgtcagaccttacccctgctgttcctgttccctttcatcttgcagttcgatggccttctgccccttggtcttcaactcactgacaattaccgccgccacaatcaacgccgcgcccaccatcgcaatcggcgggaagcgctccccggcgatccgcccgatcacgccggcccagactggctcaccggcgtagatcaaggtggcacgtgtcggcgagacactctgctgcgcccagttcatcgcgacctggatcaccgcgctggtcaagcccaggcccacggcgctgaacaccagcagccaggagaaccctggcaaggcctcacccattggcaccaccatcagaaacgacagcagcgacgccgtggccaactgcaccaccgtcacccggcgtacgtccacctgcccggcaaacgcgctgatcaggatgatctcggcggccaccgccaccgcacagatcagcgtggcgatttcgccggggctgaagttcagcgaggcgccggccgggccggtgagcaacatcaacccggtaaacgccagcatgatgccgatggccggcatcagtgccgggcgacgacccagtaccagccactgcaacagcggtacaaagggcacatacagcgccgtgataaacgccgactggctgctcggaatcgtctgcaagccgatggtctgcatgccatagccgaacatgatcgaggtgccaatgaaggcaccggctttcaattcaaaccaggtcaggtcgcgcaaggtgcgcaacgaaaagaacccgaccacgatggccgccgccgcaaaccgcaggcccacgaaaaacatcggcccgctgacggtcatcgcatgctgcaccagcaaaaaggtgccgccccagatcatggtgatcaccaccaggatgcattcggctttgctgaaacggttgaaacgtgaagaagcgttcggggcagtcatggcggctcggtcttgcaaggggaaggcacggaccgcacaatgcgccgcacgctgggcagtatactgcgcacacctaccttatgagcaatatagtgcacaaagaaaatccacaacgcgcttcggtcctgcaacacgtcagccagaacgtgcgtcgtttgcggcatgctgccgacatgagccagaccgcgctatcggaaaagtccggggtcagccggcgcatgctggtggctatcgaggcgggcgagaagaatgtcagcttgtcgaccctggatcgcgtggccgaagccttggacgtggccttcagcgacctgatccaggccccggatgccggcgaccacagccgcatcaacgagttggcctgggccggtgaaatccccggcagtaaagccgtgctgctggccaaggccacggcgcggcgtgaggtcgagttgtgggagatgcacctggaaccaggcgatcgctacagccccgaccctgacccggacggctggagcgtgcagctgtttgtgttcgaaggctgcctcacgctgttggtcggcgaggacgaaaagcgcgtcgccgccggtgagttctacatgttcgccagccgtcacgttcacggctatcgcaatgacggcgacgtgccggtgcgctttgtacgcaacgtggtgatctaactgtctgccaggcaacagtggatggacactttgctcgcccgcaagcgcacccgtttcaaggttttagccgcaacctgctgattttattggcgattacattcaggcacgactcctgcaatcactccgttatctcatcggagcctggagtcggcccatgtcagcccaccctcaacaccctgcccatatcattcgctcggatgccgaagccatcgaggtggccacgcgtttggctgcccgcttcgccatcgacgccagcgtgcgcgaccgcgagcggcgcctgccggtggacgagctcgaagagttctctgccagcggcctgtggggcatcaccattcccaaggcctacggcggcgccgaggtttcctatgtgacggtggccgaggtgatcaaagtgatctccgccgccgacccttcactggggcaaatcccgcagaaccacctgggtgttatcgacatcctcctgcaaaccgccagcgaggaacaaaagcgtcattacttcggcaaggtcttggccggctaccgtttcggcaatgccttttccgaagccaagagcaaaaacgccggcaccttcgacacccagattcggtttgacggcgacaccgcgcaaataaacggcgagaagttctactgcaccggcgcgctgttcgcccacatcgtgcctacggtcggcaacaatgaaaacggccaggcttttattgccttcgtcgaacgcaatgcgccgggcctcacagtgatcgacagctgggacggcttcggccagcgcaccaccgccagcggcggcgtgaccctcgacggggtgagcgtgccgcgcacggcggtgatcccggcgcacctggcgtttgaccagcctaccgcgaatggcccgatctcccagatcatccaggccgccgtcgacaccggcatcgcccttggcgcgctggaacaggcaaaaatctacgcgcgccaggcgcggccctggatcgacagccaacaggaacacggctggcaagaccccttcaccatcgccgccatcggtgacctgcaatggcgcgtgcacggcaccgaagccattctcgccaaggccggcaaggcggtcgaccgtgccctggccgagccgaatgaagacaccgtggcccaggcttcgctggtggtcgcccaggccaaagtgttgtcggccgaaaccgccttgctcgccagcagcaagctgttcgaactggccggcacgcgctcggtcaccggcaagcacaacctcgaccgcttctggcgcaatgcgcgcacccacaccttgcacgacccggcgcgctggaaataccacctgatcggcaacttcgtgctcaacggcgtgaagcctgcgcgccacgcctggaactgaggaacctgccccatgactgcactgaatcaagcgcgccaactgctgcaaagcacccgccgcgcagtggaaaaaagcgatgacccttacgtgatcagccgcttcggcgactggcagattcgcgtcgatgtggccgccgccttgctggaacgcgccgaaacccacccaagcccggtcgccctcaccgaagcgcaaatcgctgccgccgaagcgctgatttttgccagcaacgccgaattcgaactcaccggccaacgcaccgcgctgccgcccagcctggatgatccgttgcgctggaaataccagatcgtcggcaactaccaccttaacggagtgcgttgatgtcccgtgaaatccgcttgaatgccttcgacatgaactgcgtcggccaccaatcccccggcctctgggcgcacccgcgtgatcgctcgtggcagtacaaagacctggaatactggaccgacctggccaaaatcctcgagcgcggcaaattcgacggcctgtttatcgccgacgtgctgggcatctacgacgtgtacaacggcaatggcgacgcggcgattcgccaggccgcccaagtgccggtcaatgacccgctgtcactgatcgcaccgatggcgctggtcaccgaacacctgggtttcggcctgacggcctcgttgtcgttcgagcatccgtacccgtttgcccgccgcctgtcgaccctcgatcacctgaccaagggccgtatcggctggaacatcgtcacctcgtatctggaaagcggcgccaagaacctcggccagaaagcccagaccgaacacgacgcgcgctacgactacgccgaggaatacctggaggtttgctacaagctctgggaaggcagctgggaggagggggcggtactgcgtgaccgcgagcggcgaattttcagcgacccgagcaaaatccacgagatccgccacgtcggcaagcatttccaggtgcccggcattcacctgtgcgagccgtcgccgcagcgcacacccgtgctgtaccaggccggcgcgtccagccgtggcaagcagttcgccgccgagcaggccgagtgcgtattcgtggcggcgccgtccaaggtgctgctgaaaaggaccgtcgccgacatccgccgccgtgcggctgaggctgggcgtgatccgaagaaaatcctgattttcaatttgcagacagtcatcgtcggcgagaccgacgccaaggccaaggccaagttcgaggaatacaaatcctacgtcagctacgaaggcgcgatggcgctgatttccggctggaccggcatcgacttcagccagttcaagccggatgagccgctcaagcacgtgcacaccaatgcgattcagtcggcggtggaagccttctccacggcggacccgaacaaagtctggacgccaaacgagctggccgactgggtcggcatcggcggctttggcccgttgtttgtcggcggcccggaaaccgtcgccgacctgctgcaggaatgggtcgaagagaccgacgtggatggcttcaacctcgcctatgcgctgacccacgaaacctttatcgacgccgtggacctgctggtgccggagctgcaaaagcgtggcgtgtacaaaaccgaatacgcccagggcaccttgcgcgagaagttgtttggcgatggcgcgcgattgggggcgaaccacccgggggccggttaccgcgatctcaaagccaccaccctctaactgaaacccctcggtcaatgtgggagctggcttgcctgcgatagcggtgagtcagctggaaaagtgccaactgacacaccgttatcgtaggcaagccagctcccacagtagaacggtgttgatccaaattactcagccagcggaccaccgcacgcacatcacttgaataggagcattacccctatgagcgtgcacgaactcaaacgcccgctggccctggaatggcctgccgaactgctcggcaacctgcccaaggccttggagcaattgcaccactgggcgcagatcaccccgttgcacaccgccctgcgccacaagcgccagggccagtggtatgcctggcgctggatcgacgccctgcgcgatgtcgagcgcctggccgatgggttgcgccagcaaggtttcggcgaacaatcgcggctggccctcagcggtgccttcgagcccaacctgttgctgttggccttggctgcccagtccgtcggtggacaggtgttgaccctggccgatgacctggaacccgaagttctgtaccaacagctgtggcgcattcgccccagccattcttacgcccagggccgccagcaggtgcggcactggcagtccgccaacccggtggattttgcccaactgctcggccccattgacccggcgcagcacctgcagcgctggtggcaaccccgcgctgaaaccctgttgtggagcgaggagggcacccattggcaaggcgggctggcggtggtgctggagcaatggctgaacagcggccacggcctggcattccccgaaagcctggcttcggcgcggcgtgatcgcagtgaagtcgcaccgaccggcctgctgctgtcgcccgagcgtttacagcacctggccgatgatatcgaaagccgcctcgcgccccacggcacctggcgtcgacgcttgtgcgactgggccatcgcccacccgcaaagcggcctgcgccggttgctgaaaaatcgcgtgcgcaagctgctcggtttccagcgcctgtcctctatctggcaaccgctcaaatccagcgccgagccggtatggctggccgaattcaaacgggacatcgcatgagccaggccatactccaagtgcgggatatctcgctgtcgttcaaaggcgtcaaggccatcaatgcgttgtcgttcgaggtgcagcgcggcgaaatctgcgcgttgatcgggcccaatggcgcgggcaagagctcgttgctcaatgtactcaatggcgtgtatcgctttgacgccggcgaaatcgtgtttgagcagcagcacttccagcgcatcgacccgctcggcgccgcgcgccgaggcattggccgcacgttccagaacaatgcgctgttcaaaaagatgagcgtgctcgacaacatccttaccggtctgtcgcggcatatgcgcaccagctttatcgaacaggccctcggcttaccgcgcgcccggcgtgaggctgaggccttccgcctgcgtggccaagccatcctcgaattgctcgaactgcaagcccatcgcgacgtactggtgggcaacttgtcctacggcctgcaaaaacgcgtggagttgggccgcgcgttgatcgcaggcccgagcctgttgctgctcgacgagccgatggccgggatgaacgccgaagaaaaacaggacatggcgcgcttcgtcgccgacgtaaaccgcgacctcggcaccaccgtggtgttgatcgagcacgacatgggcgtggtcatgggcctgtccgatcacgtggtggtgctcgactacgggcgcaaggtcggcgacggcacgcccgccgaggtgcaggccaaccccgaggtgattgccgcttacctgggagtcgctcactgatgaccttctttttcgaaaccctgctcggcggcctgctcgccggcaccctgtactcgctggtcgccatcggcttcgtgctgatctacaaggccagcggtgtgttcaatttcgcccagggttcgatgctgctgtttgccgcgctgaccttcgtcagcctgcatgaccagggcgtgccgtttgccctggcgctgctgctgacggtgatcgtgatgaccatcggcgccttgctgatcgagcggctggtgttgcgcccgctggtgaaccgctcgcagatcaccctgttcatggccaccctgggcctgtcgttcattattgaaggcctggcccaaggcttgatgggctcgcaggtgcgtgctctggatctgggtatcgacgacgtgccgctgtttgtagggccgctgatggtcagccagttcgacctgatcgccgctgcagctgcggtggtgctggtgagcgtgctggcgttgttgttcaacaagacccgcatcggcgtgtcgctgcgcgcggtggcggatgacaccacggcggcgctgtccatcggcatcaacctcaaccgtatctggcagatcgtctgggccgtggccggggtggtcgggctggtggcggggctgttgtggggcgcgcgtcagggggtgcagttttcgctgtcgctggtggtactcaaggccttgccggtattgatcatcggcggctttacctcgattggcggggcaattgtcggcgggttgattgtcggtgcggcggagaacctcgccgaggtgtatatcggcccgctgatcggcggcggcatcacgccttggtttgcttacgtattggccctggccttcctgtatatccgccccgccggcctgttcggcgagcgcgccatcgagcgagtctgaaaccatgtcgattcccgttgctcaagtaactgcgccgctggtgttgatccagcggcgcgtgccctggggcctgattggcctgttggcgctggcctttatcgtggtgccgctgtggggcaatgactattggctcaacgcgatcctgattccctttctggtgctgtccctggccgggctgggcttgaacctgctgaccggctacaccgggcaaacctcggtgggcgcggcgggcttcatggccgtcggtgcgttcgccacctatgggtttttattgcgcctgccggagctgggcttgccggtggcgctgctcggcggcggcgtgatcagcgcgttggtggggctgctgttcggtttgcccagctcgcggatcaagggtttctatttgatggtcaccacgctggccgcacagtttttcctcgagtggctgttcgtcaaattcccctggttctacaactatggctcctcgggcactatttctgcgccgaaactggcgctgttcggccatgacctcaacaccccggttggccgctatctgctgaccttgatcacggtgctgctgttgacctggaccgccgtcaacctggtgcgcagccaggtcggccgcaactggatggcgatccgcgacatggacaccgccgccgccgtggtcggcattccggtggtgcgctacaagcgcctggcctttgcggtcagctcgttttacttaggcatcgccggtgcgctgtgggccttcgcctatctgggcacggccagcgccagcagcttcgatatcaaccgctcgttccagatcctgttcatcatcattatcggtggtatgggcagcattgccggcaactttgtcggagcggcgtttatcagcctgctgccgattttcctcagccatgccgggcaggcgttgttcggcggttcggtggatgcggggcagttgcagaacctgcagaaaatcatctttggcgtgttgatcatcgtgttcctgatcaaggaacccgagggcttgattcgcctgttgcacacccttcgcgatcggctgcgtcagtggcctctacgtttctgaccctaagagaacctcccatgcgtgcatccttaaaacgttccctggtcggcgccgccttcgcgctggccgccctggccggtgctgtgccccaggcaagcgcctcgcccgaccagcaattcattcccctggccacctaccgcgtcggcgcctacgcgtccagcggcgtgcaggtgtgggccgggatgatcgactacctgcgttatatcaacgaggtagaaggcggcatcaatgaggtgaaactggtgtggcaggaatgcgagaccgagtggacggcagagaagggcatcgagtgctacgagcgcttcaaaaatggcctggatggcgcgccggtcgcggtgtatcaacccaatggcgcaccggcggcgtatgcgctgagcgagcgtgccgaggtcgacaagatcccgctgatcaccctcggttacggccgcactgaagccaccgacggcaccgtgttcccgtacaacttcccggtgatgctgaccttctacagcgaggcgtcgacattggtgaactacatcgcccagcgcgaaggcggtttcgacaaactcaagggcaagaagatcgccacggtctatcacgactcggcctacgggcgtgaaaccctcggcccgctgaagctgctggcggagaaatacggctttgaaaacatccagattccggtcgccgatccgggcaacgagcagtcggcgcaatggcgccaggtgcgccaggccaatccggactgggtgttcctgcgcacctggggcgtgtcgacgccggttgcggtgaagaccgccgcacgcttcggcttcccggtcgaccacatcatcggcgatatctgggccagctccagcgaagacgtgctgccggccggcgccgccgccaaaggctacctggccctcacgccctacccggcgggtgctgatttcgacatccataaacgcctcaagcagtacatcctcgacaagggccacagcgacctcaaagacctgaaaaacttcggcagcgtgtactacaactcaggtctggtgaacgctgccgtggcggtggaagccattcgcaccggccaggccaaattcggcaaacggccactcaatggcgaagaaggccgctggggcctggagcatctgaatatcgacgacgcgcgtttgaaggacatgggctacctgggcctgatgcagaacctcaagctgtcgtgccgcgaccacgaaggcggcggttcggcgcgcgtgcagcagtgggacggtgccaactggacgctgatcagcgactggatcgccgccgaccgcgcgttgttgcgcccgctgatcgatgaaaagtccgccgccttcgccaaggaaaaaggcctgacgccgcgcacctgcaccggggatgaataaaccatgagccaagccgccgctgaaactgcacagccgtcgctgctgacggtcaacgacatcgaagtgatctatgacggcgcgatcctggcggtggccggggtgtccttgaatgtgccaaagggcgccatcgtcgccttgctcggcgccaatggcgcgggcaaaagcaccacgctcaaggcgatttcggggctggtgcgcgccgagcgggccgaagtcagccggggtgtgattacgtatgccgggcgcgatgtggccggcatcgaccccagccagcgcgtgcgccagggcatggttcatgtgctggaaggtcggcatgtgttcggccaactgacggtggaagacaacctgcgcagcggcggctttgtgcgacgcctgagccgcaaggccatggagcacgacctggaacgcatctacgcctggttcccccggctcaagaccaagcgccacacccgcgcggggctgacgtcgggtggcgagcagcaaatggtcgcgattggccgggcgctgatgactcgcccgaccttggtgctgctcgacgagccgtcgatggggttggcgccgatgattgtgcaggagattttcgagatcatcgcgcagctcaaccgtgagcagcaggtgagctttttgatcgccgaacagaacatcaacgtcgcgctcaactatgcgtcccagggctacgtgctggatactgggcgagtggtgttgagcggcagcgcggccgagctgctggcgcgtggcgatttgcatgatatttatctgggtaaacagtaagggcgaacgtgcatgactgaatccatccgcaacgctgatgtattgatcatcggcggcggcctgagcggcacgatgttggccgtgcaactgctgcgccagcccggccagcggcacgtcctggtgattgaaccgcgtgctgaactcgggcgcggcgaggcctacagcgccgttgagctgggccacaccttgaacggtaacgccgcgcgcatgagcgtcgacccggacaacgccgatgacctgacccaatggctcaccgactacatcggcgccggtggttggccggaatcggatcagcaacatgtgccgatcagtgaattgttcccgccgcgcgggatttttggcgtgtacgcgcagcagcggctggccgaagccaaggcgctgtcggcatccaccgtcgagcatgtgcgtggcgaagtgatcgacctgcaggtggacgaggcagccacattgctcaccctcgataacggccagcaactgcgcggcacttacgcggtgctggccaccggcatgttcccggcggcgcgtacaccgcagaccgagtccagcggtttgaacgccgccgccgtggacccgtgggatgtgcaggccatgactcacatcgacccgcaatcaacggtgctgatcatcggttccgggctgaccatggtcgatgctgtggtgtcgttggagcaggcgggccatcgtgggcctatcgagatcttctcgcgtcacggcctgttgccgcatgtgcgtcggcagccgccgagctgggaagactttcttgccgccgaccacagcctgcgcagcccgcggcaactgctgcgcgaggtgcgccgccaatgccggatcgcacaggcccggggcatcgattggcaggcgccgctggacaccgtgcgtgcgcacatcggccgcttgtggagccaggccgacgagcgcgagaagcgccagtttgtgcgtcatgtacggccgtggtgggagagccatcatcaccgttcgccgccgttgagtgcgcagttggtggcgcggttgcaggctgaagggcggttgcggattcaggcggcgtcgttcaagggggtggtggcgtcggatggtggtgtgactgtccgcttgcggcggcgtggtgagcaggcggtgacgcaggtgtcgggcgcggcgctgatcaattccagcggtatcgaatatgactggcgccgggtggccaggccgttgccgcagcagttgctcaagcgtgggttgatccggccgggaccgttggcgttggggattgcggcggatgtgtcgggggcggtggtggatgctgagggcgatgtcagcctgcgattgtttgccatggggccgccgttgcgggggatgtggtgggagagtacggcggtgactgatgtggcgctgcaggcgaaggcgttggctttgaaattgacgaaaatttgatgtgggagctggattgcctggggtagctctgtgttgggcggcataggtcttgggtcggagtacatatccgttatttaggtaacggccacttatggttccgctcttacagcgggtcactttttgagggaccaaaaagtaaccaaaaagtcctcgccccaccactcggcacctcgcctaggctcggtgtgccctcactccggcttgaatccgtgggccgccgcaatgggccatccctggcccagtgcggctaacccggcgtcctgccgggttacccacggattcaagcctgcgttcggccagcgtggttgacggggcgcctcagatcaagatcaagatcaaaatctacagcacggcggcctggtagccgacctgagtggttgaagcaaaagcagggcaaaagcccatccacctgatgcaatgcgatccaaatgtgggagcgggccacctcccacagttaatcagcatttcaactgccaatcttcacgaaaccaggcttgagg

SEQ ID NO: 47 - DNA, 104297 bp, Pseudomonas poae FL10F
atggtgatggtttggccgttgctcaacgttaccgtgacatcggtttgcgctttgttcgtcagggttgcggtgtaggtgatgtcgccgccttcaacgaccgatgctttgtcggcagtcagggaaacggtggtgttatcgatcgagtcggtgatggctgtttcagccgccttcggatcggttaccaggttctcgaagttgccgccttcagtcttggtgatcgtggtgctgacggtgctgccattgttgtaaacgtcgttagctggcgtctggaacacagtcgaaccaacggtttcaccggctttgatggtgatcgtctggccattgctcaacgttaccgtgacatcggtttgagctttgttggtcaatgttgcggtgtaggtaatctcaccgccttcaacgaccgaggctttgtcggcggaaagggaaaccgtggtgttgtcgatggagtcggtgatggctgtttcagccgccttcggatcggtcaccaagttctcgaagttaccgccttcagttttagcaatcgtagtgctgacggtagaaccgttgttgtaaacgtcgttggctggcgtctggaaaacagtcgagccgacggtttcgcccgctttaatagtgatcgtctgaccattcgaaagcgtaacggtaacgtcagtctgcgccttgttagtcagggtcgcggtatacgtaatctcaccgccttcaaccactgaagccttatcagcagtcaacgtaaccgtggtgttatcgatcgaatcggtaatcgtggtttcggctgctttcggatcggtcaccaagttctcgaagttaccgccttcggtcttggcgatggtggtgctgacggtggagccgttgttgtaaacgtcgttcgccggggtctggaacaccgtcgaacctacggtttcaccggctttgatggtgatcgtttgaccattcgaaagcgtaacggtaacgtcagtctgcgctttgttggtcaaagtcgcggtgtaggtaatctcaccgccttcgactaccgatgctttatcggcagtcagggaaaccgtggtgttatcgatcgaatcggtgatggctgtttcagccgccttcggatcggttaccaggttctcgaagttaccgccttcggtcttggtgatcgtggtgctgacggtgctgccattgttgtaaacgtcgttagctggcgtctggaacacagtcgagccaacggtttcaccagctttgatggtgatcgtttgaccattcgaaagcgtaacggtgacgtcagtctgagctttgttcgtcagggtcgcggtgtaggtaatctcaccgccttcgactaccgatgctttgtcggcggagagggaaaccgtggtgttatcgatcgagtcagtgatggctgtttcagccgccttcggatcggtcaccaggttctcgaagttcccgccttcggttttagcgatggtggtgctgacagtcgaaccattgttgtaaacatcgttagccggtgtctgaaacaccgtcgaacccaccgtttcaccggctttaatagtgatcgtctgaccattcgaaagcgtaacggtaacgtcggtttgcgctttgttggtcaaagtcgcggtgtaggtaatctcaccgccttcaaccaccgatgctttatcggcagtcagggaaaccgtggtgttatcgatcgaatcggtaatcgtagtctcagccgccttcggatcggtcaccagattctcgaagttaccgccctcggtcttggcgatggtggtgctgacagtcgaaccattgttgtaaacatcgttagccggtgtctgaaacaccgtcgaacccaccgtttcaccggctttaatggtgatcgtctgtccattcgaaagcgtaacggtaacgtcagtctgcgccttgttagtcaaagtcgcggtgtaggtaatctcaccaccttcaacgaccgacgccttatcagcagtcagggaaaccgtggtgttatcgatcgaatcaacaatcgtagtcaccgcaggcgtagtgctcggcaccaggttttcaaagttgccgccggttgcgccggtgatcgtcgtgctgacggtagaaccgttgttgtagacgtcgttagccggggtgtccacgaccaccgtgccgaccgattcgccggccttgatcgtaatcaccgagccattgctcagggtgatggtcaccggcgtctgcgccgggttggtcagggtggccgtgtaggtgatctggccaccttcggtcaccgtctcgcccgccgtcagggtgacggtggtggtgtcgacggtgtcggtaatctgagtcacggccgggttagggtcgatggtcagcaccaggttgttgccgccggtggtgccggtgacggtcacgctgatctggcttgggtcgatgtacgggctgtcgttcggcgccagcggtacgttgacggtgccggtggtttggccggccacgatggtgatcaccgcgccgttggacaaggtgatgctcaggttgctggtcgacggctgcgtcacggtggcggtgtaggtcagcacgccgccggcttcggtgatggtcggggttgcactcagggtcagggtcgaggcctgcagcaccaggttgccggagtcggtggtgccttgggcgccagccagctgggtttgggtcgtaccggcctggcccagcgggccggtcgggaagccgatagtcgggtcgacgcgaccagcggtcgcgtccagcaccacgaagctgtggccgccgcccgccgcgccattaccggcagcggttgcgcctgcggcagtggcttccaggtcggtggtcgggtcggcgccggcggcgatggcttgctgcagttcggcaaccgacggcgcggcttgctcggtggccgccgccaggtcgaggctggagtccggcatatcggcgctccactgggtatctcgacccaggtccagcgtgcggccatcagccagttccaggctgaccgagccggacatgccggtgtcgatctggtcgcccgcgaacaggcgatcgccttctaccagtacgcggcgcgccccttccggagaaataacgaaaacttgaccaacaatgcttttgacgatggcaacaacactgctcattaaagatttctccggcgatccgtttctgatgacttccatgtggccgctcgggggagggccaaacaggaggggcgtagactaagaggttactggcgtcaaatatttggctagatttattcgctatctagtttatgccaaactattgaccttatggtcgccatcctaaacaattggccccgtaatgtcacattgatatttatgcggcgaaccgtcctacatgtgtgaagcagttccgctttttgaactttccgacgtacggtcattacggtagccattatccgactcagcgaggccaatcgctgtgatttgagacaagaagtcctggggaatttttaaatgcgtctgcacctgtttatggctataccgttcgctctcgccgccagttttgtacaagcccaaacattgccccaggccatgcagcaggcattagatgtgcacccggaaattcaagccggtgtgaacagccgtatcgccgctgattaccaactgcgcgccgctcaaggtggttacctgcctcgcgttgatttaaacgccggttatggccgtgaaggtactgacgattccaacactcgcgccgtcagcggcccgaacggcaaccagtgggacacgcacaaccggggcgaatccagcctgcgtttgcagcagatgatttttgacggcttcgccacttccagcgaagtcgggcgtcaacaagccaacgtcaactctcgcgcttactccttgctgggaacttccgagcgcaccggcttgaccgtcgcccaggtttacctggatgtgctgacccgccgtgagttcgtgcgcctggcggaagaaaacctgcgcaaccacgaacgtatctacgaccagatcaaactgcgcacccagcgcggcgttggtaatggtgccgaccaggaccaggccgaagcgcgtctggcccaggcccgcaacaacctgatcaccgagcagaccaacctggccgactctcaagtcaattacctcagcgccgtcggccagatgcccgaccagctcgagcgcccggcgccgttcatggccatgttgccggctgacttaaacgaagcacgccgccagatgctcgacaacagccccgtcctgcgttcggccgagtcggatatttccgctgccgaaagtcagtacgaagcggccaagtccaccttttacccgcgctttgatgcggagctgggcaccaatgccgacaacaacgtcggcggcgacgccggtcacagcaacggttgggaagccatggtgcgcatgcgcttcaacctgtttgccggtggcagcaacaaggctgacctgcaatccaagtcctaccaggccagccaggcgctggatatccgcaacaatgctttgcgccaactcaacgaagaactgggcctggcctggaacgccttgaacaacgccaacgcgcaattgccggtcgcccagcaatacgtggatcacagcacccgcgtgcgtacctcctaccagcaacagttcagcctgggccaacgtaccctgctcgacttgctcgacagcgagaacgaattgttcaccgcttcccgtcgtttggaagagatcaagaacattcagttatttactcaatatcgaatcaaggcgaccatgggcgaattgctcaaaagccagggagtggtcgcaccgatggcctccgtcgtccagaacgacgtgaagccaaaagtccaactgcctgggatgaattgagtcaccccaatagccccaactgttagtcgagagtgcagcgcgtggaatccgaagtcagtcgagttcatctcagtcatgatccacgcacgctgcacgacgacccgttactcgacgggttgttggcgctctgtgccctgcatcaaaaaccggccagtgcggccatgctcaccaccggcctgccgctgccctcgcagcgcttgagtgccgacttgctctcacgcgcagccgcgcgtgccgggctgcagggccgggtgctgcaacgcaaactggaacagatcccgacgattgccctgccggcgctgctgttgctcaaggacggtcgcagtaccgtgctggtcggttggcaaggcgaagacgaagcgcgggtcctgctcagcgaaagcgacggcggtgaagtgctggtcaagcgcgagctgttggccgacgactacatcggcaaagtcttcttcgcccagccgcagcataaattcgacgtcaaccacggcaccctgattcctcgggcgcgttcgtggtttcgcgacaccctcaagcgttcgcgctggctgtacaccgacgccatcgccgcgagcttcctgatcaatatcatcgccatggccgcgccgctgtttgtgatgaacgtgtacgaccgtgtggtgccgaaccaggccacggccaccttgtgggtgttggccgtgggcatctgcggcgcgtacctgttcgacctgatcctcaaaagcctgcgcagcctgtgcctggacctggccggtaaaaagaccgacctgatcatctcggccacgctgttcgagcgcatcgtcggtatgtccatgaagtatcgcccggcgcgagtcggcagcttcgcgcagaacatccatgagtttcagagcctgcgcgatttcctcgcgtcgctgaccctcaccagcctgattgacctgccgttcaccctgctgattttcctggtgatcgccatcctcggcggccacttggtgtggattccggtgctggccttcccgattgccctgggcatcggctacgccctgcaaaaaccgctggtggcgaccatggaacgaaccatggccctggccgccgagcgccagtccagcctgatcgaaaccctcgccgggctggacgcagtcaaggtcaacaacgccgagagcgaacgccagtacggttgggagcagaccatcggcaccctcagccggcttgagctgcgcgtgaagttgctgtcgggcctgtcgatgaacatgaccctgctgatccagcaactggccggtgtgatcatgatcgtgttcggcgtgtaccagatcatcgacggcaacctcagcatgggcggcctgatcgcctgctacatgctcagtggccgcgccctgagcccgctggcctcgctgtcgggcctgctgacccgctaccagcaggccaaggtcaccatgacctcggtggaccagatgatggagctgccccaggagcgcaatttcgaagagcgccccatgagccgtcgcactctgcaaggtgccatcgagtgccggggcctgaacttcacctacccgaaccaacaaaacgccgcgctgaaaaacatcaacctggtgatcaagcccggcgagaaaatcggcatcatcggccgtagcggctcgggcaaaagctccctggccaaactgatcgtcggcctttaccagcccgactccggcgccctgctggtggacggtgtggacgtgcgccagatcgacgtaagcgagctgcgccacaacatcggctacgtcgcccaagacatccaattgctcgccggcaccctgcgcgacaacctggtgtccggtgcgcgttacgttgaagacgaaatggtcctgcaagccgccgaactggccggcgtgcacgaattcgcgcgcctgcaccctcaaggttatgaactgcaagtcggcgagcgtgggcagaacctgtctggcggccagcgccagaacgtcgcccttgcccgcgcattgctgctcaacccgcccatgctgctgctggacgaacccaccagcgccatggacaacaccggtgaagaacgcttgaaacaacgcctgcaagccgtggtgcaaaacaagaccgtggtgctggtcacgcaccgtgcctcactgctctccctggtggaccgcctgctggtggtcgaccgtgggcagatcctcgcggacggcccgaaagccgtggttatggaagcgttgaaaaaggggcagatcagtgttgcttaactccatcaaaagcgcggtcggccgctatttcaaaggcaccgactcgctgcagggccaacccctgcccgaggtcaacaaagcgctgatcgaagatgcaccgcgggtcatccgcctgaccatctgggcaatcatcgcgttcttcgtgttcctggtggtgtgggccggtttttccagcatcgacgaagtcacccgtggcgacggcaaggcgattccgtcgtccaagctgcaaaaaatccagaacctggaaggcggcatcgtctccgagctgttcgtcaaggaaggccagatcgtcgaagccggcgcgccgttgattcgcctcgatgacacgcggttcgtctccaacgccggtgaaaccgaagccttgcgcctggccatgcaactgcgcgtcgagcgcctgagtgcgcaggtggacgaccgcccgctgaacatccccgacgacgtactcaaggccgcgccaagccaggccgccaacgagcgctcgctgtatgagagccgccgccagcaattgaaagacgaagtaggcggtttgcaggagcagttggtgcagcgccaacaggaactgcgcgagttcacctccaagcaaggccaataccgcagccagttgtcgctgcaacgccaggaaatcaacatgtccgagccattggtggcccagggcgcggtatcgccggtggaagtgctgcgcctcaagcgcgccgagatggaaacccgtggtcagttggacgccaccacgttggcaattccccgcgccgaatcggcgatcaaggaagtgcagcgcaagatcgacgaaacccgtggcaaattccgtagcgaagcgctgacccagctcaacgaagcgcgcaccgaactgaacaaggccgaatccaccggacgcgccctcgaagaccgggtcagccgtacgctggtcacctcgccggtacgcggcatcgtcaagcagctgctggtcaacaccgtcggcggcgtgatccagccgggcagcgacatggtcgaaatcgtgccgcttaacgacaccctgctggtggaagccaagatccgcccgcaagacatcgccttcctgcacccagggcaggaagcgatcgtcaaattcaccgcctatgactacaccatctatggcggcctgaaggccaagctcgaacgcatcggtgccgacaccatcaccgacgaagacaagaaaaccacctactacatgatcaccttgcgcacggatcgcagccacttgggcaccgatgagaagccgttgctgatcatccccggcatggtggcctcggtggacatcatcaccggcaagaaaagcatcctgagctacctgctcaagccgatcatcaaggcgcgggccgaggcgttgcacgagcgctgatctctatcgcctgccagggcctcatcgcaggcaagccagctcccacatttgaatgtgttcacaaatcaaaatgtgggagctggcttgcctacgatggcgccatcagcttcaccgcagatcccaaccctaatgcatatcgatattcactaacggtatttaatcgcccgttcttatatctataaagtcactcccctgtccgaccgggagtgcactcatgtccgccacctctactgttccaacagcgacctctaccgcccaaaccttcgacatccgcccatttcccggcagcgtcggcgccgagatcgtcggcctggacttgtcccgcccggtcagcgaccaggatttcgcgcgcattcaccgcgcccacctggaccaccatgtcgtagtgttccgcgaccagcgcatcacccccgaacaacagatcgccttcagtcgccgcttcggcgtgctgcagattcatgtgctcaaacagttcctgctggccaaccacccggaaatcctgatcgtctccaacatcatcgaaaacggccaatccatcggcctgggcgacgcgggaaaattctggcactcggacctgtcatacaaagaactgcccagcctcggctcgatgctgcatgcccaggagctgccgtccgaaggcggcgacacgctgttcgccgacatgcacaaagcctgggaccaactgcccgagcacctgcgtaaagccgtggaaggccgcagcgctgcgcattcctacaccgcgcgttacagcgaaaccaaattcgaaggcaactggcgcccaaccctcacgcccgagcagctcgcccaggtcgccgaagtggtgcacccgattgtgcgcacccaccccgaaaacggccgcaaggcgctgttcgtcagcgaaggcttcaccacgcgcatcgttggcctgccggaagacgaaagccgcgacctgctggcccagctctatgcccacagcgtgttgccgcacaacatctaccgccaccagtggcagccccacgacctggtgttctgggacaaccgctcgctgatccacttggccgccggttgcccaagccatctgcgccgcaagctatttcgcaccaccatccagggcgacgcgcctttctgattccccggcaagagaaatgaaatgaacgcgcccctgcaaggccacgcggccagcaacctgaacactgccggtccgttactggcggtggataacgtcagcctcgagtaccgcacgcccgagcgtgtggtacgcgccacccatcaagtcagtttcgagatcgacccggccgaccgctacgtgctgctcggcccttcgggttgcggcaaatccaccttgctcaagtcgattgccgggtttatcaaaccctgcgaaggcgagattcgcctgctggggcaaaaggtcgaacagcctggcccggatcgcatcgtggtattccaggaattcgaccagctgccgccgtggaaaaccgtcaagcagaacgtgatgtttccgctgctggcgtcgaaaaccttgaagcgccgcgaagccgaagaacgcgcgttgcactacctcgaaaaagtcggtctcagcgccttcgccgatgcatacccgcataccctttccggcggcatgaaagcccgcgtggccatcgcgcgcgccttggccatgcagccgaaaatcctgctgatggacgaaccctttgccgcgctcgacgccctgacccggcgcaagatgcaggaggaattgctgctgctgtgggaagaggtgcgcttcaccctgttgttcgtcacccactccatcgaagaagcgctggtggtgggcaatcgcatcctgttgctgtcgccgcaccccgggcgtgtgcgtgccgaaatccacagccatcaatacgacctgcacagcctcggcggtgtggaattccaggcgtcggcgcggcgtattcatcgcctgctgttcgatgaagcgcccgaggccgaacgtgagttgggtttcgccgatatccgcatcgcttactgagaggccgacgtatgcgccaggaatttgaagtaaacctcgaaccgctgctgagcgtccccgtcgaacgcgagctgccgctgcgtcagcgtctgtggcaacaaggctggctgcgcaagggcctgatcctgatcgtgctcgccattctctgggaagcggtcgcgcgctatcagaacaacgacctgctgttgccgagctttctgcagacctttcacgcgctctacgacggcctgctcagcggtgagttgctcagtaaagtgagcatctcgctggcggtgctgatcaagggctacctgatcggcatcgtgctggcattcgccctaaccacgttggcggtgtcgacccagttgggccgcgacctgctgagcacgctgacctcgatgttcaacccgctgccggccatcgccttgctgccgctggcgctgctgtggttcggcctggggcagaacagcctgatttttgtgctggtgcattcggtgctgtgggcgttggcgctgaacacctattccgggtttctcggcgtctccgaaaccctgcgcatggcgggccgcaactatggcctcaaaggcatgcgtttcgtgctgttcatcctgatcccggcggcgctgccgtcgatcctcgccgggctcaagattggttgggcatttgcctggcgcacgctgatcgccgccgagttggtgttcggcgccaccagcggcaaaggcgggttgggctggtacatcttccagaaccgcaatgagctgtacaccgacaaggtgtttgccggtttggccgtggtgattctgattggcttgctggtggaaaacctggtgttcgatacgttcgaacggctgacggtgaaacgctggggcatgcagcgctgaacccgcggttttaatcctgctacgattgcacgcaattcactctccaccgaccatgagtgcttggcatgcaactaccggacatgaacctgctggtcgccctcgacgccttgctcgacgagggcagtgtggtcggcgccgcacggcggatgaacctgagcccggccgccatgagccgcacccttacgcgcattcgcgaggcggtcggtgacccgatcctggtgcgtgccggtcgcggcctggtgccgacgcccaaggcgctgcaactgcaaggccaggtgcgcaacgtggtggagcaggcggcgttgctgtttcgttcggcggatgaggttgacctgagcaccttgcgccgccgcttcagtgtgcgcgccaatgacttctttatcggcgtctacggcggtcggctgttcgacacgatggagcgcatggcgccgttgtgcgagctgtgtttcgtgcccgaaggcgacaccgacgacgaggcgctgcgtgaagggcggctggacctgcgagtgagtaattccatgccgcccagcccggaagtgaaggtgcaaaacctgttttccaccaccttcgttggccttgcgcgcgaagaccacccgctgttcgacgaagaaatcaccgccgcgcgattcgccagctactcccacatcagtatttcgcgtcgtggcatcgcccgtgggccaatcgacaccgcgctgaatgccctgggcctggagcgccgcgttgcaatgatcgccccaggctttcatggcgcgatgttcatgctgcccgattccgacctgctgctgccggtgcccaaggaagccctgctgagtgccaatcgcctgaagctgccgttgcgcgccttccagttgccgatctccctgccgacgctgatgttggcccaatcctggcacccacgcttcgacaaagacccggcgcacaaatggctgcgcgaaaccatgcgcgaaagctgccacgccacctggctcgaagcgcagcccagctgaatctcacctgcactggatcaacatgtgggagctggcttgcctgcgatggcggtctgactgtgtagtgattcattgcctgacccaccgctatcgcaggcaagccagctcccacagagatcagcagtgcccctgaggattgcgtctggtgcacttataagctgccaacaagtaactttttgtcatgggttcgcctgattaaactgctcgggtatttctaaccccgagttacccgttcatgacttccctcgctgcccccgccctacaggctgcagcccaacccactgcgctcaaccctcccgtgttcggcccgcgcattatcatcggcctggtcggcgtattgctggcggtgctggtgtccggcctcaacgagatggtcaccaaggtcgccctcgccgacatccggggtgcgctttacatcggctttgacgaaggcacctggctggtcgccgcctacaccgccacttccgtggcggccatggccttcgcgccgtggtgttcggtgacgttttccctgcgccgcttcaccctctgcgccatcggtttgttcaccgtgctgggcatcctgtgcccatttgcgccgaactacgaaagcctgctggtgctgcgcaccgtgcaaggcctggccggtggcgcgttgccgccgatgttgatgaccgtcgcactgcgttttctgccggccaacgtcaagctgtatggcctggccggctatgcgctcaccgccaccttcggcccgagcctgggcacgccgttggcggcgctgtggaccgaatacgtcggctggcaatgggcgttctggcagattgtcgcgccatgcctgctggcgatggccgccgtggcctacggcttgccccaggacccactgcgcctggagcgcttcaagcagttcaattggcgtggtctgctgaccggcttcccggcaatctgcatgctggtgatcgggctgttgcaaggcaatcgcctggactggttcgagtccggcctgatcacgtttttgctcagtggcggcacgctgttgctggtgctgtttctgatcaatgaatggtcgcagccgattccattcttcaagttgcagatgctcggcctgcgcaacctggcgtttgccttgatcgtgctggcgggcgtgctgatggtgctgacctcggtgatcatcattccgtcgagtttccttgctcaggtgcagggttaccggccgctgcaaactgcgccggtgatgctgctgatggcgctgccgcagttgatcgcgctgccgctggtggcggcgctgtgcaacctgcgttgggtcgactgccgttgggtgctggggctcggcctgagcatgctggtgctgtgctgcgtgggcagcgcgcacctgacgtcggagtggattcgcgacgatttctacggcctgtacctgctgcaaatcttcggtcagcccatggccgtgttgccactgctgatgctttctaccggcagcatccaaccgatggacgggccgttcgcctcggcctggttcaacaccgtcaaaggcctcgccgccgtaatcgccaccgccgtgctggacacgctgaccacgcagcgcctgcactttcactcgacgatgttggtggacggcctgggcaactcgcccctggccgatggcgacgcgccgggcctcgctcaccgcctgcacgaacaggctgtggtgctgacctctgcggatctttattacgtcatggccgccgtcgcggtggcgttgatcctgctgattttctggatgccgacgcggatttttccaccgcgcgcaccgacctgactgaaaggacctctcatgaaacgcaaagacaaaattgccgtctccgttattgccgtgtttgccgtcggtgtactggtttacctggtcgcgccgggcgtgctgggcagcaagcgccagaccaccaacgacgccttcgtcgctgccgacttcaccctggtggcgccgcgcgtggccggtttcatcaaggaagtgctggtggaagacaaccagcgggtcaaggccggccaactgttggcgctgatcgacgaccgcgactttcgcgccgccgcccaagccgccgacgccgatacactggtcgcccaggcgcaactgaaaaacgccaccgcgacccttgagcgccaaagctcggtaatcgcccaggcccaggccaccgtgtcggcagaccgcgccgaagtggccttcgccgagcacgagctgaaccgctacaaccacctcgccggtgtgggcgcgggcactgtgcagaacgcccagcaggccaagacccgcatcgaccaggccaccgcgcgcctggcgaatgccacggcggtgctggcggccgagcgcaagcaggtggaaatcctcaccgcccagcgcgatgccgccgaaggtggactcaagcgcgcccaggcggcattggaaatggccagctatcagctgtcctacacgcgcatcgtcgcgccggtggacggcatggtcggcgagcgcgcggtgcgggtgggtgcgtatgtgacgccgggcagcaagatcctcgcggtagtgccgctggccgaggcctatgtggtggccaatttccaggaaacccagctgtcgcatatgcacgccggccaagccgtgcaggtgcgcgtcgacagcctcgacggcgagctgctcaacggccatctgcaaagcctggcgccggccactggcgtgacttttgcctcggttaagcccgacaacgccaccggcaacttcaccaaagtggtgcagcgcattccggtaaaaatcatccttgagcccaaccagccgctgaccgagcgcctgcgcgtcggcatgtcggtggaagccagcgtcgacacccagccggtcacgcagccgcgtgaggtagcgcagcaatgagacacttcgcctggctcaccttgagcctgatcagcctcagcgcctgcacggtcggcccggacttccagaaaccccaaggcccgcacgtcactcagtgggccgaaccccagggccgccaagccgtcagccgcgcggtgacggacccgttgcaggagcgttggtgggacgtgttccacgacgagcaactctcggcgctcacccgtcgtgcgctcaccgacaacctcgatctgaaactcgccagcagccgcctgcaacaaagccgcgccgtgcgccaggtgaccaccgccgagcgttatcccaacgtcaatgccagcggcgactacctgcgtcaacgcaacagtggcaaaggcttgagcgacccgtccggtgagaatggccagtccgcctacaaccaatgggacatgggcttctccgccgcctgggagctggacttctggggccgcgtaaaacgcgaaaccgaagccgccgacgccaccctgcaagtggccgaaaacgaccgccgcgccgtgctgctgtcggtactcgccgagaccgcgcaggactacatccagctacgcggcgtgcagaacacccgtgccgtcaccgagcagaacctcgacgttgcgcgccacagcctcaagctctcgcaattgcgcctggccgacggcgtggcgaccgacctggacgtggccgaagccgccgcccaggtcgccgccatcgaagcgcgcctgccggacctgcagcagcgccaggaccagttgatcaacgccctgagcctgttgatgggtgaaccgccccaagccctgcacgcgcagttgtccaaggacgccgccgtgccgcaaacccagcgtcaggttgccatcggcttgccgtcggagttggccgaacgccgccccgacatccgccaggccgaagcacgcctgcacgccgccaccgccaacatcggcgtggccaagggcgacttctacccgcgtatcaccctgtcgggcagcctcggctcccaggccttggaactgtcggatttcggctcgtggggctcgcgcgcgttcgcctttggcccgcaattcagcttgccgctgttcaacggcgggcgcctgcaaggcatgttgaacctgcgcgaagcccagcaacaggaagccgcgctcgcctaccaacaaaccgtgctgcgcgcctggcatgaaatcgacgaccagctgacccgctacaacgccagccaactgcgccgcgacagcctggccgaagcggtacgccagaaccagatcgcactgagcactgcgcaacatcaatacgtcgaaggcgtggtggatttcgtcaacgtgctcacggtgcagagcgcgctgctggcgacgcaggaacagtgggtggaaagctccacgggcgtgtcgctggccatggttgggttgtataaggcgctgggtggcggctgggagtcggtgtatcccgcaggctaaaggctaaacacaacgccctgtgggagcgggcttgcccgcgatgagggcagatcattcaacatcactttgactgaactgccgctatcgcgggcaagcccgctcccacacggggtaattactggttttgcaaaaacaccacatacccgcgaaaccactcattccccttcaaataccccggcgcctcccacacgccaccctgaatcagccccaccttgaacggcaatcccagccggttcatgcgcggcaaatatgccgcgtaatccgggatgctgtggcgcccttgataggtctgcaccaccacttcatccaccacgcctttgagctgggcgatggcgcttgggtcggcgttgctgctccagtccatcagcccggtgatgctcagcttcaagtcggcgggcaggcggtggcgcaggtcgcgcaggaagtcggcgtattcgtgcaggtattgggtgcgcgcgtcgaagtcgatctggatgccgaccaccgggttgcccgcgtcacgccagcgttgcacctggccgagcagttgggtgtagacccgctccggccagtgcagggtgtgggcgcggtagaccacccagacctcgccacgggtgaggcgcggtatgccgaggccctgggcgatcagttgcacgccgcgctcgggggcgcggcgggtggagttgatctggccttgcaggatgtacagggtgttggcctgtttaagtaccggctgcggggtgacgccactccacaaccagaaggcatcgtagtcgcgagcgtccacggcaccaaaggccgggcttgccagcagcagcaagcccagccacaggtgtttcaccagtagtactgcagcgatttgccccactgggtgtcggcgaagccgcttttcagctggcggaaccaggccttgcgcacggcgggctcaacgtcatcgccgccgcagctgttgtagccggccggggcatagcagttgatggcgcggaacagagcgtaggccttgtcgttcttcggcgccttggcgttggcgatcacctgcttgtagccgttgagccgcgagaaggtttcaccggggaattgcgccgcggtgctgcccaggctgccggcggcgcgtgcctgttccaggggcatgccgtcgaggttattgcgcaggatgaactcaccgaagcagttcagggcctgcgggtttttcgcatcggtttgcaaggtggcggcggtttgcgcgatggccgggcagctgtagccggattcggctttgtcgccgttccactggaacagcttcaagctctggccgccgctgtagacgtagcccaggctggtgcccagtttgtcttcgggggccggcgttggcagttgcttgaggtcatcggcgaaggtggcgaactggccgcgcagcaagtctttatagagcagcacgaattgcgcggtctggcgttccaccgggtcgtcggccttggcgatctgctggcgcagcaagtccggcccggcaacgttgcgcagcaggatataacgcacttgcttggcgctgattggcgagtcggctgcgaacaccttggccaactggccgctgcgctcgtagttgagggccagggccaattccaactggtcgcgttgcagcggcaatttggccagcggcagcagttgcagccacaggtcttgtgcgcctttccagtcttgcttggcttccagtgccagggcgcgcagggtttgttggctgaaggcgaagtaattcaggctcgacggcacgctttgcggcaactgcttcaaggcggcatccggttgatgctcgacgtacagcgcgctcacagctaacaagtagtcgtaaaacgccggctcatcggcaaacgctgctttttgcttctcaaggtctgcgcggctgagcgcgggctggttgccgccacgcatcaccatcaggtcgctgacgagctggatcatcggggtcttgacggtgtcgctattgaccatcaacagcttgaggtcggcctcttcaaccaattcatccaccgacacattgcgctgctcgtcggtggcctgggtcagttgccaggcaaacgcttcggcgagtttttcgttgtcgtccgccagccagtagacccggcgcagcaagccgcgtgcagaggcgctgtagtcgccctgtggataagttttcagataggcatcgaaacccttttcggcctcggcgagcgcaggtttatccacacggtcgaggtgcggcacgccgtcttcgtcataggtattggcctgggcctggttgagtgcgttacgcgcggtcatgtacagcgcggtttccttcagccagggcgaagtagcgttctgggtggcgacgaagccaggcccggcgtcggtgaagcggccggtgtagaagtcggcggcggcttgcaggtacgtgcgaaacagctggccttcgctcgattggatatcttgcggcggctcgaccaccgggcctacccattcgcacgcggtgagcaattgcaggcgcgccttcaccagcagatcgcgttcggcggctggcatgtcggccttgatcacttggcggataaacgcggcagcgctgttctcgtcgttgctgcggcaacggctgccttcgccattgaggaacgcatcgccggcggctttagtgtcttcgcgcttgatgcccagcggttcaagcagtgcatcgagtggcgaggtttcgggggcgtcggatgtgacgggctcggcttcgccacgcggcaccaggcgatacaccgggaacggcaccgggccaaaaccctcggccaggtcatcttcgctcaaggcattgggcgtcagcggcgctgctttcttgtcggccagcaacaagcgcaggttggctcggctgtcattgcctgggctcaggaacggcaggttattgcaggggtccagcgtgtcacgcgacacccgccagtcggggtaacacgagtcgtccgaactggcctgggccggtagggaaatgccggcaagcagggccagtgccaggggtgacagaaaaccgatgcgcatgacgtgtccttgatcctgagtccttggagggtgccaatcatagcttgatccgacagcggcttcggtgaaggcctacacaaattgctgatttgtccgatttttggtcgtggcaatgctcagcgaaatccaggcgcagtcgcaggtttatgaggttcaagtcaaatcccgcagcgtgccgcccgacggttgcaaatcagcgagcgaaaccggggcttttgtcctagagtggcgcttgtttgcacgtgtgcagggtttgtccgggaaatgggcagtatcaggggaattgaggtgcgacggtctgtggtagagcaagacgacaaaatggggacgtttcccgcagtcaatcgcctctcgggcgcctgggaaggcgccggttggctcagccggttgtggtgggtgccgattctggcgctggccatggcggtgcgtttttatggtctgaccgcttcggcgatctggggcgacgaaggctcgagcctgctgctcagcgagtacgccatggaggacctgtggtttcacgccgctcatgatgtgcacccgccgctgtacttcttcatgctgcgcggttggatcgagctgtttggcgatgggatctggtcgattcgcggcatgagtgccctgcccggcgtagcggcggtggggctgggcatctggctcacgcggcagctgtccacgcgtcgcgccgccgtgctggcgggcgtgatgttggcggtgtttccgacggcggtgcgttacagccaggaagtgcgcatgtactcactgctggccgtgtggttgctgggcgccacgctggcgctggtgtactgggtgcgccaacccgagcgcacgcgttacctggccgcctatgtcgtgctgatggcggccgggttctacacccactatttcaccgcgctgtgtgtgctggtgcattgggcttacctgggcgtgttgtgccgctcccaggcacctggccaacgcttgatcattcgcccgtcgtggtggtgcgccaacgtgctgatcgtcgcgttgtacctgccctggctgccgaacctgctggaccttatccaacacgttgagcagctcaaggtgggcggtgacattggctgggaagacccggtttcgctgatttccgtgccgtcgatggtctggcagttcatgcttcaggatgaaggtatcggcttctggccgccgctgttctggctgttccctgtgttgttgatcacggtggtgggtgccaccgcctggcatgatcgtgagcgctatcgcccggcttgcctgctggcgctgttctttttattgccgctgctgctggtgtatgcggtgtcgtttgtttcgccggtgttcatcgagcgctacctgacggtgtatgcactgggcttgccgattctgctggcgttggccatcgaccgcttgcccccgcgcttggcatggctgggcgcggcgttgttcgtactgttcgtcggcgtggaactgctgggcctgaagaacaacgccgctgtcgacgagcatgatcaattcaacgtgccggtggagttcgtcaatcgcaattaccaggaagacgaccgcatcgttctcagtgacatgatgtggtacctgagctacgtgtattacgaccagaccgacgcccaattgcagctcttcaccccacccaaacccgacggcaccccgacccgaccgaacgcctacggcttcggcacgttggtggatcaggacggcgggcgtatttacctggaccgtttgtcggcattacccgccgatacgcaccgcgtctggctgatcagcagcaatgaaatgccggatgatttcgccccgattcccgccgactggcgccagcttttgcagcaggacggcggcggggcgcgggcgcgcttgtttgtgctgtgtcgcgggccagagccctcacagcccgagggttgccgttaatcaagcagcggcattaagtacatgcccggaacacctgtaccgggccaaccccttgcggttgttggcctggctggtgcgtgggctagactcgcagtaaccgtcttcccaggagccagccatggaatcgccagtgcacagcctgccgtcactgttcaaacagcttgggctgccggatgacccggtgagtattgagcagtttgtgacggttcattcaccgctgaagcctgaactgcatctggcggatgcgtttttctggacgcccagtcagagagcgtttttgcgcgaagagattcgagaggatgccgactgggcagaggtggttgatgagttgaatgtgttgttgcggagagggcgtgaggtgtaaaaactcgggcctcgttcgtgttttgggattcaatgctgacgttttgtacggatgcccatcagcccgaagccaacactgaactaaatgtgggagcgggcttgcccgcgatagcgcactgacagtcaacatctgtgctggctgagccgccgtcatcgcgggcaagcccgctcccacaggtatctatctgtgttgcgagaatcgcgatccctacgctgaaaaaccaacacccgcgcgcaaacccgctttacttacccacaccttcccgcgccacccatcataaatttgtttcaaaacttgacggctttggatacatccaccatattgatagttagcaaactaactgtatgcgaacactccagtgcctcaaaccctcgaacaactccagatgaacctcagcagcagcatggtggtgggcgcccgtaactggcgcaaaatctgccagaccacgctggtgagctacggtatttccgaagcctgcgccgtgccgttgttgatgatcggccgcttgggcgacggtgtgcaccaagtaaaggtcgcccaggcctccggcatggaaagcccgtcgctggtgcgcctgctcgatcagctgtgcgccggcggctacgtgtgccgtaccgaagacgtgcacgaccgccgcgccaaggcgttgagcctgaccgagcgcggccgtgagctggtgcaagcggtggaggtgcaactggtgcgcctgcgcaaagacgtgctggcggacattgcccaaagcgatcttgaagcggcgttgcgtgtactgcgggcctttgaggcggctgaggcaacctcttgaacggattttttaccggcttcccgcccgctcgcgactggttctacggggtgcgtacgttcgccgcgtcgatgatcgcgctgtacatcgccatgctcatgcaaatgccgcgtccgtattgggcgatggccacggtgtatatcgtctccagcccgtttgtcgggcccaccagctccaaggcgctgtaccgcgccatcggcaccttcatgggcgcggcggcggcggtggtttttgtgccgatgttcgtgcagtcgccgtatgtgctggtggtggtgattgcgctgtggaccggcattctgctgttcctgtccatgcacctgcgcaccgccaacaactatgcgctgatgctggccggctacaccttgccgctgatcgcgctgcccgtggtggataaccctttggcagtgtgggacgtggccgaggcgcgcaccgaagaaatcttcctcggcatcgccgtggcggccgtggtgggcgcgatgttctggccgcgtcgcctgatgccagtgttcgacggctcggtggccaagtggtttgccgacgcgcaggtctacagcctgcgcttcctcacgcgcaatgtggacactgaagaaatcagcacgctgcgcagcggcatggtcgccacgttcaacaccctcgaattgatgatcggccagttgccccacgaaggcgcgcgcccgcagacggtgcgtaacaccaaggaactgcgcgggcgcatgattcacctgctgccggtggtggatgcgctcgacgatgcgctgtatgccatcgaacaccgcgcgccggagtttctcgagcgcatcacgccggtgctggaggccacccgccaatggctggaaaccaccacgcaaactgccccgctggaaagctggcgcgtgctgcgtgaccaggtcgacgcccttcaaccccaaggcgaagcgctggacgaccgccacacgctgctgttctccaacgcgctgtatcgcctgggggagtggatcgacctgtggcaagactgccgcagcctgcaagccgccatccagtgcgaaagccaggacacctggcgtgccgtgtaccgccactggcgcctgggccggctcacgccgttcctcgaccgtgggctgatgttctactcggcgttttccaccgtcaccgcgatcatcgtcgcctcggtgctgtggattctgctgggctggaccgacggcggcagcgcagtgattctggcagccgtggcctgcagctttttcgcctcgatggacgacccggcgccgcagatctaccggttctttttctggaccgcgatgtcggtgttgttcgccagcctctacctgtttctggtgctgccgaacctgcacgattttccgatgctggtgctggcgtttgcagtgccgtttatttgcatcggcacgctcaccgttcagccgcgtttctacctcggcatgctgctgacgctggtgaacacctcgtcgtttatcagtatccagggcgcgtatgacgcggacttcctgaacttcgccaacgtcaacctggccgggcctgtgggcctgttgttcgcctttgtgtggacgttgattgcgcggccgttcggcgccgaactcgcggccaagcgcctgacccggttcagctggcgcgacatcgtcaccctgaccgagcctgcgaccctggccgaacaccggcacatggccgcgcaaatgctcgaccgcctgatgcagcacctgccgcgcctggcgctgatcaaccaggacaccggcaccgccctgcgtgatctgcgtgtggcgttgaacctgctcgacctgctggcgtactcgccacgcatctacggcgtgccacgggtgttgctcaaccaggttgtcgaaggcgttggcggttacttcaaggcgtgcctgaaggccggtgaacgcttgcccgcgccgagcggtctgctgatgacactcgaccgcacgcgccgcgccctcaacggccaaggcttgcaaaacgaagacgatacccgcctgcatctgctgcacgcactggccggcttgcgcctgtcgttgctgccaggcgtggaatttattggcggcaccgaaatggaagcgccgctgcctgatggagcgcctttatgatcggtgatctggatatcagcggggtgttcctgcccacgctgctggtgctgatgggcattacgtacgtgttgtttctggtggtgcacgggctgttgacgcgcattcacttctatcgcctggtctggcaccgggcattgttcaatgtggggctctacgcgctgttgctgggcgcggtggactcactcagtcgatacctcatgacatgaaaaaaccttttttgaccatcggccgtgttgtcctgacgttattgatagtgaccttcgctgtcgtcgttgtgtggcgcatggtcatgtactacatgtttgcgccctggacccgtgacgggcatatccgtgccgacatcgtgcagatcgccccggacgtgtccgggttgatccagcaggtggacgtgcgcgacaaccagctggtgaccaagggccaggtgctcttcgccgtcgaccaggaccgcttcaagctggcgctgcgccaagcccaggccgccgtggccgaccgccaggaaaccctggcccaggcccaacgcgagtacaagcgtaaccgaggccttggcaacctggtgccgagcgagcagttggaagaaagccagtcccgcgtggcccgtgcccaatcggccctggccgaggcgcaggtgaccgtggacgccgcccagctcaacctcgaccgctcggtgatccgcagcccggtggacggctacgtcaacgaccgcgcgccgcgtgcccaggagtttgttactgccgggcgcccggtgttgtcggtggtggacagcaactcgttccacatcgacggctacttcgaggagaccaagctcgacggtattcacgtcggcatggccgtggatatccgtgtgattggtgacaacgcacgtttgcgtggccatgtgcagagcatcgtcgccggtatcgaagaccgcgaccgcagcagcggctccaacctgttgcctaacgttaacccggcgttcagctgggtgcggctggcccagcggattccggtgcgtatcgccttcgatgatgtgccggcagactttcgcatgatcgccgggcgtacggcgacggtgtcgatcatcgacgacgagaccgccgccaaagaaaaagcccggcagggagaaaaaccatgaaaccggcggcgctgctggccacggccggcttgggtttgctgctgtcggcctgccaggtagtcggcccggattacacactgccggagaagtccgccatcaaccgcggcgacctgcaagggcagatcgcgggcgagggccacaacgtggtctcggcgccggtgccggccgactggtggaagctctacaaagacccgcgtctggatgagctggtgcgtcaggccatggcgtccaacaccgacttgcgtgtggccgccgccaacctgcaacgcgcgcgcttccagacccaagaggcgcaatctgccggtggttggagcgctggcgcaaaagctgaggcccagcgtttgcaggagtcgggtgaagcctatttgctgacggaaaaagtcccggtggccaatatcggcagcgccagcatcagcacgtcctaccagtttgacttgttcggcaccttgcaacgcggcatcgaaagcgcccaggccaccaccgacgccgcccaggctgctgcggatattgcgcgcattacgctggtcgccgacgtggtgcgctcctacacccaagtgtgtgcggccaacgaagagctggcgattgccaacgagtccctcgacctgcaggcccagagcaccaagctcacccaacgcctgcgcgacgccgggcgcggtgatgaaacccaggtgacccgttcgcaaacccaatacaaatccttgcgtgccgacatgccgcgctacgaagcagcgcgtcaggcaggcttgttccgtttgtcgatgctgctggccaagccggtcgaccaactgccgtcgggcactggcacttgcgccgagctgccgcacatcgcccagttgctgccggtgggtgacggcgccgcgctgctcaagcgccgccccgacattcgccaggccgaacgccaactggccgccgccaccgcgcgtatcggcgtggccaccggtgcgctgtacccggatatcagcatcggcgccacggtgggcaccgtcggtattcttgacgacttgggcacgccggccaccaaccgctggggctttggcccgctgatcagctggtcggtgccgaccaacggcgcccgcgcgcgcatccacgaagccgaagccgcgacccagggcgccctggcgcacttcgacggcgtggtgctcaacgccatccgcgaaacccagaccggcctcgcgcagtacaccgcgcagttgcaacgccgcgacgcgctggccgatgccggtgcgtccgccaaggaagcgtcggagcagacgcaccgcttcttccaggccggtcgcgcgtcgttcctggccgacctgcaagccacgcgcacctacaccgatgtgcgtgcgcaactggcggcggcgaacacccaggttgccatgagccagatcgatctgttcctggccttgggcggtggttgggaaagcggacgaacgcaagcgtcacagcccggcaaaccctgagctaaaagctatgctttgtcaggtgagccgcggtgacggctcacctgacactgctcgcgtttgctcatggggattccaataatgaaaaacccttatgctcccgctttctggtgcgtgctcttcgcactggtgttgttatcggctgcctacttctacggcgtcatgcttgcccatcaactcgacaaggccatggtgttcctcgacagcgcgtgcctggtgatcggcaccttgtccatcggcgtcgtggcgtgggcgtcttatcaaaaccaacgggtgaaacgaaggctgctcgaacagggcaagacccgcgtggcgatctgggacaccaaagtcgccctgcgccgtgtcgaaaccgtgttcgaccgttatttctggggcagttactggcagcccggccgcaccttccaggaagtcatgggggaactcaccggcacgcccctggaaaaaagcctcgaagccctgaaaaaacaatgtgtgctgctcgaccagcaggtcgccgacggtaggcattggctgaataacgcccgggaattgtccgacgtggccaacgccatggcccgcgagcgctatcaactggatttctgtaaccccaaggccgacaccccgagcaatgcggtgatacatcgcgagtttgaggtgttggtgtacacctggaccgcacgcttgaagagttttgatcaccagctcgatgagattgaattggagtacacgtgaaccaactgctggcctgacccctctgaaaagctgggccgttcgcggccgccagtgctaatcttcccccgttttcggcgggcttgagccaaccccctcggggttcaaggaagacagcccacttctcacaggatttgatcaggtcacttcatgaataagccagcagttgttcttttgggtttcgttgtcgccgtcggcgtcgtcagtgcaggcggcgcctggtacaccggtaagcagctggagccggtgttgcaaaccgcgatccagagcgccaacaaggaactgcagacctccatggccggcgtcgatggcagcgtgagcctggagctggtgtccctggaccgtggcctgttcagcagcaccgcgcactaccgcctcaaaggccagggcagtgtgttcggtgaagacaacccgaaccctgaactgctgttcgtcgaccacatcgaacacggcccgctgccgttttcgcgtttggtgtcgctgaaatggctgccggtcatggccaccagtcactacgcgctggaaaaaaacgccaccaccgaaaaatggttcgccgccagcaaagacgtgtcgccgcttaaaggcgtagccaatatcggctacaaccgctccgtcgatggcaacgtcgagctgctgcctctggagctcaaggacgacaagtcgtcggtgagcttctccggcgccaatctggacttcgacagcagcgccgaaggccagaaggtcaaggccgacggttacatgaacagcctgaaagtcgcggtaatcgacgccaatggcgtgccgttcgacgctgagttgtccggcctgaccgtcgccagcaacctggaaaaatccagcttcggtttctacaccgggcagaacaccgttgagctgaccgacaccaaagtcaccttcggcccacagaaagccgtgctgaccctcaagggcttcgagcagaaagacaccagcgaaaccaaagacaacaacctggctggccgcgtcgactacaagatcgacgagatcggctaccaaggtaagcctgtgggctcggccgcgatggccctgagcatgaagaacgtcgacattccagcgatgctggtgctgaccaagctgtaccaggacaagatgcagccggtgcaagccgctgccgctgccggccagccggtgcctgagctgcaactgaccgaagccgagcagaccctggccgagaccaacgtcaaccaggtgctggctgccaagccgcaagtggcggtggaaaacctgtcgttgaaaaccacccatggcgaaagcaaattcaacctgatcgtggacctgaccaaacccgcttcgatggagctgccaccggttgagctgggcaagcaggtcatcgcactgctggatgccaacctgaccctgtccaagcccatgattgccgacgttgctgccctgcaagcacaagtaggcggcgtgaccgaccctaaagccatcgagcagcaatcccagggggcggccgagatggtcagcggcatggcggtcggcacgcaactggcgaccctggtgggcactgacgtggtttccaagctgcattacgccaacaatgaagtgaccttcaacggccagaagatgaccgttgagcaattcattggctttgtgatggccaaagtgggtgctgtcagcggcgcgcagtaagatttccgacacccttcggaaataaataaatgggggagcagggttgcctgaggcagcggtcaaacagtcggcggataggccgacggtgaccggtcagcgcgggcaagtctgctcccccattggcttttctggtgggtgggcaattctgaacaattgttctgaattgggcatttccctacattcctaggggatagttcctacaggaaagctaggtcgggtcactagacgccgacaccctgacgcaaattgctcaggaccacctatcgttacagctttccgtgtgtaaggaagctcacgatatgctgcgaaacctaccactcagtgcttcaggccggttgcgactgctcatcggtgcggccttgtgcagtcagctgctgatgcccagcctcgcgtttgcagaccctgcctacgacgccttgatcattcaggcgcgcaacggcaacttcacgccagccctcacgcaactgcgccaactgccgtccgagcgccagacgccgggccagatcagcgatcacattgtgattgccggctgggctgggcaagacgccgaagtgctgaaggtgtacgaggcccagggcaagaatcgcaacctgaccacccaggcgctcgccacggtggcccgtacttatcgcaatcaaaagcagtggccgcaggccttggcggtgtatcagcaggcgctgctgcgcgagccgaataatgttgacctgcaactgggccaggcgctgacccaggccgacggcggccaaaccaacgaagcggtgcagcgcacccgtgcattggtggcggcgcaaccgaatgaccccaaccgccgcatggcgctgggctatgcgctgacgcgcgcgggcttgaattacgacgcgctgttcgagttcgaccaggcctttatccgtgccggcgacaaacccgaagtggtccgcgaatacatcgtcgccctgcaaaaggcgcggctgccggaaccggcgttgcgcctgtcggccaaacaccctggcgtgctcgacgcagtgacccagcgccgccttgaaggcgacctcgccgccgagcgcgtgcgcatggccgagttcgccacgcgcaccgagaaagaacgctacgtgatcgccgatcgcgcccttaatgactacgacaaactgctcgcgcgctgggccccagaccccagcgcacacgacgacgtggtgcgctggcgcatcgaccggttgggcgccctcaaggcgcgtgcgcgcaccgctgaagtgatccgcgactacgaaaccctcacgggcgaaggcgtgcaattgccgacctacgccgtgcgctgggtagccgccgcttacctcgatcaacgccagccggaaaaagccgagccgttgtaccgccaggcgctgacggccccggatgccgaccccggcgatcatgtcgaagacagcactgcgttgttctactcgctgctggaaagcgacaaagtgatggaggcgcgtgaagtcgccagcaacctcgccaacacccagaaccctcgcgtcgaactcaagggcttgcccatcggcaaccccaacgacagctggatggatgcgcaacaattgtcggcccaggccggcacctacggcggtgacctgccaggcagcgaaaccggcctggaagccttggtggccaaagccccgggcaacgtcggcctgcgcctggcccaggccgatatgtaccgcgcccgcgattggccgcgccgcgccgaaggcacgctgaaggaaaccgaggcccaggccccacgtgatatcggcctggaagtgtcccaggcctacaccgccatggacctgcaggaatggcggcaaatggacgcgctgaccgacgacgtgctggcccgcaacccggacaaccgccaggtgcagcgcctgagccgcctgcgcgatgtgcatgacatggccgaactgcgtgtcgaagcctacaccggcaaaagctacggcggtggcggcaacaatgacgttggcgcagtcgcgggcagccgtgactggggcattgaaagtcggatttacaccccgcccatcgacgaagactggcgcgtgttcgccggtgccgggtatgccacggctgactttaacgaaggcaccggccagcatcgctggcaagtcgtgggcgtggagcgtcgcacccgcgacatgacgctcgaagccgaagtctccaaccactcctacggttatggctccaagcaaggcgcaagcgtgtcgattgcccgcgacatcaatgacaactggcaatacggcggcagcctcggctacctgctgacgaccacgccattgcgggcgctgaatgccgacgtcacggccaacggcggcagcggttttatccgctggcgcgccaacgaaagccgtgaatggaaactgtccgtcagcccgtcgcacttcagtgacggcaacaaccggctcgaagcgctgctcaccggccgcgaaggcatctacagctcgccgcatgtgcaagtggacctgggcctggaagtcggcgccagccacaacaccaaggaagacacggtgtacttcaaccccaagtctgacctcagcgtgttgcctaccgttaccgtcaatcatgtgctctatcaccgctacgagacccagtggagtcagcagttccaagtcggtgcgggtacttatagccagcgcgattattccaccggcggtgtcggtttgatcggctacggccaacgcgttcgctggaacgacgtgctcgaagccggcgccaacctgagcctgatcagccgaccttatgacggtgatcgcgaacgcgatctgcgcttgctcatcgacctcacttaccgtttctagaagagcctgacaatgaccgttctcagccgttgtttattggtcctcggtgtattgctggcgggtgcctgtgcccagcaacccgcgccgtacacgccccccgccgagcggccgacaccgacccgtgaagcgccgtggccgaaaaaccatttcctgggcattgcctaccacgacgttgaagaccgcgaccccgatcaggcggtggtggcggtgcgcaccgagcgtttgatcgaccagttggcctggctgcgcgaaaacggctaccagccggtcagcgtcgaccagattctcgcggcacgcagcggtgggccggagctgccgcccaaagccgtgatgctgagttttgacgatggctattcgagcttctatacccgcgtgctgccgatcctgcgtgcgtacaactggccggcgatcctcgccccggtggggtattggattgatacgccgctgaataaaccggtggattttgccggcacgccacgggcgcgttccgacttcctgacctgggagcaggtgcgcgagatttccaagtcgcacctggtggaaatcgccgcccacaccgacgccagccacaccggcatcctggccaacccgcagggcaacctcgagccggctgcggcaacgcgtcgctatgatgcggccaccggcaaatatgaaaccgaagcgcagtttcaggcgcggatgcgtgccgacgtaacagctatctccaacaagctgcgtgccgtcaccggcaaggcgccgcgcgtgtgggtgtggccttacggcgccgccgacggcacctcgctggcagtcgtcggcgagcagggctataagatggccctgaccctggacgacggcctcgatgacctcgccaacctcaagagcagcccgcgcttcctggtggcctccgacccggatggcgaacactacgccaacgccatcgtcggcacccaggccaagacctcgatgcgcgtgctgcacgtcgacctcgacaacgtctacgacccggacccggcccaagaggcgcgcaacctcgaccagttggtgcagcgcgtcgtcgatatgggcgccagcaccgtgttcctgcaagccttcgccgaccccaagggcgacggcctggtgcactcgctgtacttccccaaccgctacctgccggtgcgccgcgacctgttcaaccgcgtgacctggcaactgcgcacccgtggccatgtggcgatctacgcgtggatgccggtgctcagttttgccctggacccgtccttgccgcgcgtgacccgcatggacccgaaaaccggccaggtcggcctcgacccggaccagtacaaacgcctgtcgccgtttgatccgaaagtgcgtcagcaaatcggtgaaatctacgaagacctggcgcgcaacacggcgattgacggcgtgctgttccacgacgacgcgatcctctcggacttcgaagacgccagccccgccgcgctcaaggcgtatgccgccaacggcctgccggacagcatcgccgcgctgcgtgccgacccggccgtgatgcaacgctggacgcgcttcaagagccgctacctgatcgacttcacccaggagttggcgggtaaggtgcgcgccattcgtgggccgcaggtgcagaccgcgcgcaatatcttcgccgagccgatgctcaacccggccagcgaagcctggttcgcgcagaacctggatgacttcctccagacctacgactggaccgcgccgatggccatgccgctgatggaaggcgagacgctgaaaaactccaatgcctggctggaaaaactcgtggccacggtcaaggcgcgcccggatgccttgcaacgcaccgtatttgaactgcaagccaaggactggcggaccaaggacgcgccggatatcgacggcgcacagatggccgaatggatgggtgtgctcaaacgccagggggtcaggagttttggctactacccggacaacttcctggaaaactcgccggacctgaagacggtacgtccggccctttccaaccaatggaacccttgaccatgttcgacagaatcctggctttattcgtgttggcgctggtgttgggtgtgccccttggcctgatcttcctggtcaccgggcagttcctgatggacttcgtgttcttctacccgctgttcatgtcggcgttgtggatcgccggcgggctgtacttctggctgcactgggaacgtcactggccgtggaaggaagacaccccggcgccgatcctggccggcaacccgctgatctcgatcatcatcccttgctacaacgagggtgataacgccgccgataccattcacgcggcgctggaccagctgtacccgaacatcgaagtgatcgccgtcaatgacggctccaaggacaacaccgccgcggtacttgatgccctggcattggaacacccacgcttgcgggtgctgcacctggcgcagaaccagggcaaggccgtggccttgcgcatgggcgctgtggccgcgcgcagtgaatacctggtgtgcatcgatggcgacgccttgctggataaaaatgcggcggcctatatggttgcgccgatgctggataacccgcgcctcggtgccgtgaccggcaacccacgcatccgcacgcgttcgaccttgatcggccgggtgcaggtgggtgagttctcctcaatcatcggcttgatcaagcgcacccagcgggtgttcggtcggatcttcacggtttcgggtgtggtcgtagcgtttcgcaagaaagcgctggaccgcatcgactactggagcaccgacatgatcaccgaggacatcgatgtcagttggaagctgcaactcgatcactgggcaatcttctatgagccacgcgccttgtgctggatcctcatgcccgaaaccgtcggcggcctgtggaaacaacgcctgcgctgggcccagggcggcgccgaggtactgttcaaaaacatccgtggcatctggcaatggcgccatcgctacctgtggccgctgctgttcgaatactgcctgtccaccggttgggccttcaccttcctgctgtcagtgatcttctggggcttgggcaagttcatggtgctgccacaggcgattgccgtggactcgctggtgccaccggcctttaccgggctggtgctggcgatggtgtgcctgctgcaatttgcggtgagcatcctgattgaccggcgctacgaaaaagacctgtggaaaaccctgttctggaccgtgtggtacccgatggtgttctggctggtgagcctgctcaccacgttggtcagctttcccaaggtgctgttcaaccagcatcagaagcgcgcacgctgggtcagcccggaccgcggtattaaacctagcgaagaggaggcgtgagcatgaaactggtcagaactcgccaaaattcagtgatgtgggtcatcgatgtactgttgaccctgctggcctgggctgggctggtttggctgctggcgcgcgggattaccgcgatgctggaaacccacggcggcccgcgcattgaggcgccgatttttgcggcgctcaacaccttgcagatctacttctggatcgcgctgttcaatgcggtgatcctgatcagctgggcgcgttatcagcaacgccgcgggcgcaagttcgcccagcgccgtgccgaggccaatgcgctcagcgataagagcctgagtgaaagtttcaacctgggagacggccacctggagcagtttcgcaagccgggagtgctggtgatccacaacgacgaagagggcggcgtggaagatgtgaagtcgcatgtgtcccgcgacgtggagcgcccagggctgacgctggtgccggaaaaagacaaaggcgcaggctgatggctttgatcgttcccacgctccgcgtgggaacgcatcccgtgacgctccgcgtcactgcaccagtcttgagatcggcgcaacctttggacgcggagcgtccggggcggcattcccacgcggagcgtgggaacgatcagcaaggcgcaggctgaggacctcctgaggtgagcagacttgtcgtggcgagcgggcttgccccgcgttgggtggcgaagccgcccctatcaggaccgctgcggtgtatcaggcaaaccgtgtagtgaggtttggggctgctgcgcagcccaacgcggggcaagcccgctcgccacagaaagcgctgcaccagactaatccgataaatgggatccaattcacaaaacagccgcgaacttttctccaatccccggtactaacctaactcgacacgtagttgatggccaactagtggcatttcatcagcgcttgatcgaatcgctatcaaaatagttgccgcttgtcggaataaagcttccagtgacaggctcaatcgctttttgataattatttgttgttatttatcaacggcttgcagatttaactagtactgatgtgcaactaatccaacttcttggatccgcactagttcgatgttagtttgccgccccttgattttcgatggatcgaacatgtcttcgttattgccacggactcggtatttgctgtgcacttttctgctcgcttgcttgagcctgaacagtgccaccgccgcccccacaccaggggatcaagacctgatccgtgaccggcaaaaccgcctgctcgaagagcaacaacggcgcctgcaagaactccaggacctgcccggtaaagaagccaagccccaggctccggccccgcccgcggacacgcgctgcttcccgatcaaagacatcgaactcaagggcgccgacagcctgccagcctcagaccgcgagcgcctgctcaagccctacatcggcaaatgcgtgggcgtttcgcagctcaatgagttgctcaaggtcatcaccgactactacatcaccaagggccgcgtcaccagccgcgcctacctgccgcaacaagacctctccaccggccatctgcaagtgctggtggtggaaggcaaactcgaagccttgaaaagcgccgaaggcagcacggtgacggaccgcgaactggccatggcctttcccggcaaggtcggcgaggcgctgaacctgcgtgaagtcgagcaactggtggaccaattgaaccgtttgccctccaaacaggcgcaaatggaactgacccccggccaacagatcggcggcagcgacgtggtggtcaagaacaccgcgcaaaagccctggcgcgccagcctgtcgcgcaataacgatgggcaaaaaagcaccggcgaacagcagtggggcgccggccttgagtgggacagcccgcttggcctggccgaccaattgatgctgcgtggcggccacgacgccgtcagcgaccaccagaaaacctcgaaaaacagcatgctctactacaacgtgccgtggggctggtggaacttcagctacacctacagcgagagtgattaccgcacgtatggcgtgaccgacggcttcaaattcaagcagaacggcgacaacgaaaaccatcagtttcgcgccgagcgagtgatccaccgtgacgacgtgagcaagacgtcggtcaacgtcggcgtggcgcatttgcgcaccaacaactacatcctcgacatccgcaccgagcccagcagcaaccgcctcagcgagctgcaatggggcatcaaccacggccggcgcatcggcaatgcgttcgtcaacgtcgacctgggcatgcaaaacggcatcggcgcgttcgatgcccaagccaacaacgagcgcgacgcctacggcaaccgactgccgagtgcgcgctaccgcaaatacaccgccaccgtcagctacctgcagccgttcagcctgtggggcgagtcgttcagtttctccagcctggccaccggccaacgcagcgaagacatcctgttcagcccccagcgcatgagtctgggcggctcggcttcggtgcgcggtttcaaagaccagcaactcaccggcgacagcggcggttactggcgcaacgacgtgcgctgggcgcgcccggtgacctgggactggatgcgcccggcctttgccgaatacggcgccagcgtcggctacgaccaaggcgtgatcagcaatggccgttacaacggtgaagtgcacggccgggtctcaagcaactcgttggagttgttcgcccgcggcaaatacgtcagcaccagcgtgacctttgcgcattctctggaacgcccggcagtgatgagcgagcgcgaagcgccgatctacttccgcatggatttcttcctgtaattcaacgccccgttacatcgagactatgacaatggatgttcgccactttgccttcctggcccgccaaccttctgctgcgctgaagccgcgagactcgttcttcggcttgcccaagcgcggcctggtgctgatcctggccaacgcgctgttctggcagccgttgctggcccaggccgaaggtattgtggtcagcgcgccgggcaccaccgtcggccaggccggcaatggcgtgcccgtggtgaacatcgccacgcccaatggcagtggcttgtcgcataaccaattcaaggactacaacgtcggccccaacggcgtgatcctcaacaacgccacgggtgcggtgaccaacacccagctgggcggctacatcgtcggcaaccccaacctcaagggcggcgcggccaacgttatcctcaacgaagtcaacggcggcagccccagccagttgcgcggtttcaccgaagtggcgggccagtcggccaaagtcatcgtcgccaacccttacggcatcacctgcagcggttgcggcttcatcaacacccccaatgccacgctgaccaccggcaagcccatccttgaccagaatggccgcctggagcgctaccaggtcgatggcggcgccgtgaccatcgacggccagggcctgaacgcgagtaacgtcgaccgcttcgaaatcatcacccgctcggccaagatcaatgcgcagatcaacgcgcgcgaattgaccgtgatcgccgggcgcaacgacgtcgatgcccaaagcctgaaagccaccgcgcgcgccgacgacggcagcgccaagccggagctggctatcgactcctcggcgttgggcggcatgtacgccggcgcgatcaaactggtcggcaccgaagccggtgtgggcgtgaagctcgacggcacgctggccgccagcggcggcgatatccagctggatgccaatggccacttgagcatggcgcagacgtcggccaccggtaacatcaaagtcaccgcgcaaaacgtcaacctcaccgacaaggtctacgccaccggcaatgtacaggtcaccagcgcccaagccttggtcaaccagcagagcgtggccgccggccagcgcatcgaactcaacgcggccagcatcaccaaccccggcatcatcgaagcgggcgtcgcggcggataacagccgcaacgccaccggcgacctggtggtgaacacgcaaaacctcaccaccaccggcaacctgctggccagccgcgccttggcgatcaccgccgcgcaaacgctgaccaaccagggcgcaatcattcaggccaaaaccgtcagcgtcagcaccgacaagctgaccaacagaggcgccaccgcccgtgtgtacggcgagcaacagctggcgctcaacgcgccggccatcgtcaacgtcggcgggctgattcgcttcggcgaaggccaggccgcgaccctcgacagcgcgtccctggacaaccgccaaggccgcatcgaaatgtccggcggcagcctggtgttgaccagcaccgacctgaacaacaacagcggccaaatcatcgccagcaacctgaccgtgaatgcgggcaacctgaataaccagaacggtgtgctggtcgccggcgcgctcacggtgaatgccggcgacctcgacaacagcctcaaaggcctgatccaggccgataacggcgcgctgaacctcaccgtcgccaatgccttcaacaactaccagggttacgcccaggccagtaccgacctgaacctccacgccggcagcgtcagcagcaacgccaacggcgtgttgagtgccaacaccggcaagttgaccctcgccaccgcccaacaactcaacaacgcccagggccgcttgcaggccgggcagggcgatgtcgagctgcacgccgcgaacctggataaccaaaacggcgtgatcgtcggcaaacagctgctgcttgatgtgagtggcggcaacatcgacaaccgcgccgggcgtgtggtgggtgactacctcgacgtgcgtgcctcgggcctcgacaaccgcaacgccggcctgctggccggtggcgcgccgggtgtgagcctgctgctcaaggggccgggcctgttgctcaacgcccaaggccgtatccaaagcgaaggcctgttgcagctgcaaggcgagcgcctggacaacagcgccggcatcctgatcggcacatcggttgacgtcactgcgcagaccctcaacaacagcaaccaaggctcgctggtcagcaacggcggcgacgtgacactgaacgtcagcgacctgctgaccaacgcgggcggtgtgatcgacgcgggcgaacgcagcgtgctggtcaaagccctcaccaccctgaacaacagcggcggcaccctgcgcggcaagcgcctggacatcgcggcccagcacctgaacaacgacgccggccaactgctggccggcaaccagggcctgagctacagcggccaggatgtgagcaaccgcaaaggcttgatcctcagcggcggcgcccacactcagctcgacaccgccagcctggataacctcggcggcaccgtgcagggcgataccctgaccgtcacggccaacacggtcgacaacagcagcggcggcttgatggccagcctgctcggcaacctgcaattgaccgtcgaagccctggccaaccgcggcggcaaactgttcggtaaagaacaggtgacgatcaccggcgccacgctcgacaacagtggcaatggccagatcagcggcaatcagctcagtttcacctcacgcgacaccctcaccaaccgaggcggtctgatcgaagccaaccagggcctgaccctcaatggcggcaacctcgacaacagcgcaggcgggcaactgcgcgcactgggcggtgccaacagcagcctcaacctcagcagcacgctgaacaaccaaaacggcaccctcgaattcggcagcaccgccttcagcctcgacaccacgcacctgaacaaccagagcggccagttgcagcacgccggcaacggcctgttccgcctcaacaccgccagcctcaccggcagccagggcaccatcaatggcctgggcaccgccgactgggcgttcggcagcgtagacggcctgggccgcgtgcaactcaatgaagccctcacctataaaagcacccaaggcctggccctcaaggccggcgaccgcatggccagcagcaagggcttgatcatcgacgtggccagcctcgacaacggcggcgagctgctcagcgacggcgacctgagcatcacgctcagcggtgacctggccaacagcggccgcattgccacccagcaaaacctcagcgtcacggccaacagcctcagccagaacggcgggcgcctggcgggcaacaacacccagatcaaactggcgggcaccctcgacagccttggtttcctgacggcgcgtcagcagctggacattgccgcggcacaaatcggcaaccgtggcacgatgggcgcccagggcgcggtgaacctcactgccgtcaacggcatcaccaacggcgccgattcgctgctgttcagcggtggcgacctgaccctgcgcgccaatggcttcgccaacagctatggcgacgtctacagcaaaggcaactttacgtttgcaggcgtcgatggcgggcgtgcggtgctgttcagcaaccgctccggcacggtggaaagcgaaggctacatcggcatcagcgccggctttatcgaaaacgccaaagacaagttcgagttggggcaaaccctccagaccggcagcttgagctgggtgtgcgggcagcactgcggcgagaaggacagctggcgtcgtggcgaaatcaccatcaacgagacttaccttgagtcggcgattcaggattcggcttcggcgcggctggtggctggcaaagacatgctgctgcaaggcgacacggtgcagaaccgcaacagcctgatggccgctaacggtaacttgagcatcaccgcccaggatttgctcaacgaaggctccggcacgcgcaccgggcaacgcaaaatcgtgatcaacacccccgggcatgtagacaagcacctgtgggagcgcatggaatacgtcgatgtgccgaccttcaacaacgcgacggcggccggtaattttgaccaggcgaaatttgaagccctcaaagcgctgtcacccaacagcgcaccgttccggcaaacgagcgacgtcaccacctggacccccaacggtggcctcgcctacgacgccgtcctgcaggccggcggcaccgtcgacctgtccaacgtcaccaacaaaattcaaaacggtacgctgcacgacaacaccctggcgcaattgaccggcaccctcggcaacgaccagaccggcatccccgtcggcggcatcaatatcaacctcagcaagcacgtcaacgacgccagcgcccaggcgcccggcagcgtgttgcctgtggttacgctcactccgggcggcggcttcgtgcccgtggactacaccggcacgccgttcgccccggtcgacccgaccacttcgccgtacttccaactgcccaagggcgactatggcctgttcgtcaaaagtgccgaccccaccagccactacctgatcgaaaccaaccccgagttcaccagcgcatcgggcttcttcagctccgactacatgctcggcaaacttggcttcaattccgacaacgcctggcgccgcctcggcgatggccaatacgaaacccgcctgatccgtgacgcggtaatcgcgcaaaccggccagcgcttcctcgccggtggcttgctcagcgacgccgaccaattccgctacctgatggacaacgctctggccagcaaagacgccctgcgcctgagcgtcggcgtgacgctcaccagccagcaagtcggcgccctgacccacgacatcgtgtggatggaaaaccgcgtggtcgacggccagaccgtactcgtgccggtgctctacctggcccaggccgaatcgcgcaacgtgcgcggcaacagcctgatccagggccgtgacctcaacctggtcaccggtggcgacctggtcaacgtcggcaccctgcgtgccagcaacaacctctccgccgtcagcagcggcagcatttacaacggcggcctgatggaagccggcaacaacctgagcctgctggcccaggacagtattcgcaacgccatgggcggcgaaattcggggcagccaagtcagccttgccagcatcaaaggcgacatcaccaacgacaacactgcgatccaagtgcgtgaaggcgtgggcatgcgcaccctcaccgacgccagcgcgagcaccatcaccgcgcgtggcaacctggccattgacgccgggcgcgacctcaacaaccacggcgcactggtcgccggcaacgacgccaccctcaccgccggccgcgacctcaacctggtcgccgccagcgacaccagcgtgatccacaaaaccatcgacggcggcgaaaaatccaccatcaccaccgacgtcaaaaacctcgccgccaccgtcacggcaggcggcaacctcaacatgcaggccgggcaagacgtcaacatcatcggcagcaacgccaccgccggcaaagacctgaacatccaggccgggcgcgacctcaacgtcgcctccgtcagcgacatgcacaacgtcgaaggcaaagagaaagacggcaaaaaacgcatcaagacagcggatgagcagaccacgcaagtggccagcgtactaacggcgggcgcgaactttaccagccaggccgggcgcgatacgacgctggtggcgagcaagatcagtgcgggcaatgaagcgtatctgtacagcggcgataagttgaacctgctggcggcgcaaaacagcacgcataccttgtatgacatgaaggagaacggtgggtggggcgcgaaaaaagccaagcgcgacgaagtcacccaaaccacgaacgtcggcactgagatcaagaccgcaggcaacctgaccctggtcagcaacggcgaccagctgtaccaggtcgccaagctcaacagcggcaacgacctgatcctgaaaagcggcggcgccgtgacgtttgaaggcgtgaaggactatcacgacgagagccataccaagagcaagagcgacatggcttggttctcgatgaagggcaaaggcaaaaccgatgaaaccctgcgccagagcgaactggttgcaaaagggcagaccgtcatcgaggccgtcaatggcctgaaaatcgacgtcaagcaagtcgaccagcaaaccgtcagccagaccatcgacaccatggtcaaggccgacccgcaactggcctggatcaaagaagccgagaagcgcggcgacgtggattggcgccaggtaaaagagctgcatgactccttcaagtacagcaactcgggcatgggccagggggccatgctggcggtcatcatcatcgtcactatcgtgacggcaggtggcgcgagcgcattggcagcgtcagcgggtagtgcggtaggcgccggttctaccatggccgccggcacagctgcggttgcggcgaccagtacgtcggcggccgtagcagccaccagtgccgggcttggcaacatgatggccaccgccgcactgacctcgctggccagtaccggtgctgtgagcaccatcaataacaaaggcaacctcggccttgcgctaaaggacaccttcagcagcagcagcttgaaaaacgccgccatcgccgggctggcaaccggggcgttgaactacgcagacagcaattggttcaagggcgcaagcccggccgagggtgcgggggcgaaagtcaccacggcggggccggtacagaacccgggctattccagtgattggctcagctggcagaaaacgcaggatgcggtgctgcgcggcggcacgcatgcggtgatcgaaagtggcatctccaccgccatcaacggcggcagcttgaaagacaacctcggctcggccttggtgtcgcaaggtttcgaccttgctgcggcggccggcaacaatggcattggcaacctcgcgagcgagctggacctgagccctggctcgacgcagaaggtcttgctgcatgcgctcctcggtggcgcgctttcagcggcccgaggcggcgacttcaagaccggcgccatcgccgccggtgcggctgaaggtttgacggcgattgcgaacaaaaacctcggtaagtatctggatgagcgcttcgtcaccgatgatcaattcagagtcgccaccgcgcaactcatcggtattgccgccgggtctctggttaacggcaacccgaatgacgccgcgtgggtagcgggcaatgttgagcggtacaacgagcagctgcacccagatgcgcctgagctgattgaaaagcaagcacccgtgctggcggaacagaagaagatcagcgttgaggaagccacgcgcctgatgggcgttgctttggcgtacaacaccgatgagggctggagcaagtcaatctcgcaaaaagacgtagacgctatcgacacgcttactttgcagaatctgggcattgcgcttgcgcctattgcaaaccaatacgcccgaactgacgcctctgcagacgggcgctcgagtgggtacagcggtaatgaaacagcggccttgattcttgatttccgcacgactcggcctacggctttcaaagacagcactatcaacatcgactacctgggtgatccgaaagggcgcaacacccaagggttggtggatttctacgagactaacctggattacagcggcaaaccgactgactacgtcgaccttgccaaaggcctggcggtaggggctggccgcagtatttgggggcaagtgcaaggcttttccaaggttgccggtgggtttttaggtaatagcagcccactggaagtgaccgacgccctgttggggccgattgccgacccctcggtggaccgcggcggccaaattatcaccaggcagaagggcagggaatttgtctcgaacttgcaaggcaacagctatgagtcagcggcgcaagtcactgagttgttgactgatggtttatccatgatcacgccttccggccgatttgggcaggtttccaagtttggcgaggtttcaagcgtcgtcagggccgacggcgcacttgtggcccgtagcgacgtcggtttggccagcgtggggcgccaggaagcgcttggcagcagcggcatcgcacgcgttgcggatgacatccccaactatggcctgaaccccaacagcctggactcggccgtacgcttcgagcgcccaggcgccactgcgacagccccgaccacctcgattgggaaatacgagcaaaccgtctacaccggtgatgtgggcagcttcgccagggccgatgacctgttcgccacccgacgcaatgacattgttctctcgaactacaaagagccttgctgcttcgcggccggcactaaagtctcgacccccaacggcgaccgcactatcgagtcgctcaaagtcggcgacgtggtctggagcaaacccgaaaaaggcggcaaacccttcgccgctaaaattctggccacccatcaacgctctgaccaaccgatttaccgcctcaagctgaaaagcgttcgcgccgacggcaaagcgcaaggtgaaacgctactggtcacccccggccacccgttctatgtaccggccaagcgcgactttatctctgtaatcgatctgaagccgggggacctgctgcaatccctggcagatggcgatacggacaacacgtcatctgaggttgagtcgctggagctttacctgccagtgggcaagacgtacaacctgacggttgatgtggggcatacgttctacgttggggatctgaagacctgggtgcacaatacggggccgtgtgcgctgccgccggacttttatggtaaaaaagatcgcgttagcaccgttaacaacgtgactgaaggcgaagttggtaattatgggtctactgcacctcgtagcgtgggtgatggtctcacaccagaccatattccttcgtttgcagctgtaaaagagtcgttacgccaaatgggggttgtgttgtcggacgctgaattgaaagctctgcgtaataacactaattgtgtggtcgtgaagacctgtagtcacatgacagactcacgaaccttcggcggaagaaataatccagaaaaaattaaattagatggcgccgatttatataaggccgccgaggcagacataaatacatgggtgcctgtctggaaaagtgaaggttggtcagccagtaaaattgacggcacgcgaaaccagattcatgaattgaataaaaaattatttgatgggatgggtattaagtatgaatccaaatgattatttaggcggatcattgattgaggctttagcgaactttaggaagtcaatgccgatggttgattacgctaaagttgaagatgatgagtttttaaagttgccagaatgcggtatctactttcaatccggtggcgacggagttattgcggcttacagagtttattatcaggccacggaggagtattttcaggctgactccgaaacaaaaagggagtgtctagatattgagactgtcgacgattcaatcaatcttcttgggcagcctgtgcgggatgtaccctccatacgtattcccggaagagcacctacaagtcctgggtgtgagttttcattaaaacagaaagtgatgaccgttcattatgatgcggaaagtcggtttgttacttatgtgcatgtaagaaataaagctggaagtgtgcaaggaatgtagtgaaagttaaaatggggtgacgcacagttttttgggctaggattagcaaagaatgcgggcagactatattaaatagaagtgtttttattatttaaataaatttgcccattgttcagtttgtcgtggcacagaaaaactgagaatgagtttgactagccaaggttacgactcgggcttgtggatgaaagcattcaaaaatcgttcaatgaaatcatgaggctgggatcgagtaatgaacatgtggtcagattttgttcaggctctcggtcaagatgagggtgggccaatggtgaaggagttatgccttaaagttggtgagccgccggaaatttcagagacgccggatagctataatgatccgctgggaaagacgcggtattataaatttttcaaatcaggtatggagtttgggttttgttcagggaagttgaatcacattcatttttttgtgcaggggcatgaagggtattcagcttgcaaggcggatgtacttaatcgaaaggctcaagcatggaatgctcaagatattatttgcgagttaggccctgctgataattctgcaccaggcagactcgatatgttaattggttatgttcaacagtggtttaagtatgattttgagacgtatgctctacgcttggaattttccgagggtggagagatgtggaaggcaacactgatatcaaattgatcaagtgtaaagttggccaagtttatataaggagaaatagggcgcagaccgattttttgggcttatcaggacgcccgaaaaagtgtgagtaaaacgaatagagagaatagtggtctgacccctatttcccggaaggcagtgccaccggtattgcagcctggcagaagcattgaatgaggtcagtatgattgttcaagagacggggcgagagcctgtaacggtgtatggtatctactggattgagggtgaacggttttactgggtgattccctatggggggtacggggggctaatgtcgcttagccataaagatatttcagtgattgacggttccttatcaaatgatttgtttttctataaggacggtgatgggcgagacatgatattacattgggctgcggaagatattcttgatgatttggttgattgtaatccggttgctatgacggattttatgagtcgtttggacgtctgaaattgccccagtgctgccggctggatcggcaggcgtcggcggtgtttatagagtacgcacgcaatgtaatatcgctgtgagccgtaaaaaaattgggtggctaatcatgccgcagtggttgcagttgttttgaacgagaggttacatgatagccgctcaaatggcatggatacgactgatacagccgctcaaaaaattaatgatgctgccgtcattgatggatttacgagtgcaagagaaataggaggcagaccacttttttaggtgtatcaggacgcccaaaaaagtgtgagtaaagcgaatagagaaaatggttgtttgacccctatttcccccgccgggaactgacgcggcgagaggagaacatatacgagttatgccgcctggttcatcagctgttcccggttacgagagtggctattggcgttggcaaaacgctgggaagcagccgatgaaccctgcgactgggaagccgggtatcggcccgggagacacacatatccctcttgcacccgtttctttaccgcccgttcgtcgctgaggttatggattaaattagggtgatatatgagtatgttgtcagatgattttgattttttactgatgtccggctgttatttggaaatgatttcttttggagtccgtatgaccaggctagacttttcaaggccgcagactttccctggtgtatctccatataaagtttctttctgcgtagaagctggattgaagtatcgaattggaaatgtcgttggtcaacgtaattttgctgactcgtcaaccagtgcgcgcttgttagactttttgttaatggacgttcagtcggttgaggaagttaagcctgctacgctacagataacattttgcacgggagataaaattttagtcgagcctgacgatacaggtgattacgaattttactcaatttatcttgattccggtgacgtgatcgtaatatgacgctggagataaggtggaagcataatgagcggttttatttattttcagaaattgcgttggtggcgataagttaaataaatttattgcgggctgaaaatggtataggcttctatgactaagtacaaacttgagtttcgtcacagacccctattttcagagcctattgaaggtaggcacagtcgctttctggaaaagttgtccagcttaggttcgccatgggatttggctggtattcctgaagctcctgatagtgggatcgagcttattgtctctgtctcgttagacaaggtgctcccgtcgggcgtgaaggggcgagtgtcatatgcgctccggagtgagaaatatttagaagatgacgctcaatttgatgacacgctctttgttgagttctcaagcaataaagttgattactcagatttattgaaaagagttttccctaggtatgtagaggcttttggcgcctacagggcggcgctgcatgattggtctattacgagaggcgattggcccgaagttgtggctgcctgcgatgctacccagaaagatattaatggtagagacggtgtttttcgtataaatgcggctaatttttttgatggaaaattgtgccttcgcgcctttggaaaaagtccgcaacagctcgttgactgcttaaaggggcacgttgaagaagtttccgagtttgcggggggcgtattgattgtcgttagttatactccgctgtcctccaacgaaataatgagcgcgggtgaacgattaaaggcgctactgggtgagtaacgtttttcactaacgccgcaggggctcaggctgagaggcaggcgtcgctgaggaaagagttgtttaacacctgaactatgagcgagaagcagcggatttatttgagtgcttaagttctttgcgacttgaatgaatctgccacctttatattcctcttagcgactcgttcacagggcgaagccctcaaccattaaacaaggaagttcaatgggcatcccactccccttctggctcatcatcacagccgtcacggcttacgttgcaagtacgcgcgggcgctcagggccccggtggtttgcaatctcgctctttctttcctgtgttgccctggttgccgtgttattaatgccccggctggcgaagaccggtgttgatgcgctggtgcacccggacctgcggccttgcccagcatgcaaccaatccatccaggcggcggcctctcgctgtaagcactgcggggcgcaagtggagccgattgctttgagagatcgcagcggttgggtcgctcgcatgaccgtcgatactactcaaattcctgaagtctgaacatggcttggacgggctggtgacgtggcggacggtgatgcgataactcgaagtagacccgcttcctcttatctgcgtaaatgatcatgaagaacaaagaagtgttagtcgttgattgtatttgcgggaagtagtgggtaagcgacggtttgcaaagatggaggtgtattaagattggagaaataagggggcagaccacttttttgggtgtatcaggacgcccaaaaaagtgtgagtaaaacgaatagagaaaatggtggtctgatccctatttcccgactcctatttccctgcccgccatgagaggtgtggagcaccaaggtgatattcacagggttcaagggccagcggaaaaaatacttggtaagtgattatggaaaataaagaagagttaaaagcgttggttgaagctgtaatgtactcaaaagagtacgagggcaattacggctatcgcataacatgcacgagtgcgatgttaaaaaatgttgatgaatcagatcgacagcaggccccggctgactatctggagtttcttactgagtttggtttcggcgaattagatgcggcatttcatctcgatgatggcccggagaagtattccactgtatgtggtcgggaagttgagggttatgagggattttatgtgttcggtgggaattcgagtgatgtgctatatgctttcgacgcaaaaaataattggcagatcgtagagattagctctgagttggatgaggttgatgtgttagcgtcaagtttttctgattttatcttaggacggttgaagcacgtcaagtcgttagttgaaagacgcgcagcgggctgattggcagcgttgcatttttaggggtacaaaagcaactccatccggtttggtttctggagaaactggagttgtaggaactggtaaagctgcggcttatgatgcaagtttgacagcaacatccacatcaggatggacgagcatctcgattgacgctcgcgcggtggtccgggacgtcgagtaccattcaggtgtgccgatgccctctaaccagcgcacgcaactcgtagaggagttgcgtcaggtggatcacacttatgtcgcgcccagaagcgactatcaagccttacagcgtgaatacaatagccagcgaaataatctcaagcgtgagtgggagttgaatactggtttgacatagcccaagacggagagtggtgtggatttccaagcgcaccatgtgataccacagcagtatggtggacctaaccaatggtggaatttgcatccggtgccgggtgggagtgctcaccaaggtggcgttcatgccccagcaagtccaacaactacagcatttgcgcagaaacctccgaggcgtccatgaccatgtacgaaaaattagaggccttcaatgcactcgcatgcgtgctattagagcggctgaaccctatttcttctggtgacgtgagtgggatgcgacagcagtggccagcggctcccgatgagtattttgcttttatgcaggagcgggggcatggtgagataaaggaggacgaccgcgcgttgtcgattttgacgattcaacccacattatgtcccgcggcagactactttgatgatgatgggttttataaggacggaccctatgaatcgggtgctaagggcgaggtgtggctgttcggttgggatagcaccgggactgctttcggtttcgacagtggagacaactggcgattgttggaaatcgacaatatgcgttggataacgcgacttgacttgtcgtttcgtcagttcatcgaaggggtgttggtatgttatccacagcggccgataagctttgcgaatggagtttggcgcgactcgggagatatttcttacaccctatcggattaggcataaaagcttgctgagcctaaaaaagtggaaagggcgcgcatttatctggtgcaaaagccacagcaggtgctagccaacctatcaacctgttggaggaaagggcggcataccacccaattagtggattagtgggtgatcgtggttcacttgcagaagttggttctgttttccatagccagaataacagtgttcttcatgtcccatctaatgccgctcaaagctttaggtatactcgtttcaaaggcgctgcagaatacagaaatcctgcggctgactatgtttcagttcttacggatttgaatgcaaaaaatttgacgaaacaggctaaagagtttaattcttatcagtcggattgttggagattacgggctcgaagcggggagtcattaaacgtggattattcaagaataattgatcttattaaagaatcggatttcgttgaatttgctgattatggggacggtattgctgatgagtggatttataaagctgaaactcgtcttgcgttgaaattgcctgatagctataaatggtggttgaagtgttattctggcggggaaatatcgggggaggagatttatagtatttacgaaatggattttgatagtgtatgtggtggtgatatcgtttatatgtcaatcgttaacggtcgaaatgggttgtgtgggaaggataggctatttatctgtgagccgccgggtgcgggggagtcattttatttcgccacaggcgatggtcttaatgatggggagtatactgtttataggcttgatctttctaataaaacttctagtttgtatgcgaaaaattttatcgagctcttagaaaaaagaataatttctttcagttgaataatgattgtgcgatgaaaaatgtttgagaaaggcctagtccaaaagcgacaggagaataaataaaacgctaaaacgggttcaggccacgattttatgaatatgattttagacttggctctttgataaattattatttgtttttttttcgaaaaaagatacgggttcttacgtttcgagatttaccgtgtaaatagaactgtgtaatcgtagtctgacccctatttacaccgactcaggtggagattgaaggggcgttccaaaattccacgcccatgccgggtgcatctaagtggcagggaacctctccaagtgggttgaagatagaaggtgattacggcaagccgaacggtcctggcacaacagcttggccggtctatcaagggataaattgatcagtatggctaacggtaaaatttattttgtaaggtcctctaaattcaatcgtttagaggtcttggccacggagccaaacgcggacccgcggatatcttcaccgcagagtgtgggcgttagagaaattgcagcttggttatctgatgatgtgaatagccatttgtcagcaattggatgggttgcgcgtttggaagctttggaaagtgcagagtcaaaaggatatttaggaactggtaacgcccatacggtgggggtcgctggggaatacatatttttagagtgcgagtttgaagaagatttaaaggtgctggtgcataagagtcatgttgtctcattgctgaaattttacatcgccactcacgaagaacatatttcaagtacttgttatgatgtggaatatgtactagagggtgagcctgctttaaatcgttaccttgaatggggagggcgattaggtctctccgatacggaaatagctgaaaatgcccggaaaattaatcgtcataaaaaagaaagcgggtaggcgtccaaggccttaggagagagtgagattggctgatctttttcgctatctatattttaagttcgctgaattgtattaacgatcaaaatatgtaagttgattgggtacgtacctcactgggagcattctgacgcctatgaatatgcactatacggcattgcggtcggtcgaggatttgaaccctacgatatgccggtatcctcagatgaagcgcttgccaatcttgatgcattgccagaggctaaaagagtgtttgttgaggtatttgactttattagtctttgattgagggaaaagttagattgagaattcgcaggagcaaagggggcgaagaaatagggaaatagggggcagcccccattttacaattgcttactcgccttgggcaaatgagttgtccgagggttggcgggacgtccgaagacaattgtttgttagccgtgtaatcgtagtctgacttcctatttacccggccagatacgttggattttacttatacaattgatggggcgcgtcaaactgctcgctttgaaaatgaaactcgctaaattccggagcataaaaaatgattactgaagatatagaaattgttaaaaaaatttttgagctgattcagtcgggaattgttgagggttatgacgccttcaggtacgaagctgaagtatgtgaaggctatatggttgaagaaatctccattgaaaaaaatgggatattaaatgaaagtccaaaaacggattttaatggggcaatattgtatcggctcgtcaatgaattgaaagctagtgctgcttcgcgcggtgaaaactggcgttcatttgtgatgagttacactgtcggtggtcaggtgaagacaaattttgtttatccgtgagagaaatagagagaaataggggacagaccacgtttttgggtgcatcaggacccccaaagtgggagtaaaacgaatagagaaaatagtggcctgatacctattttccatggcctgctacgcgacatgtggatgcgcatatgcctggtgggtttagatataattcaggtggccctggatcatcccttccggcataccccccgaaaaaaggaactgagtaatgcattccttacagccagagtacgcgaagcaaaggttgattttttatgttgcacaggatttggagcaggttattaagatcgatgtgcagcagcttgttagtgagctttccacatcaagggattggagtgtgtcgcctccaaactatattgaagaaatagatgcagggggtttagaagtcgtaggcggagtgttggaaatttattcggcgttagggccgagtacgcttcctgtcgaattggattcaaggagcctggatgatgtggaggcattgattgtcgctgtgagagttttatctgaagtgatgagtctttcttttgagtttcaattggacgctacatatgttggctgtattgatgatggaatcatcgaccgagttctttatgagggtttgcttgttccatggagagagaatctccagcggagaacgtgagaagatggtggttttacccctatttcctcgcaaagatgaaggtgaattagtgatgatgcacaccacagcctatacgccagtgaccacagcgtttgcgtctatgaccacgaaagaactcgatgatttctacgagtggtttatgcttaacaaaccctactgcttagatgatttgattcaagctgtttggcagacgcctgggtatgaggattggcgtgcagatttctccccggagtctctgggtctattagcagagtggttggcttctcaaatgaccaagaccaaccggtcgtcgaaaggcagcacactcgcagaggactcaatggccagtgcggcgggcgatgaggcacctgatatatccgatgaagaaaagtctttaactgttttggtcggtatgtattacggtgaggtcgccgttagaaataatgcgcgacttacgtggtcgcagttgaagggtaataagaagcaagcggattatggccagcctgttatatctgcttccggtacactcccgaccaatccggtgcgtgttattaatgcatttgcgtgcggccttgctgacggctcacgaacaagcgggcggcttcgagaaacctatgattattggatggagttgataaagcacgagggataggattcaggccgcgtgttgcaatatctctattttaaaatagatccgcttcccttatcgcaacagctataaaacgaacggaagggaataaatgtctatcaacaaagactgggttcctgggtttggcgagattgtcacgtggttcgccatggacaaggctggcgcaatcgccgtgatggtgaataactgctttggccgtttgccggccgtgttgttagcgctgcctgatgtagagtcgaagttggatcgattgagcgaatacctgtgggaggaatctaccgagttcgatacctaccctgagagcaaacaaggtgaaacgatacttggcctgtattccgctcgcacctatcggcaccttgctcgaagagcagacgtagaagcattgataggtgagcactcgtcagcggagttggcgttgacggaatataacgtgccgtcggtcaaagggttctatgtttaccatggggttgaaggcagcgtgcccaatgaagattacccggtgggctatgaggggcagagccagataggggattatttcaggtatttgctgcccactatcacggcgagcattgaggatataccggcgccactcagagggtgcatcgcggtgtgtgagtcgtttgaattttctgaacggtctttttggtccagcgattgggttgatgcgtattttcgtaggttgtatgggtgacgttgcgcgtatcagttgggcggcgccagggccgcccggtttctactcaggatgggtcggcatggagcctgcgcatgatgacatcaagcaaatcacacccgtcacgcagcggaatggccagcaattgggcgaagtcttgaagcaccacagcatcgctgctgagctgttcgcgaaaggccaggttttccagcagttgggtgacggctcgaatccggtacacggcggcgtcgtggaggacgtcgaggggcgcacaggtatcgatgagcagagcggggacggtgctgtcgtggcccgtaaggggcaggtattggttcatttgaaatctcggtcagtaaagtgaagccgtctcctttcgtcgccaaacgaatgggtgacagctgtacgcaggttggcgaaccgggaccgagttccggcagacccgaaggtctcccgcgcacagctgccataaagcagcaatgcgggtacggaagcccctgcaagcaagcagaaagctttcgcacacggtcgtcgggtcgccaaacccgatcgcccttgttgggcgacgggccggactataagccccccacccaaacccacgcaaggcatcaaagtactggcccacgcacaccgcctaatgtcttcagactcatggccgacacattggcatgattaaacgcaccgaggtaccggcccttacaatcgctgcccgtacctcaccaaaaacattaaaggactgatgtgaaaaaccttctactgattctgctttccaccctcatcctcggcggctgcgtcagccagcccctcacgcccgaacaccgtgcgcaggtcaaaacggtcaaggttttgcccgtgaagtggcaaaagaacatggtctacatgggccgtgaacaagcctggggcgcggcactgggcgccgggcttggcgcgggcgtcggcatggccagcggcgcgggcaagctgggcacggcggctttgagcggcgcggggtttgccggtggcatgaaggttgggcaactggccgagatgtcgacgcctgcggcgatcctcacggtgatggacgccgaaaacatcgacttgggtgtgttgctcaagcagggctttatcgatgccctgggtaaaacctcatcgctcaaagtcgtgggtgacgatgagccggccgacgcgcaaattgagctcacggtgggcgagtggggctttcgcctgacccagggtttcagcagcgtggtgtacccgacgctcacggtggtggcgcgcatggaccgtggcgacgagatgctctggcgcacggtggagacggtcacgccgttcaatggccagaatgtctacggctacacgccgctcacgtatcgcaccgaccctgaggcgttgcgccgcgcactcacgggtattacgcagatcaccagtgggtatctggtgaaagaactcaagtaagcctgcgagtgcgttaatgctggcctgctctctattttctgattacacggatgcatcccatgaacaaggcaatggttgtattggcaatcgcgggtttcgtcgcaggctgtcaagcctccgcaccacccagctcctttgaacagagcctggccaacgtccaatgcgtgctgtctgagggcgcaaaaagcctcacggtagaacaggtccaatccattcgtaacgcaagcgataacggcaacgtgcgctgcaagaccgcgctcggtggtttgtacgaaaccggtcgtggcggcgtaccgcaagattttgccaaggccaaatcgctctatgagtccgtcgccgccgtggatggcatcggttacgagaggctggcgcgtatggccgaggagggccacgggcaagcgcgtaacgacgtggaggcgcgccggctttatcagttggcgctgaccagcagcgacagcgataaaagcaagctcgccttggccaaattgatggaggagggtcgcggtggcccgcaggatttgttcggggccatgatgtattacgtggaggccagccagcacgccggcgatgtcgcgtggaagggcattcagcgcattcgcgctcaagggccggtgctgacgcctgaacagacgcagcgctacaacgacgtctgggcggataccagtcgcaagagcctgaatcgcacgacgatggacatcgagattgccttgaacaagcacgtccaacgcgccagcgtcagcaagccggtgacgctgcaagtgcaaggcaaatcgggttcgaatgtgccgcacatcgcattgatccaaagctcgggcaacgctgaggtagaccaggccgtaatcgccgcatttggtaaataccgcattcctgccgagccgctattgccggctggccaggattcctggtcgtctgagcggtctctcaaggtcggcctgtaatgggatggcggttagtgcagggaatttgcctgctgctgatgttcgtcagtgcaagcgtctctatgttggcgtgggcctacttcgacagctccaccgccggcgctttcggctcggcgctgggtgttttcctgatgggcgccattgggctgctgttcgcgtttgtgttcgagcgctcacgcacgccgcgggccacggcgcgctacctggcaacacgcttggccgtggtactggtgctggcagcgggcgcggcctacctggttgaagcgctgtggcttgcgcctgagcgcgacgagctcgacgcgaatctggagggcgcgacctgtggcaaatacaccggcactgtcgtgaaaggctgggagcagatttgcgccgagcagcgcgagcgagaagcgcgttgagcgctgcctttaccggcggcttccacttcatcatcaaggactgaacaatgaccgaaaacgttttcgccacccccactgccaatcttcaaactgctgcgcaggtcacgcctgagttttacgtcatcgccgagcgaaagctgtttattttgtcggtcctgagcttgggcctttatatgtatttctggtccttcaagcactggagcaactacaagaaggccacccaggccgacatctggccctgggcacgcgggctgctgtgtattttctttgtgcataagctgtaccggcgcgccgaccatcagattcgcatcacgggccgctcgtatatttttgattttgagcagtgggcgacgatgctggtggtgatcacggtggcggcgcatatcgtcgacagactgtctgatcacattgaaagcacggcagcggttgcggtctggctgtttatctcgatcccgctgcgcgcttacctgatgcaaaagggccaggcgatgctcaactttgcggccggtgatgccgacggctcgagcaatgcccgcttcaatgtctggaattacctgatcatggtgccgggcgcggcgctgtgggcgttgatgcttttcctcacattaagctagttcttttgacgggagataaacacggtatggatacgagtagccccgctgatcgaggcgataaataaaagtgcagccctttaacccgctgaacctgcccgatacgctgcaggcctgcgcgcacgggactatcagcgtgcctatctgcacactgcaagccccggcgctctggtacgtcttcccacccgcgctcacgccgatctggagtgacggctccggccccacttacatcggctactggaaacactggttcgtggaccgcgagccgtgcttcgtaaagctgtatgtcgactgccagtgcatgacctatgaaatcgccagaacccccgcgcagctgttggcggtgatcgcgatgatggcgatgagtgtggatgacggcatcaccccacagcttgagcagttcgccgacgcggtggggcttgattgcctggctgaactggatgcgctgtcgttgaaaagcggtgacgatcccaaagggtttgctgagctcgagttgttcagaacactgacgccactcgacagcgtgcccgacaacggtgcgccttatacgggggattttcctgacccggccaacgcgtccagggcgtggtggaacagcagttgctccttcgaagtggtgcatcgggacatgcacgtgccaccgggtgtggaactgcccgcctggtttgatccgcagcaggataaaaaagcgctgttcgaaggcttcctggctgccgagcgccttgattgcgcctggttgacgttgaactccacgggctggtcgattgcggatgccaggcgcgcgattgttcagttacaagtcaaggcgggtgatgaggcgtttgatcgggtggtcgccgcgtggctggcaatcgccagcaccgacgcgggcggctattgaggggtttgagccgcccgtcgacgaagtgagaaagcattgctcatgtatttgacggggttgccgatacgatagtggctcagggccatcacttcaaaggctcagcatttatggacagcgcagctgcgttaaaaaaccagctgccctagggagtactcaatgcgttttgctgcatggattttgctgggtgttgcgctgttacttgccggctgcaacaccacaccctacgaccgggcgacggtgtattacgaccgcgcgcagtacccctccgacctggtgaaagacttccccggcatcacggaccccattgttcaacatggccgttgcgccgtggtgatgaccacgcccaactccaatacgggcgcctattacttctgcacgtttgcgctcacggccaacgacctgtacgtgatgggctggaacggcaagaccatgaagtatgagtcgcttgccaacgtgaagttgtcggccctgaagaagatttcgatctggtcgttcttccgcgcacggcaggtgcaactcaccgaaagccagcgtctgttgggctttagcgtgaccattgatgacggtggctacgacgacggtgcagcgaccgagcggttgttcgaaaccctgaaaggcaaaggcatcaccgtggtggaaagcgaaggccagatcaagccgccgccggcgcccgcgccgatgtttattccgatcattattcccaagtagccctcaaacagccgtttcagtcagggcgagcactgtcactgtggcgagggagctagctcccgttgggcggcgaagccgccccaaaaaatgggactgctacgcagtccaacgggagcaagctccctcgccacggttaagcggttgcccgagcggggcatacaccttcctttctcaccgtagggatcaacagcgttatgaacgactcagtttcggcctccgccggctacgaccttgccagcccaggcaagcgccttttgggctacgtcatcgatatggccgtggtgtttgtcctgctgttcttgaagggtttgctggattacgtcgcggtgtatttttcttcagcaggcagcgccgtggtgtttcactacctgcacttcctgctgttttggctggcgctaggttacatgctgttctgcgatgccttgcccaatgggcaaagcctgggcaaacgtctgtgccgcacctctgtggtgggttacccgtaccccaccaactgcagcgtgttccaatcgtttttacgcaatgtgcccaaactgctgttcagcttgttggatggcctttttgtgttgttcggtatgcgccgccggttgggtgacatgctggcgaagacgattgttatcaacagcccgcctgctccacgcaccgaaaccgcttgagtacgttgggcaaccccgtaaaatgccgcggcacgagcaacatgccacctttcagggacgaataaagcaatgcgcgtttttgcctttctcttggccatctgcctgatggccggctgcgcctccaagccggattactacatttcaccggcgccggtcaccattcccaagactgccacttactggctcgacaccttcgacgttgacgttgtgggcaagaacgagcgctttctgccggatgccaaggttcgccagcaattgggcatcgacctgatcaatcgactgctccaggccaagcgctacgccaccagtaaggataaggccgactacctgctcgacgttgacgtgatctatacgcggcgcatccaggacacccaaggcggcttcatgaccgccatcgtcgacgacaacaccatcctcgccagtgtcgacttcaactattcggtcaagatcaagaaggccgatgccgagatactgcacttctcccaagctcgccaggggcttatgcctgggggttaccgcggcgactggcagaacatgaaaaccgtggccggtgtgctgaccaactccggcaactcgagcgtggagtccttttacaccggcgtgctgagccgttttatcgtcgatgatttacgcaatatcccgtcccgctagcgttacctgctgcaacggctgaactctcactctaggagcaccctgtgaaaacactgtccaaaatcctgctgtcgggcctcaccgccgcagcgctgctgaccgtggccggttgtgccacggagagcaaccgcgcgatgccggtggaacaagtcgccagcgccaacgtcgcttattccggcgtgcgcgtacccatcgccgtgggcaagttcgataaccgttcgagctacatgcgcggcatcttctccgacggcgttgaccgcctcggtggccaggccaagaccatcctgatcactcatctgcagcagaccaaccgcttcagcgtgctggaccgcgacaacatgggtgaaatctcccaggaagccgcgatcaaaggcaccgtgcagaagctcaagggcgctgactacgtggtgaccggtgatgtgaccgagttcggccgcaaagaaaccggcgaccgccagctgttcggcattcttggccgtggcaaaacccaagtggcttacgccaaagtcgcgttgaacatcgtcaacatcagcacttccgaagtggtgtattccactcagggcgccggtgaatacgccctgtccaaccgtgaagtggtcggcttcggcggcaccgccagctacgactccaccctcaatggcaaggtcctcgacctggccatgcgcgaagccatcaaccgcctcgtcgacggcatcaatgccggcgcctggaacccgcgcaactgatcagcagcacctcaaggagcagtacacggatgagcaaggcagttaagttggcgctgatgctgacagcaatcgcgacggtcgccgggtgccacacggcgccccaacccctgtatcagtgggaaagctaccagccgcaggtttacgagtacttcaagggcgagcccaaggaagcgcaggtcgaggcactggagcgcgacctgcaaaagatcaacgccagtggccgcaaagcgccgccgggttaccacgcgcacctgggcatgctgtacatgaccatgggcaaggatgaccagatggtgcaggaatttcgcaccgagaaggcgctgttccccgagtctgcttcctacatggactttctgctgaaaaacgccaagaccggagtggccactaaatgagcctgttaaaactcaccggcgccttgctggccctggcgttgctcggcggttgcgcagcgcccaagaccattgattacacggcctacaaacaggcgcggccgaagtcgatcctggtactgccgccgatcaatgaatcgccggaagtgcaggcgtcctacagcatggtgtcgcaagtcacctacccgttggccgaagccggctactacgtgctgccgattgccctggtggacgaaaccttccgccagaacggcctgaccactgccaacgatatccagggcgtggcgccggccaagctgcatgacatctttggcgcggacgcggcgctgtacatcaccgtgagtgagtacggcaccaagtacatgctgatctccagcgacacctcggtgacggcctcggccaagctggtcgacctgcgcaccggcaccaccttgtggaccggttcggcacgcgcatccagcgaggaaggcaataacaacggcggcggcctggtgggcatgctgatcacggcggcggtcaagcaggtgatcaacagttctaccgatgccgcgcacccgattgccggtatcaccagtgcgcgcctgctgtcggcagggcaacgcaccgggattctgtatgggccgcgtaacccgaagtacggcaccgactaaaccggctgcgcaaccgtgaacgagcgtttaccggcccttacaggttggtaaatgcttcgccggttgggtgctcgcgcttcgctgttagtgaaccatgatgtcctggggactgatcaattgcgtactttttattagaaagtccgtcgtacggttgccggtcaggtcgatggcgatgaaatagcgcccgctttgcgggttgtatttcactatcgtatcgcctatgcgcccggtaaatgcctcaacgagcttgaggcgtgtattggcttctttctccaccccgcgcagatcaatgctgtctatgccgctggtgaaatccgtcaataaccgagcattggaataggtcgaatcgcgggcgctgtcgaagatgaaaggcggttttgccacggctgtaccaacgcctgaggtctcgcgcgtcctgactttgccagcgctgtggggcaagaggtcacttggcctgacttgcccatgggtcttgataaacaggtcagccctgccattgccattcaggtcgatggccacggaacccatgccgcttcgttcgtcgtaagtgagcagcgcttcaccggctttaccgctccaggcacgaacgacagacagggaatacaggcccgcactgcgcaacgcacccgtcacgtcgatcttgtcgctgccgctggtgaaatccatgatttcgtccgggttttgcggcgtggaatcactggcgcggttatacacaaaactgtcggcacctcggcccccgcggagtcgatcggcgccgcccccgccggtgagccggttattctcatcgttaccgatcagcgcatcatggcctgcgccgccgatggcattttcgatcgtgacaccccgggcgattgagacgttgccctgcccattacctacatcagagaacgaacctgccctgaggttgatgacttggttgttgtagtaacccgagacgtcgagcgtgtcgttaccggcgccgtcccagatgcaaaaagcagccatgtcgcggttgctgttcagtgagtagtaatcccgcccggtgttggagttgaagccataggtgttgttttccctgcgggtttgatagttggcgccgtacttgtgttgaatagtgctgatgtcatccatcatgggcgcaaccacgtcgtatgtggcatttttgccactgctttgagcgttgtaatagctcatgacgctatgggctttggagtcttgggcgtagacacgtttcgtatcgtctggtcgaccgtcataggcaccggggtgactcaggccgagggcgtgaccgatttcgtgggtcatggtgggtcgtgttacatgacgctggttgtagcgggtttcaccgccaataccgccgttgtagcggctataagggtaggcgccatcggcaacgttgatgccgttgaatattttgaaggtcaattgcccttctgctgcgccgccgttttctttgaaggccagattggccacgtcgccccaagactggatggaacgccgggcttcttgcttttgatattcgttgaatcccatgcccccttcgtttttgaagtagtaggaaatctcggttttgttatttcggttcgagtcctgccatgtggttgtctgccgcgtgagctgctctatggcccgttgtttgtcaaaggactgcctgtttgctctgtttaagtacggatcgtctgcacgcagggttgcgtcatacgtgctgccaggggtgtttgcagcgctcgctgccgaggtggcccatcgacgactttccgcaaccttttggcctgatgcctggggtacaacacgatgcgggtttgaggtttgattcgacggctgcagaccgagggtgcgcgaggctccatcgcccggttgagtgtcaatcggatgaggctgactgaaaggcatactgaggtttgttttcaaagtaatcactcctatcgaaccattgactgaatggggcttcgctgcggatgcggctttgagtgccggtatcattggcgggcttgcttacggtgctgctggatcagctctgcccgcgtagcggcgcccatcgaggcgcggcggttgcccacttggccgatgatcgaaccgtagtgcagcccgatgatttccccggtgtcggccgaaatcagcggagaacccgacgtgccgggtactttgtaggcgtcatggtagaaagaactccgggcgccgctgtcggcgttgtgccccaaaacgctggtgggtttgccggcggcgttcaggaaggcaatgcctaggccttgctgaccgtggttgggcataaagattttttgcccggctcgggcctgggtgttatcggccaatttgagcggcgagaactgcttggccagggcgttgatctgcgcctgaggcaagtcgacccgcaactcggcgtaatccaggtcggcgtcgctactgagcggccgggtatccagcggcaccttgcgctcgacgcgcatgcggccgctgtcatcctctgtgtaacccagccacagctcgagattgctgcctttggcgagggcgtcgtgcacatgtttgttggtcaatacgctggcgcccccgtcgatcagtgaaccggtgcccaaggtgttgtaatgaacccgctcgtagccccacgagtcgcgcagcacggtcacttcgcgaatgctgcccaccgctttggcgctggcatgcatggctgaaccctcaagcgacccactggcccagttttgcacagagaagggcgcgcgttgcgagggggtgctatcgcgtttgatccgcgaaacagtcggcgatgtgacggtaggtgccggtgccggggcgggtgtaggagcaggagcaggtggtgggggcgtcactggagggtgcacagtggcgccattggagatcacatcgctggccctgattgcaccattgctcctgatgaacaggtcggcgttgccgttgccattcaagtcaacggagaggctgctttcccgggtactcgggttgtagcccaacaccgcttcgcccgcccggccgctcaagcgttggacaaaacgcaggctgttgacgcccgcctcacgcaacgccccggacacatcaatcttgtccagcccgctgctgaagtccatcagcaggtcggaacgactgagggtggagtcactggccttgtcgtagacaaaggtgtcggccccggcgccgccggtgagtcggtctgctcctgcgccacctttgaggcgattgttggcgttgttacccgtcaacaggtcatcgcccgaaccgccgatggcattttctatcgttacgcctctggcgatggagacgttgcctttcatgccgccgacatcggaaaaatgctgggcgttgaggtttatgcgctggttctgatggaagccggaaaagtccagggtgtcattgccgccgccatcccacacgcagaacaccggggcatcgtctgcggaccgcaggctgaacgcgtcacgaccggtgttggagttgaagccgtaagtggtgtcggtgttgcgggttttatagttggcgccatacagtttttgcacggcggtgatgtcgtccatcatcggcgtggaagggtaatgggtgcgccggtgcttggcaaaatcatgcccgagcaggccttcccaccagtagctcatgatgctgtaggcgcgagtgtcttcggcataggtggcgcgtgtggcgtagtctccgtcaccgttgtatcggccggggtgcatcagccccaaggtatgcccgatctcgtggttaataagccattgcccgaaaccgtcttgggtggcgggcctttccatgccatccgaagagatccatacctgcgtaccgtcgctgtagatgccggggtagctgcctgttccggcaaggccgagttgcgagtcgttgcctaataacaactgcccttcggcgtcgggcgcatcctgtgcaaaggtgatattggccaggtccgaccagtactgcatcgcgcgtacggcgtcggctttctgagcatcggtaaattcattggcgcccttgggcgtattgaaggttgcttgcgacggggtgaaaaaccggtaggcaatgggtatgacgccgtcaccattgaggtccttccagcgaaaccccaatcgcgtgatttgtttggcggcctgatcggtattgtaggatctcttgttgttaccctggcctgactcaggcgtgggcggttggctgggtgaatcggcagcctgtgtattcaaaaaagcagtgacggggttcgggttgattctgaccatggctatttaccttctgtcagttagcgtgcacaggcagcccgactgcttgcgcctggcggctcaagcagcgcgtttacctgaaaggttatcgttgggtgataaggccgctgatatcgtgaggcctgatcaatcgggtgctcttgagcagaaagtccgtgtggccattgccggtaaggtcaatggcgacaaagtaccgcttgctgtaggggttgaacttcaccacggtgtcgccggtgcgcccggtgtaggcgtttaccagccgcagtggcgtgcgagtgttttcgctcaagccactgaggtcgatcctgtcttggccactgacaaaatcggtgatcaggtcagcgttggccgccgtcgagtcactcgccttgtcgtagacaaatacgtctgcgccgccgccgcccaccagcgtgtctgcgccgcccccgccctttaatcgattgctcgcgtggttgccgatcaacctgtcgtcctgggcgccgccaatggcgttttccaccgtcacgcctttggcgatggagacattgcctttcatgccgccaacatcggagaacgcttcggcgttcaagttgagggtttgcttctggttgaagccggaacagtccaacgtgtcgttgccaccaccgtcccatatgcaaaaaaccggtgcgtcctgcggcgacgtcaggctgtaatagtcgcgctcggtattggaattgaaaccgtaaacggtatcgccgctgcgggtgttgaagttggcgccgtagagcgtctgcaccgctgcaatgtcgtgcagcaagggcgctgccgagtagtgggtccactcagcgtttttcgagaagttttgcccactcctgatctcggggttgtagctcatcaggctgtaggcttgagtgtcctcaaggtaatgacgtgcgacgggttgccgggtgtagtccccaggatgatccagccccagcgaatgacccacttcatgcgccatgacctgccggtcgtaacggtcggactgggggcgggcatggccgttatccagccacgcctcgcccccttttttgaaatccatgggaaagggcagggatgcataggactcgccgtcaccgtcgtaaaggcccagggtcagtcggccttcggtgctggtgccgttctccgagaatttgatgcgggcgacatcggcccaggcttgcatggccatccgcgcccgtttcttttgttgctcacttaattcgctggcgccttcgggggcgttgctgacggcgtgcgggttgtgtggcgtaaaaaactcataggcaatgtcgatgacgccgtcgcggttcttgtcttgccatttgaagcctcgggtgtggctggtacgcagcagttgcctcgcggcttgatcggtggtgtaggacgccaggggcgtgtcttgataggtggactcgggtgaagtaagtgccgagtaagttttgtgattgacagagaacatctacttgaatccttttaatagacgaagtgaagcgtgagcttcatggctcatgggtaaacgaactttgctggggttaacgcctttaactaaagccggtgggtgatgtgtgcgaagacacacgggcgttatttaactgcgtgtggtcaaaccctgaacgtcttcgggtttgatcggttgggtgctcttgatcaagaagtctgttcggcgattacctgtcaggtccacgcctacaaagtatcgcccgctgtttgaattgaacttaaccacagtgtcgccaatacggcctgtatagtgctcgacgagtcgcaacggtgtgcccgaggtttttattaattcggtgagattgattttgtctttgccactgacgaagtcgctgatcagatggctattgtgatagggcgaatcgctggcgttttcgtaagtgtgtgaaatcgaacggcgcactcgcggtttgggtgtcagcgcggactgaatactcgggtcagcgagcggctgagcaaggtcgccagtgtttgcggccgtgatgatatccccgggtttgacctccccgtgagtgcgtatcagcaggtcggctttgccgtcgcccgtcaggtcaatagccacgctgcctttgccacttgtctggtcaaacaggaggaccgcatcacccgccttgccggtcatttcgctgacaaatgccagggcggggacattcgcgttcttcatggcgttggacacatcgattttgtcgctgccactggtgaaatccatcagcgtgtccgggttgtccggcgtggagtcgctggcgctgttgtagtcaaacgtatctgcgccaccaccgccgcgaatgcggtcgcccccagcgccgccggtgaagcggttatcggcgtcgttaccgattattgcgtcgtcgcctgaaccgcctctggcgttttccacggtgacgccccgggcgatggacacattgcccttgagcccgccgacatcggagtacgagcccgccctgagattaatggtttggttggccctgtagccggagacgtccagggtgtcattgccacccccgtcccagatgcagaacaccgcagcttcccggttggatttgagggtgtagtggtcccgctggctgttggagttgaacccatacgtagtgtcgccctgacggatttgacgattcacaccatagagtttttggatggcggaaatgtcatccatcatcggagaccctgggtcggtgccgccgaatttttttccgctttttcccgcgttgtagtaactcatgacggtgtgggcctgggagtcctgcgcgtggctccatgagtctgggcgcaatcggccgttgtagtcgccgccatgtttgagccccaaggcgtgacctgtttcatgaatcaagtcgaagggagtgactcgggtggcgttgtacagggtcgagcctgcgtcgggacggttacctgggtaggcgccgacggcggtgggcactcccgatatgccaaacgacattttcccctcggcgcgtgacccattttcctcgaagaccaggttggacacgtcgctccacgcctgtaccgcacggcgcgccatcgcttgctggttctggttgaactgcccgaaacctcggttgaatgagtaacccaccgagactttgccgtcgccatttcggtcaacccacttggtgttgccccgcgtgaggttgtcgcttgcctggcgtgcatcgaaagagcgtttattcaggttggccacatacgggtcgtcggggcgcagcgtaggatctttaccgtcccagctgcgcttggtcggtgtatcggatgggatgggatgggttgtagttgcaggcttttgcgggcgtcttgtggatggctcagtgaaggggcgtacgtagggctgctgggtcctcggttgtacgaaagggcgtatatatggatgccgaatgaatggctgcaggaatcgaccaagaattctgaggccgggagcgtattgaggcgccggtcgaagagtcggacccaggttgtttttcgcgtggttcggttgttgaaatacaagtggcctgaagtcaattcgcatgagcgcaatccatgtttttgttgtgagatggattccttttttttaggggaagtgcacgtccgtttgctggaaataccttcgcactctataaatgaattgccaatggggtatatgtttcttgagtgtcttgatggcgcagtgcgtcatgcttggtaacagcggctgtgtttatttttgcgttaaacagcctgtgtggagtgttgattttaaaagcattacgcgcagaagaaaaaagtgtgtttttaaattgtgtttagtacgtcttctttggaaatacagaaatttttacagtgtgattattgttgttaagagttttagagtgcggtgaggagaatataacagtcaagtgccttagttatcgaagtttcctacgggccatcaagttatattgaaacttgttttgctgaagtgccgacaactctttgttcttcgaactgacaaggcgctgactgccgaaaggcgagcgtgtggcgaggaatgacgattcttaacccgaaccagaggtgttttgcgtctgaacctgtgaacggattattaactgttgaggttcagcaccatgccacaagctcccttattcttgcgtcccatcgctggcggcgttgtcgttaccgtgctgctggtggcgcttgccggctgcgggctgtcatcctctcaagaggccgcccagcctgccgcgccagcccccgccacagcccaccccgaggcggctttgatcaagcgagcggcggtccctgcgttaatggctgcgccaagggtcatgtacgacacagccatgccggatcgggtcgaaccttcagagcactaccagaacttgcccgaaaaccccgtctacagcgtcgcacaacagcctgtttcgaccttcagtgcagacgtcgacaccggcagttatgccaacgtgagacgttttctcaaccaaggtagcctgccgcctgacggcgctgtgcgcctggaggaaatggtcaattacttcccttatgactacaggctgcccaccgacggctcaccttttggtgtgaccaccgaagtcgcccccacgccatggaacccgcacacccgactgctgcgcatcggcatcaaggcctgcgaccgcgccgtggcggacctggcgccggccaacctggtgtttctggtggacgtgtccggctccatggaccgccgcgaaggcttgccgctggtgaaaagcacgctgaaattgttggtggaccagctgcgcgagcaggaccgtgtggcgttggtggtctacgccggtgagtcgcgtgtggtgctcgaacccacctccgggcgtgaaaaaaccaggatccgcaacgccatcgaccaacttaccgctggcggctccacggcgggggcgtccggtattgaactggcctaccagatggcccgcgccggctttatcgataagggtatcaaccgcatcctgctggccaccgacggtgacttcaatgtcggcgtcagcgatttcgacagcctcaagcagatggccgccaaccagcgtaaaagcggcgtatccctgaccactctgggcttcggtgtggataactacaacgaacacttgatggaacaattggccgacgcgggcgatggtaattacgcctacatcgacaacctgcgggaggcgcgaaaagtactcgtcgaccagctcagttcaaccctggcggtggtggcgcgggatgtgaaattgcaggtggaattcaacccggcccaggtcagtgaataccggctgctgggctatgagaaccgcgccttgaagcgggaggatttcagcaacgacaaggtcgacgctggcgagatcggcgcagggcataccgtgaccgcgctgtacgaaattgtgccgaagggccagaagggttggttggagccattgcgctacgccgctgcgcccgcggctgaaaacacatccgctgagttggcgatgctgcgcgtgcgctacaagcctgcggcgggtggtaacagccagctgctcgagcggcccatcagcactgtgtcgacccaggccagcgacgacctgcgtttctcggcggccgttgcagccttcgcccgacagctcaagggcgatggccgctacactggcaacatgagcctgcaggacaccgcagcactggcccgctcggcgcgcggcgatgacccgttcgggttgcgcaacgagttcgtgcaattggttgagttggcgcagagcctgaagcactgatcttgagcccaacgaagctccaatgtgggagctggcttgccagcgatagcggtctgtcagcaccgcaaatgctgcctgacccaccgctatcgcgggcaagcccagcttccacatttgaaaagttttaacgtctcgaaaggagttcgctcactacatggccgtaccagatgattcacccagcgacgaagcgctgctggcccgctaccgaagcggtgaccccgccgcgttcgaggttttgtacgcgcggcaccgtcaagggctgtaccggttcctggtgtctctgagcaacaaggcagagctggccgaagaggtttaccaggagacctggctcagcctgatccgcagcagcacccagccacagggccgggcgagttttcgtacatggctgttccaaattgcccgcaaccgcctgatcgaccactggcgcaagcacggcgtgcataacccactgcatgacagctacgacgagcaactgcacgcccagccagatgacagcccctgccccgagcagcaactgagcctgagtcgcgaccacgcgcgcctcgacgctgcactgcaagatttgcccgaagaccagcgcgaagtcttcctgctgcgcctgcacggcgacctcgaagtgccgcaaatcgccgccctcactggcgctccgctggaaaccgtaaaaagccgcctgcgctacgcccagcagaaactgcgccgcctgctggccgaggagatacccgcatgaccgactcacgccaaacacctgacgacgagctactccagcattttcgtcaacacagcctgggcgaaccgccagcgtccctcgacgccttcatcctcaacaccgcccgccatgaagcccccgcgcgacagccaagcctgtggcaacgctggctgcaagcctgccgccaaccgcgctggcaaatggcattcgccaccgtcgccggcgtagcgctgatgctcggtgtagtgatgcgctcacccgtgccgcaaccggagatctccacagctaccttctccacgctccaccaggaagccgcccgcccggcgccgcaagcgttctcggcacccgcgcccatggcccgcatggccgccgcgccgcccgtgcaggccgaggccgccagcgtgttggcggatgaaccggcggcaaaggtcagcaagcgtgcggcgattgtgttgccgtcgttggagcaggggctgcaggagattgtggatctgcgcctggctggcgaaacccgagcggcggatgaaaaactgctggcgttgcataagcgcttccccaaggaagacttgcctgcgcggttggaggtgttgcagaagcggtaagacgatgaatactgttgccgattgacgagcgatcgtaagcctttatacttcttcgcaacacggcccctgtcggttgatgcgcttcggtgctgagactgctcaggggttttttattgcccgtgttttgtcatttaccagctacgatcctgccaattgtgatcgacacccatgccctctaaattcaaatcaagatggtgcaagtcaggaaagtctttttccagcagtgccttaagtcgccttccccagctcgaggacggattgatgacgtgcatcagatgttgggtgatgcacaacaacatgaatggccgagcccgccgatgcacgtcatcatgaaatgccgacaacgaaggtgcttgttccacaggcggtaattttggctggtcgacgatgtttcgattccaaagacgactgtgatgagcgcatacatttctcaggtaattcagactacgcaaccaactggcaaaggttctgccattactgatgccatatgcctcagaaatagcgtcttggtcgccctctgtcatacctgagtatagggtcgacagagtgccgaagtcccacacctcacacaccacccagaccggcagtggcagcccgtatttttccttgttatggcggatgaaatcttcgttcgagcggttgatcaatgcagcgtgtttcccgatccatgcatgatgtttggttaaccctgtcttggcatccaactgaatggaaaagctttcatgaaacaagtctggcttcaggtaggcgaatttgtcgtgtttacctaatgtgtgtgagatatccactcgcaaggctatttctatacgttccagcgcatccagagtcagtaggcgaagctttttatcgaatacatacaagtcgattgcattctggaaggtggcaccgggcttgaaggtatcgagtgggattcgcgtgggcttcgtcttggtgggtttctgatttttgtactggaggagcggacaacagagttcggtgcgctctcgaaaggcaaaccagtagccgctgaggcggtagtaaccgacgcgctccaggtactccagggctttaggtgggtcagtagcggtcatgcctcgcgctagaagcagatcgagttgtccttgatagctcagccaaggttttggataaccacgcgtcatcgattaatcaccttggtagccgtgttgcaggcctttatttttgaggttcagactgaaaacctgagagttcttgatcgagtgttttctgtgctgttcagcggcaagcaatgtacctcttttgcagcatctctctgtgtcgggaagcatttagagacaaagacggcaaatattccaaatctaaaatgcaaaaaagccccagctctttcgacctggggctttttcatctgtatctggtgcccggcgtcgtttgaaccgggtagtaaaaagtccgtattcattgggtgtgtttggtggttctttggttaggcatacacgtgggcatacacggtgcttccttctggccacttttttgaggtaggtaaagcaacaccaaatggttgctgatgtgttgccatccagctgattagttacttcttagctcgaccttctgccgcaagtgaggcaagcgcaagggtgataaatcctgcatttccatccagggtatccagtgcccctcgaatgttctgtgccacttctgtagatcctctttgctcaacccagtttgacagctcctcgatagctgcccccagggccagttggttttcattcatgcgcttgagtaatgacgcaagcaaaggggtgtcttccatgatgttctcccgccgtgttgtcaggtagtcaatctacctcgagccagtcgcattgcacatcagctgtccacaccacctggtgatcggaaatcacgctggtcatcttgattccctagatgcgaagttgcatggacttgaccacccatttgcattcgacttgaccagtcgtttgcatcggatttgaccagcactttggttggccttgatcggcaaaaaacggccagaagcggactgaggagcggtaaataaatctgtccccttttcgttgggttgcgaagcgaccccaaaagaaagaatgcggtgactcaggcactcttcgactgctggttttttggggctgcttcgcaacccaacgcgggacaagcccgctcgccacaggttacttattgcctgttctacctaaataccttgaaagctctgcatctacctcgcagccaaaaagctaggacaaatcagcgacagggctgacgctactgtctcgttctgcgatgctcaacaccaccggtagctgctgctccacaggtacctcgtcggtcttctcaagaagttcacccaagtcgaaaacggccatttcgacatagcgttttatgcacatccgctcataggaaacgctgcgaataccgtccagtaccagccagttcaagaacagtgcgcccatacccagcaccacgatcaccgagcccttgccccatgtgaacaaaggcgtggctttaataatttccgtgcacaacgcgatcatcagggcgatcagagaggcgaaactcaggttctgggataaagcaggcctggcgggttttccggtcaggcccgcataagctgacaactcgcgtagtttctctaccgtgtagccctccttgcgcaatccctccagaaagaaggcataacaaagggtgttttcccgttcaaggctcggctgctggtcaatcgcgtgatctgcaaactgctgcgggtaaaccatgcgcaatgccttaaggcgcgtgacatagagcagaagagcccaaggagccagtgccatgtaggtgtaaggaattagcgtagggttcttgatgccgaacattgcgaacacaaaaagcaatgcggttgaccctacagctgaccacattggccataacttgcgagcattgtggagtttgaatatgtgtttattgggttgtttacgactgattttataaagggcctcgagttgagcccattccttgagtttcatgacccatccttatttttaaagtcgtgataaccgagcggtacaacgttgcccgcaattgccactgctgacaacccacagccaaaaaagacgatcgaaaggcgacagatttatttttctatcactgtccgattttggccggtttctgcccttcacgaagggacgctatgggtcaacttctgccaatcagggccaccaagtgtgctggtcaaatccgatgcgaacgattggccaagtcgaatgcaaatgagtgggcaagtgcaatgcaaatgggtggtcaggtggagtgcaattacccaccctagatgccaacaatgtggtgtagggccaatttggaaaggcagcatcagagcacatatccagcccccctccaaaactggtgtaaccggtgttacgggtgtaacgccgttcaccaaacgcccggtttcattggctttcatggctgttacacagttgagcgacatagcgtacccccgatgtaacgctgcccctgcgtgtaacgctaaagtcagcatccgggtgttgtgggcaggcgctttgcgctcgagcctaccaaccgaatttcgctggctccgcctttcgatgagaggaaatcccgctggggaccctgagagctttagcttcacacggggcatgaaacccgcgggaccgcgttagcggcagccgtgccagcttactgaaatttcaatgttgaaattgaaaggaccttgaagaaaagagggcatcgttaccgtattggtaatggtgcacgcagatggcccaaacggtagggcaaatgcacaggtgaactggaattcaccgggttcacctgttcactaagctgggtgactttctgctaacacgatcctgcgggtttcctaccccgtatcttaagaaagtccccagggccccggcggttgtgcatcacaagggacgctgtaggaatttatacatacggggagcggggcgactacatacatctctcaaagcggtgttacgggtgtaactggtgtaacgggttcacctaaccccctgtatttaaacgttttatcagcgttacacagtttttttgactgagttttgatgcgtgttactcacttagcaggtgtaacggtttcaggtgcgagggcgtttatttatggttcgagtgccctgttgtctgtacgaagctgctcgcagcatgaagtcctttccagcttcttgaggccattgcggtttgctcgggttggccgattatctatttacaccatgtgtccaaacgcgcgtttattcggcctgatagcgtgggtgagccaagaaaaaatccatcaatggtgacgcctctggtcaattatggctctctcgagccgcatacggcgttgggaagcgcgctccgattcccacctgggggtaagcgaattgtgagctagccatctgatatcaattgtctggacagccacgcgttggaagggtaggttttcagtgcgtaattcctgatcgtcatagacaacaaaacgagagaaacatggatagctctaacaaaagaattctatttgggaaaaagtaccgagccatttacaactcagatgcgccgccaaatcttggatttttagacgtggtatttgaacaaatcaatggtgagctctacttagtaaacgataaagagtttttttgtgagacctctcaggtttttgtgacaagtaactatcacgatatagacacaaaatttgatagcggtgaattatttcagattgaagcgatacctactacgcaggagtggaaagagggcgattgtcgctatgtaactacagcatcaaaagtcgactctagattacctagaaaagcggcattgcaaataatcagcacaagcctaccatcgccaaatgataaggttatatatactgatgcccctccttttactcctctgattttaataaagaacggcgattcgctttatgggccgttccagactactgctgaaagcgacagtaacgggagtacgatactaagtcttcagtcattggaagggccctttccaggaaaaaatgtaaccggcagcatccgaaaatatcgatatgaagatattgagccaggtgtggcacactatgatattcgtggtgatagatattcttttctgctacgagcagatatgtttgagcagcaaagttgcgattacgttgacttcgcgtccgatgaagaaattgtaaaaatcggaagtgagcttttaaagaaagttgcatttaagtcttttacgaaaaatgaacagatcatgttcagggctgcacttaataaaaccaaaaatatccctaataacgcgaatgatcagctaaatcgtttttttgctctagctactacgacctcggaaaagttggagggacttgagggcgctctgcatgaatatctacaaacctccaatggtcaaagtctacttagcaagcatgttgagtctcgagaagaaatttatttacgaaagttcaaggctgaaaaagaagataagctaaatgaagagctttcgaatctcgcgttaaaagtcgataagctaacgaaactgcaaaaaaatctagaagctgaaaaccagaacgccacagaaaagcttgagcaacaaaatgctacgttcaagtcccagcaacaagtgtttgtagacgaggcgcgaaataaagagcggggtgagttggaagccgaaattacgaaggcgagaaccgagctcaatttgttgaaggaagaggctgatcctttcaaaaatcttgctgcgctaaaaagtgaaattacctctgctaatgagcgcttgaagatttatcaagaacaaagcgatatggcgaagcaaagtaaagaacttatggaggatgaactaaagcagcgtgatgaggaacttcgtaaaaaactcttcactttgcgaccctatgtcgaagctatttcgggtatgagtccccccgtggaagaactgctgaaggcgctgcctcacgctattgctagggaaattaagccggattccctattgtcggagcgtagccgatatattgatgagctacggcagcagctagcttcaaaaggtcgtcattatgaaaaggattttatagcaaatcttctaatatcgattcaacaaagctttatcgttattctgtccggcctccctggtgtaggtaaaacctctcttataaaaattctcgctgaagctaagcaattgtcttcgcgaatgctcaatatctcggtaggtagagggtggacaagtcaacgggatcttattggttattttaatccgttgtctagccgcatgattcctgctcccacaggtttttatcagtatataaagtcatgtcagaatgaaaagtgtgaatcggctgcgccactttgggttcttttggatgaagcaaatctctcggcaatcgagcactactgggccccatttatggggatggcagacgttgagtccgacaaagtactgcgggtaaacgattcggagttaccaatgcaggtgcctagttcgcttcgattcatcggcacaataaacaatgatctcacgactgaacctctcagccctcggttaattgaccgtgcgccgattattacgcttcaacctgtaagcgagcagtatgaagatgaatttttggagcaggacgttgatggtatcgaacttccaataagtcatagtacattacaccaaatgttcgatatcgatcagactctcccgctcaccgatgagcgggaagcgatcgccgaacagatggcgtttttacaggaggtgaagagtgttctcatggatgacaatattgcttggggtaaacgttgcgttatatcaaaacgtaaagagaacgcaatcgagcgttactgcctggtggctcatccgctgatgaggtctagctcaaatatgcgagcactggactatgcccttagtcaacatgtcttacctctaatacagggaagtggggacggctacgcattgaggttggagaagttgatagatctacttgatcaggacgacttcaagattagccatggtctgttgcgccgtatgcacgaggcaggtcgcatcgacatgaactcttttagctatttttcgcactgatttatgactgccatgattgaaatatcattgctcgttcaaagtcatgaggggatccaggtatttccgctgctggagacctttacagaaattccagctattcgagagaccgacacaatctctttcaaagtagtctgtccaaatgtcttgggtgaacctaagatttatattcaggatcatgcggttatattaaatcgcccataccctaatggggacctgactgagcatacggtagagtttagccggtatttggcaaatcattttggcgtaacatccatagcagtgtcgttttcaaatactgatgatttaatgcgcgtcacaccaattgatgtgtatgcaaccaagctaaataaagagcaggcggaaaagatactagagtatctttcgctaaaaatgaaagacgttactcatttgtgcttttccaaaacgcatattgggtcggatgccaagtcgggtgaaactactgatacactaacaaaattagatttctcgagaaaaataattgaaatgctgaatgctaaccggcatcggtttgtgtctcagccttgcaagagatctgtcgaagctctgaaggtgagtagctacgaagacaccacttatataacagataaagatatttcttggctgtttcagcaccttgatcaaatctatcccgcatctgcggactcatcgaaaatcgcgataaataatcgccattattctatagatcaaatacagagaagtactttaaaggttgatacgaatctttttgagaatcaagtgattctaagctttttagttaatctaaaaagttttttgatgtctgttcctgatttcaagagaaagtatcaggtgcacacgccgtataaagattattacgcgtttgacagtattttgaagaaggtagaagctccgcttatggagcgccgatatcgcgaggcaagaatgttattgcagcaatgcaatgaattaattgctttctttaaaaagtatctgccctgtacgattcgtggaacagtaacgcccatacttacacctcaggctaagcgctatactcattacgagaagtcttttcgaataattgatagttggtataagcttgggcatcctgcgtggagcggtagtaactatctttttggattgaaatcacttgataaactttacgagtttttttgcctgtataaaattgctgataaatttgtcgaattagggtatcagctcaccgttacgggagttagcgacccggatagaagtttcgggatgcgcggcaaacccgctcaatcaccactagataaaattactaactattataagtttgagtcaaatgaaaaaactttagagcttttttatgagcctacagtatgggcttatagcgagttgtcgaagcccggtgaactcattgatatattccatgcgagaggtgtttcgaatcccttttttacacctgactttgttgttcgtcaggataatggtgatgattacccgagctattatgtttttgatgctaaatattcatcagaaagtcaaaccaaggagcggcatttaccgtctattattgacaagtattatttgaagctgaaggggattagcaaaaatatgcaagtggattcgcgcgcggttaaacttgtgtatgctctgataccgaaaactttcagtcaagagcaaggcttccatggtgggccattcaatgtttatgatcaattgccgacagccccgttctttgggtttttaaagttgacaccagatgaggaacgtccccttgataagcttctttcgacgttgtttaaaccttcgcatgagtctctttcctatttggaagatgttgtttcggcaagggtcgattcaatagtcgaggaggatggagtggttcctttaagttaaattatttattgttttgtatggaagatggaaaattacaaaaaaggcctttgaaggccttttttgtttattgtttgttgcggtattgcttcagtgtaaagcgcgatttagtgtgcttcgctcttcggtttcttgatgatgttttttctagttcactctatgcaatattgagctttgttgtcggcctttcaactggcattcgacgtggtttatttcagccttgatcgaatttgccgtgagtgtctgaaccttggttggttgtccggtctttatatctacgattttaagtagtgcggtcagatgatttttgcgtgttttcaaggtgtcgatccatctcgcgctgctttgaatttgcttgatcatggtcttcgtcctgatgagttataaacagcccgcgtgcgcaggctgtttcaggtggctgagtgcgttacagcgagagaatgtcttctacggtgaatttgtacgagcggtcagagagctcacgactatcccatgtgtcgaagccttcaccttctttaggaagcaataaccttctcaggctgatttgatcgccacccagcaaacgtttagcagcccatagcttggcgcccatatccatcagtgcctgagctttttcgttccactgctcttctaataccttctcggccagcaacaaggctgttctctggatggccaggtgctcgctttgcgcttcggcaatgtgctggtcgacgattgccagctcctgctctagtgcggcaatgatcatttgttgtcgacgattgtgctcggtcgcagtcgccaaatctcttgcagccttttgtgcatctgcattggaggttttttcgccctcagtatcaccccatgccacggcttgcgcataggcggtcaccgcatcattttcagcttgtcgggctttcgctatgtcctctattgcttgctgccggacctgttccaaacgcgtgcttaggctctcccgtttttcgttgagctcctgctcgtctgccttccagtttgtcatcgactcagcgtaaccagccatcaatgtctcgtgattaaggagtttttcacgtcgggtaatccgattagtaacaacgctggcctgatgctttcgagagtcgtaagggattttcagggtgttgtactgtttgcgaatttcgtaaagtcgatcagcatccagcgtctcctcattctccaggagtgcctccagcggaccgatctcgatatacatctgttcgacttcactcaggtatttttccctctcgactttcagtttttcgatctcgcccagcagcagctgtttcttgacgcaacacccggtcgcttcactgttgtccgaaaaatgctgtgcgagctctgtagctttacggctttccatctcatcggttaatagttcacgttgttctgtggatgcttgaaatttgttcatctgtcatgttccttaaaatttgggtttgggtttgggtttgctgagcggctggcgaggccgggagtgagccggcgctacctcgatcatcagagaggctctcaggcagcccgggccttgctctcatccgtacctggaatcgtcttcacgatgtagcagcgctgctgtcccagaccgggtaaccgaaccagactcgatgccttgccgtcgctggccggttgcagcacgcctcgttgcagtagctccttgttcaccgcgctgatgttcatgcccttgaagatctcggccctccacgcttcaggcagcacgtagtaggtattggtggtgtgtagggcatcacccatgccgtgttccagggtcttgcgaaaacccagccgatcaattgtgcgtgggccgtgctcatcgatcttggcggcggcggattcccagcgggtaaagcggctttctccaaagcgctcgatgacctgtctcagtcgcgccaaaatcgcatcaccctcgaagtttccggcgccgccacgctctgccagccatgcatgcaggcacacccttgcggcggtcgtggccgtgccgtcgggccagccggtgatgccgaaagcggtggccaactctccggccgctgctgtaagcccaaagcgaagggcggcacgttgagcttgaccactggccgagacgggcaggttttgggtgatgaactgctccaccgtgcggcgaacgatcaccgaccacctgagcatttctccaggcgcacacagtgcgtgcaggaaggcggtgaggggtgtgccgtagtatttggcgacgcgggccttaagcgcatcggagagggcggcagcgtcctcaaaaccgttcagcacatcgaacatgccgaggcctttgctcgcatccgctggcacggcgagcatgcgcacctccataccggctttcagttccttgttggcatcggacatgtgctgtgccaacgtcttctcgccggtcgagagaaacagcaagcgccactcctgcacctgtcggcccgcttgtcctcgatcattcgcccgggccttaccggtgccattgccaagcatgtacaccgtctcgccgataatgcgcgggtcgcacatgccgatttcatccagcaccaggaggccgtctgagtgagcggctgcgatggactccagggcgttatctgtggagcgccatgaacgcaccagacgcggcccgccataaaccgatgcagcgacttgtaggtgagtggtcttgccaccggagctgtcgccgtacaggtggaagccgcctgactcatgccccagcaggtttagcagaggtcctgcaaaggccacagagacgacaaaagccaagcgatggttaccaacgcacagcgcgcctatttgctgctgccactgctccagagagcccgcctcgctgatcggtggcaactgcgcaccggcctcataaaaatgcaggtgttcggcgtgcgagccaatctgttgttcgggcaatagaaacgccttgtcgtgccagcccaagcgcgttaccaaacgtgcgcgctggacgctgtcgaagccaccgaggtaactctgcagatcattgcgtgcgttacgtccagaccggcttcccgcgaggcgcaggcccatgtcgaccagcggcccgagtacatccttgccgaagtcgccggtcatggttcgtgccggaatgttccagcgtttttttgcgccgtccgggtcgtcgaactcgaccaataacccccagttgtggcccttgtcgtcgcgagtacgggcaatgatttcgagaggcgaacacacaggacgcgcctcgccatcatcgccggaataaaacaccccttcagacgtcaggcgaaagccgcccggcgataggtcatttttcgatttcgcagggcgtttggcgggcgccttggccttctgttcttgaggttcagttggctcagcggcactgccgaaaaactcaccgatgcgcgccagctcggcgacgtgggcagcggtccagcctttggctaacgcatccgctgcatcgtcgccgtctgcccattttccacccttgatgagcgtgggctctccgcctttgctgctgggcttgagcttgaacacgtcgagcgagactcgttgtaccgaagcgacgcccagctcaatcaacttgagctcgatggcgtccatgcaggtcttgccgctggcatcgttatccggccatagcaccaccgtgcgccctttgagtggcgtcaggtcggccttgtgccaagagttggagccgttcggccagcacgtggctacatggtcgggcatcagttcagcggcggcatcagcagccttctcgccttcacatagcaccacaggcgcatcggcccgctgtgccagctcatccaggcgcagcagtggccgaggctccagcaatccttgccagcgccattgcatggtttgcccatcggagcgcttgcaccaggtcaacggtgcgaaaacctttcgcggcttgccgtcttcatcgggactcaggtcgaagcgatacagcgtcatgaccggctggccctgagcatcgcgatagatccacactttggacggaacaccgtgttgccggtgtttgactgggcacttgttcatggcctcggctgggatcggttggatcgcaatccactccgctgctgcgggcttggccggtgcgcttttggcgttcgccgaaccggcggaaacgctgagcagatccgccagctttttgcaggcctcaacgtccgtgccgccgtcgatgtagcgcacgaggtcgatcaggtcaccgcccttatcgccggtggcaaaatccgcccaggtgcctttgctcaaattgaccttgagcgagccagcgcgcttgtctgtacgcgtcggattaggtgcggtgtattccttgccgccatcaacgcgtttgccgttcggcagccagtgagcaagcacaaggtcgatgttcttcagtgcggcactttttacgtcggcgaagctggggcgttttgaggtgttgccggtgcgttgagtcatggtgtggccctcgactcaagcaacgcctcattcacgtcgtcgatcagcgctttggccatctcgccgaggtagaacgcaggccaactaaaacgctcgcctgcatcgctgatggcggcgtcgaggatcagttgattggcgtggtgcacaatctgggagacggcctcaagtgcgtcctctaccgggatacccgcattcacccgaaacaggttttggccgttaccgttggcaggggaaaactcggagcgtccaagcgtgctgtagtggttcacagagcaccgcctttctggcccatcggcacagaggaggcatcaccgtacatggtgagtgttttgatcaagcccaaggtgccacgcacgtcccaaataacggacgacagcacgcggttggaaagcaagggtttatcgccgtctaagtgatcttccaacagcatgagaactgaattggcacggtcgagcgcacaggtgatcgcgtcgataggcagaccggcttcggcctcttggctgacgcagagtagatcttcgggcagtgcaaagcctgggagcatgctcattgggcaccccctgctgcttccagggcacgagccttggacatatgggcgttgtaacgggaaaggcgtgtagcgaggctggagttggcgtgtaaagcggcgagagccattgctcgatgagcagcggcgcgaattttggacggattgagggcgtggttcatgcgtgaggctcctaacgttgaggaaccgccactactcgctgcaaaacaagattgggtggcggctgtacgcaggtttgcagaccgggacgttaggcacccggcgcgctcgagagcgccccacgcacagccaccataaagcgaagttgcaggcataaaaaaagcgcctgctttcggaacggtggcgcttatgcgcctaacgatgttcgggctgcaaaacccggtcgctgaatttgcagcgacgagcagagagtaacgtccgctttttgaaagtgcaactgtgtggatcgcttgcggattttttcgatgcggcataaattgattaggcatgtagatttacctcaacgcctccggttgccgccgggggcgttttcgtttcaggcatggatatcccagcgtagggagacaaagggcagcaggtcgccttcgaggcaggcgcgcgcgtcctcgtaggcgtcgatttgttggccttcgtcgacgatgattgcttgaggggcttggcagggaactgacaatgcgcaccagatgccatctctccatcgcatcaccatcacgtcccggtccaggcgtttttgctctgtgcggtaacgttcaaaacgctgcataccgcgtgatgagaatccgactgttctgagtacagaaaagggctgcaagatggccctgttggcaacacgatttttcatgctgccaccctgtcgcgtgcttctatgcggcttcgtgcccatgtttgaatttcagataaaacccaagctacgggcgcaccgcgagcgttgctgttgctcaatttgacgggcaggggaaagccgctatctgtgcgctgcataagtttgtagatggtggagcgcttcatgcccacgatccgctcgacctcgggcatacggatcaatgtcgacgatgcgtcaaagattgggcttggagtggttggggtaaagcggggaatttcggtgataggggctttcataggtcttgctctcgactggttaggactgagagcaatgatctaggtgcaggtcggtggtgagcagttcacttccaattgaaatctgattgaaatttctggcttacagcacgaagtagcgtttgagaatggcctcaactcttttgcgagtgagggttttttcggtctcaagcgtaatccactcaggccgctgttttggaggttttgctacctcaccttgtagccagacatgcaccttcgttgcaacgtagcgtttggacatccctgctgcgcggtagtgacgaccctgtttaactattgcaatatctcgaacgctaatctcctccttacgatccattccgctgatgaggccgccttttttgcggatggcatttttgattgctcgttcggcgatgggtcttagttcatcgtcggccaggcaggacagggacatgatcggtttaagatagagggcgtaatcatcaagtgtttgaatccgctcatccggatcgacctgcatctctacgaattggcaatacagatccctaggccagtcagtaggaggttcagagacatgagaccaagcctcttgatcgcctgtttgcatccaactggctaatgtccccagcgcttttacggcacaagccatgatgtagcccgcatgagcatcgcgctccgacactgagtaataaccgctgtacattcgtacccaatgcgccaggcgtgccttggtgtcggtggaggcatattgaaaaatgctctcctcatggatcatcgtctgaatgcacatactgccgagatccttaatgtcggcgagatctttattgatatcgtcgcgatgaatgcgcagccagcactggtcgatcaggtggcaggcgtcagcgacctgtccacggcagagatcatagagcggttgtgctgagagagatttgagcaggccgctgcctagcgccgaatgcaatatgacttggtgatcagtcattgccaggtcatccgccgtgtaaccgaaagtcccacgccctgcgcttgaagggcggagccagcgagagtcgcttggcaggctcgggcgaaaacgtctgcccgcagcacctgagcgctgacttttgcgttacacgcaggggcagcgttacatcgtgtgtacgctatgtcgctcaactgtgtaacaggcgtggaggcgaatgaaaccgggcgtttgactatgggcgttacaccagtaacacccgttacaccggttttggaggggggctgggtatgtgctctcatactgcctttccaaattggccctgcaccacatttccactcactagggcatcaaggtgatcggcgtaccactgcatcatcactctacgctgagccaggtacaccgctttgttatagaccccggcaataccctcctttgcatgggagagctgggcctcaatgtgattctcatcgaaaccctgctcattgagtatggtgctcgcgatgtgacgaaagccgtggcctgtttgccgaccggcatatcccagtctgcggagcgccattagaaagacggtgttactacgggggattgtcctgtctttccttcctggaaataggagagggtacgcacctgtcagtgttcgcagctcagtgagcgcttcgatcgcctgtcgagagagcggcaccacatgttcgcgacgacgtttcattcgctcggctgggatcgtccatagctttttggatagatcgatttctgaccagcgtgcttctcggatctcgctcgggcgcgatgctaataaggaaagcaagcgaagccctatacgaacgtcctttgcgtgagggtaggagttaatcgctcgaagtagcgcaggcagttcttcaatcgaaacgtgtgcatagttttcagcgctacgtgattgcaggaatttgctgagaccttcaagggggttgtggacggctcgtcctgttaagcgggccaggtcataaatctctttgcaaaaggcacgaacccggcccatttgttcaatgatccccttctgctccatgccgcgtagaaactccatccattccaggggcagtatttccgtgtatacgcgtttgccgaacacggggaacacgtgaagctccagtgcgccaagcactcgtcgagacgtacctgactcccagcttgtgcgtctggcctcaaaccactcgcggcctaacgcttcaaaggtgttgttggcagcaacctggtctgcaaccttgcgagcttgcttgctcaccaatggatttttgccggtcgatgcgtcttcccgcagttgagctgctttctgtctcgccaaagagccactgatttccgggtagccgccgagacccagccaagaccatttcccgtctggctttttgtagcgcagctcccacgatttttgaccgttaggtttcacccggaagtacaggccattcccgtcctgctcccgatatgtagcgtgctcaggctccaggcctgcaagtgtggtatctgctaaggggcggcgtttgatttcagagcgcttcacttcctgtatgcctccagttataggaatctcaaagcatacacgtgggcatacacggcgggaagttataggggtggacaggagtggatagtcagaaacaagaaagcccgcacggggcgggcttcttggagtgtttcgtagactgtctgagacagcccgagactgctatatggtgcacccggcgggattcgaacccacgacccctgccttcggagggcagtactctatccagctgagctacggatgcttgtgcgggcgacatcatacccatgtcgcccttgggcgtccatgccggtctttggccgtttatgggtaggaaattgctgcatagcggccctgcgccgggtgccggtggtcgaggcgctggaacccggtcgtatcacgctgatcagaaagattcggcaaatgcgccgttttcgttctttttttcgaacagactattgccctgtacccccattgatcctaggattcgtttgagatttcaaacgctctgtctcccgtgcgctctttcactgttcccgcgcgctggggctgatttccctgacggcagcccacaaggcgcctttcaacaactctaattcgctccgcgtgcgcgcggtgctgttaaggaaagccgacatgcagctcaaagatacccagttgttccgccaacaagcctttatcgatggcgcttgggtggatgcggacaacggtcaaaccatcaaggtcaacaacccggccacgggcgagattctcggcactgtgccgaagatgggcgctgccgaaacccgccgcgccattgaagccgccgacaaggcgctgccggcctggcgtgcgctgaccgccaaggagcgcgcgaacaagctgcgccgttggttcgagctgctgatcgaaaaccaggacgacctcggtcgcctgatgaccctggaacaaggcaagccgttggctgaagccaagggcgaaatcgtctacgccgcttcctttatcgagtggttcgccgaagaggccaagcgcatctacggtgacgtaattcccggccaccagcccgacaagcgcctgatcgtgatcaagcagccgatcggcgtaaccgctgcgatcacgccgtggaacttcccggccgccatgatcacccgtaaagccggcccggccctggccgccggttgcaccatggtgatcaagccggcttcgcaaacgccgttctcggccctggccctggttgagctggcgcaccgtgccggcatccctaagggcgtgctgagtgtggtcaccggcagtgccggcgacatcggcggcgagctgaccagcaacccgatcgtgcgtaaattgtccttcaccggctccactgaaatcggtcgccaactgatggccgaatgcgccaaggacatcaagaaagtctccctggagctgggcggcaacgcgccgtttatcgtgttcgacgacgcggacctggataaggccgtcgaaggcgcgatcatttccaaataccgcaacaacggccagacctgcgtctgcgccaaccgcctgtacattcaggattcggtgtacgacgcgttcgccgagaaactcaaagtggccgtggccaagctcaagatcggcaacggtctggaagaaggcaccaccaccggcccgctgatcgacgaaaaagccgtggccaaggttcaggagcacatcgctgatgccctgagcaaaggcgccaagctgctggccggtggcaaggtgatggaaggcaacttcttcgagccgaccattctggttgacgtgccgaaagacgccgctgttgccaaggaagaaacctttggcccactggcgccgctgttccgcttcaaagacgaagccgaagtgatcgcgatgtccaacgacaccgagttcggcctggcctcctacttctacgcccgcgacctgggccgtgtgttccgcgtggctgaagccctggaatacggcatggtcggcgtcaacaccgggttgatctccaacgaagtggcgccgttcggcggcatcaaggcctcgggcctgggccgtgaaggctccaagtacgggatcgaggattacctggaaatcaaatacctctgcctgggcatctgaccggtaagagatcgcagcaaacgcagagggcacgagagcgctgaccctttgcgtgtttcacaccgttattcgtagtggccgggaaagctgtggcagtcgatcatcgcatgctgccgtagttgcctccccgccacgtattccttggaccacgccacccgatgagtggcgaatgaggactttatgagcaagaccaacgcatccctgatgaaacgccgcgaagccgctgtaccgcgcggtgttggccagattcacccgatcttcgctgaatccgcgaagaacgccaccgtgaccgacgttgaaggtcgcgagttcatcgacttcgccggcggtatcgccgtgctgaacaccggccacgtgcacccgaaaatcatcgctgccgtgactgaacagctgaacaagctgacccacacctgtttccaggttctggcctacgagccttacgtggaactgtgtgaaaaaatcaacgccaaggtgccaggcgatttcgccaagaaaaccctgctggtcaccaccggttccgaagctgtagaaaacgccgtgaaaatcgcccgcgctgccactggccgtgccggcgtgatcgccttcaccggcgcctaccacggccgcaccatgatgaccctgggcctgaccggcaaagtcgtgccttactcggccggcatgggcctgatgccaggcggcgtgttccgtgcgctgttcccgaacgaactgcacggtgtgagcgacgacgatgccatcgccagcatcgaacgcatcttcaaaaacgatgccgagccgagtgatatcgctgccatcatcatcgagccggtgcagggtgaaggcggtttctacgtcgcgcctaaatccttcatgaagcgcctgcgcgaactgtgcgacaagcacggcatcctgctgatcgccgacgaagtgcaaaccggcgctggccgtaccggtacgttcttcgccatggaacagatgggcgttgccgccgacctgaccaccttcgccaaatccatcgccggcggtttcccgttggccggtgtgtgcggcaaggccgaatacatggacgccatcgccccaggcggcctgggcggcacctacgccggtagcccgatcgcgtgcgccgcggccctggccgtgatggaagtgttcgaagaagagcacctgctggaccgctgcaaggcagtcggcgagcgtctggtgacgggcctgaaagccattcaagccaagtacccggtgatcggtgaagtgcgtgccctgggcgcgatgatcgcggtggagctgtttgaaggtggcgacagccacaagccaaacgccgcggccgttgcctccgtggtggccaaggcgcgtgacaagggcctgatcctgctgtcgtgcggcacctacggcaacgtgttgcgcgtgctggtcccgctgacctcgccggacgagcagttggacaaaggtttggcgatcatcgaagagtgcttctccgagctgtaagcgcaagctgacctgatcgacagaaaaaacccgcttcggcgggtttttttgtgcccgatgcaacacattcaggccatgttcattgtacgcagggggcttgattgtctaaggttgcagcattgccgatggagcgtgctggatgactgctgttgatttaccggctgtaccccgagtgctgattgccgaggcggacccttggtcgcgggacttactcaaacaagtgttgttgaatgtgcgctgcgacgcacggctggacgtgtgtgcagatgggcagcaagcggccacgctgctgcgagataaaacctacgacctgatcctggcggattgggagctgccgggtgttgatggcctgagcttgctgcgcagcgtgcgccagaagcgccgctcattgcccttcatcctgctgagcagtcgcaatgacagcgccagcgtgcgtgaagccttgcccctggcgccgacggcgtacctgaccaaaccgctgaatatggaaggcctcacgcagcgcctgcaagacctgctgctgaacgaaggcgaaagcgtgtattgcgagatcccgccgctggcgccgggcatgaccttgccggtgttcctggagcgccgccgtgacgcctgcgacggcgcgccgttgcgggtagacgtcaaagatgcggtccagcacagcctcacacccgatggcctggaccttaaacagctggaagaccgagtgcactcggacccgcaaatcacggccgtactgatcgccgccgccaacagcgccggccatcacggcacgccggtacaaacgctgtcggcggcgctgcacaagctggcggccgggcaaagcatgaacctgatcctgggcctggcgctcaagcacaacgtcgtgttgggcgacccggcgctgctggcgtatgccgagcgccattggcagttgtcccaggacaccgccgactatgcccgccgcctggcacgcatgctggagctggaccacgagcgctgctacagcgccggcatcctgcatcggctgggcgatttggcgttgttgcgctgcctggaagactggcgccagggtggcggggcgttggacgacgaagcgattggtgagtctttggacacgtttggtgcggcttatggttcggccttgcgcgcgcgttggcgcttgccgttggaactgcgccagttgattgcggcgatctactcgctcgaaggcggggtgtattcgcgggaatcgctggtaatgaacctggcggcgcaaatggcgcggctgactgagcacgaagggctggaagcgctggccggcagtaagacggcgcgcttgctgcgcgtcgggttgtcagagctgacgcgggtgcgcaaagcctagcagccccttgtgggcgctggcctatgtgggagctggcttgcctgcgatagcatcgcctcggtaaagcggatagaccgaggtgctggcatcgcaggcaagccagctcccacacaagcctgctctcacattttattgagttctaacccgcgattacgcggtttttgccctggcgcttggcttcatacatcgccgcatccgcccgtgcaaacaggctgtccagggttgagtcttcttcgcgcaagctggccaagccctggctgacagtcacggtgaactgccggccttcaaagctgaagctcagcgcctggatctccttgcccagccgctcggccacctgcaacgccatctccggcccacaaccgggcaacacggcggcgaactcttcgccgccaatacgcccgaacaggtcgccacggcgcaatacgccgcgcccgctctcggcgatacgccgcaacacctgatcgccctccaggtggccgtagctgtcgttgacgtccttgaaatcatcgatgtccagcaacaggaatgccaatggcgagccttgggcgcaagcagtgtcgaaggcctggttggcgcattcgaaaaagtgccggcggttgctgctctgcgtcagcacatcggtggtggccaggcggtgcagctccagctccatctgtttcttttcggtgatgtcttcggccatgccgaccacaatcaccggcttgccgggctcaacctgttggttgatgtagcacttgtcgctcagccagcgaatctgcccgtcagcggtgatgatgcggtactcgcggtcctccacggcgccttggtccagcacacgggcgaggctgtgttcggcgtagtcgaggtcttcggggtggatgctgttgcgccattcgcggtggtcggcaagcagcaaaccggctgaacggccaaagacgcgctcgtaggccgggctgacgtacagcacgcggcgcgtttcccaatcaatggcccacaacacggcattcacactgaccagcagcgagctcagcaactgctcgcgctcgctcaaccgttcgacctctccctgggcgtgcatcagcgccaacagggttgccgccgccgccgggcgaggagcctcggccgtaggagcatcgagtgaacaggggttttcgtgaaccatcggtacaactctctctgggcgcgtcgcaggatggagcagcgatcactacaaggggtcaccatgatggcgaagtgttcattgagagaggggaattgcggtgaagttccgtgagcagcttgactaagaaatggcgtcagaaaccggttgtaggccgattttcggggagaatgggctagttttgctgggtactttgactgtggtcggcgggcttgtcgtggcaagcccgctcaccacaacaagcgggctgtgaatgccgggtcagaccgctgcagggcgcagcgaataggtcttcagctggtgggcaaaatcgcgcagggactggatgccgctggcctcggcctcgtgcacccattccttgatcgcggccagcatgtcgtggccattggagctggtcttcagccagatctgctgcagcgccaggcgcttctcgtagatcacagtgagcgcgtggctgtgctccagcatgctctggatacgcacatggtggcggtcatccagcaggctggtttcacgcgacagcaggcgcttggcgcggcggaactggtggcgcaccgagtgatcgaccttctgcagctcctgcttgaccagcgggccaatcaccaacttgcggtactgggccatgatctggaagcggttgttgaggatcgccatcgcggtgtccatgtccagatggcctttgccttcgacacggtgagcgatgggcgccacgcgctgcaccttggccaggcgcaggaagctgaacactttgatccacgcccagcccaggtcgaactcccactttttcaccgacagcttggccgagttgggataggtgtggtggttgttatgcagctcttcgccgccgacgatgatgccccaaggcaccaggttggtcgccgcgtcacggcattcgaagttgcgatagcccacggcatggcccaggccgttgatcacgccggccgcccagaagggaatccacatcatctggatcgcccagatggtgatgccgatggtgccgaacagcagcaggtcgatgacgcccatgatcgccacgcccaacagcgggtaaggcgtatagattttgcgttcgatccagtcatccgggcagtttttgccgtagatacgcagggtctcggggttttcggcctcggcgcggtacagctcggcgcctttgcgcaacacggtggacaagcctttgacgaccgggctgtgcgggtcgtcaacggtttcgcatttggcgtggtgtttgcggtggatagcggtccactcgcgggtgttctgcgccgtggtcagccacagccagaagcggaagaagtgtttcagaccagcattgagctccagggagcgatgggctgaatagcggtgcagatagacggtgaccccaacgatggtcacgtgggtcatcaacagagtgactgccaccagttgccaggctgacaggtcaagaaaaccgttgtaccacataggctgtatggccctcagataaagaaaaaaccagctcacgcattatcactaagcctacagagaaaaccagccgccctttcagatagaagtgactggatgtttcttattctataatccgcagcctttgtagggcgattttgtttttttggtaaggattactgaccatatgctgttttcgtaccgaggtgccctgcgcgtggggctggtatacctgctggtttccattgtgtggctccagctaagccaccagctattgatcaactttatcgatgacccgtgggagttggggcattggctacaggcacgcggctatgtgtgggtggccctcagcgcgctggcgatttacctgctatgcgcgcgttttgcgcgtacccaccagttgcagcaaccgctgaaagaaaaccgcgagcgcctgcgccaggcggccgccgtgttcgattgcacccgagagggcgtgctggtcactgacgcccaggggctgatcgtgcacgtcaaccgggcgtttatggcgatcaccggctacagccgagaggacgtgatgggtgaacggccgagcctgttcaagtccgggcgccattcgtcgaatttctaccagcaggtgttccagacgctggagcgcacgggcgaatggagcggcgaaatctggaaccgacgcaaaagcggtgaaatttatccacagtggcaaaccattcgtgtgatccacgacgattcaggcaaggtcagccactacgttgcggtgttttccgacatcagcgccatcaaggattccgaacacgaactggcccacctcgctcaccacgacccgctgaccgacctgcctaatcgcctgctgttcaccgaccgtgccgagcaggcactggcctcggcgcaggtgcataaacgtggctgtgccttgctgttgctggaccttgaccacttcaagatcatcaatgacagcctcggccataacgtcggcgaccagttgctcaaggcggtgggcgagcgcctcaaaggcctgttcggccccggcgtgactttggcgcggctgggcggcgacgagttcgcggtgctggccgaaagttgtccacaggtggtgcaggccgccgccttggcccagcgcatgctcgaggcgatgaagcagccgtttatctttgacggccaccagctgtttatcagcgccagcatcggcatcagcctgttccccagcgatgccctcagcgcccagcaactgctgcgcaatgccgattccgcgctgttcaaggccaagagcgccggccgcgaaagctacgccttgtacaccgaagagttgaccgcccacgcgcagaaccgcgtggaaatcgccagcgagctgcgccgtgccctcgaccaacaggaactgcgcgtctactaccagccggtgcatgacctgcacggcagccgcctgatcggcgtcgaagcgctggtgcgctggcagcatccggagcgcggcctggtgccaccgggggatttcatccccatcgccgaacgcaccgggctgattgccgatatcgacgcctgggtgatggatcaggcctgtcgccagatgtgccaatggttggcggacggcgcgccgctgagctttgttgcggtgaatgtctccagccgcctgttcgcccggcgcgagctgtacgagcaagttgcccaggtgctgcacgccactgggctcgatccggcgttccttgagctggaagttaccgaaagcgcggtgatggatgaccccgaagtcgccctcgagcaactgcaccgcctgcgcgagctgggcttgcgcctggccatcgatgattttggcaccggctattcgtcgttgttgcgcctcaagcgcctgccggtgcagaaactcaagatcgaccagggctttgtcgccgggttgccgtgggatgaggacgacgcggcgattgtgcgcgtggtgatcgccctggcaaaaagcatgggcatgcaggtgcacgccgaagggatcgagcaagtggaacaggcgcggttcctgttggagcaggaatgcgatctgggccaagggtattggtttggtaggccgatgccggcacaggagattgattggcaccgggcacccgctatccggacttgaaatacgatcaaatgtgggagcaactgtcttgatggcttttttccaagctgctgttccagagatgacagtgcccccacagcagtacac

SEQ ID NO: 48 - DNA, 101923 bp, Pseudomonas poae FL10F
cgagccttggcgaggctgcgaaagcggtgggtcaggcgaccactctcccaacagtgccgccgccttcgcagcctcgccaaggctcgacagctcccaaatttgatcttcactgccccctgaatcatcggcgtgcttcccaatgatcaggcggctaaccgcgattgaatcaacacagataatcccctgtgggagctgtcgagccttggcgaggctgcgaaagcggtgggtcaggcagccactattccaacagtgccgccttcgcagcctcgctaaagctcgacagctcccacagttgatcttcactgccccctgaatcatcggcgtgcttcccaatgatcaagcggctaatcgcgattgaatcaacacaggtaatcccctgtgggagctgtcgagccttggcgaggctgcgaaagcggtgggtcaggcgaccactctcccaacagtgccgccgccttcgcagcctcgccaaggctcgacagctcccacagttggtcttcattgcccctgaatcatcggcgtgtttcccaatgatcaggcggctaaccgcgagttaatcaacacaggtaatcccctgtgggagctgtcgagccttggcgaggctgcgaaagcggtgggtcaggcgaccactattccaacagtgccgccgccttcgcagcctcgctaaggctcgacagctcccacatttgatcttcactgccccctgaatcatcggcgtgtttcccaatgatcaggcggctaaccgcggtttaatcaacacaggtaatcccctgtgggagctgtcgagccttggcgaggctgcgaaagcggtgggtcaggcaatcactgttccaacagtgccgccgccttcgcagcctcgctaaggctcgacagctcccacagttgatcttcactacaccttgaatcatcggcgtgtttcccaatgatcaggcggctaaccgcgagttaatcaacacaggtagtcccctgtgggagctgtcgagccttggcgaggctgcgaagggatcaccgcgctgtacctgtcaaaccgcagcgcctgcatcgcagcctcgctgaggctcgacagctcccacatcaacgcaccggcggcgcgtactggatgccgccgttgctccacaacgcattgagcccgcgcttgatcttcagcacgctgccctggccgatattgcgctcgaacacttcgtcgtagttgcccacctgcttgacgatttgcaccacccaatccttgcgcagcttcaggtctttgccgtaatcgccatcggcacccagcagtcgtgccacgtcggggttcttcgtggtcttggcctgctcttcgacgttctgcgaggtgatgcccatttcctcggcattgagcatggcgaacaaggtccacttgacgatgctgaaccactcatcgtcgcccttgcgcaccagcggcccgagcggttctttggagatcacttccggcagcaccacgaactcgtccgggtgggccatcttgatgcgctgggcgtacaggccggattggtcggtggtgagcacgtcgcagcgcccggcttcgaggcccttggcgctttcatcggcggtgtcgaaggtgatcggcgtgtacttcatgccgtgggtgcgaaagtaatcggaaacgttgagttcggtggtggtgcctgcctggatgcaaatggttgcgccatcgagttgcttggcggcggtcacgcccagtttgttattcaccagaaagccgatgccgtcgtaataggtcacgccggtgaacaccaggcccatgcccgagtcacgggaactggtccaggtggtgttgcgcgaaatcaggtcgatttcgccggattgcagcgcggtaaaacgctccttggcggtcaactggctgaacttcacttttgaggcatcgccgaataccgccgccgcgacggcgtggcacacgtccacgtcaatgccggtcatcttgccctggctgtccggtacaccaaagcctggcaaaccatcgctgacgccgcactggataaagccttttttctggatcgcgtcgagggtcacgcccgcctgggcactgcccgccaggcccagtgccgcagcggcagtgagggcggccaacgtggtcttgaggttgttcatgcgaggcactccctgtcgaactttattattcggcgccgcacagcccgcgccggtttatagtggtgccgcgcagtatcgacggctttacacccctgccacaaacgacctttaggcaaaggctccttccgatttggaatgaactgcatgatctcaaaacgcttgaccccttcgatgactgccctgcagtgcttcgaagccgccgcccgccacctgagtttcacccgcgccgccgaagagctgcacctgacccaaagtgcggtaagcaagcaggtagcgcagctcgaagaaatgctctgccacaacctgttcgaacgggtgcgccagcgcttgtacctgtcgccggcgggctcgctgtacctggccgaagtgcacaagatcctcacccaggtcgacatttccagccgttacatcctcacctatggcggcgagaccgaagtgttgcgcatcgccacccagccgacgttcggcgaccgctggctggtgcccaagctcaaggattttgcagccaggcacccgaacatccacctggatgtgcgcaatgaactcgaacccttcgacgtgttgcaggccaaggccgatatcgcgtttttcttcggccagggctcgtggccgggggcgacgtgcatcgagctgtttcgcgaagccgtggtgccggtctgtgcgccgggctttgtcgccgaaggcagcgatgcttcgtcgcgccacaccttgctgcaatgcacctcgcgcccggaagcctggcacgaatggttcctggaacagggcctgcattcgcagaacagctaccacgggccgcgtttcgacacgttctacatgtgcattcgcgcggcgcaatcgggctatggcgtcgcgttggtgccgcagtatctggtggctgaagaactggccaacgccagcttgatgattccgtgggattacaccatgcccagcgctggcgcgcattttatcgcccacgccgaacatgccggcgaggtgcctaaagtcaaagccttcctgaactggatggtggactacgtaaaagcacatcccgacttttaataatgacccggcgactttatttcgtttgcggcaaggccgggcgcgcggcttagataaaaacatgcccgtcattgccgagtccgagattcatgaaccgcgaaaccatcagccagtcgatttccatcgttcaccccatcagcctcagccacggcaaaaacgccgaggtctgggacaccacgggcaagcgctacatcgattttgtcggcggcatcggcgtgctcaacctcggccattgccaccctggcgtggtcgaggcgattcaaacacaggcaaccaaactgacccactacgcgttcaacgccgtcccgcacacgccctacctcgaactgatggaccgtcttgccgcgtttatcccggtgcactacccggtgagcggcatgctcaccaacagcggcgcggaggcggcggaaaacgccttgaagatcgtgcgcggcgccactggccgcacggcggtgatcgcctttgacggcgctttccacggccgcaccctggccacgctcaacctgaatggcaaggtggcgccctacaagcaaaaggtcggcgtactgcccggcccggtgtatcacctgccttatcccagcgcggacaacggcgtgacctgtgccgaagcactcaaggccatggaccgcctgttcagcgtggaaatcgacgttgaggacgtggcctgtttcatcatcgagccggtgcagggcgaaggcggtttcctcgccctggacgttgaattcgcccaagccctgcgacgtttctgtgatgagaaaaacatcctgctgattgccgatgaaatccaatccggcttcgggcgtaccggccagcgcttcgccttttcgcgcctgggtatcgagccggacttgatcctgctcggcaaaagcatcgccggtggcgtgccgctgggcgccgtggtggggcgcaaagccttgctcgacaacctgcccaaaggcggcctgggcggcacatattccggcaaccccatcgcttgcgcagccgcattggccacgttggatgcgatgaccgatgaacacttgaaaacctggagctcacaccaggcagaagccattgtcagccgttatgaaacatggcgtacgcaaggtttgccctatgtgggccgcctgacgggcgtcggcgccatgcgtggcatcgaactggccaacgccgatggcacgcccgcgcccaaacaactgacccaactgctgagcctggcgcgggacgccggtttgctgctgatgcccagcggcaagtcgcggcacattattcggctgctggcaccgctgaccatcgagcctgcggtgctggaggaaggcctggatattctcgaggcctgcctcaaacagctgactcagtagcgtgcgtcggcgggcttgccgccgttaggccagtctttgaccttgtcggggaaatccggacgcggttgagtggagaagtacgccgccacgtccaccgcttcctggtccgacaacccgccctgccccagcgggaatttctcgtgaaagccgatcggcatattgcgtttgacgaacgccgccgccgtatagggccgcgccatgccggcgccgatgttgaacgactgctcgccccacaacggcgggtacaccagctcgccatcggcacgcgccagaccctgaccgttgtcgccatggcacaccgcgcattgcttggcgtacacctgtttgccgttctcaaggtccggtttgatcgacgggtcaatcttgcccacgccacgcccggcgactttatcttcggggcgggtgttgtttttcatccagtcgaagtacgcgaccatcgcctgcatatccgccgattgcggcggcaggggcttgccattcatcgagcgacggaagcagccgttgatgcgttcttccaatgtgaccaccttgcccgcacgcggcgcgtagctggggaagaacgccgacacgcccacaaacggcgagccgtccgccacggtgccggcgttgagatggcaactggtgcaattgagcgcgttgccgacgttgttcggcagcagcgctttggtttgcaggtgcaggcgcatgccgcgaatcacttggtcggcattcggcgcggcgagtaaatcggccaggcgtggggtttcgaaagccgacgaatcagtggtggtggggttgagttggtcacgcagttttttcacttgggcggcgctgatcggcgtgccctcgttgccccagcgggtgcgcacaaagctcaggatctcggcgatttcctggtccgccaagcggctgaaacccggcatggtgtagacccatgggtgggtggctgtttgtgcggtttcccagccggtcagggtgatgtgcagcagcgaggtcgggttgttggccgcgatgcttgggttgccggccagcggtgggaacaagcctttcacgccgccgccgtcgctgcggtggcagtcgctgcaaaactgcatgtaacccaggccgccacggctgctgaacaggtcagccggcggcgctgcggggccgtgggcgaccgacggcattggcagatcatctttgcctggcggcagggatttgaggtagctggcaatggccgtaaggtcgccgtcgctgaaatgctgagtgctatggtgaatcacgtcagccatattgccggccaccgtggcaaaacggttctgcccggtcttgagcagttgcacggtgtcttccaccgtccacaggttgcgcaggctcaaggcacgccagtgttcaacggtttcgccggccaggtaatgctggccgctgcggccatcatcactcatggctttttcctggaaggcaatgccgcgtggggtgtgacaggaaccgcaatggcccaggccctggaccaggtaggcgccacggttgagcacctcgttacggttcgggtccggctggaacggctgcgtgtcgagaaaagcaaaattccacagcgccaggccccagcgttggttgaacgggaagcccatgtccgcttctaggttagcctgctgcacgggttcaacgccttgcatcaggtaggcgtagagggcgcgcatgtcctgctcgctcattttggcgtaggacgggtacggcatcgccgggtaaagattcatgcctgtcggcgtcacgccttcacgcatcactttatcgaactgctcgaaggtgtaggcgccgatacccgtctcacggtcgggggtgatgttgctcgaatagatcgtgcccatcggcgtgctcagctccagcccaccggccatcaccttgccttgcttggcggtgtggcaggcgatgcagtcgcccagttgcgcaacgtattggccgtgttcgatttcagtgggagcggcgtgcagaggtagcgccagacacagcgtcgcccccagcaaggccaggcgtggcagggagaaggccatggcattaatcctttaataacctggcgtggagtggtcccctcggcgcaggtaggtcatcgtttttatgggtttatcaggcctgcgtgttgtaacgggttttgccgcgtggggtgttgatgtgggtcagggtcgaattgatggacataaccgtgaagactcaaggattatccaccgcctacccacactgcaaggaagcccccatgctcgatattctccaaggcacgcccctttgggtgtacgccgtttacctgtggatttgttattacggcatcaaggcctgcctgggcgggcgggagaatcgtcgctcgttgatgatcctgccggtggtgttggtggtgtggtcgctgatgtcgctggcgccgtcgatactgtcgagcagtgcctgggtcggcggcgcgctggtgggcagcctggtgggcatactgctgttcaacgccgatggcgcgcagctcgatgccaatggcgaaacgctggtgttgccgggcacctggaaaaccttgctgatctcgcagctgttctttgccgtgaagtattacttcggctatcaacaggcggtgcatccgctgtttttgagcacgccagagatgctggtggcggtgggcgctgtgtcggggtttaccgttggtctgttctgcgggcgggccgtgcggttgcagcgggcgttgacggcgttgcgccgtgataaggccgttgtgctgccttgacctgatctgcctggccactgaaaatgcgcgacgcttttttgtcccgtttactgaagtagtgaaatttcaatgtccgattcttacaccgaacactccaccgaagaatccgtaacagccctgcgatccaaggctgaatacgaaaacgccatcaatctttcacagcatgtgccggcggccaagatcatcagcgagatggtgctggacgcgttccacacctccaaggaaagcgaccagatccgcgagctgcgcgtggccatccgccaggcccacgacgcctttgacgacgacaaggcctacgacctgatgggccagctcaagcagctcaaagacgctgaggccgccgacaacatcgccctggaagacctcagcagcaaattctcgatcagccgcatcctgtccagcttcaaggacgaccccgagttccaggaactggtctacggcctggcgctgaaggtgctgaaccagtcccaccaggcgatcagcaacccaagcgccggcaagagcaaggcctcgcggccgaagaaagaagccgaagtgtttgtgatcagcaaggacggcatcagcgttacgctgccactgcgcacgccgcgctccaagttgaacgtcgaccgtgaggctttggagttcctgggcttcacgtttgtgggtgaaggcagcgaggcggagctggaaagtgaaaccttcgtcgacaacagtggcgaagagcagccggtcacgcgtaaaagcatcgtcaccgcgctgcaacagcaaagcgcctttgacggctacgccatcgccgcgcagtaagcggctgatgcaataaggcgcgcgcgcaatgcgttgcgccttgtgccgtttacgcttccttgttccataacaccgccgaacctttcattacgcccaccgcgaccgcgaacagcagcaagacaaaccctgccagcaaccacggcgacggcaaggatggctgcgaaaccaacataaacgccaacgacggcgcgaccatcacgccgatattcacccccgccgcgtaataacccaggttgcggtccacggtatggcggctggaaatgctgctgacgtagtgggtgatgcccgggaacacgatcatctcgcccaggctccacagcaccgtggccagcatcaacaatgccccgacctgaccaaaccccatcaagaaaaaaccgacgccagccagcaggaaaccggcgatcaacgcgcggctgctcgacaggtgcgccatgcgcaggttgatcggcacttcgaacacaatcaccagcaacgcgttgatgaagaagatgaagcccacgtaatacgccggcagttcggtgtagttgatgatgtacgccgacagaaaggtcggcggcaatgcgtaggccacgtgaaccggcagtgccgccagcagaatcaccagcagccgcgagcgctcatggggcgcggcctccggtaagccctcgcctttgccggccaccggcgcgccgtgtgcctcgggctttgagcgcgcgagatacaggcaggcggcgaaggccagcagggacaacagcgcattgatgtagaacaccgcgttcggatggctcaggaacaccaggctgcccagcaacggcccgatggccatgccgacgttgattgccaggcgattgcaggaaaacgccactttgcgcgtctctaacgtgctatgggcgacggtttcggaaaacgtcgccggcgtgaaggcctcgtagcaggcgccccacagaaacgacaacaccaacagcgcgagcgggttttccaccgaggggataaccagcagcagcaaggcattgagcagcaacgcgccgaggatcacgcgattggcggaaaagcgcttgatcaccgcaccgatgatcaggtcggtgcacagcgcacccgcaccgtacacgcccaccaacacgcctgcggtggctgccgacacggcgtgctggtgaatcaggtacgccgcgtagaaaggaaacgccagggtgcccatgcggaacaccagcgtaatcacgaacaaggcctgcagccgggcattcaggccgcgtaatgcgcgataggtgcccatcagcaaggcccgctgcaacggatgtcgaccaaggcggcgtaacgtttcatgcggctgtcccttcgcaatggtgacgccggttgatccggcgtcacactcaaggcttgggaacgtaatgcagcactgccgggccaacaagctgcccataaggacaggtaaggtcaggacgggtggcggatatagcccagttgcagggccttgcggatcgccgatttaccgttggtaacgtccatcttggcaaagatgttcttcatatgaaacttgaccgtgtgcgacgtcatcgacgtcaacagcgccacttcgttgtaggtcttgcccaggctggcccaggtcagcacttcggtttcgcgcggcgtcagcagcgtttgtggctcaacgggcgcgtgctgttccaaggcctcgtcatacaccgacaccagcagcatctgcagctcactctggaaagcctgcacggtttcgcgaaactgttgttcctcgccgaagctgcacaggttgagcaccgagtagaacccccgattgccatgcacgatgaaactcgcgccctcccccaccggcttgcacgggcctggcaccggcagcgcttcgtcggccggggcgagcaggttttcatcgctccagaaaaacggcttgatgcgcttacgggtcagggcaaccagctcgccgcgccggtagaaatcatccgcggtatcggacggttccagggcatcggggtaattggaaataatctgcgcttcgtccagcggcggcccgcactggtagacctcaaagtgccccaggccacggcggctcagctcggtatcgagcaattgccggacctcttcgggttccaggggcgtgggcgtgtcggggtgtccattgcgtcgcatgcgtatcgtccttgatcattcaacccggtcgagaatgcggcatgccttgcgcgcctgtccaggccttaagcactcaccacctgcgccgcgaacacctcgcgaaagcgctgcatctcgtgcttattgcccaccgtcacgcgcacccagtgcggccagtccttccacacccggccgatcaacacgccgtgtgcggcgagcttctcgatcacctgctcggcgggttgcttcacatcgatcatgaagcagttgctctgcgatgcggtacaggtgaacccccggcccttgagccacgccacggtctcgtcgcgcaactgagtgttgagcgccttgcgctgtggcaacagcttgatgtcttccagactcgctcgggcgcccagcagcgtagaagccgccggcacgttgtcgccgccgaacaccgctagccgttccagcagcgccgggtggccgatcgccaggcccaggcgtgcaccggccatgccgtagattttcgagaaggtacgcagcaccaacaaatcgtcgtggtccttgacccaactgaccacgcttggcgtgtcggaaaaatcgatataggcctcatccaccaccagcacgcagccttggggtttgttcgccagcgcctggcgaatcgcctcggtcggggtgatggtgccggtcgggttgttggggttgcacaggtagagcatgcccgcttggggatcggcggcgagcatcgccggtacgtcgtgggcgtggtgggcgtcgaggcttacttcatgaacctgcgtcttgcaggattcggcggcctggcgtggcacttcgtaggacggtgtggccatgaccaggccgcgcgtgtcgcgggtgaatgccagcaccgcgtagcgcaacgcagccatggaaccggcaaacactgcgacgttttcttcggtgatgccttgctgctgggcaaacaacgcggctagcgcgtacatgtccgggtagggataacgccccgacgtcgcgaccccgcgctgcatggcctcacgcgcagcgcttgaagggccgtaggggctttcgttgtagttgagccgcaccttgtcaggcttcgccggcgacggggcggcgagcgcccaatccagatgcccgagcacgggcagggccgcaccgagggcgagaagggaccgacgacttacgctgaccatggggctactccttgtagacgggtgatcgattcgcacagtgcgtacaaggaagtatgacgaggaaggtgtcggctgatttaaccggcgccggggaatcagctctccaagtagtcggcaatgggatagcgcgcgcacagggcttcaacctctgaacgcgtctgctcgcaaactgcaggctccaggtggtattcctgctcgcccagcggtgtcacaccgcccagcacccggcaaaccagcgcgatgacctggcggcagccttcacgatccagcctgcgctgcgccatggagccggtgccgatacacaacccgctggtcaccaacgacgagcgtgtctcgcccggcacgcgatgcttgttgacgacgatgccgcactgctccagcgccgactcggcgatagccccggtcatggcgccttgcaagcggatcaacagcgtatggttttcactgcgcccgccgaccacgtcatagccattggcctgaaacgcgcaggccgcttcatcggcgagtgtacgaacccggcccatgcaggcgtcgaattgcgccgatttcgcgtaacccagcgcggcggcttttgccgcgatcaggttgaccgccggcgcgccctgcatgcgcgggaacacggcctgatcgagtacgcgactgaaggtcgaacgcaaaccggggactttggtgttggcgtcgcggcccgacagaatcagcccgccgcgagggccgccgagttgtttgtgggtgcaggtgacggtgacgtgggcggcgttgatcgggttcgggtgacgccccgtcaccaccagcccggcgatatgggaaatgtccgccaacaggatcgcgcccgcctcatcggcaattgcgcgaaaccgctcgaagtccaccacccgcgagtaagccgacgcaccacagataatgatgcgtggccgatgtgccaacgccaggctgcgtacctgtgcgtagtcgatcaggccatcggcatcggtgccgtagcgaagggccttgtagtaggcgcccgtgaacaccgccgggctgccaagggtgagatcgccgccgtggtcgtgggccatgccgagcaaggtatcgccaggctccagcagcgcgctgagtacttgggcaatcgcgttggaggccgagtgcgactgcacgctggcgtaatgggcgtcgaacagttcgcgtgcgcggcgaatggccagggcttcgaccaggtcgacgttttcgcagccggcacgctgacgtttgccgggcatgccctcggcgcttacgttgaccaatgccgaggcacacgccaccagcgttcgtggtgtgaccgcgcaggaagaggaaaccagagacagggtgcggtgctggcgcaagacctcggcatctaggaggctcgccagctcgaaatcttcggtgtgcagatcggccaggccacgacgcagcaagtcggcctggtctttgaggtgtgcggtgttgactgccatcggtgcgggtcccttcctgggcgttgcatgccggtccatcctgaaccgcgggcttttattaaacaggaaattaaacaggaaattaaacattttccaaatttaatgtgcttttttgcccgaccgtaaccaggcgtcggcgcaggaacagcgcacccgggactttattgttagggcccacgcatgcaacactcccgccgccgcgacgccgcacgcgccgcgcacagggacggcatgactaaaaggaagtggtgagtacgtgatacacagacgggaaaaaaccgagcacttgaagagcaacatcaagtacttgatcaaaagccgcggcgaaacgcagctgtcgttatgcagtgccgccggcctgaccaggaccaccatctacaacatcctggaaggcaaggtcgttaacgtccagcagtccaccattcgcaagatttcggatttcttcggcgtctcttacgacgaaattgaaaccatcgattttgaagccaaggaaatcatcgagagcagtgtttccccccagggcaacatgaacccggcggccgtgccgatcctcacggaaagcctggtgatccagaacctggacaagcgcattggcgaactggcgacgctgtacccgctgacctactacttcggcacctcgcataacctgatcgcggtgcgcctggaacacgcgatccccggcatcaatgagccgggagatctattgatcgtgcaaaaaggctcgtcgagcgacggcaaagaaaagctggtgtacgaccgcgccaccaaacgcatgttgatcacccttgaagcctctgcccactcggaccgcctgtgcgtggtcggcgatatcatcgaggagcgcttcaatgaccacgtatgaagccggcatcgaaaacagcaaatacaaactgctgggctttgaaaatgacaagcgcctggccgtgatcatggtgatcgccacgggcaaggtcatcaagatgaaactgagcgaagtactcaacagcgaaataatggacaacttaaacaaaatggaagttaagaacatgtacaagaagttttattcgcagggcggggcactcaccgcctacgatataaacgatcgcaatgaaagctcctggatgatttacatcattctgaacttgctgctcttcacgttttatatcttcaccagcattgccgcgactaagccgctttacctggaatcgctgggcatcatcgttacgccgggcacgtttctgtatccgctgacctttttgatcgtggatttgcttaacgagcaattcggcctgcgcctggccagaagggccattttgtttgcgtttgccagcaacgcgatgatcatcatcttgctgtatggctcgacctttctgccggggctgccgggctggaagctggacgggccgtataacgacgtgatcattcaagtgtcttcggttctggtcgcctcctccgtgtcgttcctggtgtcggagaacataaactcgtacttgctgtgcaagatcaaggaactgaccaattccaaatacttgtacctgcgcattttcttcagcacgttctttgcggtgattatcgacagcttcctgttttgcttcatcgccttttacggcgcgatgcagaccagtgacatcctgagcatgatctacgtgcagattgcgattaaagtcggttttgcgtttttcaacatcgcaccggcctatggggcgcgtgcgttgttcaagcgctggattaccggtactgccagctgatgtaattcgctctcaatgtgggagctggcttgtgtgggagctggcttgcctgcgatgcagacacctcggtgtttcagatgtaccggggtgatgctatcgcaggcaagccagctcccacacaagcccgctcccacattttgatcgagtacagcttgctggcccctaaaccctagctcagctgcaacttacccttcaggctctgcatcacatcggccttgttctgcaaatactcattcaaaccccgagcccgcaggttgcacgcgtcgcagttgccgcagccactgccgataacgccgttgtagcaggtcagcgtctggtgacgcaccagctccaactggttgtggtaatcggccaaggcccaggtttcggccttgttcagccacatcaacggcgtgtccaggcgcagcttgtattccatgcccagctcgagtgccttgttcaacgctttgacgaactcgtcgcggcagtcggggtagcccgagaagtcggtttcgcacacgccggtgatgacggtttcggccttcacctggtaggcgtagatcgacgccagggtcaggaacaggatattgcggcccggcacaaaggtgcttggcaggctgccaccagagctgtccacggtcggtacgggaatgttgtcgcgggtcaggctgctgatggccagctcgttgagcaaggacacgtccatgactttgtggacggtggcgcccaactgcttggcgagcttctgggccacttcgatttccgccacatggcgctggccatagtcgaatgtgatgcagtgcacttcgtcgtacagcggcagtgcctggatcagacaggtcgtggagtcctgcccgccactgaacaccatcacggcttttttagtcattacgttgcttcctgcaggttaaaaatgtgggaatagtttaaaggcccagccataaaaaaccccgcgcttctttcgaaggcggggttttttaatgctcgatgactcagtgtgcgtaggtcagcaacagctctttcggcacttggaaatccagggacatcatcacgctgagcgcggtgatggtgaagatcgagaacacgaacagcttgcgcgcccagacggtgtcgtccaccgccttgtagccggtccaggccatgtacaaccagtacatgcccatggccgccgcgacggcgaggtagctcatgccggcgtagccactgaaggtcaacatcaaggtcgccacgaggaaggccaggatgtagagcaggatgtgtttcttggcgacctggatgccacgtttgaccggcagaaccggaatcgaggcagccaggtagtcattgaagcggaagatcgcgatggcatacgagtgcggcatctgccacaggctgaacatcaccagcagcaccagcgcggccatgtcgaagctattggttacagccacataaccaatcaccggaggcatcgcacccgacaggctgcccaccagcgtgccgtgaaccgacttgcgcttgaggtacaggctgtagaggccgacgtagatgacaaaaccgatcacggcaaacagcgccgccagcgggttggccaccttgtacaacaatgccacgccggcaacacccaggacggtcgcgaacagcagtgccagtttcagggagatcaggccctgcaccagcacgcggttcttggtgcgttccatcttgatgtcgatgtcgcggtcgatgcagttgttgaacacacaaccggaagctaccaccagggaagtgccgatcattgcagccaggaaaatggccagatcgacatgtcccttggaggccaggaaaaaaccgcctgccacagaaagcacgttaccgaaaatgatccccggtttggtgatttggataaagtgcttaagcgacatcgggttttacctcacttcgccatcatgaacgtatggatgctgaacatgatccagatcgacagaccaaccagcagcaggatcacaaggcctgcgaacacaaatgcaatcacgttatcgcgctgctctttggaacggtccaggtgcaggaagtacaccaggtgaaccagaacctgaatcaccgcgaacgccagaacgatcatcaaggtgatcgacttcggcagggtcgggtacatcaccagaccgaacgggatgagcgtcaggattaccgacaggatgaagccgatggcgtacgacttaacgctgccgtggcttgcatcatggctgtcatggtcatgggagtgtgcattagccattacagagtccccatcaggtaaacaacggtgaagacgcagatccagaccacgtccaggaagtgccagaacaggctcaggcagctcaggcgagtcttgttggtgttggtcaggccgtgtttattgacctgatacatcatcaccgccatccacagcaggccggcagatacgtgcagaccgtgggtgcctaccagcgtgaagaacgcggacaggaagccggaacggtgcgggccgtagccttcggagatcagcagatggaactcgttgatctccatgccgatgaagcccaggccgaacaggaaggtcagtgccaaccagctcagtacgcctttcttgctgcccttgtagaaggccagcatggcgaagccgtaggtgatcgaactgaacaacagcaaggcggtttcgccgagcacgtaaggcagttcgaagatgtcgtggcccgacgggccacccgctacgttgtttaccagtaccgcgtacaccgcgaagatcgacgcaaacaagatgcagtcggtcatcaggtagagccagaaaccgaatacggtcattggccccgagtcgtggtgatggtcatcgtgcccatggtcatcgacatgggcgtgtccagcattggtcactaagttcgacatggtttaagcctgttccaacgaggtttctacacggttggccgggattttcttctcggctaccaggcgagcgtgttgctcggcttcgatgcgctcgatcgtctcgaccggcaccatgtagccttgatcatcacgggcagcgtgaatgatgaagtaaccgatggtgcctaccaggcccacgattgccagccaccagatgtgccagatcatcgcgaaaccgaacacggtcaacagcgcgcccatcaccacgccagtggcggtgttgttcggcatgtggatcggctcgtagtgcttaggttgctggtacgcagtaccgtcttccttggcttcggtgaacgcatcgatcgtgttcgcagtagggatcacagcgaagttgtagaacggcggaggcgacgaagtcgaccattccagggtgtggccattccatgggtcgccggattcgcaagcgttctgcttacggtcacggacactcacgtacagctggatcagctggcaggcgataccggcagcgatcatcaacgcaccgaacatggcgacgtacaggtacggcacccactcagggttggtggtggcgttcagacgacgggtcatgcccatgaagcccagtgcgtagagcggcatgaacgcgacgaagaagcccgagatccagaaccagaatgcagccttgccccaaccttcgtgcagcttgaagccgaacgctttcgggaagtagaagctgaaaccagcgatgtaaccgaatacagcaccaccgatgatcacgttgtggaagtgagcgatcacgaacaggctgttgtgcagtacgaagtcagcacccggaatggccagcagtacgccggtcatgccgccgatagcgaaggtcaccatgaagcccagggtccacagaacctggctggtgatgcgcagacggccgtggtagatggtgaatagccagttgaatagcttcacccccgtcgggatggaaatcagcatggtcgccaggccgaagaaggcgttgacgctggcacccgaacccatggtgaagaagtggtgcagccacaccatgaagcccagtacagagattgcgcccgatgcgtaaaccatcgagtggtgaccgaacaggcgcttgccggtaaaggtcgagatcacttcagagaagataccgaacgctggcaggatcaggatgtacacctcagggtgaccccatgcccagaacaggttcacgtacatcattggattgccaccaagttcgttggtgaaaatgtggaaatccaggtaacggtcaagcgacagcagcgccatggtagcggccaggatcgggaacgaagccacgatcaggacgttggcccaggtgcaggtccaggtgaagatcggcatgtccatcagtttcatgccaggggcgcgcattttcaggacggtggccaggaagttgacccccgtcaatgtcgtcccgagccctgataactgtagcgcccagatgtagtaatccacacccacgccagggctgtactgaatgcccgacaacggcggatacgcaacccagccggtcttggcgaattcgccgacgcccagggacaggttgatcagtaccacgccggaaaccagcagccagaagctcaaggagttcaggaacggataggcaacgtcacgcgcaccgatctgcagcggcaaggccaggttcatcaagccggtgaagaatggcatcgccatgaagatgatcatgatcacaccgtgagcggtgaagatctggtcatagtgttcaggcggcaggtagccaggcgaaccctcggtggccatggccaactgggtacgcatcatgatggcgtcggcaaaaccacgcagcagcatgaccatggcaacgatgacgtacatgacaccgattttcttgtggtcgacagacgtcaaccactcggtccacaggtaggtccacttcttgaaatacgtaattgcagcaaacagtgccagaccacccagcgcgatcatggcgatggtcaccattacgatcggctcgtggaacgggaccgcatcccaacttaatttaccaaacatcgtttactcctctgccccagcagttgaatgcgagcccgtgtcagaaccttcaaccacggccacttctttcttctcgtgcttgaccggtttgcctggcttcataccttcgtacttgtcgacgattttctgaaacaggtccggcgtgtacgtggagtacagagcgactgggttgttctggcttggtttggcaagggcgtcgtattcagcttgatcaagctgtttaggtgcggccttgactttggcgacccaggcgtcgaaatcttcctggctcgtcgagatcgctttgaatttcatgccggtgaagccagcgccgctgtagttggcggagatgccttccatttcagctttctggttggcgatcaggtgcagcttggtctgcatgcctgccatcgcgtagatctggccgcccagagcagggatgaagaacgagttcatcacggcgtcggaggtgatcttgaagttcagcggagtgtgctccgggaactggatttcgttaacagtggcgatacccaggtccgggtagatgaacagccacttccagtccagcgcgaccacttcgatgttgatcggcttgacgtcggattccagcggacggtacgggtccagagcgtgggtggacttgtaggtcacataacccagggcaatgatgatgaggatcggcaccagccagactgcaacttcgatcttggtggagtgcgaccacttcggcgcgtaggtggcgctggtgttcgacgcgcggtatttccaggcgaaggcgaaggtcatgatgatcacggggaccacgaccagcagcatcagcagggtggcggtgatgatcaggtttcgttcatccagaccgacctgtccttttgggtcgagcaaggtccacttgcagcctcccagcattaacagcatgccaagcagcggcaaaaagcctagtaatcgggggtacctgtttttactcatctcacgacctctaaagcagcttgcgcaatgcagttgggttttgatcgccaacacttcaccctgccaagggttggcatttctcttcgattgaataagagcctgcccggcacgccataaatggacgtttcacggacctgcggtgagttcttattcgatttcgtggttaaaggccttgttacagaccaattccatttggtgcggatagttgaaaggcttgccggaacctggggtcgcacagagccatccatctgcccctcgaccgctccaatgctcaaatattgaacagcaccggacattcagtgcgggcgattgtagttagctagcgatgtataaaccatgtcttataaagaaataatttttatcgattccagcaacaatccttcaccaatcttgcaaaggttcgggatcttatcgtgttcgattctcaacaaaaaccacaaaaattgccgtgttattgcgtaaagcaccacagcccttacagcttgtaagggcatgcaaaacggatccaagtccccataaaacaaggcattcggacatcaccgattggctcggactgcgcgacattcgtggcatcgctcaaacgacgaactgacagcacatcttggcggttttatgcaaatttaagcggtggccgggtgcgtcagaaacgtcctgcgacagtgtccgtgtgacaacatgtcgcacgctgcgcgcacctgatcttgtccttcgtcacgcccctttcacaaatccctacatacaaaaacgccccgtccttccttgaatgaagaacggggcgtttcagtgagtcgggtcaggccttgcgttggcgattccgatagatgcccagtggcaccaggatcaccgtcagcacgaacgccaccagcgcccattgcgccagggacaagcccaggatcggcggatacggcgtgctgcagaagccgtccacctggaagcccagggggaacaccttggccagtggcaagtcatcgacgatcggttgcagcacgtcgatgccgcagctgacctcggggaagaactgggtgtacacgtgatgacccgccgccgccacgccgcccagggcgctgaggaccaccagcccttcaaacagggtgaccgcgcctttggtgcgcatggcggcgccgatgaaggcgaagaccgcgatcaacagcaacgcataccgttgcaggatgcacagcgggcacggcgcctcgcccaacaccacttgcatgtacagcgcaccgccgatcagcgccaggcagatgatgcccagcaacaccagaaagcgccgctccctgcctaaacgcaattcgtcactcatccccgtttccctttgcctgattatggttgtgcctgatggccgcaagtttacacacaggggatggttaaaacattggggggttaacaggggattaatctggaggaatagagaaacaaatgtgggagcgggcttgctcgcgaaggcggtgtttcagtcgacttattaagtgactgatccaccgctttcgcgagcaagcccgctcccacattttgaacagtgttgtgcctgggacggttattccagggccgaggccgggccgaagaattcgtagcgcgcctggttatcagggacgcccaaagccttcaggtggcgtttgatggcggccatgaagcctttagggccgaggaagtaggcgtccaggtcgcgccgctcgggcaaccaggcggccagttgctcctggctcagcatcccaaccttgtccgccgccgggctcacgccatcgtcttcggcgtagcagtagaagcgcttgagctgcgggtgcttggccgccagggtgtccacccagtcacggaacgcatgcacgccgccgttacgcgcgcagtggataaagtgcaccgggcgctcggtggccagggctgcttcgagcatcggcaaagtcggggtgatgcccaccccgccgctgatcagcaccagcggtttgtcgctggccgccagggtgaactcgccggagggcgggaacaggtcaagggtggcgccgacgtgcatctggtcatgcaggtagttggacactcgcccgcccgcctcgcgcttgacgctgatgcggtacacgcccgcgtcactcaaggcggacagggaatagttgcggcgcacctcctcgccctccagcaccagcctcatgccgatgtactggccaggcgcggcggccaggatcgggccgttatccaccggggcgaagtagaacgaaatgatttcgtcgctctcctctacacgtttcaccagcaggaacggtcgcgcaccgcgccagccgcctggagcctgggccttttcgtcgtagatcgcggcttcggcgccgatcagaatgtcggccaactggccgtaggccgcgccccatgcactcatcacctcaggcgtggcgatctcgctgcccagcacttcagagatggcacgcagcaggcacgcgccgacaatcgggtagtgctccggcaggatctgcaacgccacgtgcttgttgatgatcttggccaccaggtcgcccaactggtcgagctggtcgatatgccgcgcgtacatcagcacgccgttggccagggcgcggggttggtcgccgctggcttggtgggcctggttgaacagcgggcgaacctcggggtactcgctgagcatcatgcggtagaaatgcgtgatcagggcttcgccgccgctttccagcaggggcacagtggatttgacgatggcacggtcttgggcactaagcatggcagactcctgagtctttttactgattgcccttctctactcagtattcgtgccaacttataagtcgtttattttcaatgacttgagtaaaacctagtcaatatgacttcctacgcgatatagtcataaggactacaaggagtcattatgactgcacaatccctactcaccaccctgctgccgctggtcgccgacctgtcccgcgagctgcctgaaggcgagcgctaccggcgcctgctgcaagcgatgcgcgccctgctgccgtgcgacgccgccgcgttgttgcgcctggacggtgaatggctggtaccactggcggtggatggcttgagcgccgacacccttggccggcgcttcaaggtcagcgagcacccgcgcttcggcgtgctgctgagcagcccgggcccaacccgctttgacagcgacagcgaactgcccgacccctacgacggcctggtcgatggcctgcatgggcacctggaagtgcatgactgcatgggctgcccgctgttcatcgacgacaagccctggggcctgctgaccctcgacgccctcgacaccgagcgtttcgagcgcgtcgaactggatgccctgcaagccttcgccagcttggctgcggccacggtcaacgtcgctgatcgcatcgagcgcctggcgttgcgcgccgaagatgaacatcagcgtgccgagatctaccgccaggccagcggccagcagcacaaggaaatgatcggccagagcaaggcgcacaagcacctggtcgaggaaatcaaactggtgggcggcagtgacctgaccgtgttgatcactggcgaaaccggcgtgggcaaagagctggtggcccaggccatccacgcggcatcggcccgcgcggacaagcccttgatcagcctcaactgcgccgccctgccggaaaccctggtggagagcgagctgttcgggcatgtgcgcggggcctttaccggcgcattgaacgagcgccgtggcaaattcgagctggccaatggcggcactctgtttctggatgaagtgggcgagttgtcgctgaccgtgcaggccaagctgctgcgcgtactgcaaagcggccagttacaacgcctgggttcggacaaggaacaccaagtcgacgtgcgcctgatcgccgcgaccaaccgcgacctggccgaagaagtgcgcaatggccgctaccgcgccgacttctatcaccgcctgagcgtgtacccgctgcaagtgccggcgctgcgtgagcgcggtcgcgatgtgctgttgctggcgggttttttcctcgaacagaaccgttcgcgcatgggcctgggcagcctgcgcctgaccagcgatgcccaggcggcgctgctggcctacaactggccgggcaatgtgcgcgagctggaacatttgatcggacgcagcgcgctaaaagcactgggaaactgtcgcgaacgtccgaagattttgagcctcagtgcccaagacctcgacttacccgacgtcagcgcgtcgccggtgatcgaagcccaggccgaaaccaccgccgtcgccaccggcgacctgcgccaggccaccgaacactatcaacgccaaatcatcagcgcctgcctggagcgccaccagcacaactgggccagcgccgcccgcgaactcggcctcgaccgcgccaacctgggccgcatggccaaacgcctcggaatgaaatagaaaggtcaccacaatccaaatgtgggagcgggcttgctcgcgaatgcggtgtgtcagccactcattcatcgactgatacaccgcattcgcgagcaagcccgctcccacatttttaaatctgcttagcctttaataccgggttcacaagctgagagggcctaaccttcctgaacaccaacacattccccaacatcaccaacaccaaccccatcaacgccggcgccgtccactgatacccctcggcaaacgccgacacattcagcgccaccaccggaaacagcaccgtgcaatacgccgcccgctccggccccatacgccccaccagcgtcaggtacgcggtaaacccaatcaccgaccccggaatcaccaggtaccacagcgccccgacataccgtgcgctccaatccatgtcgaagggaatcccacgcaccgcgcaataagtcgccagcatcaccgagccatacgccatgccccaggcattggtggtcaagggcttgagccccgccttctgctgcaaactggagagcatattgccggccgaaaaacacatcgtccccaacagcgccaagcccaggcccagcaaggtctgcgggctggcggtatgcccgaccaattcaggccagaacaaaaagcccaaccccaccagccccagcgcgccgcccatcaacacgttacgcgccacccgctggccaaaaaacacccgcgcattgagggcgttccacagcgtggccgtggaaaacaccaccgccaccaaaccgctggggatccactggctggccgtcagaaagcacatgaagttgacgcaaaacaggcacaagccttgggccaggcagatcaggtgcccgcgccggttcatcacctgcaacttgcggctgagcagcaacagcgcaaacagcaccaatgccgccaggccgaagcgatagacgatcgacacaggaatggccacgacgcccaactgccacttaagggcgatccaggtggtgccccagatgagcacggtgagtaaatacaggaaaaggttcatggtgggctccggtgattgagccacagtgtcgcccgccgccccgggagcgctcttgcatattcttgcgcttttgtcgggtgccgggatcacagcaacggcgacgcggagtaggatgcaaggcgtcggagagatcaaccatgccagacctggaatcgctgcaagtctttcaagccctcaaccgctcgcccaacgcacgccttgaagcctgcgccgagctgggtgacggcttgtctgcagctttgtggagcaaccatcacgacgcccaggattaccaggcgcccacccaccacacgttgtcctgctacatcggcggcggcaccggcacgtttcgccgcgaccagcccggcaccaagggcggccccgataaactgtgcatcctgccggccgagcaccagtcggcctgggtgatcaacggcgagattcgcctggcccacgtgtatttcagcccggagcaattcgccctcgggtgcgtcaccttgctcgaccgcgaaccgcgcgaactgcaattgcgcgaaagcacctttcttgaagacgccagccaggcccggcgctttcaccagttgatcgccctcaattggcacgagcccgccgagcgcctgctgaccagcagcctggcgcatgaaatgctcagccacaccttgctcagccaagtcggcgcacgcgacgggctgcgtttgaaaggcgggctggccgcgcatcagcgacggctgttggtcgactacatcgaccaccacctggaagacccgatcagcctggggcaactggccggaatgtgcgcgttgtccgaataccatttcgcgcggatgttccgccaaagcttcggcctgccgccccatcaatacctgctggcgcgccgcctgacgcgcgcacaaagcctgctgcgcaacggcgccctgcccctggccgaaatcgcctggctgtgtggcttctccagcgccagccacttcagccaacgcttccgccaagccacgggcgcaacccccggcgaataccgccaagccttctgcacctagcgcacaacctcaagccaacaaagatcaaatgtgggcgatcaatgtagaagaccaatgtgggagaccaatgtggtagatcagtgtggaagatccctgtgggagcgggcttgcccgcgaagacgtcagcccagcaaacattgatattgactgacccaccgctatcgcgggcaagcccgctcccacagggctttacccttaaaggtttttttgttcctaccccatcaaccccaacatcttggccttcgccaccgcctgcgtgcgccgctccacaccaagcttgctatgtatacgccgcgcatgagtcttaaccgtgtgcaacgaaataaacaaccgatccgcgatttccaaattggaattacccagagcgatcaactgcaacacttccaactcccgctggctcaacgggttctccaccaccccagtggacgacgtctgcgcctccagacccaactcactcaacaaccccggcgagcgcaaacgcagctcacgaatcgcctgctgcacttggcaacgccccgccagctccaaaccagtttgcagcgcactacgggccaacgccggatcccccagttgccaagccacctcacccagcaccaactgcaactcggtttccaggcaaagcatgccgcgttgccgggtggtatccagcaaggccttcagccgctcaataggctgctcggcacagcccaacttcacctcggccagcaccaacaaatactccaggcgcgggatgagttccaaggtggccggcggtgcttgcttggcaccagccccgcgaaagtgacgcagcactcgacgcaccgcttccagggtcaattcggcgcggccctgctgcaaccagaagtgcccactgaccaacagcagcaccgcgcgatacaccgtgtccggcacgtggcgttgctgcatcaaccgctcggcctcgcgcagttgaataaaggcctgggcgtaatcgccacggttcgccgccagcagcgccaggccgagaaacccatacaacacgcgcttgtcctggctgtgcaggcacatcgtcaaaccggcctcaaagcactcggcggccaggctgtcctgcccttggcgcaacgccaggtgcccgcgccgcaacgcgatccgccccgccaagggcccggccttgagccgctggcgaaccagcatcgcctgcacattttccagcaggctttgcgcccgatacggcgcgccgcgttgctccagcaattgcgcgtgatccagctccagcaacgcctcaagcactaacgagccatgggcgcgggccaggcatagggcttcgcggttcaaggcttggcccacgtccagttcaccgcgcagcaaggcttgctgagtcagacccgacaggcacatcaggcgcgaggtccaggcgctgtcgggcaaggcttgcagcgcctccaggaaatgctcgcaggaacgctcggcatcgccgctcaaatgcaacagccagccccattgcgcctgccagcgcgccaatagataacgctgttgcgccgccgtcggttgcggcgcgaaccgggccaattggtcgatacacacggccgcctggtcgaagcgcccggcaaacagcaatgccgccgtgaccaagccgaccagttgcgccgaaccgagcatcaattcatcgccatgctgctcatgcagacgcaacagcagcactgcgttctgctggcggaacaggtcttcgaaactgaagtgctgcagcaggctcaccgccacttcataggcttcggccagcagcgcctgttcgaaggcagcctgccagtcctcttgtgtggtgaaccattggcaggcgcggcggtgccagccgcgcttggccggccaaggctcatcgcggatcaactgcgccaggggcgggaacacctgcagccaatcggtggtgtcttcccacggttggataaacgcaccgagcgcctgtaaatcgcgcaggtactgatcgccgtcgccagcaccgaacaggtgctcacacaggctcggattgaagcgcggcaaatgcgccaatacgcgccaggcctcggccagttcggcgggcaaggtactgaagagttcgtgttgaaggtagtcgagcagggtcttgtccgggtgaccgtcgcccagcaaagcgatgcgcacgcccgcgcaccaaccgccgctgaattgcatcacgctgtcgacgctttgcgcagggccgagcaactgctcgatttccgcagggctgaacatcaactcactgcacgccaataactcatcgtcgagcagcaggcgcggccagttacacagcgggcgccgccgtgtgcccagccaccaggtcagcgtcgggctggcggcggtgagcaaacggtcgagcaaggcgtccagttcgggggcgggcaggcgacagaaatcatcaaggaatatccacgccgtggtttgccagcggctgaggtcgagcagcaaggtggcttcgtcgataaacgccaggccaaggttttgcgccagccgggcgcagaacgcctcggcgctgagtacggcgccattgagcgccagccaatacacttggcaccccaccggcgcctgcaacgcacactcggcgagcaacgcgctcttgccgctgccgcccggcgcgcagagcaacttcaccctgacctgcgccgcgagcaaaggctcggccaagcgtgggcgcaacaggtggtgagcggacagccgtggcatgaatccaggacggtccaggcagcgtgtcatggcggtcattgctgcatcctgctttttattgttatgcaacctggcgcctaccctagtcctgtggtcggcggttgttgaagaagtattcagcggggtgatttatagccatgcacaaaaccaaatgtgggagcgggcttgctcgcgaaggcggtgtatcagtctaatcattcggtgactgacactccgcattcgcgagcaagcccgctcccacattttgatcccggttggattgaagatcagcgcacgccctcagacctcaacgccgccggcgtgtagtccgccgccttggccgcaaagccgaacacgaaactgtgtttctcctcgttcttcatccccagcgcgatgtagcgcccggcgatgatgtcgtacagcgtttccacggtgtaggccggcacttggtggtcgtagtagaactgcgcatggccttcggcgacacgccacagttggccacggccgtcgtagtgatccaccagcgcgacttgccagctgtcttcgtcgatgtacatgtggcgcttggcgtagatgtgccgctcgctcggcttgacggtgccgaccacttcccacacccggtgcagctcataacgggtcaggtcctgattgatatgcccggccttgatgatgtcgtcgtacttgagggtcggcgaatcgagcttgtagctgttgtaggggatgtacatctcttttttgcccaccagcttccagtcgtagcggtcgggggcaccggagaacatgtcgaagttgtcggtggtgcgcaggccgtcggaggcggtgcccgggccgtcgtaagacacttgcggcgcgcggcgcacacggcgctggccggcgttgtagatccaggccaggcgcggctccttcacctggtcgagggtttcgtgcaccagcagcacgttgcccgccaggcgtgccggggcggtcaccgattgcttgaagaagctcagcacgttggccgccttggcctggtcgatatcggggatggcttggggcaccgccacttcttcttcgaagcggatcggcgtgtagctgccattcgtttgcggggtggcctgggtgatgatgcgcttgaggttgccgccgtggtaccgggtgatgtggttccacaacacttccacgccattcttcggaatcgggaaggcgtagtagcggttgccggtgaagttttccaggccattgccgtcgttgatcgcgtgcacattaagcgcactgcgcttgatcgactcgtagatgtccggcggcaggttaaccgtgcggtgggtcgggtacaccgggatcttgtaggtctcggggtagcgcttgaacatcgccacctggccgtcggagagtttgtctttgtacttgtcgaccgtggcggcggtgatcacgaacagcggtttttcgttggcaaatgggtcggccaaaaagcccttgctgtccaccgcaccggcgtttttggggatgccgccggtccaggccgggatcgagccgtcggcgttgccggctttttcggcgccgaccggcgtgaggctggtgccgagcttggcggcttcttcggtcgacaccgccgccatcacgtgggcggccagcagactcagggccatcactgcaaatatcttacgcataggttgttgtccttccttaaacctgatcagaagttcacgccgaagctgagggcgataaagtcgcggtcggtgagggtgttgtagtcgccgccgaaaaagtcggtgtagctgaggctggcggtgtaggtgttgcggtagtccgcgtccacgccgacgctgatcgccttggcgccttcgttgaaaatcccgttgggcccatagccgctgacgtcatgggaccaggagaggttgggcttgaggttcaccccggcaaacacgttgttgtagtcgaggatggcgcgggcgcgataaccccaggaattggcagtgacaaagccatcggtatcgccttggaaaccataggcgccgtacaccgagtcacggccgtaacgcagtttggttttggcctccagcccgccgacgtgcacgaacgccgcctcgcccaccaaggtcaggcgttcggcgcccagcacctggtcgaagaactgggtcatggtgctctggatctgggtgatttccttgcgtcgataaccggcgttatccgagccgaacgagctgcggatcggcgaggcggtctggccggcgatcgggttgaccagcgccagggtcaggtcggtggtgttgagttgcaccggcgcgttcggccgatagctgatttcgccggtccaggcggtgccggtgggcaaggtggtggagaaactggcgccgtacaggcgaatgtcttccgggtaatcgaggtaatactggccacgcccgagcatggtgctctgggccaggcccgagccgctgccaggtgcgatggcattggcggtggccgcaattcggccgatggtcgccaggttggtgttggcggtcagcgtgcccacggtcggcgtgcggctgtggtagttcatgaagtacaggccgtactcggtgtcatcgccgagccagcgcaaggccgcgccgaactggccgccatcgcgggcttcgcggtccttggcgcgctgcaccaccacgccttcgcgcgtgacttgaaagccctggccgaacgctgcggccaccggttgcaacggcgcaatcgccgggctgccgacggtgtagttgttgttgcagccgtgggcgaccacgtcgttaccaaagaaggtgccgcagttatccaccacggtgttttcccagttcagttggtagaaaccttcaaccgaaagctgattggtgaggctctgggaggcaaacagcatgttcaccggaatcaggccttccttgatctccgcacctggacggcggaaggccgacacgtcgatggggttgatgctgttgatcgagttgccgataaacgtactctcgccccaactcaccacttgcttgccgacgcgcacgttgccgggcaggtcgccaatcgaatagttgtgatagacgaacgcgtcgagcagctcatagccggaagagcgcgcgccttcgtcgcgatggtggttgctgatctgcttgaactcgcggtcttcgtcctgcagttcgaagtcgtaccagtatttgccgcgcacgaagacgccgctgtcgccgtatttgagctccaggtcgtggatgcccttgaagatcttggagaaggtctcgcctttcttgaaattcagccgcccgtcatcaccggtagacgcctgccccgtgccgccattgggcacgcccaccagcttcttgtcggcatcgcgcatgccccaactggcgcccaccgacagtgaggaatcgaattgcccttcgatctcgccaatgttgaacgaaacagcctgtgcctgggcgcagcagcccagtgcaaccgccgcagccagcgcctgtggcgtgaagatggcgcgcattgttgtttttgtcatgcgtcttccccggtgagtgacagaaggccccaccctactgccgctcgtcaggagcgataagcgcaccaaaggggtattcgcagtgtcgctcgaaaggattaacaggcgctctggccggggtttgcgcacggctatggattggatagatgacgggttatcaaaaagatagataggccgatgatcgttcccacgcgcgatgatcgttcccacgctccgcgtgggaatgcctccagggacgctccgcgtccctccgaagcccgtcaccgcctgcatttccacgcggtacgtaggaacgatcgttactgattttgtaacagtccttgtcctgaaccgctattactcattttgttacagacgactattctaagcgggctttcagggcaaacagcccgcttgtgtaaaagcaggaaaagtctgattccaatagattgacccgttgtatcaatctattaccgctgttcactgacgttgatttgtcgctccttgatccaacgtcttacttcggccgctgcctttgcagcggccttttttatgcccgcaataaaacggggcgctatcagcgccccgtcagattcaatcgtgttcaagcaacgatcagaggctgaacttctgcaagttggccatcatctccttcaatgcctcgatattgtccttggggtgagccgcgccttcaaagtcgcaaatctgcgcccagtgcgccgccacatcatccggtgagaacccggcttcggggtcaaaccccacacccaggctgcgctcccagcgggtcttgccgatccagccgccacccacttcaaacaaccccgaggtttcctggcacgcctcgctgcccaggtacaccaccaacgggctgaccagctccggcttgaggcgctcgaacacttgcggcggaatcaggccttcggtcatacgcgtgccgccggtgggggcgatggcgttgaccaggatgttgttcttgcgcccttccagtgccagggtgcgggtcagcccatacaaccccagcttggccatgccgtagttggattggccgaagttgccgtagatgcccgaggtggacgcggtaaagatcacccggccataaccctgctcgcgcaaatgcggccaggcggcgcgggtgactttgtaggcgccttcgacatgcacccggtaaaccaggtcccagtcgctgtcgtccattttgtggaaggtcttgtcgcgcagaatgccagcgttgttcaccaccacatcgatgcgaccgaacacgtcgagcgcgtgctgcacgattttgtcaccgtcggtgacggagtcatggttggcttcggcaatcccgcccgcctcgcgaatctcggcgaccacgcggtcggcggccgaggcattggcgccttcgccctgggtagaaccgccgaggtcattgaccagcactttggcaccgtgccgggcaaacagcagcgcatgtgcccggcccaacccaccgccggcaccggtgacgatcacgaccttatcctggaactgcactgactcactcataccgaactccgctggcgacaatgggaatggcttgagtgtcaggcacacagcctctggtcacaataaagtcggccgaggctgaatggtgcacgataaggcagcgggatgatccaccatcttctcagtggcgagcgggcttgccccgcgttgggtggcgaagccgccccagtaatgtcactgcagagtgtcaggcgtatcgcggtggtaggttttagggccgcttcgcgccccaacgcggggcaagcccgctcgccacaacaagcccgcttgccacaggaagccccatgagccgttcaggaataggccacgcgcggcgccggctggccgatgcgctcgcgaaacgccaggtaatgcttgagcaccagcaccggcgcttcaatctgcgggtaatggccgatattggccagcgacaccgtgtccgcgtgcggcaccaattggtgataacgctccaccatgtgcgcgccggagatcgggtcgacttcgccatcgatcacacgcaacggcacttcgccacgctgcatcgcctccacccagcgctcgcgcaatcgacggcgctggggaatgtaggcgatcagtttgtgcaggatgcgcgtaccgtcattgcaattgatcaggctccagaaatcatccagcgcgctttcactcggccgcgtggtcgggccgaaaatctggctgaaactgttcgacaaggcattgcgcccaaacgcgcggccgatcatccagccgagcgggctgagcagtagcttctgcaccagcgccgggcgatgggtttccggaaatagcccgccgttgaggaacacgcaactggccatctgaaaccggccttcgtaatggcgggcgagcagttcctgggcgacgctgtcgccgtagtcgtgggccaacacgtgcaccggctgctccacgcgcaggtagtcgagcaacgcctgttgcagatcggcttgttccagcaggcaataatcgtggtccagcggcttggccgattcgccgaaccccagcatgtcgcacgcgatcaccaggttgcgctgggccagcggctgccacaggtagtgccagtcccagctggcggtggggaaaccatgaatcaacagcagcggttcgccctgcccggccacccagtaacggatcttacggccacggaagatgaattcctggctacgtttgcgccaggctctgagcgggatttcggcgagtggcatcagcttttatacccgggatcttgcaggtccaatttacgcagcagcgcaggccaggccagcgcgcctcccataccttgggcgctctttgtgacagccgccaccatggccttggcgcccgctagaatctgcggctcgatgctaatcaattcggccgcgccgttttgcgccagcacctggatatcgcaggcgcgctgaaaggtgaacatcatcaggaacgtgtcggcgatggtgccgccgcaggtcaacaggccatggttgtgcagcatcaggaaattgttttcgcccaggtctgcctgcaggcgcgctctttcttcagggttcagcgccacgccttcgtaggcgtgataggccaggctggcaagcacgaacaacgattgctggctgatcggcaacacgccctgcttctgggccgagacggccacccccgaaggtgtgtgggtgtgtatcacgcacgccacgtcgtggcgcacttcatggatggcactgtgaatcgtgtagcccgcagggttgatctcgtaggggctgtgcatcaacttgttgccggcctgatcaaccttgaccaggcttgaggcgctgatttcgtggaacatcagcccataggggttgatcagaaagtcatcggtgcccggcaccttggcggaaatatgcgtgaagatcaggtcatcccagccatgcaatgccaccaggcgatagcaggccgccaggtcgacacgggcttgccattcggcagcgctgacctggtctttgacattctgtggcgatagaacgggggctaggctcacggtaacgacctccttggcgcattttcttattattttttgagtgaggggccagtctagtcagacgacgtagcggaaggagttgccttcgcagccagcttgatgactgagcgagtcacccaagagaatagtccatggggcgtcagagaagcgccgccaataaaggcacggcgaacaggttgagcaagcccgtcagcaccatcaccagccccgccaccgagccttcttcgccgcccacttcccgcgcgcggctgacgccagcgccatgggcgcccacaccaaacaatgcaccacgcgccaggggcgtacgcagcggcaaccatttaagcagcacgccgccgagcatggcgccgaacacaccggtgaacatcacaaacacggcggtgagttccggtacgccaccgaggtcagaggacaccggcatggcaaacggcgtggtgatcgaacgcggcaacaacgacatcgtcaccgaactgttcaacgccagcgccttggccaacccgaacgaggtgccgatagaggccgcgctgcccgcgaccatccccagcagcaacgccgaccaatgccgcgccaacaggcggcgctgctgccagatcggcacggcaaacgccacggtcaccggccccagcaccagcatcagccaatgggtgtcggtggcgtattcggcgtaggcggttttcatcggcacggccaccgccagcaacagcgcgggcaccaggatcaacggcgatagcaggtagcggccggtgcgacgatagatccagcgactgaaaatgtaggcgcccagggtcagggcgagccagaacactggcatcagttcaagcttcacggcgcatgctccagcggcagaccatctcgacggtgaacgccgtcaccagcatcaccgacagcgtgctgaagccgatcaccagcaggatgcgccagccgtcattgcgcaccaggccgccgtaatcgagcaggctcatcagcgccgggataaagaacagcagcatttccgccatcaatacgccggcgcccaactgtagggtcgccggcttgaccaggccactggcgaaggtcgccagcaacaggcccaggccgaccacgccgccgggaatcggccacccgaaccacaccgacagttgagtgcccagcaggtagatagccagcagtacgaccaactccgtcagcagacggccaaggtgtttgaaggtgaaacgtttcatgagctttgggtcctcgcaggcgacccattttaaagagacggctcctatccccacagcgaattgttagactgccgactattccaatctggaattaggctcatggaatttaaacagctgcgcagttttgtcgaagtgattcaccgcggcggctttacccaggccggtaaaaccttgcacatcagccaatcggccgtcagcaagcaggtggcgcagctggagcaaagcctgggcacaccgctgctggaacgcacgggctcgcacattcgcctgacggccgctggcgaagtggtgttgcaacgcgccgaggccatgttgcgcctgcagaccgagttgctcagcgagctggatgatatgcagcaactggcccgcggcgaactgcgcctgggtctgccgctgttggcaggcgatacgttgtttgccgggctgtttgccgaataccgcaagcgttatcccaaggtcaccattcaactgctcgaaggcggcagccggacgatcgagcaggcgattctcagtggagagttggacgtgggcggcaccttgatgcccagtgatccagccttcgcctggcaaccgttttgcgatgagccactggacgccttgctgccgatggatcatccgttggccgaaaacgcccatgtgcgcctggaggaattggcggacacaccgttcctgatgtaccagcgcagttttgtcctcaacgacaggttgatgcaggcctgtcagcaattgggctttacgccgaaggaaattggccgcagcggccaggcggattttctggtcgccctggtcgccgccggccaaggcgtggtgctgttgcccagcgtggtcgcccgtgggctggtgcgaccgggggtggtacgcctcacactcaaggcgcccgactacctgcgctgggacattgcctttatctggcgtgaaggcgcctatctgtccaaggccgcccaggcctggctggcgttgttgcgtgagtttccggtcaaccgcgcagtgcagtaaccagctcggccagccacggctcggcgtcggcttccggggtgacgctttcgctggcgtccaggcgcagcatcggcagcacttcgtgtacgcccaattcggcgaacagctcgcgcatttgctcgccaccgccacagaacgtgtcgccgtagctggcgtcgcccaggccgatcaccgcaccgggcaggccacgccaggcggcgggcaattggtcgcggatgctcgaatacagcggttgcaggttgtcgggcagttcgcccatgccggtggtggaggtcaccgccagaaaggcctcgggggcgaaggcctgcacgtcggccagggtcgcgcgagggttgtgccaggcttcaaaaccggccgcattgaggaggccggcggcgtgacgggcaacttcttcagccgtgccgtagaccgagccggaaaggatggcgactttcatcaatctgatcctgtggttaagcgaaagcgtgggatattagcagctgacgcaaatttttcagcgcacgccgtgcaacattcaacgctcgccctcactccaaatttccataaccagccatggaccgctcgatcatgatcaacgccaagctgatgcagatggtcatcaatgcctccaacgacggcatcgtcgtcgccgaacgagaaggcaaagacaaaccgctgatctacgtcaaccctgccttcgaacggcagaccggctacaccctcgacgaaattctctatcaggactgccgctttctgcaggcaggcgaccgtgaccagccggcactgatagcgattcgtgaggcgctcgccagtggcggttcgtgccgcgagatcctgcgcaactatcgcaaggacggcacgccgttctggaacgagctgtcgctttcgtcggtttataacgaggccgacaagcagacgtattttgttggcgtgcaaaaagatgtcaccgcccaggtcaaagcgcagcagcgtgtcacccagctggaagcgcaagtggcgcaacttaaagcgcaattggcggcgctcaaaacgacgagcggaaataactaagtgtagaaaatgcggcctttagagcgataatggctttttaatgtctcatcgttgagctacatcaatgcaccgcgacgcactattgacgcaggacgaactggattttatccaggacatgcagcacaacccgcagctcaacctgcgggatgcgtggtcgagcctgaccgtcaatggcggtgcgcagattcgtgatttgctcacgcggctggccgctcacgaccacgtcaccatccaggcgcagttcgacaatcagcaactcacctttccgctgcatctggtggaagacgagtttcatgctgtgcatttgcgcttgggcgtgccaagcatttttgaagacggcccgatgattcggccctggcggctggcgcttgaaacgccagtggcgctggagaacgtcaggggcaacccaggcgctctttgggtgcatgaagtgtcattcaagggcgtgctggtggaaattcgcgaccgggtcaaaccgccgaaaaccttttccctgtggttcagcccgtccggttacgagcgcattgcgctgcgcggttcgctggagcgggaaaccgcccgtggcttgttcgcttaccgcctgagccagagtgatgccgatgaaatcgagcgcctgcgccagttcattctgcaccagcaccgtctggttcacccgcacgtacacgcctgatttcaggtatccaactgcccactgagaaactgctgcaagcgccgctgcatcaggcgcccttcactgcccaggcagccgatggaagaccccgccagttcatcctgggccatgtccgacgcggcaccggcaaggaacagcgggcaatccagggtcaacgccaggcggctcaggcgcccttgcaggtcctgagtttgtgagtggttggagaacacgatcagcgcctggggccgggtcttttcacagaccagggtcaactcatccaacggctggcccatctccagcaccctcacggccaagtcatcccgactgatcaacagcgccgccaccagcaattccaattgacggcactcaccgggcattgcagccagcacgacccgtagcaccggtgcggcgcaggcgtgctgcagacgttgcgtggcgtgcccgcgcaggaacgcatcgaagaacaaccactcgctggcctggccgaaacggccctgatggcgatgcagctcattccagagcggcatgaggatgtcttgaaacgccacactgagcgggtacgtcgaaaaaatctggccgtacacatgctcaagcgttcgatcatcgaaagcgctgacggccagcttcaaccgcgcttgccattgcggccactgcgcgtcctcgccggtgtctcgttcagcgcgcacggttgctgcctgctgatcgtcacgagcgagaatcttgccgaccttgctgacggccacgccccgtccgatccaatcgagaatacgctcgacggtctcaatatcggctttggagtagaggcggtgcccgctttcggtgcgcgtgggctgaatcagcccataacgacgttcccaggcgcgcaaggtgaccgggttgacacctgtcaatctcgagacttcacggatcggtaacagctcatcggaatcagcgaggttgcggtgggtgatttcacgagtaggagcagtaatctcagacatcagcggccggaaacattcgtgtgaacttggatcccatttaacgcttttaaacttgtccttttcaaggcctgctctgtcagaccaatgtcactggcgtatttttacaaaacaggaataatccttgcctgttttttctacgtcgctgcaccaccccgcagcctcgttcgtgtgccacctacccggttcggcgcacccgtacatttggagatacacaatgtctacctctcccgtcaccctgatggttgcgcgccgcgtggccaaagggcgctatgaagacctgatggcctggctgcgcgaaggcgagcaactggccactgactttcccggttacctggggtccggcgtgcttgcaccgccacccaatgacgatgaattccagatcatcttccgcttcgctgacgaaaaaaccctgcatgcctgggaattctctgcctcgcgcagcgcctggctaagccggggcagcgagctgtttgcagacccgtccgagcatcgcgtcagcggcatcgatggctggttcggcgccgtgggtgcacggccgccgcgctggaaacaggccgtggcaatctggttggcgtttttcccggtgtcgctgctgttcaacttcgtccttgggccgctgctcagcgagctggccctggccccgcgcgtgctggtcagcaccatggcgctcacgcccctgatggtttactggttcatcccgctgtcgacgcacctgctggcgagctggctgcaccccgcaccgccaccgcgcaaggtcaccgaagccgccgtttgagtacaggggcgcccggtcgctggtatagtttcaacctgccagcgacttgagcctcccatgactgcaacagacgccccgatcctgatcaccggtgccggccagcgtgtcggcctgcactgcgccgagcgcctgttggacgagggccatgcggtgattttcagctaccgcagcgaacgcccgggcgttgacaggctgcgtgatcgtggcgcgatcggcgtgtttgccgacttctccagcgaggccgggattctggccttcatcgccgagctgaaaacccacaccgacagcctgcgtgcgatcatccacaatgcctcggcatgggtcgcagaaacacccggcgacgaaagccgcgcgtttaccgacatgttcagcgtgcacatgcttgcgccgtacctgatcaacctgcattgttcacctttgctgcaacgctcgacacctgccgatatcgtgcatatcagcgacgacgtggtgcgcaagggcagccgccagcacattgcctattgcgctaccaaagccgggctcgacagcctcacgctgtcgtttgccgcgcagttcgcgccgctgatcaaggtcaacggtattgcgccggccatggtgatgttcaacgagggcgacgacgcggcttatcgcgccaaggtcctggccaagtccgcactgggcatcgagcccgggcccgaggtgatctaccagagcgtgcgttacctgctggacaacccttatgtcaccggaaccaccctgaccgtcaacggcgggcggcatatcaagtaagccgtttgtgaggatgttgtatgaccttgtccctgccccaacactaccgcgagatcctcaaaggcctgggcgaagaccctgaacgcgaaggcttgctcgacacccccaagcgcgccgccaaggccatgcagtacctgtgtcacggctacgagcagaacctggacgaaatcgtcaacggcgcgctgttcgcctccgacaacgacgagatggtgatcctcaaggacattgagctgtattcgctgtgcgagcaccacctgctgccgtttatcggcaaggcccatgtggcctatattccgaccggcaaggtgctgggcctgtcgaagctggcgcgcattgtggacatgtatgcgcggcgcctgcagattcaggaaaatctcacacggcaaatcgccgatgctatccagcaagtcacccaggccgccggcgtggcggtggtgatcgaagccaagcacatgtgcatgatgatgcgcggtgtggaaaaacagaattcaaccatgaacacctcggtgatgctcggcgccttccgcgagtcgaacaccacgcgcatggagttcctgcaactgattggacggagcaagtagcaatgccacaacttcaaccaggcatggcgcgcatccgggtcaaggacctgtgcctgcgcacctttatcggcatcaacgaggacgagatcctcaacaagcaggacgtgctgatcaacctgaccatcctgtatgccgctcaggaagcggtgcgcgataacgacatcgaccacgcgctgaactaccgcaccatcaccaaggccatcatcgcccacgtcgaaggcaaccgcttcgccctgctggagcgcctgacccaggaactgctggacctggtgatgagcaacgagtcggtgctgtacgccgaagtcgaagtggacaagccccatgcgctgcgctttgccgagtcggtttccattaccctggcggccagccgctaacccctgaatctgcgtgagccctatgaacgatcaacaacgcctcgaacttgaagccgccgccttccgccggctggtggcccacctggacagccgcaaggatgtgcagaacatcgaccttatgaacctctcgggcttctgccgtaactgcttgtcgaagtggtacaaggctgaggccgacgagcgccacatcgagctgagcctcgatgacgcccgtgaagtggtgtacggcatgccgtacgccgagtggaaagcccaataccagaaagaagccagcgccgaccaacaggcggcgtttgccaaaggaaaaacccatgactgacctgaacaccctgcgcaccagcctcaacagcggcgaacacgtgtttgccgacaccctggcctttgttgctgccggttacgactaccagccgcaagcctttaccaatggcagcgtggagaacgccgccgggcagaacgaaggttcgtgcaagaccctgggcctcgcgctgctggaaggtctgagcgaccaggaagcgctgctggcgtttggtgagcattatcgttcggtggtggcaacgcctgagggcagtgaccatggcaatattcgggcgttgatccaacatgggttggccggtgtgaaattcaccgcacagccgctgacacgccgctgattcaatgtgataacccggttaatgtgggagccgggcttgcccgcgatggctgtggtggctgacacaccgctatcgcaggcaagccagctcccacagtgattgggttaacacatcgcaattgtggcgctgattaaacccagcgcataaaaaaaccggcctcagccggttttttcatttcaacgggtttaaaacgaagcgtccttcaaaccgtcgaggtaacgctcggcatccagggccgccatgcaaccggcgccggccgaggtgatggcctggcggtagacgtggtctgcgacgtcaccggcggcaaagatgccttcgatgttggtcgcggtggcgttgccttcacggccgccttgcaccaccaggtagccgtctttggcttccagcaagccttcgaacagcgaggtgttcggggtgtggccgatggcgatgaacacgccgtcgactttcagctcatcgaagctgccgtcgttgtttttcaggcgagcaccggtcacgcccatgttgtcgcccaggacttcgtcgagggtggcgttgagcttgaggatgatcttgccttcagcgacacgggcgtgcagcttgtcgatcaggatcttctcggcgcggaaggtctcgcggcggtgaaccagggtcacggtgctggcgatgttggccaggtacagcgcttcttccacggcagtgttgccgccaccgaccactgcgaccggcttgttgcggtagaaaaagccgtcgcaggtcgcgcaggcggaaacgcccttgcccatgaacgcttcttccgacggcaggcccaggtaacgggcgctggcgccggtggcgatgatcagtgcgtcacaggtgtagacgccgctgtcgccggtcaggctgtaaggctttttcgagaagtcgactttgttgatgtggtcaaagacgatctcggtttcaaagcgctcggcgtgttctttcatacgctccatcagcaccgggccggtcaggccgtggacatcgcccggccagttgtcgacttcagtggtggtggtcaactgaccgcccgcctgcatgccggtgatcaacagcggcttgaggttggcccgcgcagcgtagacggcagcgctgtaaccggcagggccggaaccgagaataatcactcgcgaatgacgggtatcagacatgactcactcctatcgaccgcccggacaacacaggacggctggaataaaaaaggaccgcgaagcacttggggaagtgcttgaactcgcaggccctgaaaaataatgggtgcagcgtatcgaggggggcaagattaaggaaatacggaataacaatccagctcataggtggtctctatgcagtccacccgattaatcgacgccattgttactgtagatgtcgcggcttccgcactgaatgcaaagtcggtaaggtcggcgcgttcgccctttttgctcggagttctccatgcccgcccctgctctttccggcccgcaatacctgcgtgaaggcctcaagctggtgctcagcccaggcctgcgcctgtttgtgctgttaccactggcaatcaacctggtgctgttcgtcggtttgatctacttcgccggccatcagttcagcctgtgggtcgacaccttgatgccaacgctgccgggctggctgagtttcctcagctacatcctgtggccgctgttcgtggtgctggtgatgctgatggtgttttttaccttcaccatgctggcgaatatcatcgcggcgccattcaacggctttctcgcggaaaaagtcgaagtggtggtgcgtggcaccgacgacttcccgccgttcagctggggtgaattggtggcgatggtgccgcgcacgctggcgcgggaaatgcgcaagctgggctacttcctgccccgcgccattggcctgtttatcctgtcgttcattccggtggtcaacctggtcgccgcgccgctatggctgctgttcggcgtgtggatgatggcgatccagtacatcgactacccggccgacaaccacaagctggactggaacgaaatgctcgcctggctgcgccagaagcgctggcagagcatgagcttcggtgggattgtttacctggtgttgctggtgccggtggtcaacctgttgatgatgcccgcagcggtggccggggctacgttgttctgggtacgcgaacaaggcgccgaggcgatggcgacgcagaaactgaccaagtcataaatccatcatgccaacgacacaatgacgacatggcccatggtgacactgtgggtcatgacgacagcctcgcttcacatcaccctgattaccgaaaccttcccgccagagatcaacggggtggccaatacccttggccgcctgtgtgagggtttgcgcgcgcgcggccatcaggtcgagttggtgcgcccacgccagggcagcgatcaaagccgccccagcgacgacgccttattgctgtgccgtggctggccgctgccgggctacccgggcctgcagtggggccagtcgtcgatgcacaagttgctgcggcgctggactcgccagcgccccgatgtgctgtacatcgccaccgaagggccgctgggcctgtcggcgttgcgtgcggcgcggcgcctggggatcagcgtggtgagtggcttccacaccaacttccagcagtactcgaaccaatacggtctgagcctgctcagccgcatggtcacgcactatctgcgctggtttcataaccgttcgacattgacgttggtccccagcaacagccaacgcctggagttggaacgtcggcaattcgagcgcttggggatgctggcgcgtggggtcgacagccagttgtttcaccccgccaaacgcgaccacgcattgcgtgaaagctgggcgctgaacagtgagcaaatcgccgtgctgcatgtcggccgattggcgcaagagaagaacctggggctgctcaagcgctgtttcgagaccttgcaagacacctatccactgcgccagatgaaactgatcatcgtcggcgacggcccacaacggacgatgctggaaaaggaactgcccgaggcgattttctgcggcaccttgcgcggcgaagaactggcccggcattacgcgtctggcgacgtgttcctgttccccagcctgaccgaaaccttcggcaatgtggtactggaagccatggcctcgggattgggggtggtggcttacgaccaggcggccgcgacccagcacattcgccatggctacaacggcgtgctggcgatgccgggcgatgaagaggcgttttgcgacgctgccaattggctgctggaagatgcagaaagtttgcgacgtatgcgcctcaatgcccgccaacacgcgagccgccagggctggccggcgattatcgagcagtttgaacggcagttacgcggggtgtgcagcgagcagtcggtgattgcaggagagtcgcgcttgatttgacgtcatcgctatcgcggggaagcctggctcccacattggaacacatgttcccgtgggagccgggcttgcccgcgatggcgtcggagcaaacgcccgttacaccagggtcgtcaacgcctcacgactgaacggcaggatgtcgccttcacgaccttcgcgcaccttcagcgcccaatccgggtccaccagcagcgcacggcctacggcaaccaggtcgaattcgtcgttgttcaggcgctccagcagtttttccaggctggccggttgtgcgaccttgtcagtgttgaccataaattgcaggaactcgccgtccaggccgacgctgcccacggtgatggttggcttgccggtgagctggcgagtccagccggccaggttgaggtcggagccttcgaactccggttcccagaaacggcgagtggagcagtggaaaatatccacgccagcgtcggacaacggcttgaggaattcacccaaggcttccggggtttgcaccaggcgcgcggtgtagtcctgctgcttccactgcgagaaacgcaggatgatcgggaagtccgggcccacggcggcgcgagtggcctggatcagctcgatggcaaaccgcgaacggttggccaggctgcctccgtattcgtcagtgcgctggttggtgccttcccagaagaactggtcgaccaggtaaccgtgagcgccgtgaatttccacgccgtccatgccgatactctgggcatccttggcggcttgggcgaaggcgttgatcacatccttgatgtcttgggtggtcatgccgtgcacgaccaccttgccgtccttgagtttctccatcggaccgtaggccggaacgctggcgtcaggctcagtgccgatacggcgcacgctgcccacgtgccaaagttgcgggacgatcttgccgccctctgcgtgcacggcgtcgaccactttcttccagccggccagcgcggcctcaccgtaaaaatgcgggacgttcgggtagccattggaggcttgatgaccaaccacggtgccttcggtaatgatcaggcccacgccggcagcggcgcggcgacggtagtactcgatgactttggaattgggtacgccacccggcgagaacgaacgagtcatcggcgccatgaccacacgggtcgaaagctgcagtgcaccgagctggaagggtttgaacaaggcttgaacaggcatgggagcactccacatcagagggatttatgatgtggataatattgtcagtgcgaagtcctgggtagcactattgatctgggtgattaaggggtagtagtcgcgagggacttgggacggctgcgcagtccagcgggagcaagctccctcgccacagggggccgattcagctcagggctttttcaatggcctggataatcgtcggatcatccggtgctgtacgtggggagaatcgtgccagcacgcgcccatctttgccgagcaggaatttctcgaaattccaggtgatatcacccggaaattccgcgccctcgcccgccagcaaacgatacaactgatgacgatcgtggccgttaacgtcgagcttgctgcccaacgggaacgttacgccgtagttcaggctgcagaattgctggatttcttcctcggtgcccggctcctggcctgcaaactggttgcatggcaggcccagcacggtaaaaccctggcccttgtattgctggtagaggttttccaacgccgcatactgcggggtcaagccacatttggaggccacgttgaccaccagcaccacttgccccttgaagggcgccagcggcagctcttgtccgtccaaagctttgagtttcaggtcgtggaaagcactcatgacgaactccagatatcccatgttcttcgcattgcgaccgttcgagattacagaccgcaagcctgcaatcatagacgccgattacaaaactcgcctgcagcctactgagcggtcggccaaggcaaaatcggaatcgcggtaaccgcgttttgcgggctgccttcgatcaagcggtcgctgtagaccaggtaaaccagggtattgcgcttcttgtcgagaaaacgcaccacctgcatggtcttgaacaccagcgaggtgcgctccttgaacacttcgtcgccgtccttgagctcgcccttgaaatgaatcgggccgacctgacggcaggcaatcgaggcctcggcgcgatcttcggccaggcccagcccgcctttcactccgcccgtcttggcgcgcgacaggtagcaggtcacgccgtcgaccttggggtcatcaaacgcctcgaccacgattcgatcgttggggccgacaaatttgaacaccgtcgacacctggccaatctcttcggccgaggccagcagtggcagggccagcaacaggccgagtaatccttttatgacgcgcatcgtgtattcctttgtttaaaccaggatcaggttatcgcggtgaaccagttccggttcagccatgtaacctaatagtccgacaatcgcgtcagacgattgtccaatgattttctgcgcttcaagcgcgctgtagttggccaggccacgggcgatctcacgaccgtcgggcgccacacacaccaccatctcaccacggcggaagctgccctgcaccaacttgacgccgaccggcagcaagctcttgttaccttgggacaacgccgacacggcgccatcgtccagcaccaaggtgccgcgggtttgcagatgcccggccagccactgcttgcgcgccgcgagcatgccgcgttccggcgacagcaacgtaccgatgcgctcgcccgccttgaggcgatccagcacacgctccaggcgcccaccgacgatgatggtgtgcgcaccggaacgcgcagccaggcgcgcggcgcgcagcttggtctgcatgccgccacgccccagggcgccgccaacgctgccggccacggcatccagcgccgggtcatcggcgcgcgcttcgtagatcagctgggcgtcggggttgttgcgtgggtcggcgtcgaacatgccgtcgcggtcggtcagaatcaccagcaggtcggcttccaccaggttggccaccagcgcggccagggtgtcgttgtcgccgaagcggatttcgtcggtgaccaccgtgtcattctcgttgatcaccgggatcactttaagctcgaccaacgcgcgcaaggtgctgcgggcgttgaggtagcgcttgcggtcggacaggtcgtcgtgggtcagcaggatctgcgccgtatggcggccatgctcggcaaagctggattcccaggcttgcaccaggcccatctggccgatggcggcggcggcttgcagttcgtgcatcgcgctgggtcgcgcggtccagccgaggcggctcatcccggcggcaactgccccggacgacaccagcaccaactcgacaccggcctcatgcaaggccaccatctgctcgacccacacgctcatggctgcgcgatccagacctttgccatccgccgtcagcagcgcactgccgatctttacgacccagcgctgcgcacctgtcactttgctccgcatcatcttcaaccttagattgagggcagcgcgacccagcgccgcccataacgttattagtgactacgtatatccagataccaaaacgccgctccagagagcggcgtttaagtttatcgcaaccgatcagtcgcgcacgtaaatgatttccggaccgtcttcatcatccacgtcttcttcgtcccaatcatcgtcgccgatgtcatggacagacttcacgccgctgcgacgcagggcacgctggtcgtccagggcttgcagctgggcacgggcttcgtcttcgatctgctggtcgagttcggccagttctgccttgtataccgggtcagccgccaggcggtcggcgcggtcttcgaggtagcgcatgatgtcgcgggtcaggcgctcggtgccttctttggcgatggccgagatcacgtagaccggaccttcccactccaggcggtcgacgatttccttgacgcgctcttcgtgctcttcttcaaggatctggtcgcacttgttcagcaccaaccagcgatcacgctcggccagggccgggctgaacttggtcagctcgctgacgatcacttcggcggcgtccggtgcactggtgtcatccagcggcgccatgtcgacgaggtgcagcagcaaacgggtacgcgacaagtgcttgaggaagcgaatccccaggcctgcaccgtcggaagcaccttcgatcaggccgggaatgtcggcgatcacgaagcttttccagcggtcgacgctgaccacgcccaggtttggcaccagggtggtgaacgggtagtcggcgactttcggcttggcggccgagaccgaacggatgaaggtacttttgccggcgttcggcaggcccaacaggccgacgtcagcgagtactttcatttccagcttcaagtcacgctgctcgcccggcttgcccggcgtggtctggcgtggtgcacggttggtactggacttgaatcgggtgttacccagaccgtgccagccgccctgcacaaccatcagcttctggccggccttggtcaggtcgccaatcacttcctgggtagcggaatcgatgatcgtggtgccgaccggtacgcgcagtaccaggtcttcgccttttttaccggtgcagtcggtgctgccgccgttggagccacgctcggcatcgaagtgccgggtgtaacggtagtcgaccagggtgttgaggttttcgtcggccatcatgtagatggagccgccgtcaccgccgtcaccgccgttggggccaccgttttcgatgaatttttcgcgacggaaactcatgcaaccgttaccgccgtcgcctgcttttactcggatggaaacttcatcaacgaacttcataacaaaacgcctctcgtcgcatggacgagcttaagaaaccaagacataagactcttgcaaaaatgagcgcagcgacctcaaacaacaaccgcctatccagcgcttgagctcattacaaacagctttgcaagagactcactccacaaacgaaaaagccccgtcgcgagacagggcttttccagcgatcgcgcaattaagcggcgacaacgctcacgtaacggcggttgaacgcgccttttacttcaaacttgatcacgccttcgattttagcgaagagggtgtgatctttacccatgccaacaccgtaaccggcgtggaattgggtgccgcgctgacgcacgatgatgttgcccggaatgattttctggccgccatacatcttcacgccaaggcgtttggcttctgagtcgcgaccgttacgggtactaccaccagcttttttgtgtgccatgagtcaattctcctagtgaggaattaggctgaaattaagcctgaataccggtgattttgatctcggtgtaccactggcggtggcccatacgcttcatgtggtgcttacgacgacggaacttgatgatgcggactttatcgtgacgaccttgggagatcacttcagccacaacggtagcgccagcaacaactggagcgccgatgttcacgtcatcgccattggcgaccaacagaacgcgatcaaaggtaacggattcgccagtagcgacttccagtttttcgatcttcaggtattcacctggggcgaccttgtattgcttgccaccagtaacaattactgcgtacgacatggtatttctccgataatcctgctcacccagcgctttataagaagaggtattggctggcatggctgcatgggatggacgtcccgaatgcaattgcgtaaggcaggtgctgcccaggaagttcagggtgcgcgattgtacgcaaggtaaatgggtgatgcaagtggccgtctatcgcgccttgacagtgccgggcctgggtcctagcatgccgcgcaacccttctggagcgactgtcgctgatgcaaccccaagctttctaccgcgcggtcgcggacgattttagcgccgtcgacggcatcatcaagcagcagctgacgtctaaagtgccgctggtctccaaaattggcgactacattacgtcggcgggcggcaaacgcctgcgtcctttattagtgttgctgtgtggcaaagccctgggacgcgaaggcgatgacctgcgcctgctggccgccactatcgaatttttgcacaccgccaccttgctgcatgacgacgtggtcgacatgtccggcatgcgccgtggtcgcgagacggccaatgcgatgtggggcaatgcccccagcgtactggtgggcgatttcctgtactcgcgctcgttcgaaatgatggtcgagctgggctcgatgccggtgatgaagattctttcacaagccacgcgcatcatcgccgagggcgaagtgttgcaactgtcgaaggtccgcgacgccagcaccaccgaagaaacctacatggaagtgattcgcggcaaaaccgcgatgctcttcgaggcctcgacccacagtgccgctgccctgtgtggcgcgactgtcgaacagtccgaagccctgcgcacctttggcgatcacctgggtgtggcattccaactggtcgacgacctgctcgactataagggcgacgccgagacactgggcaagaacgtcggtgacgacctggccgaaggcaaaccaacgctgccgctgatctacaccatgcgcgaaggcacgccggaacaggctgcgctggtgcgcaaggcgatccagaaaggcgggatcgaagacctggaagccatccgtgcagccgtggaagcctccggctccctcgaatacaccgcgcaactggcgcgtgactatgtggcccgcgccatcaagtgcctggacgccctgcctgccagcgaataccgcgatgcgctggttgagttgagtgagtttgcggtcgcgcgtacgcactgattccacgctgaataatgtgggagcaggcttgcctgcgatgactggagtgaactcactaccgctatcgcaggcaagccagctcccacattgcaccgagtccccgcccctctcttgcaataaaccttatataatgtgcgacttttagccatcctgactttcaaggagctttagtgagcacgttgccaccctgcccgaaatgcaattccgaatacacctacgaagacggcgcccagctgatctgcccggaatgcgcccatgagtggtccgccaatggcgaggccgaagcagccggcgatgaaaccgtgaagaaagactctgtaggcaacgtcctgcaagacggcgacaccatcacggtcatcaaagacctcaaggtcaaaggcacgtccctggtggtcaaggtcggcaccaaggtcaagaacatccgcctgtgcgacggcgaccacgatatcgattgcaagatcgacggtatcggcccgatgaaactcaagtccgagttcgtccgtaaagtctgattctgctgcatccatcccgcgcccgccgcgggatggcgtttcgccctccccgttgatcgagcgcaatatccacacagaaaaacctggaaaccgccaataggcacttgctattctacgaataagaattattctcattgaaacttatcaaggagaacgaccatgacttatttgatagatgcctggctggaccggccacacccttacctgcgaatcctgcatcgggaaaccggggaagtctgtgcggtgctggaagaagaagcgttgaatgaactgcaggaccagggcgacctggacgtcaacggcctgagttcgagtgagcctggggtgctgaaggaagtggtgcgcaacctgtttctgttctgctatgcccgagcgttgcgcccggccacggagttgaatggcaagttccatccatgaatgaccacccgaaacctgcatgcacccgctctatgtgggagctggcttgcctgcgatagcatcaactcggtgacacttcagaccgagtcgtctgcatcgcgggcaagcccggctcccacataaggccaggtgcaaccatcagcaggtcttacagaacgtcaagcagctcgacgtcgaacaccagaacgctgtgcggcgggatgctgccaacgccttgagcgccgtaagccagttcgctcggcacgtacagacgccatttgctgccggcattcatcagttgcagggcttcggtccagccagcaattacgccgccaaccgggaattctgcaggctggccgcgctcgtaggagctgtcgaacacagtgccgtcgatcagggtgccgtggtagtgggtacgcacttggtcttcacgggtcggcttggcgccgctacccgcagtcagcacttcaaattgcaggccggaagccagggtggtgatgccgtcacgcttggcgttttcagccaggaacgccaggccagcaccagcagccgcttcagccttggcagccgcttcggcttgcatgatttcgcggataactttgaagctggccgccatttgctcttggtcaacgcggcttggtttgcctgcgaacgcgtcggtcaggccggccaggatcgcatcaatgctcacgcccggtggcgggttgtcgcgcagttggtcgcccaactgacggccgataccgtagctgacgcgggtttcgtcggtggacagattaacttcggacatgaagaggctccgctgtaggacaacacgatttcccgtgccatccaaaactaaaagggccagcagactagcacacaaggcctgcccgtgatgagcccctgccctacgccataagccacacggcgatcgcgacccttcgtcgcacccggattaaaaacatttcagaatcacctgacgccgccgatacagccctacacactttggctggctcaaacaaaaaaacaccgtccagcagacacacatcattcttgcggagcattcgatgaatagctggttcggcaacatcagcgtcaacctcaaactcggcctgggcttcggcctggtgctggtcctcacctcgatcctggcactgaccggctggaccagcctgggcggcttgatcgaccgcagcaactggatgagcgacatcacccagctcaacgcctcgctgaccaagctgcgcatcgtgcgcctgcaatacatgctggctaacggcgatgaagcagtggcacagaacgtccagaccaatctcgacgccttcgccgcccagcaacagaagctgctggacagcttcaagagcccggaaaacctcaagctgctcaatgagcagaaagccgtcatcaccgcgtatcagcagtccttgaacaaaatgcgtgaggcctaccgcaacggtaacgccgcgcgccaggtcatgggtgacaaggccgacatcgccaacgcccagatcgacgcgctggaaaccactgtgcagcagatgcctgacagttcggagcgcttcacccaataccaggccgtcactcacgccaaggaagacttccagttgagccgctacgaagtgcgcggctacaccaacagtcccagcgcagagaccgaagcccgcgccgctgcacagattgaaaaagctatcagcggtttgaaaggcctcagcgccgcattcggcgccagccaacagagcgcattgacctcactggaaaccgcgctgggtgcctatcgcagcgccgtgcaaagctacaaggcggccaacgccaacatcgtcagcgcccgtgcggaaatgaccacccaaggcgccgatatcgtcaccatcagcgacaagctgtacgacatccaactggatcgccgtgacgcagaaagcgcccaggcccgcagcctgcaactgatcagcaccttgctggccctgctggtcggcgtcattgcggcactggtcattacccgccagatcactcgcccgatccaggaaaccctggccgtggtggagcgcatcgcttccggcgacctgagccacaacatccaggtcacccgtcgtgatgaattgggcgtgttgcaacaaggcatccagcgcatgggcaccaccctgcgtgaattgatcagcggtattcgcgatggcgtaacccaaatcgccagcgccgccgaagagctgtcggcggttaccgaacagaccagcgctggcgtgaacagccagaagatcgagaccgatcaagtcgccacggcgatgcacgaaatgaccgccaccgtgcaggaagtcgcacgcaacgccgagcaggcctcgctggccgctgccgatgccgatggccaagcccgcgcgggcgacaaagtggtggccgaggccatcgcccagatcgaacgcctggcggctgaagtggcacgttccaccgacgccatgacgcacctgcaacaagagagcaacaagatcggcagcgtgatggatgtgatcaaggcggtggccgaacagaccaacctgctggcactcaacgccgcgattgaagccgcgcgcgccggtgaagccggtcgtggctttgccgtggtcgccgacgaagtccgtggcctggcccaacgcacccagaaatccaccgaagaaatcgaaggcctggtcgccggtctgcagaacggcacccagcaagtcgccaccgtgatgaacaacagccgcagcctcaccgacagcagcgtcgagctgacgcgcaaggccggtgtgtcgctggaaaacatcacccgtacggtgtcgaacatccagtcgatgaaccagcagattgcagccgcggccgaacagcagagtgccgtggctgaagagatcagccgcagcattgtgaacgtgcgtgatgtgtccgagcagaccgccacggcgagtgacgagacagccaagtcgagcgtggaactggcgcgtttgggcagccagttgcagcagatggtcagccacttccgggtttaaaaaccaaaaagccgcctcggcctaaaccgaggcggctccacttctcagaccttacaggtcatcgaagctgtcccgcaggaatgtccacacgtgataaacacgcacggcattcactacgaggttccacgtacgtcgtgcaaacttagacatactcggccctccctgagttgggccttacctccagcacacttaccggaacacgtgggccttgggatgcacatcactgcttcctttgaggcggccgggctttggttcctcccgcatgaatccggcacggattactagcccgtggcgttcggtccattattccgcgcgcatacccagccacctacaaaacgacggacttggaacggggctgatactaaccaacatcccggcaaaaggtgtaacgagcgacgataaaacctactgcaaggtccgcaaattcattgccaaactttaccgctcattttggatagaaaatgaagagtaccgaccgtcgtcatgtcttgcctgatgcaataaccggcagtagtatccgtgtggcacatcactgcttccaatgaggtcgcaaccccagccactcactgggtttgcaataaaaaaccgccctactaaggcggttttttattgcctgcgattgacccatcaaccctcgccttcctcgacaaacaccagccgattcccaaacggatcgccgatgctcatctcccgcgagccccacggtgttgcctcaaccccaggcttggcataccgataatccttggccagcaactgctgctgatacccgtccacgccctgcgcctgaatacgcaccgccgccccgggcgaagcatcgccgtgatgctcggacaaatgcagcacgcactcgcccagcgacacttgcaaatacaacggaaaattcgcctcgaagcgatgctgccagtcgaccttgaacccgaggaagtcgacgtaaaattccaacgccttggcttcgtcgaagatgcgtaaaatcggggtgacttttcctaagtgcatgaccacagctccgtgtatgagagcacccactatagagacgaaaacccagcacgcaaatctccactgcgcgccaggaaccgacccggccgctgaccattggcctgtccgtcgctgtaactcaacaccccgttgacccacaccccatcaatgccttcggccgcgcgttgtggttctttgaagtccgccacatcgcgcacgcgcaacgggtcgaacaacaccaggtcagcccagtgcccctcacggatttccccacgctcagccaggccgaagcgcgctgccgacagccctgtcatcttgtgcaccgcggtgtgcagcgggaacaaccccacgtcccggctgaaatgccccagcacgcgagggaacgcaccccacaaacgagggtgtggaaaagggtcttcaggcaagccatccgacccgaccatcgacagcggatgcgtgaggatgcgtcgtacatccgcctcgtccatcccgtagtacaccgccccggccggttgcaggcgacgtgctgcgtcgagcagcgaaacgtcccactcggcggcgatgtcctgcaagtcgcgcccaccgacttccgggtgtggcgtcgaccaggtgatggtgatgcgaaacgcgtcggtgacttgcttgaggtccagcgtcgaagaactggcggcgtaggggtaacaatcacagcccaccgggtgagttttcgccgccagttccagcgaggccaacagctgtggactacgcccccaattacccgcgccggcacatttgaggtgggaaataatcaccggtgccttggcatggcggccaatcagaaaggcctcgtccatcgcctccagcaccggctcgaattcgctgcgcaaatgcgtggtgtacaccgcgccgaaggccgtcagttcttcactgagttgcagcacttcatcggtctcggcattaaacgcgctggcataggccaggcccgtggacaaaccaagggcgccggcttccaggctctcttgcaactgcacacgcatggcggcgatttcaggtggcgtggccgtgcggtgcaggtcgtccatgtgattactgcgcagcgccgtatggccaatcaacgccgcaacgttgacggccggatgggcgctttccacggccgcacggtaatcggcaaagcgcgggtaagcgaacgcctcacgcgaaccgagcaagttcatcgggtccggcggatcactgtgcagactcaccggcgaggcgctgatgccacagttaccgacaatcaccgtggtcacgccctggctgagcttgggcagcatttgcggatggcggataaccacggtgtcatcgtgggtgtgcacgtcgataaaccctggcgacaacacgcggccactggcgtcgatctcgtgctcggcgcttgcgctcgcaaggtcgccgatcgtctcgatacgcccgccgcgcagccctacatcggcgacatagcctggcgtattgctgccatcaatgatcagcgcttggcgaatcagcgtgtcgtacttcatttcaatctccaagcggcaggctgtcagggccgccgcgataatcgtccagggccagcttgatccggcgcaggcgttcctggttgtcgtctggcatggccagcgccagctcggtggcgagcaggtcgatggccaacagcattccgtagcgcgccgcggtgggcttgtagataaaactggtttcggccggttgcagcggcagcagcacgtccgccaactcggccagcggtgagccggccagcgtgatcgcaacgatgggcgcatcgtagttgcgcgccagcgtcaccacgtccagcaactcgggcgtgaggccggagagagagcacacgatcagcgcctgttctggccccagggtcgccgccgtgacacgcatcatcaccgggtcgcggcaagcggcaatcgggtaacccagacgcaccaggcgtacttgcaactcttcactgcacaggctcgacgggccgcccatgccgaatgcatggatcatccgcgccttgcccaacaggctgacggcgtcgacaaaactcgcctgattaaaacctgacagatgctgacgcaacgtcgcttcgatatcgccgagaatctgccgatgaaacgccgactgttccggcaaccccgccgggtcgagaaagcggctgccaaccccactggcctgagccaattgcaggcgcaaatcacgcaagtcacggcaacccacactgcgggcaaaacgcgacaaggtcgccgtgctcacctcggcccgttgtgacaactcttccaggctggccgatgcggcaaagcccacgtcatcaagcatcagcttggcgatacggccttcgccggcactgaaggaatcctggcgggcgcggatctggtagaggatgtccatcggggctccgggttacgaaagaaggctcatagaaccagagacaggccgtaagtcagaccgaatgcgactaccgaaatcaacgtctccagcacggtccaggtcttgaaagtctggatcaccgtcatattgaagtattccttgatcagccagaagccgccgtcgttgacgtgggaaaaaatcaccgaacccgcgccagtggccaataccaataattcagggtgtggataacccaagcccatggccacaggcgcaaccacaccggaagccgtggtcatggccaccgtggccgaaccggtggcaatgcgcatcagcgcggcaaacaaccagcccatcaccagcggcgacaaatggaaggcatgcgccaggccgagaatttcattggtcacccccgcgtccaccaggatgcggttcaagccgccgcccgcgcccaccagcaaagtgatactggcggtcggtgccaggcattcattggtgaacttgaggatcgcttcgcggttgaagccctgggccaggcccaaggtccagaagctcaccagggtagccaccaacagcgcgatcaccgagttgccgataaacagcaggaactggttaaagccggtgccgggggtggaaatcacattggcccagccgccgatcatcatcaacaccaccggcaacaggatcgtgcccatggtcagggtaaagctcggcaaacgggtgcgcggttcgcgctcgataaactggcgttccagcgggttctccgccggcaggtgaatacgcggcacgatgaacttggcgtacaacgggccagcaataattgccgtgggaataccgattagaattgcgtacagcacggtctgcccgaccgacgcgttgtacgccagcaccgccatcatcgccgccgggtgcggcggcaccagcgcatgcaccaccgacaagccggcgaccatcggcaagccgaccatcaggatcgacaccccaacgcgccgcgccacggtaaaggcgatcggcaccagcagcacaaaaccgacctcgaaaaacagcggcagccccaccaggaacgcgatgcacaccattgcccaatgcgcattgcgttcgccaaaacggttgatcagcgtgcgcgccacctgctcggcgccgccggactcggccatcatcttgccgagcatggtgcccagcgccaccaccagagcaatgtgccccagggttttaccgacgcccgcctcgtaggaacccatgatcgtgtctgccggcataccggccatcagcgccaggccgatggacaccaaggtgatgacaataaacgggttgagtcggtaacgtgcgatcagcacgatcaatgcaatgatggcgatggcagcgtatgccaacagccccaagcccagtggtgcggccatgcggtactccttggaaagggtcacgtcgaattggttgtgaaactcataaatcattacccggtgtaattttcaatttttatgaaagtaattttcgcccacggataagcgctgtcgcttggggatatgcccaacgccagcgcatgaaaatccggggggtgttcttacatgaagtttttgccgcgcagaaactcagccgccaaggccgagtctcagattgcggcctctactacgatcaggaattcccaccatgaaccgcaagaccctgcttgttcctttcgccgccagcgccatgctgttggccctgtgcggcagcgcctcggccgccgagaacgccgcactgaaaaaatgcatggacagcgccaacaccaccgtcgacatggtcaattgcaacgccaaggaagccaaggttcaggacgagcgcctgaacaaagcctataaaaccgccctggccgcccaggaaggcgaccgcaaggagaaactgcaggacgtgcagcgcctgtggattaaataccgcgacgccaattgcggcttcgccggctccgccaccggcggcaccatcgaccaggtcaacggctccggctgcctgctggacatgacccagacccgcgcccaggaacttgaagacctggtcgggccgtaatcatttactcctgatgcacgcgggcgcgcttgagcaacttcttgcagcgctccgacaaatgcagcacccgcaaatgcttgccggccttggtatagcgctcgcgcaaggtcatcaacgccgcaatcgctgagtagtcgacgaagctcaggtgacggcaatcgagcgtcacctgggccgggtcgttggccgggtcgaactggttcaggaatggcgtcgtcgaggcaaagaacaaggtgccgtgcaggcgatagagcttgctgccgtcggcttccagatgctcatcggcgtacaactcacgcgcctgttgccaggcgaagttcagcgccgcaatcactataccgcagagcacggcggtggccaggtcggtgaagacggtgatcaccgtcaccgccaggatcaccagcacatcgttgaacggcaccttgttgatcacccgcagcgacgcccaggcgaaggtttgctgggacaccacgaacatcacgcccaccagagccgccagcggaatacgctcgatcagcggcgacagaaacagaatgaacaacaggatcatcaccccggcaaacaccccggagaaacgcccgcgcccgccggagctgaggttgatcacggtttgcccgatcatcgcgcaaccgcccatgccgccgaacaggccgctgaccatattcgccgcgcccagggccacgctttcgcggtcgggatagccacgggtttcggtaatttcgtcggtgaggttcagggtcagcagggtttccagcaggccgaccatcgccatcaggaacgcgtagggcgcgatgatgccgagggtttccagggtccaggggatttgcggcaaggcaaaggtcggcaagccaccggcgatgtgcgccatgtcgcccagcgtgcgggtcggcaggccgagcaggtacaccgccaggccgacgccgaggatcgcgaccaaggcaggtggcacggcgcgggtcaggcgcggcagcaggtagacaatcgccatggtcacggcgaccaggccggccatcacatagagcggcgtgccgctgagccagtgctcaccgcttttgaaatgctccagttgcgccagcgcgataataatcgccaagccgttgacgaagccgagcatcaccgaatgcggcaccatgcgcaccaacttgcccaggcgcagcaggccgaacgcgaccatgatcagcccgcccaacagcaccgtcgccagcaagtactccacgccgtgctgcaccaccagcgcgacgatcaccaccgccatcgaacccgccgcccccgagaccatgccgggccggccgccgaacagcgcagtgagggtgcaaatgataaaggcgccgtagagccccatcagcgggttgaggtgggcgaccagggcaaaggcgatgcattcgggcagcagcgcaaacgacgtggtgaggccggccagggcatcggcgcgcagacgggtgaggttcatgatgtaccagggtaatgcgggggataaggcggggaatggtacggaattgggcgaggtggggccagcgctgggtaaaccaaaatagaccgagtcgcccctttcgcgagcaagcccgctcccacacttgaccgagttccaacattggaatgcagtcaaatgtgggagcgggcttgctcgcgaaggccgcgccgcggtgctaagtgaacatcacaccatctcgttgcgaatccactccaccaccgacgtgcgcttcggcgcccagcccagcaactcacgcgcatgcttgccacgcacccggctgttggagcccaaaccatagttggccatttcatagccccactcggcttcagcatccgccaacggccaatcctgtggcttgcccagtttcaacgcgtcggcaatcgccgtggtcatgtcgacaaacgccgcttcgccgctttccacaaagtagaaggtgcctggcacattcttctcaagcgccagcaggtagagcgccaccacgtcttcaatatgcacgttggaccagatgttctgcccggtgcccacatggcgcaccacaccgcttttgcgcgcctgcttgagcaagcgcggcaattgcacgctgtcacgcttcacgcccaggctgtggccgtaaatcagggtgttgcagatcaccgccgagttcacgccgtctttcgccgcggccaggatcaggttgtcgatggccacacgggcggccttgtcgacggttggctgcggcaggctgtcttcaaagtagatgacatcgctggccttgccgcccgacgcatcaccgacgatgctcgaaccgctggtgtgcaggaacggtttattcgagcccttcaacgcagccagcaaagtctcaaccgcagcgcgatggtcgctgctggcggcgttgattaccgcatcagccttttgcgcctgctcggtcagcacggccgaatcgtccagcgtgcccatcaccggggtgataccgagggcggtcatttcagcggcttgttcggcgctgcgcaccaggccggtaacgctatggccagccttgaccaggccggtggcgatggaaccgccgataaacccggctgcgccggttacgaatacgttcatggagtgtgctcctgactgggtaagtgatgggtccattgttacggacccgccccggtcgaataagacccgattgcccaattcaatcttgcgcgcacgtcacgaatcagcaggcataccgcgccagcttggtctgaatgaagtccaggaagcactggatgcgcaacgccaactgcgagttgcggtagaacaccgcgtggatcggctggcgatagccactgttgaacgcctccagcaccggcaccaggcgcccggcgttgatgtcctcgaccgtcatgaagttcgacaggcagcaaatgccctgcccttccagcgccaactggcgcagggtctcgccactggaagcggcgacactcggctggatcagccaacggtcgccctccacatggcgtagcggccagtggttgagggtctcggtctgggtaaagcccagcaaggtatggtccgccaactcggccaccgtggtcggcgtgccgaattgcttgaggtagtcggggctggcaaggatatgcagcggcgtacaacccagcgaacgcgcatgcaacgtggagtcggccagggccccgatgcgaatggcaatgtcggtgctctgctccagcaggtcgatgatcaggtcatcgctgttcagctccagttggatttccgggtagaggctgcgaaactcggcgatgtacggcacgatcccgtgcagcatgaagggcacggcggcgttgatgcgcaggcgcccggccgggtttttctggcgcgacgacagacgctcttccagctcatccatctgcgccaggatcaccttggcctgctcgaagaaatacttgccctcttcggtcaggtccatgcgccgggtggtgcggttgatcagcgtggtgtcgagcttggcttccaggcgcgacaaggtgcggctgaccgccgacggcgtctgcccgacctgctccgctgcggcggaaatcgagccgcactcaatcacgctgacgaaaatctgtaactcatcggatcgggctttcacaggctgtccttcttgatcggtgagtagcagcttacaccgtgaagttaaacacctgcgccagatgctcctcgtagcgcgccacgtccgcctcgatggccgggcgtttcatcacgtccacgcacaggaaggtcggcaggccggtcatgccgaggaactcgttggccttgtggaacgggaagtacaccgcgtcgacgcccttggcttcgaagaaatccgtcgggtcgtcgaaggcttgctgcggcgcgttccaggtcagcgacagcatgtactgcttgccctggatcaggccgccgctgccgtatttctgcgacgcgtcggaacgggtgcggccatcgctggcatacaggctgccgtggccttcggtgaagacttcgtcgatgtacttcttgacgatccacggcgcgcccatccaccagccgggcatctggtagatgatcacatcggcccagaggaatttggcgacttcttcggccacgtcgtagcctgcgtcgatgtgggtgactttgacttcgataccgcgacggtccaacacggccatggcggcgtcatgcagggtggtgttgtagcggccgtcggaatgggcaaattgtttgccgccgttaagcagaagtacttttttcatgggagggaatccaaagggttagcaatgtctgccggcaggctatcgacattgcgcccttggaataagcagcggtgcggcaaaatacatttgatcaaaacgcacgaataacgccgtactcttgacttaaccacctatcaaaaggtggccgcccagcagcgccatgccgataaaaaagacccgtttgaacagcaccgcgctgatgcgctgacgcagtgcctggcccagccacatgcccaacagcgcaggcaccaacgccaacatagaggcattgatttcgccgccaccgagggcgccgcgccacgccagaccggccgccagcgccagcgtggaaacgctgaacgacagccccagcgcctgcaccaactgatcacggttcaagcccaaggcttgcagatacggcacggcgggaatcacgaacacaccggtggccgaggtgataatgccggtgatcagcccacacaacggccccagccagcgctcggtgtgaggctgcaccttgaacgtgggcaggaacaacccgctcaacgcatacaccagcaacgcgccacccaacgcgcgcaccacccaatggccgccgtccatgcccagccacaacgtgccgagcccggtgccgaggaaaatcagcaacagcattggccacaggcgcttgagcagcgcgctcaactggccgccgaatgccagttgccagaggttggtcaccgttgagggaatgatgagcaatgccgcagcctgcgccgggagcatagccaggccgagcatgcccatggccacggtgggcaggcccaggccgatcacgcccttgacggtgccggccagcaggaaggtgccgatgaccaacagggtcagggccgggccgaggttttggtagaacgccaggaaggtagtcatggggggattgtgcggcgttaaggcggttatgaaaattcgccatatactgaggcagcctcttgttttgcgtgaggcttagatggttatcgcaggcgagccagctcccacctttgaactgtgttcacacatccaactgtgggagctggcttgcctgcgatgaggccagtcccctcaccaggaattttcagccatgcactttgacctgatcgacctgcgcctttacctgcacatcctcgacaccggcaacatcaccgccggcgcagcccgcagccatttatccctcgccgctgccagcgcgcgcatccgcgccatggaggcttcattgggtatcgagttccttgaacgtggccgccgtggcgtcacacccacgccagcgggaaaggccctggcccgccacgcgcgcctgctgctgcaacaggccgagcacctgcaacaagacctcgccgagtacgccaatggcgtcaaaggccaggtgcgcctgctgtgcaacaccaccgccctgagcgaatacctgccagaactgctcgcggactttttgcgcgaacaccccaacctcgatatcgacctgcaggaactgccgagcctgcgcatcacccagtccttgcgccagggcacggcagacctggggattatttccgacgcagtcgacacccacggcctgcaaaccctggcgtttcgcgacgacccgctggtgctgatcatgccgctcgaccatccgctgacgagcgcaagtttcatcgacagcctgcaatacgactacgtcggcttggccgccaacagcgcactcgcggtgtacctggaagaacaggcgctgcacgcgggctttcgcctgcaaacgcgcattcgcgccgacggttttgacgggttgatccgcatggttgccggcggcgccggcctgggcatcgtgccccaggccgcattggagcgctggccgatagaacgccgcttcaaagcccagcccctgcaagaagactgggcctgccgcaaactgctgctgtgcgcgcgcgccttcgagcaattgcccggttacgccaaggccttgtttgacgccttggccctgcccttgcggaaaaacccgtaatacaccgccgacagaatcagcaggaacggcacgccgaacaccagcgtcatcttgaacgcctcggtgaagtacgtggtgatcatcaccgcgcccatcagcaccaagcccaacagcgtgctgtagggaaacagacgcagctggaacgacagcttcgcgccgccatggcgtttgcgatagcggcggaaaaacaggtgcgtgaggaagatcatgaaccaggtgaagaccgcgccaaacatcgagatcgccatcatcagcgtgaacgagctttccgggtacaccacgttcagcaaggtcgccaaggcaatgcccgagctggacagcagcaacgcgttgagcggaatcccgttcttgctcaaggcgcccatggacttgggcgcaaagcctgctcgcgagaggctgaacatcatgcgtgtggtgatatacagctggctgttcatcgccgacaacgcggcgatcagaatcacaaaattcatcaccccggtggcgccgggaatgccgatggtctgcatcaccgtgacaaacgggctctgggtctggccggcctggttccacggcacgatggccagcatcagcgccagggtcagcaggtaaaacaccaccaaccgcacgatggtcgcgcgaaaggccttcttcaccgcctgctccgggtcggcggcttcaccggcggccaccgcgatcatctccacgctcaagtagctgaagatcgacacgatcaccgcgatccacatgccgctcaaaccatgtgggaaaaatccgccgtgggccgtgtaattctgcacgccgtattccgggttgccagagccgaacaccacgtacaccgcaaggatgatgaagccgacgatggcgctgatcttgatggtcgagaaccagtattcgaagttgccgaaggtcttcacgctgattgcattgagcaggatcagcacacttgaaaacgacacgatccacacccattccggcacgttggcaaaccagtacttcatgtacatcgccaccgccgtgacctcggcgcccaccgccagcacaatcgctgcccaataggcatagcgcaccaggaacccggccagcgggctgatgtagaactcggcgtaagcgccgaacgagcccgaagtggaatgcgccaccgtcatctccgccaggcagcccatcaacagcaaggtgatcagcgcgccgatggcgtagctcaccaatacacttggcccggcataaccgatggcataggcgctgcccatgaacagcccggtgccgatggcgccaccaatggcgatcatgctcatctggccggaagtcagctggcgcctcaggcccagttcgcggtgggtgatctctgcaaagccgttgtcgggtgtggtcacgtgatgtgcccctttattattgtgattgttactgccggtgccgaaccctgtgggagctggcttgcctgcgataactgcagtgaattcaccaccgctatcgcaggcaagccagctcccacattagtgttgtggtgctcttaagtgacgctgttgcgcaccttgaattgcggctggtcccacgtggcgttatcgaggatttcaccgaggatttccacggcgtcaaacacctcgacaaagctcgtatacaacggcgtaaaaccaaaccgcatgatgcgcggctcgcggtaatcaccgatcacgccacgggcgatcagcgcctggatcaccgcgtagccttcagggtgttcgaagctcacatggctgccgcgttttgcgtgctcacgcggcgtgatcagcgtcaggccgtgggcggcgcagcgagcttcgaccaaagcgataaacaaatcagtcaacgccagggatttagcgcgcaggctggccatgtcggtctgggcaaagatctccaggccgcactcgaccatggccaacgaagtgatcggctgagtgccgcacaggtagcgcgcgatgccggcgcttggcgcgtattgagcttccatggcgaactgccgggtatgcccgaaccagcccgacagcggctggcgcaccacgtccaccaacgccgggttcacccacacaaacgcctgggagcccggcccgccgttgaggtatttataggtgcagccaatcgcgtaatcagcctcggccttgtgcaggtcgacaggcaccgcgcccgccgaatgcgccaggtcccagatactcaaggcgccgcattcgtggctcaacgcggtaagcgcctgcatgtcgtacatgtagccggtcttgtagttgacgtgggtgagcatcaccaccgccacgtcctcgccgacagcctgcggcagctcgtcggggctgttgaccagtcgcaacgaataaccttgttgcagcaattcggccaggccttcggcgatgtacaggtcggtggggaagttgctcgcctcgctgacgatcaccttgcgattcggctggcgttggcgctgcacactcagcgcggcgctgagtaccttgaacaggttgatcgaggtggtatcagtaatcgccacttcaccatcgcgcgcaccaatcagcggtgccagacggttgcccagacgtagagacaaatccgcccaaccggcgctgttccagctgcgaatcaagccattgccccactcttcggcgatcacctgttgcgctcgtgccaacgctgcgagcgggcgcgcgccgagggagttgccgtcgaggtagatcacaccctcgggcaaggcgaactggtgacgcagtggcgccagcgggtcctgggcatcgagggcttggcagtggcttcggttggtcatgggctgtcctggtttttataagtgaagatggaccaaataatgagcgaagatttacagaattttcgtgcaaagttgtgggcaacaagctaattaagctgtaggaaattcgaatttaaccccaaaacacgcggatttattctaaccatgattctcgacgccaccgacctgcgcctcctgcattttttgcaacaggatggccgtatcagcaaccaggaactggcggaaaaagtcgccctgtcgccttccgcctgcctgcgccgtttgcgcctgctggagagcgaggggattatcagcggctaccgcgccgtgttgaatgccgagcagttggggatcgagctggaagccatcgtgcacctgtcattgcgccaggatgtggaggattggcacgagacgtttatcaagaaggtgcaaggctggccggaggtggccagtgcgtatgtgattaccggcgccagcaattatgtgctgcgggtgcaggcgcggaatttgaaacacttttccgactttatcgtgaaccacctgaaccgcacggcaggggtgatggatattcgctcggagattgtgttgcagaagatcaaggatcgggatgaggtgttggacctggtcgtgcgcaaataacccgccacaccacaaaaccctgtgggagctggcttgcctgcgatggcatcaacttggtgtacctgatgcaccgaggtgtctgcatcgcaggcaagccagctcccacaaaagccagctcccacagttttaaccgtgtttagtcttcgagggcgcgcacgcgctgcatgcgtttctgctctaccggcgcgtcagccagctgcaactcaaagtcaaaatcaatctgcgcaaaccgcccttccacgccaaactcccgcgccagttgctgatcgtcactgaaccgaatctcggcaatcaactcatcacgcgtcgcataggcaaaatcatcgtgcaggtacgggtcatccgacaggttgatctgcgtggtcaaatgccgatgccccggcgccgagatgaagaagtgaatatgcgccggccgctgcccgtggcgccccagttggtcgagcagttgctgcgtcggcccgctcggcgggcagccgtagccggacggcacaatgctgcgaaaacggtaattgccctgggcatcggtctcgatgcgtcgacgcaagttgaactccgattgcgccgggtcaaaccacgaataggtgccagcggtattggcctgccacacatcaacaatcgcgcctgccaacggcttgccatcggtgtcgcgcacttgcccgcgcataaacagcggcaccgcgtcgtctttgccatcatccaaccgtgcttcgtacttgctcagcggcgcgccggccacataaagcgggccttcgatggtgcgtggcgtgccaccggatttgccggcctcctcgtcggcggcgtccatcagcaaatcgaggtaatgctccaggcccaacccggcggcgagcagccccgcttcctgatttttacccagctcattgaggtaattgaccgccttccagaactcttccggggtcacttccaggtcttcgatgatgtttaccgtatcgcgcaaaattcggtagatcagcgccttcgcgcgcgggttgccgccgtcgttgtggtggccgctggcttcttcgagaaacgcttgggcatgggcagtctgggacagtcggatggacatggtgcaatcctcatcttgtaattattgggggcaaaacaggctcagcggtcgtcttcatggatcgacgaagggtgccggcacagcgcattcacttcgatggccatataagggaaaagcggcagttgcatcagcaggtcgtgcaggtcttgcacgctgtcgacgtcgaacacgctgtagttggcgtagtgcccggcgatgcgccacaggtggcgccatttgccctcttgttgcagccgttgcgccagggctttttcttcagccttgaggccggccgcgcgctcggggttcatgtccaggggcaggttcacggtcatttttacgtggaacaacatggcaggcgcctcttagtgtttgtcacgacggaagaacgccaaacgctcttcatcaatgctcaggcccaggcctggcgcagtggagacatgcagctggaaatcgcggtacaccggcggctcggtgagaatgtcttcggtgagcagcaacgggccgaacagttcggtgtcccaggccagcttgttcaaggtcaggaaggcatgcgccgaggccagggtgccgatgccgccttcgagcatggtgccgccgtacaggccgataccggccgcttcggcaatcgcagccgtacgcagcacagcccgcgggccgccgttcttggcgatcttgagggcaaacaccgaggccgcaccttcgcgggccaggttaaaggcgtcttccacgcattcgatggactcatcggccatgatcggcgccgggctcgacagattcagccgcgccatgccgctgcggttgttgcgcgagatgggttgttcgatcaagtcgatgccgttatcgccgagcaccttgcacgcgcgcagggccaccgcttcgtcccaggcctggttgacgtcgacgcgcacactggcgcgctcgcccaccgcctgtttgatcgcgatcacgtgggccaggtcgcggctgacctcaccggcgccaatcttcaatttgaagatacggtggcggcgcaggtcgagcatcgtctcggcctcggcgatgtcctgttcggtgttgccactggccaatgtccaagccaccggcaaggcatcgcgcacgcgcccgccgagcaattcactgaccggcaggttgaggcgtttacccaatgcatcgagcaaggcactctcgatgccggacttggcaaaggtattgccacgaatgctgcgctccaggcgcaacatggccgcgttgatattgctcgcatcctggccaatcaacagcggcgcgaagtgccggtcaatgttgaccttgatgctgtcggggctttcattgccgtagctcaggccgccgatggtggtggcttcgccaatgccttcgatgccgtcggcgcaacgcaggcggatgatcaccagcgtctggttttgcatggtgtgcatcgccagcttgtgcgggcgaatggtgggaaggtcgacgatgatcgtttcaatcgactcgatggcgcaaatcggcatggctatacccattgggttctttatagatttgcgccgattctgtgccgtatttttcctggcttccaatatagaatgggtctcatacaataccttcaaggtatgaaaggagccgccatggaactgcgtcatctgcgctatttccaggtgctgggtgaaacgctgaacttcacccgcgccgccgaacgcctgcacattgcccaaccgccgttgagccggcagatccagcaattggaagatgaattgggtgtgattttgctggagcgcggccgaccgctgcggctgaccgaggccgggcggtttttctatgagcacgccaatgtgctgctcgagcaactgggtaaggtctgcgacaacacgcggcgtatcggccagggcgaaaagacctggctgggcatcggttttgctccgtcgaccttgtacggcgtgttgccggagttgattcggcggctgcgcaaccatgagacgctggaactggagttgggcttgtcggagatgaccaccttgcagcaggtcgaagcgctcaaggccgggcggattgacgtgggtttcgggcgcattcgcatcgacgacccggccatcgtccagcgcgtgctggtggaggaccggctggtggccgtgctgcccgccgggcacccgctgctggaagcgcccgccaccctcgcccaactcgccgccgagccgtttgtgctgtaccccggtaacccgcgccccagttatgccgaccatgtgatcgcgttgttcgacgcccacggcttgagcctcaaggtggcgcagtggaccaacgaattgcagaccgccatcggcctggtcggcgcgggcatgggcgtgacgctggtgccggcctcggtgcaggtgctgcatcgggcggatatcggctacacgccgattgtggaggccaccgcgacttcgccgattattctgagccggcgggtgaatgatcagtcgccggggctgagtcattgtttgcaactggtggaagagttgatctgagatctcccgcacaccacaaatcccctgtgggagctggcttgcctgcgatgacggtggaacattcactaccgctatcgcaggcaagccagctcccaccgtttgatcttcattgttttcaaaggctgcgcagtcgcttgcgctgcagggtttggctgggggactcgtcgaagagcttgcggtactccgcagagaaccgccccaaatgggtaaaaccccaacccagggcaatctcggaaatggtccgagtagaaccatgctccagaatttcctgacgcactgcccccaaccggtacttcttcaaatacgccatgggcgacagcgcaaagtacttgcgaaacgcatcaaacagcttgaaccgcgacacgcccgcagccgtttccaagtcttccaggtgcaccgcttcacgggcgttgtcgtggatatactgccgcgcacgaatcaaatagtgcggcaacttcacgcccagcacgtcgcgcagttcttctgaatagttattcggctgggcgaggatcaaccctttgatcagcgagctttccaggtcacgggtaaacgccgcctgctcatacagctcgctgctgcgctcaagctcggcgataaagtagcgcgccatgcgccaccaggatgccgacgcgccgtccaccgcgtccatcaccgattcaaaacgcaacggcgcctcaatcggccgttgcagtaacgcctccagcgattcactcatcgccgcgcgcgtgatcaccacctgcaacttgcggcagtcaccggatatcgccagcacttggtgctcgttgggcgacaggatcacgccctggtcgcggttggaactcaagcgctcgccgttcttgctcaactcctgctcgcccaccaacggcaggctcaggctgtagctgctgaagtgctcggcgtcttcgatgccgatggtcacgtcggtgccgtattcgatcacgcccagggtggtggcgcgggacttgaacacgttggcgctgtggtgaaagcgcaggcgctcgggtgtcgaggtcgccaggcggtgcggcccgcaaatgccggacatccagctgcaggcgccttcaaggtcgaagcgttgaatatggatttcgcgtgtatggctactcatcagggtgcacccacggcggttaggcggttgcgcgctctggcggcgcgtcgttaacaatcgacagcaagttctacgccacgcccgcgtgaatgcaacggggtggatagcaacggtcgactatgtggataagctgccggtttttgcggctttcccttggtatgacagtagcgcatcgcgtcacctggctgcaccgaactgggtatttgctgcccaactatgcggcccatctctgcccattaagcggatagcccgcaccctgccccgctgcctctaatggaccaccgatcagcctctatcaaaaaggtgcctcccatgagtggtgcaaaaagcgtcgagcagtggaaaacatttatcgaaagctgcctggactttcgcccggccgatgaagtgttccgcatcgcccgcgacatgttcaccgagccggaactgttcgacctggagatggaactgatcttcgaaaaaaactggatctacgcctgccacgaaagcgagctggcccataaccacgacttcgtgacgatgcgcgccgggcgccagccgatgatcatcacccgcgatggcgagggccagctgaatgcgttgatcaacgcctgccagcatcgcggcaccacgctgacgcgcgtcggcaagggcaaccaatcgaccttcacctgcccgtttcatgcctggtgctacaagagcgatggccggctggtgaaggtcaaggcgccgggcgaatacccggaaggcttcgacaaagccacacgcggcctgaaaaaggcgcgcatcgaaagctataagggttttgtgtttatcagcctggacgtgaacggcaccgacagcctggaagacttcctcggcgacgccaaagtgttcttcgacatgatggtcgcgcagtccgccacgggcgagctggaagtgctgccgggcaaatcggcctacacctacgacggcaactggaagctgcaaaacgaaaacggcctggacggttatcacgtcagcaccgtgcactacaactacgtggccacggtgcagcatcgccagcaggtgaacaccgaaaacggcagcggcgcaggcaccacgctggactacagcaagctcggcgcgggcgacgcgaacaccgatgacggctggttcgccttcaacaatggccacagcttgttgttcagcgacatgcccaacccgagcgtgcgctccggctacgccaccatcatgccgcgcctggtggaagagcacggccagccaaaggccgagtggatgatgcaccgcctgcgcaacctgaacatctacccgagcctgttcttcctcgaccaaatcagctcgcagctgcggattattcgcccggtggcgtggaacaagaccgagatcatcagccagtgcctgggcgtgaagaacgagtcggatgccgaccgtgaaaaccgcatccgccagtttgaggacttcttcaatgtgtccggcatgggcacacccgatgacctggtggagtttcgcgaagcccagcgcggtttccagggcaggctggaacgctggagcgatatctcgcgcggcagccaccgctgggaaaccgggcccacgccgaacagcgaagccatcggcatccaaccggcgatgaccggcaccgaatttacccatgaaggcctgtacgtcaaccagcaccgcaactggcagcagttcctgctcaagggcctggaccaacaagcgctgaaactgcgggaggtgaagtgatgaatgcgcaattgcagtaccggatcgagcagttcttctaccgtaaatccgaactgtgcgatgcccaggattgggacgcctatgttcagctgttcgacccgcagagtgagttccacctgccgcaatgggactcggaacacgtctacacccgcgaccccaagcgcgagatgtcgctgatctattacgccaaccgttcgggcctggaagaccgcgtgttccgtttgcgcacgggtaaggccgcgtcggccacgccgatgccgcgcacgttgcacttgatcaataacgtgcgcattgccgagcaaccgggcgggttactggaagtgaagttgaactggcacacgctgttttatcggctggccacgtcggagcagttttatgggcatgccacctacagcctcaaaccccatggcgacagttggctgatcacgcgcaaacacgccttgctgctcaacgacaccatcaactcggtgctggatttttatcacctttgagtgtgcctgtggcaagcgcttttcgtggcgagcgggcttgccccgcgttgggctgcgaagcagccccagtacagtcactgcattttttcagtcaaaccgcagtgcctggaccaggggccgcttcgcgccccaacgcggggcaagcccgctcgccacaacaagcccgttcgctacaaagtgtgcgcagccacaaatacgcggagagcaacaaatgaatcacaaagtggccttcagttttgccgacggcaagaccctgtttttcccggtgggcgccaatgaaatcctgttggacgcggccctgcgcaacggcataaaaatccctttggattgccgcgaaggcgtgtgcggcacctgccagggccggtgcgaatccggcgagtacacccaggattatgtcgacgaagaagccctctccagcctcgacctgcaacagcgcaagatgctcagctgccagacgcgggtgaagtccgacgcggcgttttacttcgattttgattcgagcctgtgcaacgcgcccgggccggtgcaggtgcgcggcacggtgagcgaagtgcagcaaatctcaagcagcacggcgattttgcaggtgcagctggaggcaccgctggattttctgcccggccaatacgctcgcctgtcggttcccggcaccgacagttggcgcgcgtattccttcgccaatcgccccggcaatcaactgcagtttctggtgcgcctgctgcccgacggcgtcatgagcaactacctgcgcgagcgctgccaggtgggtgatgaagtgctgatggaggcaccattgggcgcgttttacctgcggcatgtcactcagccgctggtgctggtggccggtggcaccgggttgtcggcgctgctgggcatgctcgatgaactggcggccaacggctgcgaccaacctgtgcatttgtattacggcgtgcgtggtgccgaggacttatgcgaagcggcgcgcattcacgcctacgctgtaaaaattccgaattttcgctacaccgaagtgctgagtgacgcctcaccggcgtgggccggcaagcgcggctacctcaccgagcatttcgacctggccgaattgcgggatagatcggcggatatgtacgtgtgcggcccgccgccaatggtcgaatcgatccaacaatggctgtcggatcaggcacttgatggcgttcagctgtattacgaaaagtttacgcagagtaatatctgacccctcagcagttctgaggggcgggtgcggcgtgcaatcaccctcaagaaaaacaagtagaagggaatgttaatggcggatgacatggttaacccggttggcctcaagcgtggcctgaagaaccggcatattcagctgatcgccttgggaggggcgattggcacggggttgttcctcggctcggccggggtgctcaagtcggcggggccgtcgatgatcctgggttacgcgattgccggttttattgcgttcctgatcatgcgccagctcggcgagatgatcgtcgaagagccggtggccggctccttcagccacttcgcacataaatactggggcggctacgcaggcttcctggcgggctggaactactgggtactttacgtgctggtgggcatggccgaactgacggccgtgggcaaatacatccagttctggtggccggaaattccaacctgggtcagcgcactggtgttctttgtcgcggtgaacctgatcaacacgctgaacgtgaagttcttcggtgaagccgagttctggttcgcgatcatcaaggtggtggcgattgtcggcatgatcgtgctcggctgctacctgctgttcagcggcaccggcggcccgcaagcctcggtgagcaacctgtggagccacggcgggttcttcccgaatggcggcatggggctgttgatgtcgatggcgttcatcatgttctcgttcggcggcctggagctggtaggcatcaccgccgccgaggccagtgagccgcgtaaagtgatccccaaagccatcaaccaggtggtctaccgcatcctgattttctacgtcggcgcgctgaccgtgctgctgtcgctgtacccgtgggaccaactgctgcaaaccctcggcgcctcaggcgatgcctacagcggcagcccatttgtgcagattttctcgctgatcggtaacgacaccgccgcacacatcctcaacttcgtggtgctgaccgcggcgctgtcggtgtacaacagcggcgtgtactgcaacagccgcatgctgttcggcctggccgagcaaggtgacgcgccgaaagcgctgatgaaactcaacaaacaaggcgtgccgctgcgcgccctggcgatttcggcactggtgacgatgctctgcgtggtggtcaactacgtcgcgccgaagagtgcgctggaattgctgtttgcgctggtggttgcctcgctgatgatcaactgggcgctgatcagcatcacccatatcaagttccgcaaggccatgggcgagcaaggcgtgacgccgtcgttcaagaccttctggttcccgttcagcaactacctgtgcctggcgttcatggtgatgattgtgagcgtgatgctggcgattgagggtattcgtgagtcggtgtatgcgatgccggtttgggtggggattatctatattgcttatcggttgcgggttagaaaaagcaacgcggtagtgaacgcacggtgatccctgtgggagccgggcttgcccgcgatggcggtgggtcagtcagtggatgggctggctgacacaccgctatcgcaggcaagccagctcccacagggttgatggcattccaaatgaaaaagccccggtaatccggggcttttttatttacagcgtggaacgcactcgccacagctcgggaaacagcaccgtgtcgagcatcttgcgcaaataccccacgccttctgtgccgcccgtgcccggctggaagccgataatgcgctccaccgtcgtcacatgccggaagcgccacaggcggaacgaatcctccaggtcgataaacttctcggccaactgatacaaatcccaataccggctcgggtcgcgatacacctcacgccacgccgcttccacggactcatcgtgaaccgtggccgccgtcgggtcgcgctcggcgcgttcagggtcaatcgccaggcccgccttggccatcaggttgaccgcctcgtcatacagcgacggcgtggcaatcgccactttcaactcgttcaacaactccggccgatgcgcgtgaggacgcaacagcgccgcgcttttgttaccgaggataaattcgatctcgcggtactggaacgactggaaccccgacgactgccccaggaacgggcgaatcgccttgtactccgacggcgtcatcgtcgccagcaccgcccaggcgtgcaccagttgatcgaagatccgcgacacccgcgccagcatcttgaacgccggcggcagctcgcccaggcgcacgtgttcacgggcggccttgagttcgtggagcatcagtttcatccacagctcggaggtctggtgctggatgatgaagagcatttcgttgtggtccggcgacagcgggtgctgagcgctgaggactttgcccaggtccaggtagtcgccgtagctcatcgactcggaaaaattcagctcggcgttatgccattcttccggcggttgatagtcagcagagaaaggacattggctcatcgcgtgggctccttgagcgggcggagaatggcgcggaccgggctcgcgtcgaggttggcaaaacgcagcggcagcgcgatcagttcatagtcgccctcgggtacgtcatcgagcacgatgccttcgagaatcgccatgccatgacgggccacggcgttgtgggaatccatggtcttggactgttgcgggtccagcgacggcgtgtcgataccaatcaggcgcacgcccaggctggcgagcagctcgatggtctgcggcgcgatggcggtgaaattcgaatcccactcggtcagcggcgcttgtggataagtacgcagcagcacgcgctcgggcacgttatccacacgcccgtccagctgatgcggctgcaccagcgcgccactgcccaggcaatgcagtacacggcacgggcccatgtacacgtccagcgacacctcgccaattggcgcgccgtccgcgctgtaatgcaacggcgcgtccacatgggcgccggtgtgcggcgagaaggtcacgcgccccacgttcaccgggcactccgggccgaactgccacacgcgctcttcctggaacggcgtatcgcccggccaggtcggggtggccgtgctcaagggcgggctgatatcccaccacgtttttattgggttcatttcgaggctctcggtcgttactggggtgaatgatacgagggccagccgtgcattttcttgcttattccagcgccaggcgggaattctttcgcagttactgcgaggaaaggtcgggttcacgccaggaagtttcatctgatgaaagtgcctcaaacactggagatccaatgtgggagcgggcttgctcgcgaaggcggcgggtcagtctaagtatttagcgactggcactctgctttcgcgagcaagcccgctcccacatggactgcatgggtgccagaggaatcgcgttcgcttgcgcttctgggcatcccgatgtcgagttcagaccactgacacaacgccccaggccttagggttgctctttcccttccctgcctcggagccatcatgtccaagcccatcaccgtactgcgcgacacccacccactgccggtcctggatgcctgcaaatgggaaaaactcgaaggcgacccgcacaccgtcaacctcaacgcctacaccagcgaagacggcagcaaaatcatgggcacctggatctgcacgccgggcaagtggtacgtggaatacgtgaagtgggaatactgccatttccaggaaggctactgcgtgatcacgcccgaagggatggcgccgattcacctgcgggctggggatatctttgtggtggagccagggatgaaggggacgtgggaagtggttgagactgtgcgtaagtattttgtgtttgcgtgagcaaacacgttacctgtggcgagcgggcttgccccgcgttgggctgcgcagcggcccctggtccaggcaccgcgttctgactgtaaaaaatcggtgactttgctggggctgctgcgcagcccaacgcggggcaagcccgctcgccgcaacaagcccgctcgccacaacaggcccgcttgccacaaaaagtctgcctgtcacaaaaagcccgtttgccatagaaagcccgcttgctaaggcaagcgggctcaacactctactgaggcttgcgatagctgttgatgatcgccgagaagtctttgccgccttccccgcgctggctcatcgattgatacaactgctgggccacggcgcccaaaatcaccggttgcttggcttggcgcgcggcttcggtggccaggccaaggtctttgagcatcaggtcggcgccaaaaccaccggtgtaaccccgcgacgacggcgcggtttcgatcacgcccggccaagggttgtaggtgtcggaactccagcagcgcccggtcgagctgttgatgatgccggccagcacttgggtgtcgatgcccagtgcatcgcccagggccatggcttcgctgacgccgaccatgctgatgccgagcaacaggttgttgcagatcttggcgatctggccggtgccgacgtcgccgcaatgcacgatattgcggcccatctgcgccagcaccggttgcagggtggcgaacagttccggggtggcgccgaccatgaaggtcagcgtccctgcgctagcaccgccggtgccgccggagactggagcatcagctatcaccacaccttgcttggccgccgcagcggcaacctcgcagatggtttgcgggtcgatggtgctgcaatccacggccggtacgccttcaccaattccggcgagcacaccgtcttcattcagccacacgctgcgcacatgggcagcggcgggcagcatggttatcaccagctccgcgccttgtgccgcttcacgcggtgagcctgcgacggtggcgcccagttctgcgaacgccttgaacacgcctggatttacgtcgaacacgttcagcttattgccagccaaaagcaggttgcgggccatgggcgcgcccatgttgcccaagccgataaatgcaatcttcatggtcgtctcccggaatcagcgcaggttgatggtggtgttgacgccatcgttgaccgtgtcgtcgtcgaaccagcggctcgtaacggttttggtctgggtgtagaactgcaccacttgcttgccgtacgggcccaggtcgccgagcttggaaccccgcgagccggtgaaactgaagaacggcactggcactgggatcgggatattgatgccgacctggcctacatcgatttcactctggaacttacgcgccgccgcaccgctttgggtgaacaggccggtgccgttgccgaacgggttggcgttaaccaaagcgatggcctcatcgagggtcgcgacttcgagcaccaccagcaccgggccgaagatttcctgggtgtagatttgcatgtccgtggtcacgcccgagaacagggtcgggccgacgaagttgccttgctcaaagcccggcaccttgatgtcgcggccgtccagctccagcgtggcgccttcttttacgccgctttcgatcagctccagaatgcgtgctttggcgcgcttggaaatcaccgggccgacgtccgtgccggcttcgctgcctgcattcactttgagtttttgcgccagcgccttgaggtccggcagccattgcttagccgcacccaccagcaccaccaccgaggtggccatgcaacgctggcccgctgcgccgaaaccggcaccgaccaaggcattcagcgtgtgttcgcggttggcgtccggcagcaccacggcgtggttcttggcgcccatcatcgactgcacgcgcttgccgtgcttaccggccaggtcgtacacgtgagtgccgacggcggtcgagccgacgaacgacaccgccttgatatctttatgggtgcacagcgcatccaccacatccttgccgccgtgcaccacgttgagcacgcccgccggcacaccggcttccagcgccagctccaccagcaacatcgtcgacagcgggtcctgctcggacggcttgagcacgaaggtgttaccgcaggcaatcgccatcgggaacatccacagcggaatcattgccgggaagttgaacggggtgataccggcgcacacgccgatgggttggcgcagcgtgtaggtatcgaccccaccggcaacgttttcagcgaattcgcccatctgcaaggtgccgatggagcaagcatgttctaccacttccaggccacggaaaatatcgccttcggcatcggcaatggtcttgccctgctcggcgctcaggactacggcgatgcgcttggaatgttcgcggatcagggcttgcagcttgagcatgatgcgcatgcgcgcgccgatcggcgtcagcttccaggtctggaaggcttggtgggcagcgtcgatggcggcgttgacctcatcggcggtcgcaaacgggactttggccagcacctgttgggtggccgggttgacgatgtcttgccagtgggtggtctttgactcgacccattcaccgttgatcagcaacttgacctgttgcacggaaatatcggcagaagcgttcatgtggtctccaatcttgtagttatgcagagacaaggcgcgtgaatcgccttggaaatgaggcgttcggactgtttttcgagtatagatgtgcaaacttctaataagaacgcacataaaagccggtccaatatgcaaaaaaacatcacgtcactgggctccctgaactgggatgacctgaagtttttcctagaagtggcacgcacccgcaaggccagcgtggccgccaagcgcctggcggtggactacaccaccgtgtcgcggcgcatcagttcactggaagtgtcgctcggcacgctgctgttcgaaaaatcccggaccagtggtttcgtactcaccaccgaaggccagcgtttgctgggctatgcggagtccatcgaaagcacgctgcatatggcgtgcgaacaggtgtccggctctggcgtggccttgtccggccatgtgcgcatgggctgcaccgaaggcttcggcagttttttcgtcacgccgcagctcagccattttgtcgacacctacccggcgatctcggtggatatcctgcccctgccccacttcatcagcctgtccaagcgcgaagccgacatcgtcatcgccctggaacgcccggaacacgggccctatgtgtgctgcaaactctgcgactacaagctgcagctgtacgcgacccaggactacctcgaccagcacccgccgatccagcggccggcggatttggctgagcacccgtttatcagttacgtggatgacctggcgttcagttccgagctgttgtacctggcgaatgtagtgcccggcgccagcgcgagtttgcgcagtaccagcgtgattgcgcagtacgtcgcggcgcagcagggtcggtcgatggcgatattgccgtgttttctggcggcgcaggattcgcggttgttgccggtgttgggggagcagatttcgatcacgcggcagttttggatgtattgccgggaggatctgcggaagttgaagcggattacgttgttgtgggattacatcagggaagtgacggagcagaaccaggggttgttgatgggggagacgcgggagatgaggttcgcggattaaagggccatcaacgacgattcgctttaatttgcaggacgtttcctagagactctctaccccattgcgccttaccgtttgggtcactagcctccctgggtcgctgcatatcagcgatcgggtttagcgatccgggtttcaggcgtgacattgccccaatagcactcgctggcgttcgccagcttttagcgttttatggcggctgtgtgcgggagactttcgagtctacccgggatgcgctctggcccggatcgctaacctgcacacagctgccaccctcttcatgtttagcgatgtgatgtggcagctctacttgcgcagagagcattcgtcatgagcaaagtcatacctgatccaccgctttcctccatcaccacccttggcgtagtcaccttcggcgactacggcgaaaaccaaaaacccctgttccgcgtcaattccggcatgcccatcgagcaagccctggaacacgcctccaccctgctgttttactccaaaaaactcgccatggaagccgccatggatgtgcgcggcgagcaatacgcatgggccgcgcattacctgtgtgagatgggcaaggccgtggtggatgacttgacgcaggcgatgacgccgagcagttaagcgaaacactgtctccatgtgggagcgggcttgctcgcgaatgcggtaggtcagtcaataaattattggctgaacgaccgctatcgcgggcaagcccggctcccacatatgaattttggtggatgcgaatttttgctcaggcgcaaataagtgtgggagctggcttgcctgcgatagcggtgggtcagtcagcacatctgctgctgatataccgctatcgcaggcaagccagctcccacattttgaatgcatttcagatttagatcgttcccacgctctgcgtgggaatgccgccctggacgctctgcgtccgctctcggcgttagtccgcgatcaccacaatcgacacgcgccgattctcggtgcgcccggccacggtggtgttcggcgccaccggctcgctgctgcccaggccgcgcagttggatgttttcttctttcatgcccacaccagtcagcacgttgcctacgcttttggcgcggcgcagggacagttgttggttgtagctctctttgcccgaggcgtcggtatggccgtcgacgcgcacgcggttgatgccggcgccgaccagggctttgccgatgcgttcaacgatgtcggtgctggctttgttgaggctttcaacgtcgctgccgaacagcactttgcctgacaggccgaaggcccagccttcgtcggtcagttcgaagccttgctgcttgaggaccgcgacttgggccggggtcaggcctttgggtggggccgtctggcagccgccgagggccagaaaggccaccaatagagtgataaacatacagcgcgcggtcgagaacaagggatcaactcctgtggttaacatttgcggcggtgggctccgattccgccgtttgctggccgccctgggacaaacgtttggcctggtacatcgccgcgtcggcggcattgagcaaggtgccgggggtggcgccatgatcgggataaacggcaatgccgatactgagggaggtcaacacctgggtgttgccgggcagtgggatcggcttgtccatgctggcgatgatcttgtcggcgatgcgctgggcgtcgtcgagtttgtgcagcggcgccagcagcactgcgaactcatcaccgcccaggcgcgccaccaggtcatcttcacgcaattgcgcgcgcacgcgctcggcgacggcgaccagcacggcgtccccggcggcgtggccgaagttgtcgttgatgtctttgaagcggtcactgtcgagaaacagcacggccacgcgctcgttgaccttggcggcgctgcgcagggcacggatcagccggccttcgaaaaatgcgcggttgggcaggccggtcaaactgtcgtggctggcttggtgggcgagggtttcattctcactttgcaggtggctttgccaggcttccatctcacccagcagggcattgaagtcactgccgaggctgtcgagttcggcgatctgcgccggaggcacgcgccggtcaaagtcgcgctcgctgcgggcggcatgggccacggcggcgaggctttgcagcggtcgagtgatgcccagcaacaaacgccgcgccaaatacaacgccacccaggcgctgagggcggtacaaatcacgatgccggccagaccgctgagcagaaaacgcagcaggcttccgccatggccgaccacatgaatgctgcccacggtctgcccttgatgcaggatcggctggttgatgggctgttcgagcaaggcatgcgccagcgccagttcgaccttggagagcatcccggtttctggccgcacccattgcgccagcaacttgccattggcgtcgaacacttcggcctgggccacctcttcggtggaggcgatcaggctgagggcttcggtagcggccgcgctgtcgttaaacaccaccgccgcttccacggtgtagttgatggagcgcgcgatcaggtgcaggttgtgctcggcatacacacgcagcgccagcacgccgagcaaggtcagcgatacgctggccagcgtcacggcgaccagcgccaaaatcaaatgcccacggccgataaccgaacgcagcgtcggccgcgctttcacggctttcatgacgcgggcgctcgacggcgggacaactgcaacacgctggggtgaatacgcacgccactgcgggcaaccgagtccaggttgacctcgaacgacacttgctcatcgcccacgcgcaggcaaaacaggctgcccacggtgcattggtcgccaccttcgctgatgctcaacaccgggtggccgatcagcgaagtaaacagccgggcgcgttcgtctgcgctgagtttgccgatgtacacggcgtcgcaggcactgacaatgtcgggatggtcggccaacaggcgctgcaccactaccggacggccggtcgcctgggtggtgcctttgaccaggtcgtcggtgtattgggtcggcccgacgatgcacaaacgcagttgcgcaggctccaccggccaacgtgcgtaactgaggatgccgagtacgacttgggtgaccgcttgggcgcgttggtcagccgggctgggcgcctcggcaaatgctcgtggggcgagcaggcacacgagcgccaccagtaacatgcgtctccagctcaaactgcgctctgtgggcgagacagccacgttcatgcagcgattctcttcaggtattttcgaggtgatgccgcaacgatagcacagcggcggaaagccccacgaagccggtgcttcgcggagtccgctattttttcagaaaattcagacgactgaatcagaaatatttcatgacctatcagtcagttttttcatcctgggcgtccagctccagcatcaacccactcaagcgcttgaccttacgtcgcacggcttcttcgaacacgccgccacgcggctcaatcaggctgaaccaacgcttggcgcgggtgatgccggtgtagatcagttctttggtcagcaccgggttaagtgcatccggcaggatcagcgcggtgtgggtaaattccgagccctgggatttgtgcacggtcatggcgtacacggtttccacatcgttcagacggctaggcaatacgaaacgcacgccgccttggccatcgttgcgtgggaaagctacgcgcagcacgtgggggccgccgtcagtttcgggcagtttgagggcgatgccgatgtcaccgttcatcaagcccaggccgtaatcgttgcgagtcatcagcaccgggcggccttcgtaccattggtcatcgccttcgatcagccgcactttgcgcaaggcggcggtgatgcgcaggttcaagccttccacgccccaggggcctttgcgcacggcgcagagcagctggaacgcatcgaacgcttgcagcaattgttgcgcccagtgggtccaggccaggtcttcacggggtgtatcgaggcctgggcgcgcgctttgcagcaggttgaggtagtaacgataaccctgggcttcgtcgccctgcccgtccagtaccaggcgctcgaaggcgtggtcgtgctcgcccttgaggctgaggcagaacaggtcatcgtggctgcgcgcggcgagcagtttgcgcgcctcttcggcgttttgctggttgacccagcgcgccaattggccgatgccgctgccttcgccaaaccgtcgcgagtaacgcagcatcaccacttgctgggccaggggatggctgccgtcgaggtcttcttgcaggccgctggcattcaggtcttcgccgctgaccgcttgcagccattggcgcgtggcggggctgtaccagccggcttcggcgtcgcggcacaagtcgccgaggacggcgccggcttccaccgaggcgagttggtccttgtcgcccagcaacaccaagcgtgcgtggggctgcaaggcgtccagcaggttggccatcatttccaggtcgatcatcgaggcttcgtccaccaccagcacatccaggggcaatgggttgccgatgtgatggcggaagtgccgcgtgcccgggcggctgcccagcaagcggtgaacggtggtgacctctgtggggattttttcccgcacattgtcgggcacggtcaacgactgcacttgctggctgatggattcagtgaggcgtgcggcggctttcccggtgggcgccgccaggcggatacgcaacgggctgccggcttccacggcgggcgcctgcaacagcgcgagcagacgcacgacggtggtggtcttgccggtgccggggccgccggtgacgatgctgaaggcaccgcgcgtggccagggcgcaggcgagtttttgccagtcgatcacgccgtcgggcggtggctggttgaacagactattcagacgttgcggcaggtcggcgccgacagtctcctgagtcgccagacgcaagcgcagagcggtgtcgatgcgtcgttcataggtccagtagcggcgcaagtacaggcgtttgccggacagaaccaatgggcggctttgggcggcgtcgctgccatcgacggccagcgcgaccaagtcactggccgccagcgcatggcaccaatgggcgccgtcgaggccgtcgagcagttgcgacggcagcagcatagcgccggtttgcagatcgccttcgggtggcaatgacagggcgaaatccggtgccttgagggtttcgaacaggtcgaggcagacgtggccatggcccagttgatggctggtcaatgcggcggcgagtaacaccagcgggtcggcctgcgggtcgagctcgtggaggaagccgacaaaggccttgtccaacgcgcgcagccagccacggtcaacccagcgctcgagcagttgcaccaggtcggcggcgcggctgaggggctctaacgcctcaagcggtaacggcgaaaggctcatagcagcactccttgttcccaggcgggctcaaccttgggcggtatgggtttgccctgaaacaacaggtccaagccttcgatcagctcccgtggtggccgggtgaaatacgcgcctttgctcaccgattgagtgccgcgcaggaaaacgtagagcgcgccgccaacgtggcggtcgtaatcgtaatccggcaggcgtgccttcaactggcggtgcagggccagcaggtaaagtacgtattgcaggtcgtaccgatgctcgaggatcgactgttccatggcatccgaggtgtaggccgaatcgtcggggccgagccaattggatttgtagtcggccacgtagtagcggccgtcgtgttcgaaggtcaggtcgataaagcctttgaacatgccattgagcaacaccggttcggcggcgacacgggacacaccgttgtgggtgtgctggcataccagcttgtcgagggcgagcacgtcgactttatggctggcgaaccagaactccatctcgatctggtactgctgcaggctgctcagggtgacctgatcgttatccgctggcagcggcgtttgcagcagttggccgagccaaccgctcagggtaacgatccagccttcccagttgcgccggttacagcgcgcgcccacggctttttcgatggcctcggggctgacgttgaagccctcctcgcccgcccattccaacaggccgtggaggaaggtgccggggttagggccacgtgggaaacggtgaatatcgccgccggacgctgccacctcgcgcggtgcgtcagggtcgagacgttcgtcgtcgaacagcttctgggcctgcgggctttccggcgcttcgagacttgcggcgctcatgctctcgccgatgcgcaatgcgctgtaggaggcgatccaccagttttcggcggccttgcgcttgggcagcaacggcgcgagcaaggtggcttcgttgcggggcgggtggaactggatgtcttgcgcgtcgggcacctggccgtaatggatggcggcgcagccctcttgcaaatccagcagccagcgcgccaggccggcagattcgctcagcgatgcccccgcgccgagcaaatagcccagggctgacaggtgcaacacggagctgctgttgttgccgcgcttgaggtcggcaataccgagccagcaggcatgtttggcccgtgtgagcgcgacgtagaacaagcgcaggtcttcggccaggcgttcatcgtcagcttgggcaatcaactcggcggtgggccgcaggctgacttgggatttgccctgttcgtcgtggtaatgcagcggcaaacggctgccgtccaccggtttggctgagcagatgaaaggcaggaagaccaggtcgtattcgaggcctttggatttgtggatggtcacgactttgaccaattgctcatcgctttccaggcgcaggatctgttcttcaccggcctgccccgacagcgcgaggtgttcagccagatgacggatcagcgcttgctcgccgtccagctccgacgcggcctgttgcaacaattcgctgaggtgcagcaggttggtcagcacccgttcgccgtcgctgcgcgcgatcagggtttgcggcagtttgaagtcatgcagcaggcgccgcagcattggcagcacgccttggttacgccagattgcgcggtagccacggaattgcatcacgcgggtttcccacgccagttcgtcctgattcagacgctccagttccgccaatgacaggttcaaggtgacgcaggacagggcggcgcgcagtgggcgctcgacgtccggctcggcgcaggccttgagccaggccaacaggtcgtgggcttcctgggcggcgaagaccgagtctttgtccgacaggtacacgctgcgcacaccacgggcggccaactcggcgcgcacggcttgggcttccttgccgtcgcgcaccaggatggcgatgtcagacggcagcacacctattaagttgtgatcttttacgaagccggccgtaccttgctgtccgccattgagcaactcgacaatttgcgtggcgcaggcggcggccaattgctggcgatacaccgcattggaaatcggctggtcggtgggtaagtgccagaggttcattgccggcagtgtttgaccgtcgacctgcaattgctccttgcgaccttgagacagcaccgagtggaacggcaccgggttgtcgccattcggctcgcggaacaggaaggcgccacggccggtttctgcgcgttggaacacgtggttgaccgcctcgaccatcgcgtggctggagcggaagttggtgcccaaggtgtggtggcggccggtggtggactgacgggcgcgcaggtaggtgtagatgtcggcaccgcgaaacgcgtagatcgcctgcttggggtcgccgatcagaaacaggccgctgtcgaggtggttttcttcgatgcggtagatgctgtcgaagatgctgtattgcaccgggtcggtgtcctggaattcgtcgatcaacgccaccgggaactgctcgcggatcacactggcgaggcgctcgccgccgtcggcgtggagggcggcgttgaggcggaccagcatgtcgtcgaagcccatttcggcgcgacggcgtttttcttcttcgaagcgtttacccacccaaccggcggcgtgttgcaacacggcggcgtcgggagtgggcaaggcgtcgaggctggctttgaggctggccatggcgtcgatgccagggtggctcggcggctcgcccttccaggcttcggccatgccgtcgggcgtcaggcgcgtgaagccggtgccgatgtcgagttgttcgagggtttcgtcagcggcccaggcgctgatcttgtcgaaccagggttcgaagtaccgcgcttgcatcttgcggccgtcgacggctttggcagccacggcttgcaggcaaatatcgcgcagttcggcggcccattgttgccagggcgccttgagggtgaccaaggcttcgcggcgttcttgcaggcaggcgttgatcagctcggccggctcgcgcgtttcgtcggtcggccgttcgctgccgaacaacgcacgcacacgcggcatcagcgcggcggggccgctccagtttttgcgcacccagttgagggcgtcgtcgtgcatcgggtagcagaacagccgccagtagtcgcgcagcacttcgccgagcaggtcgctgtggtcggtttccagggtttgggtgaacaggctgccgctgtcgaatgcgtgttcgcgcagcatgcgctggcaccaactgtggatggtcgaaacggcggcttcgtccatccattgcgcggcgatgtccaggcgattggcacaggccggccactgctcggggaggtattcgtcgcgcaggtgggcgatcagggcatccggttgctcgatttcatcgcggaaaaagcgcgcggcttccgccaagcggatgcggatgcgctcacgcagctctttggtggcggcgtcggtgaaggtcaccaccaggatttgcggcggcagcaattcgcgcgcgaagccggactcatcaccgccgtggccgagcaccaggcgcaggtacagggcggaaatggtgaaggttttacccgtgccggcgctggcttcgatcagttggctgcctttgagcgggaaggccagggctaaaggtttactgatcatgcgctggcctcctcactgctgagcgatcgccacggcgcgttgagcaatgggcggtacagggtttcagcccagccttcgaattcttcgctggcgatgagcgtggcgtagtccgggaattgccgcgtgagcgccggagtttcgcggcgctcgccatcggtggtcaggccgtctccttcataggctttgctggcggcggcctgggccttggcggggtcggtttggccgagccaggcgaaggcggttttgaccgccaccgggagtggttttcgcatgccggtgtgccaggccagcagcaggttgccgaggatttcctgggccgcggatttttccaggggggccaggagcaaggtgtcgtcgctcgcgaccaacccggtgctgagcggcaggccgcaggcgcaggccaccacgtgattgacccaagggcgaatcaggcggtgccacttgcgggtcttgatcgagccgatgctgttggggatggtggtcacgctgagcaacccgccatcactgcgccgatgcaggccactgatccagccttccagctgaatgccttgatgctcaaaactgatcggttcggcggctgtgtgtggcgtgggccagagcgcgagtaattggcggtagcgctgcaacagatccggtaatggctcgatcagttcgttacgcaggcactcgccgaaaccgaccatgggcagcaagccactgccttgcaggcgcagggcttgggcgctgagggcctgatccacttggtcgggccgggtcaaggcggcgttcagcaggctgtcgctgaggctgtagcgttgcagcgcgtcgaggacgaagggctcttcatcggccagcgggacttcggcggcctcgaagaacactttcagacgttggctgaagaagtgtttgaccgggttgcgcaggaagtcctgcaactgaccaagactcaggggttcttcctggtggtgctctgtcagttcgactgcttgtgcttcggtatcgcgcggttcgtggagcagctgccattcgcgggcgtagctgaacagcgggtcgcccgcatggaaatagcgcgcactgaagggttggagcgggtgttcctgggtcatcgcttccagcagttcatgggtgtctgcgttatgccagccgctggcgatatggtcgcgcagttggcctatcagcacagaggccgggcggtcgctgttgtcgcggatgctgcggcctacccaactgatgtagagctggtcgcgggcggacagcagggcttcgagcagcaggtagcggtcgtcttcgcggcgtgaacggtcgccggggcggtagtcgctgcccatcaggtcgaagtccagcggtggttgcgcacgcgggtagtcgccgtcgttcatgccgagcaggcaaaccagtttgaacgggatggcgcgcatgggcatcagggtgcagaaattgacagctccggcaaggaagcgctgagacagtcgaccttggtccaggccagccagccaggcttcgcggactacggtgaggggtaactcgtcttgtagtccaacggactcacaggtttccagccagtcttctcgaagttgttcgagttggcccaggagatagtcgtcgtgctcgctgctgggcaggaagaacagttgcatcaggcgttgcaggcgctcaccccactcctggggcgcggccggttgggacagggcctggtgggcatcgtttaacgcatcgagcaaggagaccagcgggccgatcaacgccgcatcgaggccgccgatttcgtcgtagggctcaatgccgtcgcaggcgattccggtgccgacggcgtaacccagcagcatgcgccgcaggccgaatcgccagctgttttgttccagctcgttcggcagaccaagccctgcacgctgttcggcattgaggccccaacggatgccggcgccttcgatccagcggtgcagtgtgggcaggtcgcgttctttgatggcgaagcgctcgcgcaaggcgggaacgtcgagcaggtcgaggatttcgctgacggggaagcggctgtccgggagtttgagcagatgttcgacggcgatcagcagtgggtcacggccacgttggccttggtcggtgagggtgaacgggatgaaacgtggatcacctttttccagttggccaaagacggcgcggatgtgcggcgcgtagctgtcgacgtcagggaccatgacgatgatgtcgcgcggccgcagcgagggatcggcgctgaagcgttggagcaattgatcgtggagaatttctacttcgcgttgggcgctgtgggcgatgtgaaaacggatggagcggtcgttattgaggtcgacgcccggccacagctcgcgtgtttcgttgagtgggcgaagctcaaggatgtcgtcctggagctggttgagcagcgtggtcggttcgctttcgctgaacaggtcgatgcgaccgtcgcggaatgcggctcggtagctgttggggtcgtcgtaactgtccagcaggctgatgtagtcgcggccttgtttgccccaggcggcgagcagcgggtgcgcatgctggtgcagggtttgtgggtcgatggtgaccggcatacccgctttacgcgcttggcgtttgtactcgttacgcagcaggtctttatcggcgacgatgtcggaccagtgatggcggcaagggttgtgcacgcatagcaggacttggctgaaacgtgccaggccggcgagtgcttccaacgcctgtgcaggcaaagaggaaatgccgaaaacaatcactcgtgacggaaggccttggggggctttttcaagggcgttgatgcgctcgatgaaccgctggtgaacgcccgcgcggctttcggccatgccctcttcacctacatccaatagcagtgcgcgccatagttcggcttgccagcagttcgcggggtttagtggtttggactcgcctcggccgttgcgcagttggtggcggccagcagcccagtcttccagccagtcggcgcggtagacctggtattggtcgaacaggtcggccaggcgttcagccagctgatagcgcttgcgcaggtcggtgtcgtgggtgaggaagcgctgcaggggttcgaagtgtggttggtcgataagctctgggagcaggcgcattagacgccaggtcagtggggctttatcgagcagggacttgggcgggatttcgtcccggcccagtaccatgcgatagagctgccacatgaagctgccagggagttgcacatcaattgccgccgcgatgccgcagccacccatgtcgtcttcttccgggtcttcggccaaagccagcttgagccattgggcgataccgttgctttgtaccagtgcgatctcgttttccaagggggcgagcggatagcggcgcatccagctgactaccaggctgcgcagttcatccaggcggttgccgtgaaccaccatgaatccagcgctgagggacgtcgcatccggcataacggcttccttgggaaaagcaaaatcgagggagcgactttagcattgaaggcgacggcaagctgcaagcgaggctgtcaggagtgtaagagacggtcacagagtttttccgaccgcccaaaacaaaacccctgtttgcgttagcaaacaggggttttggaatttaatcttgacgatgacctactctcacatggggaaaccccacactaccatcggcgatgcatcgtttcactactgagttcgggatgggatcaggtggttccaatgctctatggtcgtcaagaaattcgggtactgagtcgtgaccaaat

SEQ ID NO: 49 - DNA, 99919 bp, Pseudomonas poae FL10F
tttttctccgctttcgaccgagaagatcgaaacgttaatagagccaaacaacaccgctctaccaactccttctgggcctcgatgaactgaagcaaatcgctgtcgaattctgcgtaactctttgtttaccaacgagttttccgtttcgactgcgccggaagtggggcgaattatagacttcctgattctgccgtcaagcactaattacgcttttgttgcagaaattggttttttcgcgataaggcgtggaatccggcgcattacgggcggaatccgcagtaccaagagcaatgcgcctatagatgcataaatagcccactccttgaggtcagcacgcacaatccacagcatatgcagcaaacccagcccaagaatcacatacaccagacgatgcagtttcttccaacggctgcccaaccgacgctggctatagcgattggaggtcaccgccagcaccaataaacagaggaagcccagcgcacccacaataatgtaaggccgcttacgcagctccaccccgaattgcgaccaatcaagaccaagaatgaagacgcagtaagccgccaggtgcagaaccacatacgcaaaacaccaaagccccagctgtcggcggaccgctatccaccccgcccacccgctcagcttctgcaatggcgtcatgcccagcgtgatcagcaacagaattaacgtcccaaggcccaatcggtccatcaacactttgccagggtcgggcccaagcacagaactccacgcctcatacagccagaaaaatggccatatagccgccgctataaaaacgcctacgcgccagatggggtaacgcatcagtagttcttccgcagatcgagaccggtataaagcgaggcgacctcatccgagtagccattgaacatctgcgtctcgcgcacattcgggctgaacagaccacttggcagacgacgctcccgcgcctgagtccagcgtgggtgatcgaccgtagggttcacgtttgcgtagaacccatattcatccgcagcgatactctgccaggtcgttttcggttgctcgctcaccaggctgatccgcacaatggatttcacgctcttgaagccatacttccacggcaccaccagacgcaacggtgcaccgttctggttaggcaactcacggccatacatacctacagcaaggatcgccagcgggttcatcgcctcgtccagacgcagcccttctatataaggccaatcgatcagaccaaaactcgagcgctggcccggcatgcttttggggtcctgcagggtttcaaagcggatgtacttggccttggaggtcggctcaacttgcttgagcaaggccgagatcgggaagccgatccatggaatgaccatcgaccacgcctcgacacagcgtaaacggtagatacgttcttctaactgatagggcttcatgaagtcttcgagggcatagcgccccggtttcccgacttccccatcaatcaccacactccaaggttcagtcttgagtgaacccgcattcgtcgccgggtcgcccttgcctgtaccgaactcataaaagttgttgtagtgggtcgcgtccttgaatggggtaatggcttcgtccttgacggtcaccgcctgccatttcgtactcggcagtttttcggcaaaccagttcggtgctttgcccggctccacgtctgcgtaacgcgcagcctcctcagcgctggcccagcgcggcaatgcactggcggccacgccggcgagcgcaccaccgagcaagctacggcgagaaagatagaaggattcaggcgtgacatccgattcgtgacattcggacgctttggggattttgattaacatggcaactccgcagcattggaggactgatgcaccaatagactgcggagtatggcggacattacattaaggcaatgttttgtcgcgtcgcagatgcagaaggtactgaatcggccccgaagcggcgtaaatcaggaacgccagcagcagaatacgcggcggatcactgaacacgaccgcgaacaccagcaccaccacgaggatcgcgacgaaaggcacacgccccttgaggtcgaactccttgaaactgttgtacttgatgttgctgaccatcagcatgccagcagccgcaaccatcaaggccaccaggaaggacatcttcgaaccctggatgccgtagtcactgaaggcccagacgatacccgccactacacccgcagcagccgggctggccagaccaatgaagtagcgcttgtcggcagtgcccacttgggtattgaagcgcgccaggcgcagcgcggcaccggcgacatagatgaaggcgaccatccagccaaccttgcccatatcccccagcgcccaggcaaatgccagcaatgcaggcgcaacgccgaaagcaaccatgtccgacagcgagtcgtactcggcaccgaaggcactttgcgtattggtcatgcgcgccacacggccatccaagccatcaagcaccatggccacaaagattgcgatggcagcaaagccgaaatacttgctggcgctcaccgcatcacccgccgccaatgcactttgagcgctcatggagttgatgatggaatagaacccggcgaacaggttcgccgtagtgaacagattgggcagaagatagatgccacgatgccggaccttgcgaccttccgcgtcatgcccttcttcgacatgctcatcgatcggtagcaggctttcggcgtcagaggcctggtgtggctcttcgggacgttcgctcatggactttaccttgcaacggtgtgaaaaaattcgacaaatacttgcggcgagtgttcgcccgcaaacgatgcagctttataccagaaccagcccctcaaacgaaaaaacgcggcctaagccgcgttttctctagatgcgtacgacttagtttttagctttgtcgacgatcttgttggcaccgatccacggcatcatggagcgcagttgctcgccgatgacttcgataccgtgagcggcgttgttacgacgcttggcggtcatcgaagggtagccggttgcgccttcgctgatgaacattttggcgtattcgccgtcctgaatacgtttcagggcgttgcgcatggcctgacgggactcggcgttgatcacttccgggccagtcacgtactcgccgtattcggcgttgttggagatcgagtagttcatgttggcgataccgccttcgtacatgaggtcaacgatcagcttcagttcgtgcaggcattcgaagtaggccatttccggcgcgtagccagcttcaaccagggtttcgaaaccggctttaaccagctcaacggtaccgccgcacagaacggcttgttcgccgaacaggtcggtttcagtctcgtccttgaaggtggtttcgatgatgccggtacgaccgccacccacgccggcagcgtaggacagtgcaacgttcttggcgttgcccgaggcgtcctggtagatcgcgatcaggtcagggataccgccgcctttgacgaactcggaacgcacggtgtggcccggtgctttcggcgcgatcatgatcacgtcgaggtcagcacgcggcacaacctggttgtagtgaatcgcgaaaccgtgggagaaggccagggtggcgcccttcttgatgttcggctcgatttcgttcttgtacagcgaagactggaactcgtccggggtcaggatcatgaccaggtcggcagcagcaacggcggaagcaacgtcagtcactttcaggccatgggcttcagccttggcaacagtggccgagcctttgcgcaggccaacagtcacgtcaacaccggaatctttcaggttgcacgcttgagcgtggccctgggaaccgtagccgatgatggcgactttcttgccctggatgatcgacaggtcacaatctttatcgtaataaactttcatgaggttcctctatatatccaggccgtaaggccattcgctaatttgggttagatgctgagtactttgtcgccacgggcaatcccggtgacaccactgcgtaccgtttccagaatcgaggccgtcccgatcgactggatgaagctgtccagcttgtcgcttgtaccggtcagttgaacggtataaacgctggcactcacatcgacgatctgcccgcgataaatgtcggtggtgcgtttgatctcggcacgttgggcacccgtggccttgaccttgaccagcatcagctcgcgctcgatgtgggcactttccgacaggtcgaccagcttgaccacttcgatcagcttgttgaggttcttggtgatctgctcgatcacctcatcgtggcccacggtggtcaacgtcaggcgcgacagggtcgggtcttcggttggggccacggtcaggctttcgatgttgtagttacgttgcgaaaacaggccgacaacacgagacagagcgccgggttcgttctccagaagcagggagataatgtgccgcatgattaagtacgctccgtcttgttcagccacatatcgcgcatggagccgtctttgatctgcatcgggtagacgtgctcgctggtgtccacttgaatatcgaggaacaccaggcggtccttcatggcgaacgcctcttccatcttcggcttcagatctttcaaatcggtgatgcgaatgccgacgtggccataggcttcaaccaacttgacgaaatccggcaacgactccatgtaggaatgggagtgacggctgttgtagctcatgtcctgccactgacgaaccatacccagcacgccgttgttcaggcagacgatcttcaccggaaggccgtactgcaggcacgtcgacagttcctggatgttcatctggatgctgccttcaccggtgacgcacgcgacgtcggtgtcggggaagctcagcttcacacccatcgccgcagggaaaccaaagcccatcgtgcccaggccaccggagttgatccagcggttaggcttgtcgaacttgtagtactgcgcggcgaacatctggtgctggcccacgtcggaggtcacaaaggcgtcgcccttggtcacttcgcacagggtttcaatcacggtttgtggcttgatgatgctgccgtcgcccttgtcgtaagggaacaggccgcggtcaccgcgccattcgtcgatctgcttccaccagctggcaacggattccttgttcggtgtttcgccgatgtccttcagcgcggcaaccatttcggtcaatacgctttctacaggacccacgatcggcacgtcggccttgatggttttggagatggatgccgggtcgatgtcaatgtggatgatcttggcattcgggcagaatttgctcgcgccgttgatcactcggtcatcgaaccgcgcgcccaccgccaggattacatcggcgtggtgcatggccaggttggcggtgtagctgccgtgcatgccgagcatgccgacgaactgacggtccgaacccgggaatgcgccgaggcccatcaaggtgttggtaaccggcaggttgagcagtttggccagttcggtcaacggtgcggaaccgccgcccagaatcacgccgccacccgagtacagcactgggcgcttggccgccaggagcatttctgccgccttgcggatttgccccgagtgcccacgaacggccgggctgtaggagcgcagcttggctttcttcgggaagacgtattcgaatttttcagccgggttggtcatgtctttcgggatatctacaacaacaggccccggacgaccggactgtgcgaggtagaaggcctttttcatgacttccgggatttccgacgcatgcttgatcatgaagctgtgtttcacgatcggccgggagataccgatcatgtcggtttcctggaatgcatcggtaccgaccatggtgcttgcgacctggccagaaatgatcaccatcgggatggagtccatataagcagtcgcgatgccggtaatggcattggttgcgcctgggccggacgttaccagtaccacgccggctttaccggtggcacgggcataaccgtcagccatatgggtcgcggcctgttcgtggcgaaccaggatgtgggtaacagccggttccttgaacagtgcgtcgtaaacatgcagcagagcaccacctgggtacccgtagatatagtcgacgccttcgtcacgcaaaaagcggacgagcatctcaccgccagataaaagctccacgttgttcacctctaaaacgccagaataccgtccgttaaaaaccgacgggtcttaataggtttacttctcaacagagcatgagcgacggtggtcgccgactacgtcagcactgactgagcaagtattgggatcgtcccaagtgttgcgggcttttcccacccagcgcgaggtaacgcgttgcgggtgttacaggtcggcgcggatatgcgcctcatgatctgctgagcgggcctgcttctggcagtcccgatacagcggactttggattcttctgtttcagccccttcaagtcaagcaataattgcgcttttttccaactaagcgcatgagaacgcataagaaaggggtttgaggagggataaaactcgcctgaatgtcgtcaagcggtagaaatgtgcgcaagactgccggaaaaaccggcagtcaggcaattaacgagcgtcgacgatcaattggtcgaactttttcagcgcattacgcaagccaaggctttcccgcggccgatcggcgtaaaccatctcggccatttccaggatccctgatgcattgggcaatggcaggtcctgctcgaggatctgcttcatgcgcaccagaaaaatccattgcagccattggtggaaatccagggtgtcgaccgaaaaaggctcgacactgctgagcgcctcggcgctgggggacacctcgtcccaccagccctgcacgcgcaattcgcgctcaatcagcaataactgttcggcaatcgctggaaaacgcgcatccatcagaggctgaccttggctttttgacgtgcctgggcggcaccggcggcgtcgccttgtgcggcacgtgcatcaccaatcaaggcccacaggttggcttgcaggtctgggcgaccattggccagggtcaggccgcgacgggcgaactgctcggcttgcggcgcatcgccctgggccatgcgcacttgggccaggcgatacagcacttgcggctcacgtggagcaacgcgttgggcgcgctcgaggctcgacgatgctccattcaagtcgccacccgcctgttgctgctgggcggtggtcagcaaagccagaaccggcccgtccaattgctcgtccgctgaaaggccgccagcgctggacgccgatggaatgccactcggcgtggaaggcatgttgtaggtgccctgattgaccggcgccgtttgaatcggcgtggagtcaaccggccccgatgtgcttggccctggtgtccacggctcggcactgatcggtgcggaggtcgcagcaccaccgcccggcaccatcaccactacacccgaatcctggggaatggattgaggggtggcttgggcaggacgcttgaccacggtctgacggaaaccgccgttggccgagatgcgatcgttattcgaaaccgtcgtgctcgagtccacaacgggaatcgagccgcgctgcacgcttgagcaaccgctgagcaccgcgagagctgtaatagctggaatcaaccacttgttcacttgaaaccctctttgcttaattcatccagcccttgacccaatccatcaccgattccgcgtcagcgggggcactgccaccgcatgcggcgccgggtggtggctcgctgccgcgaatatacggcatctgcactgcgcccggacagttggcatcggagccctgccccgtgtgcggatcaatccaggcctgcacgatgttgtccggttgcggcatgttcagcggcaacgggtcggccttgcgcatgaaactggtccagacctgcagcgcaccggtggcacccgtgaacggtgtcttgccattgtcgtcacgccccagccacaccacggccagtacatcctggccgaagccggcgaaccagctgtcacgcgaatcgttactggtgccggtcttgcccgccagcgtcaggtttgacggcagcacgctgtagaccgagcgccccgtaccttcacgcatgacgcgctgcatggcgttctggatcaggtaaatggagcccgcatcgaaacgctgctgaatctggaacggataccgcttgagcggctcgccttcggcagtcagcacgctgcgaatgccgcgcatcggcgtattgaaaccaccgttggccagtgtctggtacatcgtggccacttccatcggcgtcatggcgccagcgcccagcagcatcgatgggaacgccgggaactcacggttgatgcccaggcgacccaaggttttcaacacattcggcacacccacttccagcccgaggcgcgaggtggaaatgttgtaggaatgggccaggccttgatacaggaacacggtgccgtgggatcgacgatcgaagttctgcggcgtccacacctggccatcggcacctttgaccgacagcgggtcatccgagagccaactggtcaacgtgtatttgctcggtttttccagggccgtcagatagaccgccggcttgaccagcgagccgatcggccgcacagcatccaatgcgcggttaaaaccggcaaagctcgcctggcgactgccgatcatggcctgcacttcaccggtttccgggttggtcacgaccatggccgcttcgacctcatcggagcctttgcggccggtcaggcgcttgaaggtgtcgttaacggatgcttcggctttcatctgaagaatcgggtcgaaactggtgaagatccgcagcccctcctcggtcaagtcttcgtcgcgatagtcttcacgcaactggcgtttgaccaggtcgataaagcctgggaacgagctgtcggccagcttgccgcgggtcgtgacgcccagtggcattttcttcgccgccgcgacttgctcggccgtagccacaccctgctgctcgagcacgtccagcaccaggttccgacgctcaagcgcgcgctccgggttgcgacgcgggttgtaataggacggccccttgaccatgcccaccagcaacgcaacttgatgcaacttcaattcggacaacggctggccaaagaagaactggctggccaagccaaacccgtgaacggcgcgctggccatcctgaccgacgaatacttcattgaggtaagcctcaaggatttcctgcttgctgtaatgcagctccagcagcattgccatcatggcttcggtcagtttacgggtcaggctgcgctcgttggtcaggtagaagttcttgaccaattgttgcgtcagcgtactgccgccctgagtcatcttgccgccagaggtgttgacccaaatggcgcgagcaatcgacttcggcgacacgccccagtggctgtagaaatcgcggtcttccacggcaaccagggtttcgagcaggtacggcggcacctgatcaagcttgatcaggatgcgatcttcaagatttttcgggtaaataccgccgatcatcagcggttcaaggcgtaccaccggcagcttcgaaccgttgagagacgacagctcggcaacgtaatcgccggagaaacgcacgcgcaccggctgggctttttccaggccctcatagaattggaaaccgcgggtgttcaagtcaacggtattgccgctgacggcggctgcgcccgggccattgctcactggctcgcggcggtagcccagtgcatcgagttcggtaaggaagtcatccttgctcagcttctggccggtgaacagttccagcgggcgtgcgtacaccttggccggaatggtccagcgcttgccggagaatttctcctggaccacagcgtcgaggtacaccgcgaagccggcgagcaccaccaggcctaccaggcttagcttgagtgcccagcccagccacgggcgcaggccgcgggaaggaggttttttacgggaacggggagatcgggttcgagtcatggcggcggattatacgcactttattgatgatcaacatgagccggacagcggtttgcacgaccggctgtaaccgccataatgcccgccatgatttccccccgactttgaaggatcgcctgtgagccagtccctgatcgctgccctgcaaaacccggctttgtatccccatccggttgaagcgtttcaagttatcgagacccatatttcctgggtcattctgaccggccccttcgcctataaactgaagaagccgatgaacttcggcttcctggatttcacccaactggatgaccgtgggcacttctgcaatgaagaactgcgcctcaaccagcgcctgactgaagatttgtatcttgaagtgttgccaatcaccggcagcgccgaagccccacaactgggcggcgacggcccggtgatcgagtacgcgctgaaaatgcgccagttcccgcaaagccaactgctcagcaccttgcaagccaacggcgaactgaccagcgcgcacattgatgaaatggccaggcagattgcgcatttccacctcagcgcaccgaaggttccacaggagcacccggccggcacgccggacgaggtgatggcgccggtacgccagaacttcgagcagatccgcccattcctcagcgaaaaagccgacctggctcaactggaagccctgcaagcctgggctgaaagcagcttcgagcgcctcaagccactgttggtacagcgcaagctcgatggcttcacccgcgaatgccacggcgatatccacttggggaacgccacgctgatcgacggccaagtggtgatcttcgactgcatcgagttcaacgagccgttccgcttcaccgatgtgtacgccgacaccggtttcctggcgatggacctggaagaccgtggcctcaaatccctggcgcgccgctttatcagccaatacctggaactgaccggcgactaccaaggcctcgaagtgctgaacttctataaagcctatcgcgcgctggtacgcgccaagattgcgctgttcagcatgccaagcgaggcaagcccggtacaacgcgccaccaccctgcgccagtaccgcaactacgccaacttggcagaaagttacagcacgattccttcgcgcttcctggcgattacccacggtgtctcggccgtcggcaaaagccacgtggccatgcgcctggtggaagcattgggcgccgtacgtctgcgttcagatgtggagcgcaagcgtctgtttggtgagcagcaggtagagaacacgccacaggccggtatctatgccgccgacgccagcgcagccacctatgctcgtctgaacgaaatcgccgataccgtgttgcgtgcgggctacccggtggtgctggatgccaccttccttaaaagcgcacaacgcgacgcagccgccaaaattgctgaagccaccggcgcacccttcctgatcctggactgcaacgcaccgcaagctgttatcgccagttggttggcacaacgtcaggcggataaaaacgacccttccgacgcgacactggccgtaatcgaagagcagcaagcgaaccgtgactcactgacctcccaagagctactgctcagcaaacgcgtcgagaccaatgagagcggaacactggatgccttggtggcgcacatccgccaagccctgccaggcttgtaagaaatatttcttggtcgtgtcaccgatctaccgtgcacgaccgagaaatagtggcactataatggcgtcataattccaacaggagtcgccgtcatgagtcagcccaagcttcttgataccccgctctacgcgctcctgcacaaggacgacattcgaggcttcaaccaggaacgccccaaagacgcaaccatcgacatgcgcggtggcgatttccgcgggctggacctgcgcgacctggacgccaccggtgtcgacttcaccgacgcctacttccgctccgccgacctgcgcggcctggacttgcgcgactgctcattggagggcgccagcctggcccatgcacagatctccggcacctacttcccgcctgaactgactgcggacgagattctgatgtcggtcaatttcggcacgcgcctgcgctaccgcaccaagtgacgccccctgtttaaccccggctccgcatccagcgcgccgggtgattcgcacctgcccacatacaaacactcagcgccattcttataagcgtttcagccgttcctgaccaaagaactacgcttttcctactgagcgctacactccttttcaggcttgcctggtcacgaatacccaccgcaccattcggccgtcgcaaggaggcttgatgaacgatgagctgcaacacctgaaaaaccttggcaagacgtcggcgcagtggctgcacgcggtgggcatccacagcgcgtccgacttgcgccgcctgggagcggtcgatgcctaccgagccgtacgaactcgcggcttccgggcatcgaaagtgttgctgtatgcaattgagggcgcattgatggatgtgcactggaacgacattcccgcggagcgcaaggaagctctgaaccgccagttggatgccatttcagcgcgtcagaagatttagttcggcaatcaggcccagtgtttacgggcattgcgaatgcttattggagaaatcagtaaaacgcacgaaaacaaatgttgactctcaaatgagaatcgttatgattatcacaactggtcgcgagatcagccgataactgaaagaccattggttcggactctcagattatctcctcatcaggctaatcacggttatttgacccggctcttgccgggtctttttttacctgtagaaagctgcctgtaaaaaagccagcctcagcgtgcaatgatcagcggatgcccacgctccggatgcggctgcaccagcacatccaaaccaaacacagccttgagcggttccggtcgcaagacttcggcgggcgtgtccagggcgtgtgggcgcccgtcctgcagcagcaggatacggtcacagtagcgcgccgccaggttcaggtcatggaggatcaccagcaccgccgcgcctcgatcggcgaagctgcgaatagcctgcaacgtcgtgtgctggtgcaaagggtcaagcattgacgtcggctcatccaatagcagcgtctgccccgcttcacccggccataactgcgccaatacccgcgccaggtgcacacgttggcgctcgccaccggacaacgccaggtaactgcggccgctcaagtgcccgacgtccgctgcgtgcaacgccgcgctgatgatttcgtcatcacgtactcgcccggtctgatgcggcaaacgccccatgccgacgacttcttcgaccctgaacgcaaaatccagggtcgaggtttgcggcaacaccgccagccgttgcgcacgctgcgagccgctccaactgcttagcgcttgctggtccagccacacattgccctgatcagggtgcaactcaccgcatagcgcgcccagcagggtacttttgccggcaccattgggccccagcacgcccagcacctggcctggcaacaggtccaggctgacatctgccaagacagtcttgcgaccgcgccgaatctgcagcgcttcgactcgcagcatcaggcacgcccccgcaacaacagataaagaaaaaacggcgcaccaataaacgccgtcacgatgccgatcggtaactccgccggcgccaaggccaggcgcgccaccaagtccgcaaacagcagcaaactcgcgcccgccagcaccgaggccggcagcagtacccgatggtccggccccgccagcagccgaaccagatgcggcaccaccagcccgacaaacccaatcatccctgccgccgctaccgccgcgcccacgcccagagcggtgcaaaacaccagttcacgcttgagcccttcaacatcaatgccaaggtggctggcctcggactcacccaacaacagtgcattcagcgccttggcccggcgcggcagccacagcgccacaccggcgctcaccagcaacaaaggccacaaccgcgaatagctcgcgccattgaggctacccaggttccagaaggtcagggtgcgcaaggtggcgtcgtcggccaaataggtaaataaccccaccgcagagctggcaagggccgtgagggcgataccggcgagcagcatcgtcgccacattggtctggccgttgcggcgcccgaggcgatagaccagggccgtgacgcccaacccaccgagaaacgcacacaaggacaataaataaggcccgaacgcatccggcagcccgccaaaaaacgcaccgccgacaatcgccaccgccgcgcccagcgccgcaccactggacactcccaccaagccaggatcggccagcgggtttcgaaacaacccctgcatcgccacacccgacagcgccagcacaccgccgaccgccaaaccaagcaatgtgcgcggcaggcgaatctgccccaggatcaattcggcctgctccaggccttgggcatctatcggcaaccccatcaaacgcaaggcggccctgagcgtgtccagcaacggcaggctcaccggccccaaggccagtgagagccagatcgccaatacacacaacagcgtcagcccgataaacagcgttttcggtttaaccagagtggtcatggggcaggtttagcctgggacggataaaacccggcagacagcttcaccaggttttgcggcaaacgcggccccagcccgccgaccagcagcgtcgggtcgagctcaaacacgcggccacgcttggcggcgggcgttgacgccaaaatcgggttttccttgaacaatgccgcgcgggccgcatcaccggtaagggcacgatccgcaaacaccagcacatccggactcaaccccgccagcgactccaccgaaaacggcttatagcctgtgtgggtcgccaggttccgcccgcccgcctgttgcagcagccaatcagcggcggtgtctttgcccgcaatcagcggcttgccgcccgcatggccgagcaacaacagcacgcctggtgccttttgtgtggcctgcgctttggtgacccaggttttctgccgctcaagcgcctgttcatatccggtaaacaattcgttggctttggcctcgcttccgagcaacttgcccaagtgctgcaggttgcccttcagggtaggaagatccggttcggccgaaaacatctccacctgcacgcccgcgccacgaatttgcgcgagcaccggcggcgggcccatttcttctgtgcctaccagcacctgcgggcgcaggctgagaatgccttcggccgacaactgccgctgataaccgatgctgggcaacgctttcagcgattccgggtgctggctggtagtatcaacgcccaccagtttcgattccccgcccaaggccgtcacccattccgatagcgccccaccggcactgacccagcgttgtggcagttcagaggcttgcgccccttggtggaccagcagtgaggcaacgagcgcgatagcgctggtactcaggcgcataacagggtttccttccaagggcagggcgaagccggcatttgataattgtttgcatttgcacgtcaaggcacttaaggattgaaatgaagtttctctgcccctccgacaccctcgcgcccaacagcagcctcggctttgagatcgacggttgcaagctgttggccgtgcgccgggacggcgttgcctacttctatatcaaccgttgcccccatcgcggtatcccgctggaatggcagcccaatcagttcctcgacaccagcgccagcctgatccagtgcgccacccacggcgcgctgttcctgatcgagagcggcgaatgcatcgccggcccgtgcgcgggccaaagcctcaccgccctgcccggccgcgaagacgcacagggcttgtgggtggaactctagtcgccgatcagcacttccaagcgccggtcgaggtaaatttgctcaggcgtaacgtgcacgccgtacgccagcacctccacacccgcagccttggcctcacgcaacgccgcggcgtaaccggcgtcgatttctacagccgggcgcaccgcctcgatccccgacaagttgacgcaatacaactgcaccgcccgcacgccgtcgcgcgccaggtacgccagttcacgcaaatgcttggcgccgcgctgggtcacggcatcgggaaaggcggccaccgcagtgccgtcaaagcccaaggtgacacttttgacttcgacaaacgccgcgccctgtgggtaatccaggcgaaaatcgatacggcttttctcctggccgtaaggcacttcgcgcttaagcgcggtaaagccattgagctcggtgatgaccccggcgcgcaacgcctcctcaaccagctgattggcgcgcgccgtgttcacgcacgccagccggccttgcggcgtttcggcaatttcccaggtgcccggcagcttgcgcttgggatcggtggagcggctgaaccagacctggccgccttccaccatgcaattaagcatcgacccggtgttcgggcagtgaatggtcagcaactcgccggtaacggtttcgatatcggtgagaaagcgcttgtagcggcgaatcagccgcccttcttcgaggggaggatgaaaacgcatcagccttgccagctccgtaagccgcgggcgattcgttcgaccgcctcttgtagccgttcgaggttttgcgtgtaggcaaaacgcacatgatgaccggcctgataacggccgaaatccagacccggcgtaaaggctacgtgttcggtttcgaggaaatggcggcaaaacgcgaaggcatcaccgccgaacgcgcttatatcggcgtacaagtagaaggcgccttccggctctacggcgatgccgaatccaagctcacgcagggcgggtagaaggaaatcacgacggcgaccaaactcggcgcggcgctcttccagaatgctgagggtttgcggggtaaaacaggccagcgccgcgtactgggccatgctcggcgcactgatgtagaggttttgcgctagcttctccaactcgcccaccgcagcgggcggcgctaccagccaaccgaggcgccagccggtcatgccgaaatacttcgaaaaactatttaggacgaacgcatcgtcatcgacttccagcacgctggcggcgtcggtgccataagtgaggccgtgatagatctcatccaccaccaagtgaccgtcacgcgccttgatcgcactcgacaattgcgccaattcgtcccgcgtgaggatagtgccagtggggttggcaggcgacgcaaccagtgcgcccacgctgtcctggttccaatgcttggccaccaggtcggcggtcaattggtaacgcacgtccgggccgaccggcaccagttgtgccgcaccttccaccaagcgcaggaaatgccggttacacgggtagccggggtccgccaacaaccaatgtttaccgggatcgaccaacagactgctggccaacaacaaggcgccggagccaccgggggtgatcagaatgcgctcagggtcgacattcagcccgtaacgctgctggtaaaaaccactgatagcctcgcgcagttcaggcagcccacgggctgcggtgtaacgggtcttgccattcgccagcgccgcctggccggcctggatgatgggctcggccgtggtgaaatccggctcgccgatctccaggtggatcacatcgtggccggccgactgcagctcgttcgctcgcgccagcaacgccatgacatgaaaaggttcgatggcgcgactgcgcgcactgtagggctgagccattagccttccttaacggtgaggacaaaatcaggattctaccgaaccctcacggtaaaacatgctctattgcctgctcggccatccacgaagaaccgagcaagcgcttgcaaaacgactaaaatcaacaatcgagacacgctatacccagccatggcgggctgttgctgtttgcacccccgccaagttgggcctcgacaaccgggagtggcgcaccccgaatctatctggtaagttcgcccgcttgcagccgcagggccggcaggtgtcggtgacgttgcaatcctgcgcaatggattagaagagtgagaggcggtctattcatgtccacccaagcaaagcaacagcagcagagcctcagtggcttcacaccttacgtcgaagcgaaaggtgaggagtacatgggcaagcccatgcgccagcacttcaccaagatcctgcaaaagtggaagcaggacttgatgcaagaggtcgaccgtaccgttgaccacatgaaggacgaagccgccaacttcccggacccggcagaccgtgccagccaggaagaggaattcgccctcgaactgcgcgcccgtgatcgtgaacgcaagctgatcaagaaaatcgacaaaacgctgcaactgatcgaagacgaggaatatggctggtgcgaatcctgcggcgtcgagattggtattcgccgcctggaagcccgcccaaccgcggacctgtgcgtagactgcaagaccttggctgaaatcaaggaaaaacaggtcggcaagtaatcctgtcgagctgaacgaatggggcgtgcaaacgccccatttttgtttctggcgtttaccgattttccagtagtatccggtccatgacagcctctacctatattgggcgtttcgcccccacgcccagcggccatttgcatttcggctcgctggttgccgccctcgcctcctaccttgatgcccgcgccaatcacggccgctggctgatgcgcatggaagacctcgacccaccccgagaagaacccggcgcccaggcagcgatcctgcacgccctggaaagctacggctttgaatgggatggtgagctggcccgacaaagcgagcggcatgacgcctacgccaaagtcctcaacgacatgttcaaccatggcctggcctacgcctgcacgtgctcgcgcaagcaactggagccgtatcacgggatttacccaggcttgtgtcgcaacgccgggcatgctcagcacgatgcggccatccgcctgcgcgtgcctgaactggaataccactttaccgaccgcgtgcagggcaaattccgacagcacttgggccgagatgtaggcgatttcgtcatccgtcgccgtgacggcctgtatgcctaccaactggccgtggtgctcgatgatgcctggcaaggcgtgaccgatattgtgcgcggcgccgatctgctcgattccacgccgcgccagctgtatctgcaggaattgctcggcttgcgccagccgcgctacctgcacgtgccgctgatcgtccagccggacggtaacaagttgggcaaatcctaccgttcgccgccgttgacacccgaacaggccacgcctttgctgttaagggcattgcgcgccctcggccagccggccggcgctgaattgctgcacgccagcccgcgcgagctgctggattggggcattgcgcactgggatgccagccggatcccgcgcacactcacgctggccgaagcgcaattgagctgaaggcgcttgcagcttgccagccatccgttaccatcgccgcagttttttaatcagaggccaacatgtacatctatcgattggtcctgctgctggtcgtcgggatctacctgttttcccccgccatcatggattggtggatcgacgccacgggcgcctggtatcgcccttatctgctgtggctgatcctgatcgtcgtgaccttcatcctgcagagccaaaaagatgccgatgagctttagcctcacccagatgctgctgatcagcgccgcctacctggccgcgctgttcgccgtggcctggatcagtgagcgcggaatgattccgcgggcgatcattcgccatccgttgacctacaccttgtccctgggcgtctacgccagcgcctgggcgttttatggcaccgtgggcctggcctatcagtacggttacggttttctgtccagttacctcggggtgtccggcgcgttcctgctggcaccggtgttgctgtacccgatcctgaagatcacgcgcacctaccagctgtcatccctcgccgacctgtttgccttccgctttcgcagcacctgggccggcgcgctgaccacgattttcatgctgctcggcgtgctgccgctgctggccttgcagatccaggccgtggcggactccatcagcatcctcacccgcgagccggtgcagcatcgcgtcgcgctggccttttgcgcgttgatcacgctgttcacgattttcttcggctcacgccatatcgccacccgtgaaaaacacgaaggcctggtgtttgcgattgccttcgaatcggtgatcaagctgatcgccatcggcggtgtcggcctgtatgcgctgtacggcgtgttcgacggcccgcaacagttggagttgtggctgctgcaaaaccagaccgccctcgccgccctgcacacaccgctgcaggaaggcccatggcgcacgctgctgctggtgttcttcgcctcggcgattgtgatgccgcacatgtaccacatgacgttcaccgagaacctcaacccgcgctcattagtgagtgcaagctggggcctgccgctgttcctgctgctgatgagcctggcagtgccgctgattctgtgggccggcctcaaactaggcgcaaccaccaacccggaatacttcaccctcggcgtcggtattgcggccaacagtaaatccctggcgttgctggcctacgtcggcggtttgtcggcggccagtggcctgatcattgtcaccacgctggcgctgtcgggcatggcgctcaatcacttggtgctgccgctgtatcagccaccggccgaaggcaatatctaccgctggctgaaatggacgcgccgcgcgctgatcgttgcgatcatcatggccggttatggcttctacctgctgctgggcgccgggcaggacctggccaacctcggcatcgtcgcgtttgtcgccaccttgcagttcctgcccggcgtgttgtcggtgctgtactggccgaccgccaaccgccggggctttatcgccgggttgctggcggggattctggtgtggatcgtcaccatgctgctgccactggtcggcaatttgcagggcttctacatcccactgctgaacatgatttacgtgctcgacgacaccagctggcacatggcggcgattgcttcgctggcggccaacgtgctgatgttcacgctgatctcgctgttcaccaacgccagccccgaagaaaccagcgccgccgaagcctgcgcggtggacaacgtgcgccgcccgcaacgccgcgaactgcatgccgcctcgccccaggaatttgccacgcaactggccaagccgctgggcgccaaagccgcacagaaggaagtcgaacaggcgctgcgcgatctgtacctgcccttcgacgaacgccgcccgtatgcgctgcggcgcttgcgtgaccggatcgaagccaacctgtccgggctgatggggccgagcgtgtcccaggacatggttgaaaccttcctgccctacaaggccggcggcgaaaactacgtcaccgaagacatccatttcatcgagagccggctggaggattaccactcacgcctcaccggtctcgccgccgaactcgatgcattgcgccgctaccaccgccagaccctgcaggagctgccgatgggcgtgtgttccctggccaaggatcaagagatcctgatgtggaacaaggccatggaagaactgaccggtatcgccgcccagcgggtagtgggttcgcgcctgaacaccctgggcgacccgtggaaagaactgctgcaaggctttatcaacctgcccgacgagcatttgcacaagcagcacctggcgctggacggccagacccgctggctcaacctgcacaaagccgcgattgacgagccgctggcgcccggcaacagcggcctggtgttgttggtcgaagatttgaccgacacgcaaatgctcgaagacaagctggtgcactccgagcgcctggcgagcattggtcgtttggccgcaggcgtggcccacgagattggcaacccgatcaccggtatcgcgtgcctggcgcagaacctgcgagaagagcgcgaagaagacggtgagatcaccgaaatcagcgggcaaatccttgagcagaccaagcgcgtttcacgcatcgtgcagtcgttgatgagcttcgcccatgccggcgcgcatcagaatcaggatgaggccgtgtgcctggccgaagtcgcgcaggatgccattgggctgctggccttgaaccggcgcaatttcgaagtacagttctttaacctgtgcgacccggaccactgggtcgacggcgactcccaacgcttggcgcaggtgttgatcaacctgctgtccaacgcccgcgacgcgtccccgccgcacagcgcggtacgcgtcaagagcgaggctttcgagcacacggtcgatctgatcgtggaagacgaaggcagcggtattccacagaacatcatggatcgattgttcgaacctttcttcaccaccaaggacccaggtgaaggcaccggtctgggccttgcactggtctattccatcgttgaagagcattatggacaaatcaccatcgacagcccggctgacaccgaaagccaacgcggcacccgtattcgggtgaccttgccgcgtcatgtcgaagcgacgtccgctgtgaactgagaccgtcgagagaattgaatcaatgccgcacattttgatcgtcgaagacgaaacaattatccgctctgccttgcgtcgcctgcttgaacgtaatcagtaccaggtcagcgaagccggctcggtgcaggaagcccaagagcggttcagcattccaacgttcgacctgattgtcagcgacctgcgtctgccgggcgcgcccggtacagagctgatcaagcttggccagggcaccccggtgctgatcatgaccagctacgccagcctgcgctcggccgtggactcgatgaagatgggcgcggtggactacatcgccaagcctttcgaccacgacgaaatgctccaggccgtggcccgcatcctgcgcgaccgccagtcggctggcagtgcgcccgccgaacagcgccccgccggcaaggctgccgagaaaccgggtgtcgacaacagtaacggcgagatcggcattatcggctcctgcccaccgatgcaggatctgtacagcaagatccgcaaagtcgcgcctaccgactccaatgtattgatccagggcgagtcgggcaccggtaaagaactggtggcccgcgccctgcacaacctgtccaaacgcgccaaggcgccgatgatttcggtgaactgcgcggcgatccctgaatccctgatcgagtccgaactgttcggccacgagaaaggcgcgtttaccggtgccagcgccgggcgtgcgggcctggtggaagcagcggacggcggcaccttgttcctcgacgaaatcggcgaactgcccctggaagcccaggcgcgcttgctgcgtgtgttacaggaaggcgaaattcgccgcgtaggttcggtgcagtcgcagaaggtcgatgtgcgcctgatcgccgcgacccaccgtgacctgaagagcctggccaagatcggccagttccgtgaagacttgtattaccgcctgcacgtgatcgctctcaagctgccggccctgcgtgagcgtggcgccgacgtcaacgagatcgccaacgctttcctgctgcgccagagtgcgcgcatcaaccgtaccgacctcaagtttgctccggacgccgagcaagccattcggcattactcgtggccgggtaacgtgcgtgagctggagaacgcagttgagcgcgcggtcatcctgtcggagagcccggagatttctgccgagctgctgggcatcgacatcgagctgagcgacttggaggacgacgatttcatcggcctggccccacaacagggcggtggtagcaataccagccatgagccgacggaagatttgtcactggaagactacttccagcatttcgtccttgagcaccaggaccacatgaccgaaaccgagctggcgcgcaagctgggtgtaagccgcaagtgcctgtgggaacggcgccagcgcctgggcattccacggcgcaagaccggggtggccagcgagagttgagggcgcgcgcccacaggtaacaccctcagatgtgaaaaaactgttaccgcagctttttcacgtaacaaaagccggggcttacggtaacgaagccccggctttttttggccctcaaaaaacccgaaaccacctaaaacccccggttttgctgggcggcacaaaagttggcacgcaccctgctatatgcttagtacaaaaacaataacaagctcagtaccagacaataaaaataagacgaatcgactcacgcacaataaaaacaacacggcggaggcgcagctaactgattcttttggagaggcgttgcatttggggcttgccccgcaaccaggccgagaacaacaaaaactgccctaaggcagagcctgaactggttggatcgtagatcagcaacacagcgaccaaagcaatccgtttgctcttgactcccgattgggagtgtcatgaaggtgaaatgtcatggcgagggcgatcaacaaaaacaagaagcccgcaatcaataataaaaatagagcacgcaactacttctgggggagcttcggctccccttgtagtttccggcgtttgaccggcccagcccttcttttaagcatatggcgcaacgcctgcagcttgttcctacaccatccctcgactaaatgctagaatcccggcccatcatgcggtcattcttcgttatggccgaacattccttcaaacagtgcatcccatgctgaagaagttgttccagtcattccgttctcccttgcgtcgtacgcaacacattcgcagcacgcctgaagtgcttaacagcaatcagcattcattgcagcgcgctcagttcagccgttatgcggtgaacatcgtcgaacgtttgcagaacgccggctaccaggcctatctggtgggcggctgtgtacgtgacatgatgctcaatatcacgcccaaggatttcgacgttgccaccagcgccacgcccgagcaggtacgcgccgagtttcgcaatgcgcgcatcatcggccgtcgcttcaaattggtgcatattcactttggtcgcgaaatcatcgaggtcgcgaccttccgcgccggccatccgcaaaacgatgacgaggaagacactaaccagtcctcccgcaacgagagcggtcgcatcctgcgtgacaacgtttacggcaccctggaagaagatgcgcaacgccgcgacttcaccatcaatgccttgtattacgacccggtcagcgaacgcatcctcgattacgccaatggcgtacacgatattcgcaacaacctgatccgtctgatcggcgacccgacccagcgctatcaggaagacccggtgcgcatgctgcgagcggtgcgttttgccgccaagctgaatttcggtatcgagaagcacactgccgcgccaattcgcgagctggcaccgatgctgcgggaaattccctcggcacgcctgttcgaagaagtgctcaagctgttcctctcggggtatgccgccgacaccttcgaaatgctcgtcgacttgcagttgttcgatccattgttcccggccagcgccgaggccctggaatacaacccaacgtacacccacacgctgatcagcgaagccttgatcaacaccgacctgcgcatcaaacagaacaaaccggtgaccccggcgttcctgtttgccgccctgctgtggccggccctgcccaagcgcgtactgcgcctgcaagaccgtggcatgccgccgatcccagccatgcaagaggctgcgcacgagctgatcgccgagcagtgtcagcgcattgctatcccgaaacgtttcaccctgccgatccgcgagatctgggacatgcaggagcgtctgccgcgccgcagtggcaaacgtgccgacctgctgctggacaacccgcgcttccgcgccggctacgacttcctgctgctgcgtgaaagcgccggcgagcagaccgacggcctgggcgaatggtggaccgattaccaggacgccaatgacagccagcgccgcgacatgattcgtgaccttggcagcaaaggcgatggtgcgggcgaaggcccgaaaaagcgtcgccgcagctccggcagcaagcgtaagcgcagtgctgatgcctcgggcgctgcaggcgaataaacgtggaacgcatctacatcggcatgggcagcaacctggctgccccagaccagcaattgcgcagcgccacccaggcgctggcgctgttgccaggcactacgctggctggcgtgtcggccttctatcaaagtgattccctgctcccaggccaaccgcgctacaccaacgcggttgcggcactggacagcacccttgcgccactggcgctgcttgatgcgctgcaagccatcgagaacgaccagggccgtgagcgccttgagcgttggggcccgcgcacccttgatctggatatcctgttgtttggcgagcgtcttatcgatgagccgcgcctgaaggtgcctcattaccagatgcacctgcgcgcgtttgtgttgtacccgctggctgagctcgcacccgccgacctgcaattgccaaatggccaaacgcttgaagagctgctgacggcctgcccgtttgtcggcctggaacgcctccccactgcttgattcgccccctgtaacagcggtaacaccgccctcgtaacaatgcggtaacacatccaattgacttcccgagtcctcatcacgactataggcgtcccgctgccgccaacccggcgctgaagggcgcaatccaggccttataagcactgctctcaagacggtgcgcctgtatagaacgaagactcacgcgcgttactcgctgtttccaagcgcctgaacgaggacccttttcatgccagacattaccctgaccaccttgcagagcctcaagctcaaaggtgaaaaaatcaccatgctgacctgctatgacgccaccttcgcccaggccagctgccaggccggggtcgaggtgctgctggtgggtgactccctgggcatggttcttcaagggcatgacagcaccctgcccgtcaccaccgatgaactcgcctaccacaccgccagcgtcaagcgcggtaacgacggcgcctttatcatcgccgacctgccgttcatgggttacgccacggtggaacagacattccagaacgccggcaaactgatgcaagccggtgcgcacatgatcaaagtggaaggcgccgtgtggctcgccgagtcgattcgactgctggctgagcgtggcgtccccgtgtgtgtgcacatgggcctgacgccacagtcggtgaacatcctcggcggctataaagtacaaggccgcaatgaagcccaggcgcgccagatgcgtgcggacgccatcgccctggaacaagcaggtgccgcaatgattctgctggagtgcgtaccgagcgaactggcggcggagatcacccaggccgtcaaagtgccggtgatcggcatcggcgcaggttccgccaccgacggccaggtgctggtggtgcacgacatgctcggtctgtcgctgaccggccgagcacctaagttcgtgaaaaacttcatggccggcaaggacagcattcaggctgcactgagcgcctacgtcgatgaagtcaaagccgtgacattccctggcgacgaacacggattctctgcatgaacaccgttaaaaccgtaagagaactgcgctccgccgtcgcccacgcgcgcagtgccggtaaacgcatcggcttcgtgcccaccatgggcaacctgcacagcggccatgccaccctggtgaccaaggccgcgcaacagtcggacttcgtggtggcgagcatcttcgtcaacccactgcaattcggtgccggcgaagacctggacaaatacccgcgcacgctggctgccgaccaggaaaagctgctgcaagccggctgcaacctgttgttcgcgcccaccgtcgaggaaatgtaccccggcggcatgaccggccagacccgcgtcagtgtcccgcaactgtccgaaggcctgtgtggcgccagccgcccggggcacttcgaaggtgtggccacggtggtcagcaagctgttcaatatggtccagccggacatggctgtgtttggccagaaggattaccagcaactggcggtgatccgcgccatggtgcatgacctgaacatgcctatccagatcatcggcgagccgaccgtgcgcgctgccgacggcctcgcgctgtcgtcgcgcaacggctacctcagcgacgagcagcgcgccattgcgccggtgctgtaccgcagcctcagccaaattgccgacgcgataaaagcgggtgaccacgattttgccaagctgcgtgccgagcagatccagcacatcgaagccgccgggctgcgcatggattacctcgaagtgcgccagggcgtgcaactgcgtccggccacggctgaggatcgcgatgtggtgatcctggtggccgcgtacctgggtgcgacgcgcctgatcgacaatttgcacctgaacctggcctgaccactcccgccttttctgcttcaaaaacagcgcacctgttgccctccccgctgtgccggtataaaaaagtaccggctacagcgcagacaaagccaagacatatcgacacgctaggtttaatgtaatcgccctgcgctcttggttagcgctgtccggaacccagcgcttgagaaaagactggatgttccgaactctgaagtgtcctaaaggcagtccccgtaataaaaaggaaacccgcagcgatggcgtactaccgcactcctcatgacgttaccgctctgcccgcctggcaagcgctcaatcaacatcgccaagccatgcaggatttcagcatgcgcgaagccttcaatgccgatccccagcgcttttcgcagttcaccctgagcagctgcgggcttttcctcgattattcgaaaaacctgatcaccaccgaaacccgcgacctgttggtagggctggccaaggaagtcgaccttaaagccgccatcgacgcgttgtacgcgggcgagccggtcaactcctccgaaggccgcccggccctgcacaccgccctgcgccgcccagtgggtgacaagttgtcggtcaatggcgtgaacatcatgcccgacgtgcacaaggtgctgaaccagatcaccgacctcgtgggccgcatccacgatggcctgtggcgtggctacaccgagaagccgatcactgacgtggtgaacatcggcatcggtggctcgttcctcggcccggagctggtctccgaagcgctgttgtcctacgcgcataaaggcgtgcgctgccactacctggcgaacatcgacggcagcgagttccacgagctgaccatgaagctgcgcgccgagaccacgctgttcatcgtttcgtcgaaatccttcaataccctcgaaaccctgaaaaacgcccaagccgcacgcgcctggtacttggcccagggtggctcggaagccgagctgtaccgccacttcatcgccgtatcgagcaacaacgcggcagccgtggcgttcggtattcgcgaagaaaacattttcccgatgtgggactgggtcggcggccgttactcgctgtggtcggccattggattgccaatcgcgctggccatcggcatgtccaacttcaaggagctgctttccggtgcctacaccatggaccagcacttccagaacgccccgttcgaacagaacatgccggtgctgctgggcctgctgggcgtgtggtacggcaacttctggggtgcgcagagccatgcgatcctgccgtacgaccactacctgcgtaacatcaccaaacacttgcaacagctggacatggaatccaacggcaaaagcgtgcgccaggacggcacgccggtgtccaccgataccggcccggttatctggggcggcgtaggctgcaacggccagcacgcgtaccaccagttgctgcaccaagggacccaactgattccggccgacttcatcgtgccgatcgtcagcttcaacccggtttccgaccaccaccagtggctgtacgccaactgcctgtcccaaagccaggcactgatgctcggcaagacccgcagcgaagccgaagccgagctgcgcgagaagggcttgccggaagctgaagtacagaagctggcgccccacaaggtgatcccgggcaaccgtccgagcaacaccctggtggtggagcgcatcagcccacggcgcctgggtgcactggtggccatgtatgaacacaaagtgttcgtgcagagcgtgatctggggcatcaacgcctttgaccaatggggcgtggagctgggcaaagagctgggcaagggcgtttacaaccgcctgaccggcgccgaagaaaccgtggctgacgatgcgtcgacccagggtttgatcaactacttccgcggccgtcaccgcggctgaggccggtagcacgaggccaacgtccgtttggacgttggccttgaaccctcttcccacagcgtgcatctttatgccttgtcccgaaaacaagaataaggaccgctcatgttcgatatcagcacatttcccgccgccgatgccgtccgccgggctgcgcaactcagtcaagccgagtaccagcgcctctaccgccaatccatcgaacagccggacaccttctgggccgaacaggccaagggctttctcgactggataacaccctggcacaccgttcaacagtcaaatatcaagaccggcgccgcccaatggtttgccggtggccaactgaacgtcagctacaactgcatcgaccgtcacctggcccaacgcgccgatcaaccggccttcatctgggaaggcgatgatcctgcaacatcttccaaaattacctaccgccaactgcatcaaaacgtcagccgcctggccaatgtgctgaaaagccgtggcgtgaagaaaggcgaccgggtgtgcatctacatgccgatgatcccggaagccgcctacgcgatgctggcctgtacgcggattggcgcggtgcattccgtggtcttcggtgggttctcaccggacgcgctgcgcgaccgtattctcgatgccgactgccgcaccgtgatcaccgccgatgaaggcgtgcgcggcggcaagccggtggcgttgaaaaagaatgtcgacaaggccctggccagctgcccgaacgtcagcaccgtgttggtcgtggagcgcacgggcgcggaccttatctgggtcaaagaccgcgaccttaagtaccagcaagccctggatgccgccagcgacgactgcccgcccgagccgatggatgccgaagacccgctgtttatcctctacacctccggcagcaccggcaaacccaagggcgtgttgcacaccaccggcggctacctgctgcaagcggcaatgaccttcaaatacgtgctcgattaccgtgacggcgaagtgttctggtgcaccgccgacgtcggctgggtgaccggccacagttacatcgtgtatggcccgctggcgaacggcgccacctcgctgatgtttgaaggcgtgccgagctacccggacagctcacgcttctggcaggtgatcgacaaacaccaagtgaatatcttctacaccgcgcccaccgcgctgcgcgccttgatgcgcgagggccacgggccactggaaaacacttcccgcgccagcctgcgcctgttgggcagcgtcggcgagccgatcaacccggaagcctgggactggtacttcaatgccgttggcgagcagcgctgcccgattgtcgacacttggtggcagaccgaaaccggcggcatcatgctcagcccgctggtcagtgcccaacgcatcaaacctggctgcgcgacccagccgatgtttggcgtgcagcccgtgctgctggatgaacaaggcaaagaaatcagcggcgccggcagtggcgtgctggcgatcaaagccagctggccggggcagattcgcagcgtctatggcgacccgcaacgcatgatcgacacctatttcaaaccctaccgcggttactacttcaccggcgacggcgcgcgccgcgatgcagacggcgactactggatcacagggcgcatcgatgacgtgatcaacgtgtccggccaccgtatcggcaccgccgaggtggaaagtgcgctggtgctgcatgaccaggtggccgaagccgccgtggtcggctatccccacgacgtcaaaggccaggggatatacgccttcgtcacgccaatgaacggcgtcgagcccagcgatgcgttgaaaaagcacctgctcgaactggtcagcaaggaaatcggcagctttgccaagccggaactgatccaatgggcaccggccttgccgaaaacccgctccggcaagatcatgcgacgaattttgcgcaagatcgcctgcaacgaactggacagcctgggtgatacctcgaccctggccgaccccagcgtcgtcgacggcctgatcgacaaacgcctgaaccgctaggaacccctgagtcgccatggaatttatccgcagccgtatcgaatcccagttgatgagccttaccggcctgtcgctgggccagctggacctggaaaaccccaagggcgacccaggcctgttcgggccggactcgatctgttggcaagtgcatggcgacttcagcagcatgcttataggcggcatcagcgccttgatgctgcaagcgctgcacccgctggcgctggcaggcgtgtgggaccactcgaactttcgccaggacatgctcgggcgtctgcggcgcacgtcgcaatttatttccggcaccaccttcggttcgcgcaaggacgccgaatggctgatcgagaaagtgcgcaccatccacttgcaggtaacagggcatgccccggacgggcggccttacgcggccagcgacccggagttgctgacgtgggtgcatgtggcggaagtcagcaacttcctcgcggcccacttgcgttatcgcaatccacatctgtcgggccgcgaccaggaccgctactacagtgaaatcgcgctggtggccgaacgcttgggcgcgcggcatgttccgcgttcacggcaggaaatttcggattacctggcgcgtattcgtccgcaactgctgtgcgacgagcgcagccgcgaggtgctgcgcctgctggtcaatgcgcccgcgcccagcgcgctggccaaaccttttggcagcttgatgatgcaggccggcatcgacctgctgccggactgggcaagcagcctgctcgaacagcaccagagcccgctgcagcgccagatgatccgcctcggggtcaagcgcagcgcgccgatgctgcgctgggcaatgcgcaatggttcggtgcagcgcgcccatcggcggatggggttgatgtaggcggcgtcccataactgttaaactccgcgcccatatttacgcaagcaaggcgcgctccatgactcccttgaatcaggcgctgcgcgccgccctcgatcaccgcgaagacctgatcaaccaactgcacgcccagggcaccgactgctaccggttgttccacggcagccaggaaggcgccgggggcctgaccatcgaccgttacggcccgcaattgctggtgcagagctttcaccagtcgctggaaaccgccgaccttttggacctgcaccagcagatcaaccagttcatgggcctggagttgctgctggtgtacaacgaccgctcccgtggcaactcgcggatcgaccgtgaagacacggtgtaccgcgccgaacctgcggcgctggaagacttggtcggccacgaatggggcctcaattaccgcgtgcgtgggcgccatgccgggcaagacccgctgctgtttctcgacctgcgcaacacccgcggttgggtcaaggaccacagcgccggcaaaagcgtgctcaacctgttcgcctacacctgcggcgtcggcctgagcgcagcagccggtggcgcccgcgaggtgtgcaacctggacttcgccgaaggcaacctggcagtcggccgcgaaaacggcctgctcaacccgcaggtgccggccatggaattcgttcagtccgactacttcccggcgattcgccaactggcgggcttgccgatcacccagcggcgcgggcaaaaactgccgagctatccgcgccttgagcagcgccaatttgacctggtactgctcgacccgccggcctgggccaaaagtgccttcggcaccgtcgacctgttgcgcgactaccaaagcctgctcaagcctgcgctgttggctactgccgacgatggcgtgctgatctgctgcaacaacctggcaaaagtcagcatggaggattggcgtgaacaggtgctgcgttgcgccgaaaaagccgggcgcccggtacgcgactggcaaatcatgacgccgggagcggacttcccctcgcaagaccaacagccgccgttgaaaaccctgatcctgcagttgtagtacttttcccaagagccccggtgcttcggaaccgaaaacccgtgccatactccaaggcactcctgttcgacatagatggcgtcactcatgcccaaaggattgatccgcgccgctggcgccttgttgaccgccctggctctgtacagcttgctgggctttctgattctgccgggcattgcccttcgcattgccaaccaacagttggccaactacgccacggtgccggcccgcctcgagcgcatcgagctcaacccgttcagcctggaagtcacggcatggggcttgaagatcggcgaaccgggcaaggagcaagtgggtttcgagcgtctttatgccaacctgcagatcgacagcctcttgacccgcgccctgcacctggccgatgtgcaactcgaccagcccaagaccgagctgctgttcgacaagtccggcaagttgaacctggcgcaattgttcaagctgccgccgagtgaacccaccccgaccgaccccaacgccaagccgtttccgctgcgcatcgacagcatcaagctggcgggtggctacgtgcactttcaggatttgcgccccagcgaaccgatcgaattcctctacgacaaactcgactttgagctgaaaaacctcagcaccttgccggaagacaatgccgacatgaccttggtcgcggccggccctgagggcgggcagatcgactggaaaggcaatttcagcctggtgccgatcacgtccgaaggcacgctgaaagtcaccgacggcaagatgaaagcctggtggccgtatgtgcgggactcgctaccgctggtgcttgaagacggtgtactgaatttcagcactagttataaattcagcctggcgaaagaaaccgaactgaacctgaccaacaccgccgccagcatcgcgccgtttgcgatcaaggcaccggatggtcggccactggtgcgcctggaacgcctggacgtcagcgaaaccacagtggacctggccaagcagcaggtcgtagtcggcaagatacgcagtaacaagctggaaacctgggccgcccgtgaggccgatggccagctggactggcagaaactgtttgccagccagccgagtaaaccagccaaggcgccggagcctgccacagcaccggcgactgccgactcgccgaaagctgaacctgcagccccgagcaaaccttggcaagtactgctcaaggatgtgcaactgcgtaactatcaggtgcacctggctgaccgtgcggccaagcctgccgtggcgctggaactgggcccattgaatgtcgacgtgcagaacttcgacagcctcaacaaaagcccttttaccttgaaggtcgacaccggcctgggtaaacaaggcaagatccaggcaaccggcgaggtcaacctcaacccggtcagcgccaaactcaaagtgaatacacaggacatcgacctgcgcgtcgcccagtcctatatcagcccgttcattcgcctggaattgcgcagcggcatgctgggcagcaatctggatgtgaacctgaaaagcactgagccattggcgcttcaggtcaccggccgcgctcaggtcgaccaattgcacacgctggacacgctcaagacccgcgacttcctcaaatggcagcggctggtgctcgaaggtgtgaactaccagcatggcgatagcttgtcgatcgacaaggtcaacctgctgcagccgtatgcgcgctttatgatcaacgatgaccgcaccaccaacatcgacgacttgctgattccgcagccggccgacagtggcgctaaatcagcaggcaaacccgcggccagtaaagacaagcctctgggcattcatatcggccagatcgcgatcaacgatggctcggccaactttgccgacttcagcctcacaccgaactttgccacggccattcaacagctcaacggccagatcggcaccattgacagtcgccaggccaaaccggccagcgtcgacatcaagggcaaggttgatcgctatgcgccggtgactatcaaaggcagcgtgaacccgtttgatccgatggcggcgctggacatcgccaccagcttcaaacgcgtcgagctgaccacgttgacgccgtattccggcaagttcgccggtttccgcattcgcaagggccgcctcaaccttgacctgcattatgtgattaccaaaggccagttgaaggctgaaaacaaagtggtggttgaacagctgcagctcggtgagaaagtcgacagcgccgatgccgtggacttgccgattcgcctggctatcgccctgctcaaggactctgacggcaagatctccatcgagctgccggtgaccggcgacctgaacaacccgcaattcagcgtgatgccgatcgtgtggcagaccctgcgtaacctggtggtgcgcgcagcgacggcgccgttcaagtttatcggcgggctggtgactggcgggggctcggaagacctgggcaatgtgtcgttcgccccaggctccagcgaattgaacaaagacgccgaaggcgcgctgaacaccctggccaaagcgctgaaagagcgccctaccctgcgcctggaaatcgaaggcacggcggctgccagcagcgacgggccgttcctggccgccgagcgtctggaacgtgaatatcagtacaactactacaaaatcctccagcgtcgtggcgacaaagtcccggcccaggcttcattgctggtggtgccagagaaggaaaaggcgccgttgctggaaggcatctaccgcacgcgcttgaaacaacagccaccagccgaatggaaagacctgagcagcgatgagcgcaccgcgaagctgcgtgatggcttgatcaagttctggggcgccagcgacgtactgctgcgccagctgggtcaagaccgggccagcaccatcaaggactatctggtggacaagggcaagctggaagatgatcgggtgtacttcatcgacgctaaccttgggcaggcggagaaggatggccgagtggtaacgccgatgcatctggatgctgagtaaccggcaaccagcactgatctaaatgtgggagcgagcaagcccgctcccacatttgctcccacatttgtctgatctttgtgggcctggcaattttgtgttctgcccacaatagaacaggccccgacacaagtgccggggcctgtaatgaccacatccgtgtggccggtcgcatgaactccagaggtgctgggtggataactaactcaccctaagccgccgccgtctcgttcagacgaataggtaagcgttactctgctttcaggccatcggccgatacagctttaacgcctttgattttcttggtgatgttcaccgcagtagttttctgagcttcagtcacagctaccgaagacgacagggaaactacgcctttgttggtttcgactttgatgtcggtgccaggaatgcctttctcggttaccaggtcagctttcactttggtggtaatccaggtgtcagaggtagcacctttggcgtcagcggctgcgcctttggttttgtcgatgttatcggctttagtcgcgccaccggccagcaggccgtcagcggaaacagcggtaacacctttgattttcttggtgatcgctacggcagtggctttctgcgagtcagagatcgcaactgtcgaggacagggaaaccacacctttgttggtctcaaccttgatgtccgagccaggaatgcctttttcagtcagcaggtcggatttaactttggtggtgatccaagtatccgaaacgctttctttagccttggtagcttcaccagccgccatggtcattggggcttgggaagtctgagcaaaggctacgttagcacccatggccagagtcagagcggtagcagtagcgagagcgaacttcttcatacgagtaactcctgttttattaaaagtctgcagcgtgtataccttgatgctgcagcgttaacagggttattgcaggcggcgtgccaagtaccaattgaaaatattatccatacaaatcaatgacttatgaaaacagccgattttcggaatcgtgcaacttgcatgaagtcgatcgtgcctgcgtgcaagttgcggcttttgagatttactaagcgactgatttcccggcattttcctatgggcataaaaaaggactccgaagagtcctttttcagcgtgagctggcgggtgattaaacgcccgaagccttggctgctgctacgtccttgatggacagcttgatacggccgcggttgtccacgtccagtaccagcacttccacttcctggccttctttcagaatgtcggtcactttctcaacacgagcgtcgctcagcatggagatgtgaaccagaccgtctttgcccggcaggatgttgacgaatgcgccgaagtcgacgatgcgctcaaccttaccgacgtagatcttgccgatctcggcttcagcggtgatgcccagaacgcgctgacgtgcagcttcagcagcttccttggtttcgccgaagatcttgatcgagccgtcgtcttcgatgtcgatcgaagccttggtctcttcacagatcgcacgaatggtcgcgccacctttaccgataacatcacggattttgtcggtgtcgattttcatcgcgatcatggtcggagcattttccgacagttcggtacgggactgaccaatgatctggttcatctgaccgaggatattcaggcgcgcttccagggcttggcccagagcgatttccatgatttcttcggtgatgcctttgatcttgatgtccatctgcagcgcggtaacacctttagcggtaccggctactttgaagtccatgtcgcccaggtggtcttcgtcacccaggatgtcggtcaggatggcgaacttctcgccttctttaaccaggcccatggcgatgccggcaaccggtgccttcatcggtacaccagcgtccatcaatgccagggaagcaccgcaaacggaggccatggagctggaaccgttggactcggtgatttccgacacaacacgaatggtgtacgggaacacgtcggcggcaggcagcatggcggcaatcgaacgacgggccagacggccgtgaccgatttcgcgacggccagcaccacccatgcgaccacactcacctaccgagaacggagggaagttgtagtgcagcatgaacgggtcttttttctcgccttccagggtgtccagcagctgtgcgtcacgggcggtgcccagggtcgcgactaccagagcctgagtttcaccacgggtgaacagggccgaaccgtgagttttcggcagaacgccgacttcgatgttcagcgggcgtacggtgcgggtgtcgcgaccatcgatacgtggcttgccgttaacgatgttttcgcgaacggtgcggtattcgatttcaccaaaggcagctttgacgtcgctcgaagaaggctggccttcttcaccggacagcttggccacaacctggtccttcagctcgcccaggcgagcgtaacggtcagccttgacggtgatggtgtaggcgtcggagattgctgcgccgaactcggagcggatagcgcccagcagttcagtcgcttcagcttgtggagcccaggaccaagtaggcttggcagcttcagcggccagctctttaacggcattgatcacaacctggaactcgtcgtgagcaaacagtaccgcgcccagcatctggtcttcggtcagctctttggcttccgattcaaccatcaacacggcttccgaagtaccggcaacgaccatgtccaggctcgaagctttctgttgttcgtaagtcgggttcagcaggtagccagtgctttcgtggaacgcaacgcgggcagcgccgatcgggccatcgaaaggaataccggagatggccagggcagccgaggtaccgatcatcgcagcgatgtccggatcggtctttttgctggtggaaacgacggtgcagacaacctgcacttcgttcatgaagccttctgggaacagcggacggatcggacggtcgatcagtcgggaagtcagggtttctttttcggaaggacggccttcgcgcttgaagaaaccgccagggatcttaccggcagcgtaagtcttttcctggtagtgaacggaaagagggaagaagcctttgcttgggtcagcggtcttggcgccaacaacggtcaccaatacggtgacgtcgtcgtcaacggtaaccagcactgcgccggaggcttgacgggcgatacggcctgtctcgagggtaacggtcgactgaccgaactggaatgttttgataaccgggttcacggtgtcctaccttctttgtggctcttgggggaacttgttttcttgcgaaattcttgggcaatgtcgggaatcggcccgaccctcgtccagggtaaaacgtgtatccagataaaacttgaggctgggagcctgccatgggccagcgggaatcccactgacacacggcaaacaaccaacctctagcgcaatcgcttattagcgacgcagacccaggcgaccgatcagagcctgataacgacccagatccttgcctttcaggtagtccagcagcttacggcgctggtttaccatgcggatcagaccacgacgggagtggtgatctttaccgttggccttgaagtgaccttgcagcttgttgatgttgtgggtcagcagtgcaacttgcacttctggcgaaccagtgtcaccaacagcttgctgatagtcagcaacgatttgtgctttttcttgaacgtcgagagccatgaggcaatccttttttcaggaaaccacccaaagggcagtttcaacaggccagggacaaatccctgtatctaaaaatgagtgttgaccgtgcctgttaacagccacactcgttccagtttgcgtaaaagctactgcgctcggtaatcctgcgtcaaaaacaggctcggaatgctcattaacagcagttaactccgcttcctcgcctgttttttccttgtcttaccttcgctcgctacgcttttaccacaaactggttccggtcattctgaccgaatcagtcgacgcggcgcgatgcgcccgtcttcgctcacttcaccgataccgatgaagcgaccgttatgatcctgtacccgcaccatgccgaacttcggagcgtccggggcacgtaccggctggccgttaagccagtagaacgcgctgtgctccgaaaagtgcagcaatggccaatcgagcaaaccgctgtccgatggcatcaggaagcgatcaactgcttcattgccgccttcggcgtgtacggcttccaactcttccagcgtaaccgtctgggccaggctgaaaggcccggcctgggtgcgtcgcagttctgcaacgtacgcgccgcaaccgagcttttcaccaatatcttccaccagggtacggatataggtgcctttgctgcagtccacggccagtcgggcagtgtcgccttcatgggcgagcaattccaagcgcgcaatagtaacagaacgcggttcacgctccactacttcgcccgcacgtgccagcttgtaaagaggctggccatcacgcttgagtgccgagtacatcggcggtatctgactgatttccccacgaaaaccgggtaaagcagcttcaatatcagcacgaccaacggtcacatcgcgaacctgcaaaacatcaccctcggcgtcggccgtggtggtggttttgcccagctgcatcagggtttcgtaacccttgtcggaatcgagcaggtattgcgagaacttggtcgcctcaccaaagcacaacggcagcacgccggtggccagtgggtcgaggctgccggtgtgcccggccttctccgcattgagcagccagcgaaccttctgcaaggcagcattggaggtaaagccaatgggcttgtcgagcagaatgatgccgctgacgttgcgacggatacgtttgacctgagccaccgcttactccttggcgtcttcaggtgtggacgggtgctggctgtcttcagccacggcgcgctcgatcagggccgacaggtgcgcgccacgcacgacgctttcgtcgtagtggaagtgcaactgaggcacgctgcgcagcttcatttcacgggccaactgcatacgcaggaaacctgcggccgaattgagcaccttgatgctttgcgcgatttcttcgctgctgtcctgccccatcacggtgatgaagattttggcgtgacccacgtcacggctcacttcaacggcggtgatggtgaccaggccaacacggggatctttgacttcgcgacgtatcagttgggccagctcgcgctgcatctgatcgccgatacgttgggtacggctgtattcttttgccatgtcttgttacctgttactgccacacggtgaaacccgtggggtctgaaagcggcaaacgcccggcctgacaaaagccagaccgggcgttgcgtttagagtccgtacgctgcgcggggcatttgcatgcccacacgcggcgtggctccggaagtgcgcgagttagaggctgcgagcaacctgaaccttctcgtagacttcgatcttgtcgccagccttgacgtcgttgtagctcttgacgccgataccgcattccatgccggcacgtacttcagacgcgtcatccttgaagcggcgcagggattccagctcgccttcgaagataacgatgtcttcacgcagtacacggattggacggttacggtacacggtgccttcgacaaccatgcagccggcaatcgcgccgaacttcggcgaacggaacacgtcacgcacctcggcgatacccaggatattctcccgaacgtcgctgccaagcatgccggtaagggctttcttgacgtcttcgatgatgtcgtagatgacgttgtagtaacgcatgtccaggccttcctgctcgacgatcttgcgagcgccagcatcggcacgcacgttgaagccgaacagtacagcgttggaagccagtgccaggttggcgtcggattcggtgataccaccgacaccgccaccgactacgcgcacttgcacttcgtcgttacccaggccgttcaaggcgccgttcaacgcttcgagggaaccacgaacgtcagatttgaggacgatgttaagcgtcttcttctcttcctggcccatgttctcgaagatgttttccagcttgccggcgtgagcacgggcaagtttgacttcgcggaacttgccttgacggaacagagccacttcacgggctttcttctcgtcggcaactacgctcatctcgtcgccagcgtccggggtgccgtccaggccgaggatctcgaccgggatagccgggccggcttccttgattggcttgccgttctcgtcgagcatggcacgtacacggccgtagttcgaaccgaccagcaccatgtcgccttggcgcagagtaccgtcttgaaccagaacggtcgcaaccgggccacggcccttgtccaggcgggattcaaccacaacaccacggccaggagccgatggagtcgcggtcaattccagaacttcggcttgcagcagtacggcttcgagcagttcgtcaacgccggtacccattttcgcggaaaccgatacgaatggcgtctcgccgccccactcttcagacgtcacgccgtgaaccgacagttcgctacggatgcgatcgagatcagcgcccggcttgtcgattttgttcacagccacaaccagaggaacaccggcagccttggcgtgctggacagcttcaatggtctgcggcatcacgccgtcgtccgctgcaactaccagaatcacgatgtcggtcgccttggcaccacgggcacgcatcgcggtaaacgcggcgtgaccaggggtgtcgaggaaggtgaccatgccgcgctcggtttcaacgtggtacgcaccgatgtgctgggtaataccgccggcttcgcctgcagcaaccttggcacgacggatgtagtcgagcagggaagttttaccgtggtcaacgtggcccattacggtcacaaccggtgcacgggaaactgcctcaccttcaaacttcagggactcagccagggaatcttccagggcggtgtcgctgaccagggtcactttgtggccgagctcttcagcaaccagttgggcagtttcctgatccagtacctggttgatggtggccggagtacccagcttgaacatgaacttgatgatttcagctgccttgaccgacatctgctgggcgagatcgccaacagtgatggtctcgccgatcttcacttcacgcacgacagggccggttgggctctggaaaccgtgggcgttgcgttttttcagcttggccttgccgcgaccaccacgacggaagccatcgctttcttcgtcggtagtacgtggggcaacgcgtggagcaggcgctttctctttgaccgaggcacgatgtggagcgtttttacgctcgccatcgccaccaccaccgcgacgattgttatcgtcggcacgtggcttgtccggacgacgaggctcgtcgcgcttgcgagcgtctgctgcaggagcaggtgcagcggcaaccggagcggcctcacgcacagcttcaacaggcgctacaggagcggcggccgcttcagtaccagcaggttgcgcagcagcaggctggcgacgcgcttcttcttcggcgcgacgcttggcttcttcttcagccttctgacgagcagcattttctactgcgcgacgttcttccagttcgcgtttgcgctcggcttcgatttcttccgggctgcgctgtacgaagactttcttcttgcgtacttcaacgctgatgctcttgcttccagcaacacgcagggtgctggtggttttgcgctgcaatgtaatcttgcgcggttcttccactttcgccttgtggctgctcttcaagtgagtcagcaaagactgcttctcactgtcgctcacaccttcgtcggcggcggtgtgcggcagacctgcctcacgcatctgctgcaacaggcgctctaccggtgttttgacctcatcggccagttgtttcaccgtgacttgcgtcatgcacttctctcctcaggccgcgcctagttactcgaaccaatgggctcgggcggccatgatcaacttgccggcacgatcatcgtcaatgccgtcgatgtcgagcagatcgtcaatagactgctcggccaggtcttcgcgggtaattacgccgcgcaccgccagttccatcgccaaatccttgtccataccctcaagcgagagcaggtcttcggccggatgggcgtctgccagcttttcctcagtagcgatggctttagtcaacaaacgatccttggcccgagcgcgaagctcgttgacggtgtcttcgtcaaagccgtcgatgttgagcatttcttccaacggtacgtaggcaatctcttccaggctggtgaagccttcatctaccagcacctgtgccaggtcttcgtcgacttccagctcgtcgatgaagttgcgcaggatgtcaccggtttcagcttgctgcttagcctggatgtccgattcggtcatcacgttcagggtccagccggtcagttggctggccagacgcacgttctgaccaccacgaccaatggcctgagccagattgtctgcgccaacggcgatgtccattgcatgggcatcctcgtcaacgataattgccgccacttcagctggcgacatggcgttgatcacgaactgcgccgggttatcgtcccacaggacgatgtccacacgctcaccgcccaattcgcccgacactgcctggacgcgcgaaccgcgcataccaatgcaagcgccctgcgggtcgatgcgtttgtccttggaacggaccgcgatcttggcgcgcgaacccgggtcgcgggacgcagccatgacttcgatcaggccttcggcgatttccggcacttcgatacggaacagctcgatcagcatttccggcgcggtacgcgacaggatcaactgagggccgcggttctcggtgcggatttccttgagcagcgcacgcagacgcacgccgacacggaaggtttcgcgagagatgatgtcttcgcgagccagcaacgcttcagcgttgttgcccaggtcgacgatcacgttgtcgcgggttacttttttcacggtgccggagatgatttcacccaggcgttcgcgataagcgtcaacgacttgagcgcgctcggcttcgcgaaccttctgcacaatgacctgcttggcggtctgtgcagcaatacggccgaattcgatcgactcgatcttttcttcgacgacatcaccgaccttggcgccagggtgcgtttcggcaaccttgctcggccaggtttcgatggccggatcatcaagatcggcttcttcgacgaccgtccagcgacggaaagtctcataggcaccggtgtggcggttgatttccacacgcagatcaacttcgtcttcaaaacgctttttggtagcagtggccagggccagctccagcgcttcaaaaatcacgtttgccggtacgcccttttcattggataccgactcaacaaccagcagtacttctttgctcatcgtacgcctcgcctttcgcaagccattggatccgcgggatccgcgtctcagtcaaaactgggaataatgttggccttgtcgatcatatcgatcggcaacaggaactcatggtcgtctacctgcaccacgacatcctgttcttctacaccgcgcagaaggccctgaaagttgcgtcgcccttcaaagggagaacgcagcttgatcttcacttgttcaccggcaaattttgcaaactgatcaatagtgaacagtgggcgttccatgccaggcgaggaaacttcgagggtgtattcaacggaaattggatcttcaacatccaggacaccgctgatctgacggctgacaatggcacaatcgtccaccagcacaccgccctctttatcgatataaacgcgcaacattgagtggcgaccttgagccgaaaactcaataccccagcattcatagcctagggccacgaccaccggggccagcaaggcctgcaactcttctagcttgctcgacacctgaaccccctcgtgcatgtatgtgcatgctgtgcaaaataaaaaaatgggcgaaacgcccatccttgaaacgccgtcgaacagcggcgttgaaagtgtccagctaacaaaaagccccttaaaaggggctccgctaaaactggttgcgggggccggatttgaaccgacgaccttcgggttatgagcccgacgagctaccagactgctccaccccgcgacaaagctggggcggaagtatacgaccgatcccttacagggtcaatgtaaccttccacctacaagaaagcccgcaacagcgggctctcctgataattggtaccgagaaggggactcgaacccctacaccctatgggcacaaccacctcaaggttgcgtgtctaccaattccaccacctcggcaatacagcgtttacaacccttcttacttctgctcttgagctggaggtacgtcagtcgctggggtagccgacttttgctcttgaagcaccgggacatcatcagaagccggttttgcttttggtacttccaacactgctgggtttgggagacctacttgagtcagcacatgagctttctctttagcaaagtaacctaaccctaagctggttatgaagaaaccggcggcaagtatagcagtaaacttactaagaaaggtagaggaaccttggcttccgaacacagtatttgaagcacctgcaccgaaagacgcaccagcatctgcacctttaccctgttgcaacaaaaccagggcaactacgcccagggcagccaacagatgaaaaacgactacgactgtttccagcattttttcagtttcccgcggcgcgacagatcgcaccgaactcatctgcattcagggaagctccaccaatgagccccccatcgatatccggcatgccgaacagttcgaccgcattggccgccttcacgctgccgccgtatagaagccgcacaccttgtgcgacttcagaattctctgccgccaactgagcacggatggctgcgtgcacatcctgcgcctgttgcggtgtagcagtcagcccggtgccaatggcccagaccggctcgtaagcaattactgcctttgcaaatgcaccgacacccagctcctcgatgatgctgcccagctgacgcgagacaacttcaagagtcttgcctgattcacgctgttcaagggtctcccctatgcacaacaccggaatcaagccacaagcctgtgccgctgcgaacttgcgattgagtgtcccatcacgctcgcccatcatctgacggcgctcggagtgcccgacaagcacataggaacaacccgcatcaaccagctgactcggcgaaatctcaccagtcaacgcaccttgcatgggctccaccgcagaattctgcgcgccgacctgaatcgacttgcctttcaagccatcaaccacttggttgatatgcaagcaaggcgggaaaaccgcaacatcaacaccgctaggcaaggccaagtgacgaaggccattgatcagctcagcgacactggcgcgggtaccgtgcatcttccagttaccagctaccatagtgcgacgcatgctgtacctcgtcggtcaaagtgggcgcagatgttacccaaccacatcatcactggcaagccgaattcaggcgcaaatttcagttaccagttttgccaggtcttcggcatggccgcgaacctgtgcttcgtcctcaccttcgaccatgacacgcaccagtggctctgtgccggacttgcgcagcaacacccgcccacgccccgccattgccagggttacacgctcgcaggcatctttgacagcagggtgctcgatagggttttcgccgcccgcaaaacgcacattgagcaaaacttgcgggcacttgcgcagcgcttgacgcgcctgagccaggctctcttcacggcgacgcaaagacagcaacacttgcagcgcggcaataatggcatcgcctgtggtggtgtgctggaagcagacaacatgcccggagttctcaccgcccacctgccagttacgctccagcaactcggcgatcacataacggtcaccgacattggcacgtacaaacgggatccccagctcagccagagccagctcaagcccaaggttgctcatcagcgtaccgacgacaccgccttgcagcttgttacgctcgtgcaggtcgcgggcaataatgaataacaggtcatcaccgtcaaccaccgtaccggtgtgatccaccatcagcacacggtcaccgtcgccgtcaaaggcgatacccaggtcggcatgctcagccaggactgcagcctgcagctgctccatatgggtggagccgcaattttcgttgatgttcaaaccattcggctgagccgacagcaccgtcacgtccgcgcccagctctttgaacacgctcggcgcgaccttgtaggttgcaccgtgggcacaatcgacaacgatcttcagcccggcgaaattggtgctggtaggcacgctgcttttgcagaattcgatgtaccggccagacgcgtcgttaatgcgtgacaccttgcccagcttgctggactcgaccaccgtcatcggcgcatccagcaactcttcgatcatcagctcgatctcgtccggcaatttggtgccctggcccgagaaaaacttgatgccgttgtcatcatgagggttatgcgaggcgctgatcacgataccggcttcagcgtgaaaggtacgcgtcaggtaggcgatagcaggcgtcggcattggccccaacagcatcacatcagcaccggcggcggacaaacccgcctcaagtgcggactcaaacatataccccgaaattcgggtgtccttgcctaccaggatgcggcacgcacccatgctgcggaacgccatacctgccgcccaacccagcttgagcatgaaatcaggagtaatcggaaactcgccgacccgaccacgaataccgtcggtgccaaaatattttttagtcataagtgctccatcattcttattcggctgattctacagcggcgatcatgcgcaccacatcaaccgtttcggcgacgtcatgcacacgcaaaatacgcgcgcccttggtcacggcaagcgccgccagcgccagaccaccgtaaagccgctcgccgacgggacggttcagggccagccctatcatgctcttgcgcgaaacgccgaccaacaggggccgaccaagggcgtgcaaggattccatatgcttgaacagactcaaattgtgctgcagggtcttggcgaagccaaacccgggatcaaggatgatcttttcggccgcaatgcccaccgttgcacattgagcgatcctttcagccagaaagccactcacctcgccgacaaggtcatcgtagtgtgggttgtcctgcatattcccgggctctccgagcatatgcatcaggcacacaggaagaccggttgccgccgctgcgtccagggcaccatcgcgtcgaagagctcgcacatcattgattaaccccgcccccaggcgggccgtctcacgcatcactgccggggtcgacgtatcaaccgagatgatcacatccaactcgcgagcaataagctcaactattggcgccactcgctcaagctcctccaggggagaaaccacacgagcaccgggacgagtcgactcgccacccacgtcaatcaacgtggcgccggccagaaccatcgcttcagcatgacgcagtgcggcatccagctggttgaaacggccaccatcggagaaggaatcgggggttacgttaagaatgcccatgacatgcgtatgggccaaatcaagaacccggttgccgcaaggcaaccgggtggaggacaacacagaagtcatttcaaaccttagtggtcagctgccgggccgccgatcggggtttcagggcgttcgttctgtactaccggcggagttcccgacgtacccgagccaccttcccaatcgcgaggctcacgcggtgtacgacccgccatgatgtcgtcgatctggtcggcatcaatggtctcgtacttcatcagcgcatcagccatggcgtccagtttgtcgcggttgtcggtcaggatctgcttggccgtgccgtagcactggtcaatgatgctgcgcacttcggagtcgatcagcttggctgtctcaccggagaagctcgcgctttgaccgccaccgccacgacccaggaacacctcaccttcttcctcggcatacatcaaaggaccgagtttttccgacaagccccacttggtcaccatgttccgcgcaatctggctggcacgcatgatgtcgttggaagcaccggtggtgacaccgtcaaagcccagcgtcatttcttcggcaattcgaccaccgtacagcgagcagatctggctgatcagcgcacgcttggagaggctatagcgatcctcctccggcaggaacatggtgacacccaatgctctaccacgaggaatgatcgacactttgtagaccgggtcgtgctcaggcactacgcgaccgacaatggcgtgaccggcttcgtgataagcggtgttctgcttctctttctcggacatgaccatggatttgcgctcagcgcccatcatgatcttgtctttcgccagttcgaactctttcatttctacgatgcgcttgccggtacgggctgcgaacaacgaagcctcgttcaccaggttggcaaggtccgcaccggagaagcctggcgtaccacgggcaatcaccgccggagcgacgtcgtcacccatcggcactttgcgcatgtgtactttcaaaatctgctcacgaccacggatgtccggcaggccaaccacaacctggcggtcgaaacggcctggacgcagcagcgcagggtccaaaacgtccggacggttggtggcggcgatgacgatgatgccgtcattcatttcaaagccgtccatctccaccagcaactggttgagtgtctgctcacgctcatcgtgaccaccgcccatgccggcaccacgatggcgaccaacggcatcgatttcgtcgataaagatgatgcaaggcgcgtgcttcttggcctgctcaaacatatcgcgaacacggctggcaccgacaccaacgaacatctcgacgaagtcagaaccggagatagtgaagaaaggtactttggcttcgccggcaatcgccttggccagcaaggttttaccagtacccggagggccgaccatcagcacaccgcgaggaatacggccgcccagacgctggaatttgcccggatcgcgcaggaactcaaccagctcgccgacttcttccttggcttcgtcgcaacccgcgacgtcagccagggtggtcttcacctgatcttcggagagcaggcgtgccttgctcttgccgaaactcatcggcccgcccttgcctcccgcaccaccttgcatctggcgcatgaagaacatgaacacggcgataatcaccaggatcgggaagctcgccaccaggagttgagtccagatgctctgctgctcaggctgcttgccctcaacgaccacgtggttatctaccaggtcgccgatcagaccgttgtcctggattgccggacggatggtcttgaagctgtcgccatcgttgcgcttgccggtaatcacgtagccatcaaccgctacgcgctcgaccttgccatccttaacttgctggatgaagtcggaatagttgagggtctgcggctcgttagggctggagaagttgttcatcaccgtcaccaggactgccgcgatgatcaaccacaggatcagattctttgccatatcgttcaattaactaccctctgaagcaagctccgctattggcgcgcgcttcgcatgatattcaccggcctaacttactacattacctacaactctggcaggcgccgtctgtaaccctttgtgaaactttgactacacaatattcgtaaagcttcgtgtcgaaagcgatataaaaaaacctatcgcccccctcaaattcctcaaaaacgctcttcgctcgctgccccttcaacaccgcggaagccacggcacagcaggtattgctcgcgagacctgtcccgggaagagtcaggcttgcgtgtttgcaccttgtcgaacaacttgcggatgttcttgtggtactcgtcgaaaccttcgccctggaagactttcaccagaaaatcacccccaggacgcaacacccgacccgccaaatccagcgccagttcacacaggaacattgcgcgcggcatatcgacggccggtaatccactcatattgggggccatgtcggaaatcacaaggtctacctgcgaatttcccacagcttcaagaatctgtgcgagcacggcgtcctgggtaaagtcgccatgaacaaaggtcacatcggggatgctgtccatttccaggatgtcggaagcgatcaagcgaccttgcccaccaatcagacgactggtcacttgggaccagccaccgggggccgcgccaaggtcaataacgctcatgcccggacggatcaatttgtccttgtcctggatctccagcagcttgtagctggcccgcgaacggtagccgtccttctgcgcctttttgacgtaaggatcgttgaaatgctcttgcagccacttaaggctagttttggaacgggccacgggccacctcgaaaaataaaacgggtcgtgattaactgggcggtcccggactcgctcgggtaaactggccgccgctttttacaagatcagacgcaggggtcagattatgccgctcactcaagagcagaagaaacagtacaaatccattggccaccatctgaaaccagttctgattgtggcagacaacggtttgactgaaggtgtgttagccgaacttgaacgcgcattgggcgatcacgaactgatcaagatcaaggtcaatatccttgaccgcgaagcgcgtttggccgccattgcagaactgtgcaaggtcggcaaagcggatctggttcaggtcatcggcaagatggcgctgctgtatcgcaagaacttcagcgtcaacaagcaactgtcgaacgtacaccgcttcaagtaacaaaaagggtcacgggcgtgcttcgcgcgccccgccactccatcccggcgccggctgtatcaccagcaccaggccggagaaccctagcacaagatagctgaatagctgccagcgcaacgcttccggcagccacacatgcaccacgcaaaacattgcgcatgcatacagcgccatcaacagcagttggccgcgaatatcccgccacaaactccccaagccctcggcttttatcagcaccagcacctggagcgtcacgcacgccgccgcaaaacccaccagcagcgcactcagcaatccgtcgatctcatcgatcagcaacggcgccaggccaatcaggcccagcgtcggcaatataccaatgtgcaacaaccacacgccgccaacccaaagcatctgggcaagctgccaaagcatggcgcccgcacgaagcgggcgccgtctttcagatgtgacgaacttcaacaatctcgtactcgattacgccaccaggcgttttcacagccaccacgtcaccctcttccttggcaatcaaggcacgggcgagtggcgagccgacggagattttgccgagtttgaagtcggcttcgtcttcacccacgatgtggtaaacaacgcgctcatcggtctcgacgttggcgatttccacggtagtaccgaaaataaccttgccggtatgcgggatggtcgtgacgtcgatgatcaccgcattctgcatacggccttcgatgtcacggatacgcgcctcaaccataccctgctgctcacgagcagcgtggtattcagcgttttccttcaagtcgcccagctcgcgggccgtcccgatgtcctggctcagcttcggacggacgaccttggtcagatgggcgtgttcctcttccagggccttggcgccctggacggtcattgggtatttggtcatgccttcaatcctgcgtgtagatcctgcaagcgacgcacggtcttttccggaccgaacttgagcgcttcgcagatggcttcgccagcagcaatggtagtggtgcagtagatcttgtgctgcaaggcattacgacgaatggagtaggagtccgcgatcgactggcgaccttcggtggtgttgatgatcaaagtgacttcgtcattcttgatcatgtcgaccacgtgcggacggccttccgtcaccttgttcacgcgacgcactttcaggccggcagcttcgatcagcttggcggtcccggcggtggccacgacttcaaagcccaagttgatcagatcacgggccacgcctgcaaccagtggcttgtcatcatcacgcacgctgataaacgcagtaccaccggtcggcaacacttcgctggcacccatctgagccttggcgaacgcctcgccgaaggtatcgcccacgcccatcacttcaccggtggacttcatctctgggcccaggatcgggtccacaccagggaatttggcgaaggggaacaccgcctctttcacgctgtagaagttcggaatgatttccttggtgaagccgatttccttcaaggtcttaccggccatcacgcgggcagcgatcatcgccagggacacaccgatgcacttggaaacaaatggcacggtacgcgaagcgcgcgggttgacttcaatgacgtagatgtcttcgccttgcagcgccaactgaacgttcatcaggccgacaacgcccagctccagggccattttcttgacctgttcgcgcatctcgtcctggatgtgcgccggcagcgagtacggcggcagcgagcacgcggagtcaccggagtgaacgcctgcctgctcgatgtgctgcatgatcgcgccgatcaccacgtcggtgccgtcgcagacagcatccacgtccatttcgatggcgcagttaaggaagtggtccagcagcaccgggctgtcgttggacactttcaccgcatcgcgcaggtaacgcttgagctcttcttcttcgtaaacgatttccatcgcccggccgcccagtacgtaggacggacgcaccaccagcgggtaaccgatcttgctggctgcgcggatggcttcgtcttcgctgcgcacggtagcgtttggcggctgacgcaggttcaggcgctcaaccatttgctggaagcgctcacggtcttcggcacggtcgatggcgtcagggctggtgccgatgatcggtacgccggcagcttccagggcgcgagccagtttcaacggggtttggccgccgtactggacgatcacgccttttggcttctcgacgcgacagatctccagcacgtcttccagggttaccggctcgaagtacaggcggtcggaagtgtcgtagtcagtggaaacggtttcggggttgcagttgaccatgatggtctcgtacccgtcttcgcgcagggcgagagcggcgtgtacgcagcagtagtcgaactcgatgccctggccgatacggtttggaccgccgcccaggataatgatcttgtcgcggcccgacggcgcggcttcgcactcttcctcgtaagtggagtacaggtaggcggtgtcggtggcgaactcggccgcgcaggtgtcaacgcgcttgtagaccgggaagatttccagcttgtggcgatgcgtgcgcaggttcttctcggtcacacccagcagcttggccagacgctggtcggagaaacctttgcgcttgaggcggaacatcaggtcgcggtcgatagaggacagaccgagggtcttgaccttctcttcttccttgatcagatcttcgatctgtaccaggaaccacgggtcgatcatgttcatgccaaagatgtcttcgacggtcatgccggcgcggaaggcatcagcgacgtaccagatacgctcagcgcccggcacagtcagctcgcgcttgagcacgctcatgctttccgggttgctcaggtcgagcttctcgtccaggccgcaaacacccacttccaggccacgcagggctttctgcagagactcctggaaagtccggccgatggccatgacttcacccacggatttcatctgggtggtcaggcgcgcgtcagccttggcgaatttctcgaaggcgaaacgtggcagcttggtcacgacgtagtcgattgacggttcgaaggacgccggcgtagcgccgccagtgatttcgttttgcaactcatccagggtgtaaccgatcgccagcttggcagcgatacgcgcaatcgggaagccggtagctttcgatgccagcgccgaagagcgcgatacacgcgggttcatctcgatcacgaccatgcggccggtgtccgggcagataccgaactgaacgttggagccgccggtttcaacgccgatctcacgcagtaccgccaacgaggcgttacgcatgatctggtattccttgtccgtcagggtctgagccggagcaacggtgatcgagtcgccggtgtgcacgcccatcgggtcgaagttttcgatcgagcagacgatgatgcagttgtcctttttgtcgcggacaacctccatctcgtactctttccagccgatcagggattcgtcgatcagcagttccttggtcggcgacaggtccagaccgcgagcgcagatttcttcgaactcttcacggttgtaagcgataccgccaccggtgccgcccatggtgaaggacggacgaatgatgcacgggaagcccagcttctcgaggaccgcattggcctcttccatgctgtgggcgataccggaacgcgggcagtcaaggccgatggacttcatggccttgtcgaaacgcgaacggtcttcagccttgtcgatggtgtcggcgttggcaccgatcatctctacgccgaacttttccagaacgccttcgcgctccaggtccagggcgcagttcagtgcagtctggccacccatggtcggcagcagcgcgtctgggcgctccttctcgatgatcttggcaacggtctgccacttgatcggttcgatgtaggtggcgtcggccatgtccgggtcggtcatgatggtggccgggttggagttcaccaggatgacgcggtaaccctcctcgcgcagggctttacaggcctgggcgccggagtagtcgaattcgcaggcctggccgatcacgatcgggccagcgccgagaatcaggatgctttttatgtctgtacgttttggcatgggtttgtcactcaaatccgcaggtcagtcggcaagccgtcttgaacaatctttgaagagcctgcgggggccaccgacattcggggccgcccgcacgccactcagtcagcgtcgcttggccatctcattgatgaaacggtcgaacagcggcgctacgtcgttcgggcccgggcttgcttcagggtggccctggaagctgaacgcgctcttgtccgtgcgttcgatgccttgcagggaaccgtcgaacagcgacttgtgaatcgcgcgcacgttagccggcaaggtcgcttcatccaccgcaaagccgtggttctggctggtgatcatcaccacacctgtgtccaggtcttgcactgggtggttggcaccgtgatggccatggcccattttcagggtcttggcgccggaggccagggccagcagttggtgaccgaggcaaataccgaacaccgggatttcggtttccagcacttccttgatggcctggatggcgtagtcgcacggctccgggtcacccgggccgttggacaggaacacgccgtccggttgcagggccagtacgtcgctggccggcgtttgcgccggtacgacagtcacgcggcagccgcgctctaccagcatgcgcaggatgttgtacttaacgccgtagtcataagcgaccacgtgataaggcaactcgctggcctcgagggtcgcatggctgtcggtcttcaagtcccagacagtggagcgccactcatacttctctttgacgctgacaactttcgccaggtccatgcccttcaggccagggaagccttgcgctgcagcaatcgctgcttcttcggaaatattgtcaccgaccatgatgcagccattctgcgagcctttttcacgcaggatgcgcgtgaggcggcgcgtgtcgatacccgcgatcgccacaacgttgttggctttcaggtaatcggacagcgacatcgtgttacgccagttgctcgcaaccagtggcaggtcacgaatcaccagaccggccgaccagacacgatcagactcgacgtcttccggtgtagtaccggtgttgccgatgtgcggataggtcagggtaacgatctgctgggcgtaggaaggatcagtaaggatttcctgatagccggtcatggcagtgttaaacactacctctccaacggtttgaccgtcggctccaatggcttcgccgcgaaaaatgctgccatcagcaagggcgagtatggctggcttagtcaagaagacctcccgtaaataaagcctgaaagggcgatcgcaggttgtaaaaaagcggagtgacgtatggacacgtcaccccgcttcttcactgaattattctgcgcgcttttagtggacacactaaagctgtagcttacagaaaaaggcttttttggtccaccgctaatgagccttaaaggcaggggaatgcgacaggacgtcgcttagcgggtaaaaacggggcctcaggataatcctgaggccccgttttagctactgattagtgcagatccagcacgtcacgcatgtcatacagccccgcctcgcagccttccaaccagagcgcggcacgtaccgcgcccttggcaaaggtcatgcggctcgacgctttatgcgtgatctccaggcgctcaccttccgtggcgaacagcacggtgtgatcgcccaccacatcaccgccgcgcacagtggcgaagccgatggtgtcacgcgcacgctcaccggtatgcccttcacggccataaacagcgaccttcgacaggtcacgccccagcgcgtcggcgatcgcctcacccatacgcaacgcagtacccgacggtgcatcgatcttgtgacggtgatgggtttcgataatctcgatatccgcctcatcgcccagcacacgcgccgccaggtccagcaacttgagcgacaggttcacgccgacactgaagttggccgcgaagacgatcggaatatccttgcccgcctcgaccagcaattgcttttgctcaacgctcaagcccgtggtaccaatcaccatggccttgcccgtcttgcggcagaacgccaggtttttcagcatcacttccggcagggtgaagtcgatcagcacgtcgaactcatcagccacctgctcgaggttacccgacaacgacacaccgatacgccccaacgaggccaactcaccggcatccgcaccgatcaacgtgctgcccgggcgaacgatcgccgcggtcagcccggaggccggcgagcgctgctgcaccgcctcgaccagcgtcttgcccatgcgcccggcagcgcccattacggctatacgtcgcatactcacttccttacaggtcgccgaagaagcgcttcacaccatcgaaaaaaccggtggttttcggcgaatgggagtcatcgccttccaacgagctacggaactcttccagcagttcgcgctgacgacggcccaggttgacgggtgtttccaccgctacgcggcacatcaggtcaccagcaccgccgccgcgcacaggcgccacgcccttgcctcggatacggaactgcttgccggtttgcgtaccttcgggaatcttgagcttgacccgaccgtccagcgtcggaatttccaactcgccacccagggccgcgtcgacaaagctgatcggcacttcgcagaacaggtgcttgccgtcgcgctggaagatcgagtgctcgcgcacattgatcaccacatacaggtcgcccgtagggccaccctgagtccccgcctcaccttcgcccgacaggcgaatgcgatcaccggtatccacgcctgccggcactttcaccgaaagagtcttgtactcttcgacgcggccttcgccgtggcaggaatcgcatggatcggaaatgatcttgccctggccatggcaacgcgggcaggtctgctgcaccgagaagaagccctgctgcatacgcacttggccaataccgccgcacgtcgggcaggtaatcggcgaggagcctttcttggcacccgagccatcgcacggcttgcaattgaccagcgtcggcacccgaatattgacggtggtgccgcgtacggcctcctccaggttcaattccagggtgtaacgcaagtcgctgccacgctgggcgccgccacgctgaccgccacggccaccgccgaagaagtcgctgaatacgtcgccgaaaatatcggagaaattctgaccgccaaaaccggcaccgccgccgcccatgcttgggtcaacgccggcatggccgtactggtcgtaggccgcgcgcttgtttggatcactcaggcattcgtaggcttcgttagcctctttgaacagctcttcggattctttgctatccggattacggtccgggtggtgcttcatcgccaggcgacggtatgcctttttcaggtccgcctcgctggagccgcgctccacacccaacacttcgtaatagtcacgctttgccataagtctttgcactcttaaggacgttcggcgagaccctcctgagccttgccaaactcgttgagccccaatacaggcccggacccaactcacgtcaattcaacgatcctggtcattactgctttcagccagggacccggccaaaaacgcggtgactgtcgccaggaagcaggagcattcccgatcacaccgccaacatccgaaccttgtcgcatgttgtaaaaattcgcataccccagacacgccaacgcgggagcaagctcccgcgcggcgacatcctaccagtcaccgcttgatagcggtcaaccgggcgaccaacttacttctggtctttgacttcttcgaactcggcatcaacaacgtcgtcgtgcttggcttcaggctctgcgtgttgtggagcaccgtctgccggctggccttgctcggcgtacattttctgagcaaccggcgcggagactttcgacagctcctcaatcttggcttcgatggcagccttgtcgtcgcctttgatagcggcttccagggcaaccacagcagcttcgatcgcggttttctcttcagcagtcactttttcgcccgcgtcggcgatcattttgcgcgtcgagtgaaccagggcatcaccttggttacgggcgccggccagctcagcaaacttggcatccgcatccgcgttggcttcagcatcacgaatcatctgttgaatttcttcatcagacagaccggagttggccttgatggtgatcttctgctctttgccggtagccttgtctttagcgcctacgtgcaggatgccgttggcgtcgatgtcgaaggtcacttcaatttgtggcacgccacgtggtgctggtggaatctcagccaggtcgaacttgcccagggacttgttctgagcggcttgcttacgctcaccttgcagcacgtgaatggtcacagcgccctggttgtcgtcggcagtcgagaacacttgcgatttcttggtaggaatcgtggtgtttttctcgatcagcgcagtcatcacgccgcccatggtttcgatacccagggtcagcgggctgacgtccagcagcaacacgtctttcacgtcgccggccagtaccgcaccctggatagcagcacccatggcaacagcttcgtccgggttcacgtctttacgtgcttctttgccgaagaactcggtaaccagcttctgaaccagtggcatacgggtttgaccgccgaccaggatcacgtcgttgatcgaacctacgtcgataccggagtctttcagcgcgatgcggcaaggctcgatggtacgttgaaccaggtcttcaaccagcgcttccagcttggagcgcgagatcttcacgttcaagtgcttaggaccggtagcgtctgcagtgatgtacggcaggttcacgtcggtcgactgagcggaagacaattcgatcttggctttctcagcggcttctttcaggcgctgcatggccagcgggtcacctttgaggttcatgccgctttctttcttgaattcgtcaacgaggtagtcgatcaggcgaatgtcaaagtcttcaccacccaggaaggtgtcaccgttggtggccaacacttcaaactggtgctcgccgtcaacttcagcgatctcgatcacggagacgtcgaaagtaccgccacccaggtcgtaaacgatcacggtgtggtcgcccttggccttgtccataccgtaagccagagcagccgcggttggttcgttgatgatacgttttacgtccaggcccgcgatgcggccggcgtctttggtcgcctggcgctggctgtcgttgaagtaggccggaacggtgatcaccgcttcagtcacggcttcaccgaggtagtcttcggcggttttcttcatctttttcaagatttcagccgagatttgcggcggcgacattttctggccgtttacttcaacccaggcgtcaccgttgtcagccttggcgattttgtaagggaccatcttgatgtctttctgcacgacttcttcgtcgaacttacgaccgatcagacgcttcaccgcgtacagggtgttatgcgggttggtcacagcctgacgcttggccgactgaccgacgaggatttcaccgtcgttggcgtaagcaatgatcgacggcgtggtacgcgcgccttcggcgttttcgataactttagcaacaccgttttccagcacggagacgcaggagttggtagtccccaggtcgataccgataattttgcccatgatttactctcccgaaactttaatttggttgccgcagcagtggtggctaactgcggtagcacttaaacgcttgacttataaatgggggccttgcggcggatttcaagcctgctcatcaatagaaggtgcaacaggtgcaggagccttgctcaccaccaccattgccgggcgcagcaagcgaccgttgagctggtaacccttctggaatactttcaatacgctgttcggctcaaggtcatggctttcctgcatggccatggcttggtgatgctctgcattgaacggctcgccgccttgcggatcgatggcttccaactgataacgcttcagggtgtcctggaacattttcagggtcagctcgatcccttcgcgcatcgggcggatgttttcgtcgtccgggttggacaattcaaggccacgctccaggctgtcgatgatcggcagcaggtcattggcgaatttttccaatgcgaatttgtgagctttctcaacatcctgctcggcgcggcggcggacgttctgcagatcagcggcgacacgcaacgactgatcctgcgcagcagccaattgctcttcgagcacttgcacacgagtcgccagttcatcaccgacagccgaattggcgtctggagtttgcgtatcctgcgtctgttcgtcagccatagatttctcctttcaaaatcatgcgcgaactcaactcgcgcttctgttccggtatatggggccacaatttccaggttcaagagcgcaagcgttaccaaaagtctttcagctgccatggatcaattcctgcacgctcattccccatcgcgctaaaaaagcgacttaatcaagcaaatcgagctaagcctcaggattgtcagccctgaacaaaacactgtataaataaccagacctaacgcctgggagcgccgtcatgctcgtgcacctgtctgtacataactacgccatcgttgaacatctggacctcgaactggatcgcggaatgagcgtaatcacaggcgaaaccggtgccggcaagtcgatcatgctcgacgccctgggcctgacgctcggcgaccgagccgacagtggcgtagtgcgccccggcgcggacaaggccgatatcctggccaccttcgacctggcggacatccccgaagctgaaacctggctggccgagcgcgaccttaataatgaaggcccgtgcatcctgcgccgcgttatcactgcggaagggcgctcacgtggctacatcaatggcacgccctgccccctgggcgacttgaaagccctgggcgagttgctcatcgatatccacagtcagcatgaacaccagtccctgctgaaaaccgacacccatcgccgcctgctcgatgaatacgccggcgccaccgacctggcccgacaggtccagcttgccgcccagcgttggcgccagacccgccaggagctggagcgtctctccaactccggcgacgagcagcgcgcccgccatcaattgctgagctatcagcttgaagagctggaaagccttggcctgggcgaaaccgagctggagcagttggagcaggaacacaagaacctcaccaacgccgagaccttgctgggcatttgccgccaagtggtagagcaatgcagcgaaagtgattcaggcaatgtgctaaatgcgctgacggcgagccttaatcgtctgtccagcgtgaacaacgcctccggctcgctgaatgaagccactacgctgctgaccagcgcacagatccaggtcgaagaagccgtaggagagctgaaccgcttcctcgatcacttcgatgctgacccggctcgcttgcaggagatagaagagcgcctggataccatctacaccctggcgcgcaagcatcgtatccagcccaccgaagtggcgaccatgcagcaaaaactgctggatgaaatcgaaacccttaatgccaacgacgaatccattgaacgcctgggcgacgaactcgcgtctttcgcccggcattaccacgagaaagcccgcgaactgagcgagctgcgccaacaagccgccacaagcctggccaatgccgtagagcaggagattcagcgcctgggcatgcccggcgggcgcttcactatcgaactgcatgccaacaccagcaacgaactgcaacctcacggcctggagcaggtagagctgctggtcagcgccaaccctggccagccactcaaggcactggcgaaagtggcgtctggtggcgagctgtcgcggatcagcctggcgatccaggtgattaccgcacagacctctcgcgtccccacattagtgttcgatgaagtggacgtgggtatcggcgggccgactgcggagatcgttgggcaactgctacgccgtttgggagaacgcggccaggtcttgaccgtgacgcacttgccacaagtggccgcccaggggcatcaacatttatttgtacataaagtacgcggcagcgatgcgacgcacaccgcggtgtcgaagctgaataaatcggaacgcgtggaagaagtggcacgaatgctcggcggcatcgacctgaccaaagaatctttggcccacgcgaagaaaatggtcgtggcagccaaggcttaaccccacattttcttctatttagaaagcacgaaggcgaccctagggtcgccttcaatcgttttgcagagcaaatctgcgtcgatttttactttttcttacggatgtaaagaaccagattatggtccaccaaatcgaaaccatgctgctcagcgatctgatgctggagcttctcgatttccggactggtgaactcgataacctcattggtatccaggtcaaccatgtgatcgtgatgaccaccgtcagccaattcgaacaccgcatgaccgccgtcgaaattatgacgaaccaccagccctgcggcttcaaactgggtcagcacacggtaaaccgtggccaggccaacgtcctcgttagactccatcagcgccttgtaaacatcctcggcactcatgtggcgctgctcagcagaatcgagcatttgtagaatcttgactcgtggcagagtcactttaagaccggctttgcgtagttcgctattttcaaccatggttagctttctcgcggatgctgcttcgcagcttctcttaatacgggtatgatcggcgtttacgttgtcccagccaagatagtggaagtcgcccaccgatgcaaaacaccaagctcttgctaaccagtttcacccttgtgggactgctcgcactcgccggttgttcattccccggggtttacaaaatcgacatccagcagggcaatgtcgtcacgcaggacatgatagaccagttacgtccgggaatgacccgacggcaagtacggtttatcatgggcaatcccctgctgaccgacacttttcatgccgatcgctgggattatctctacagcatccagcctggtggcggtgaacgccagcaggagcgcgtcagcgtcatcttcaatggcaatgaccagcttgtcagcctgtccggtgacttcatgcccggcgtaagccgtgatgaagccttgctgggcaaggacaacggcaccaacgtgactgcgcctgcgcaggaagcggagaagccgaagtccgaggttccggccaagcctggctccttgctggatcagatccagaaggacgtcgacggcgtgcaaaccgttccagtcccgacgccacagcctctggacaccgccccgcagtaattttgcggcgcacaacaaaaagcccggcatgccgggctttttgttgcctgccgattggcagactcaggaattgcgttgcttggccatcgccgccttgaccgcgcgcagcctgcgcacttctttagggtctaccagcaagggccgataaatctcaatacgatcacccggctgcacggcgcgcgcatccgcgtcggcaaccactttaccgaatatccccaaggggcaatcagccagcgtcagttgcggaaactgcgctgcaattcccgacgccagcaccgccgccctcaggctcgtgcccgacggcaccgtcaccgccaacaggacctggcgatcctcggcggcatacaccacttcaatctcaaccatgcagttgcttggctcgctgacaaaatgcatccaccaaggtattggcagcctgattgaacaaaggccccagcgtcgcccgcacgatgggccccgcgtaatcaaaggacaaatcgaggcttatcttgcaggccttgtcagtcaacgccttgaatacccacacaccgtgcagttgggtgaacggcccttcctgcaggttcatttcaatggattgcccaggcaccaggatattgcgcgtaacaaaatgctgactcatacccgccttggcgacgccgacactggcaaccatgtgctcgtcactgctctccagcacctcggcggcagagcaccacggcaggaattccgggtaacgcgccacgtcgttgaccaggtcatagagcgcctgtgccggataaggcagtaaggccgaacgttgaatgtgcgtcgtcatgtgcgcgttacttccactgctgaggcaaacatcgcgaaagaacagcccaatccgcgagagaaaaaaaccgaagaactgccggtattgtccgggattcgtccaacacgctcaagcacgcaggttgaccgtagccgacacgctcgcaactccctataatgccgcccctatggctaaacaaaagaaacaccccacagggaccatcgcgcaaaataaaaaggcgcgacacgattacttcatcgaacatcggttcgaggctggtctggtcctggccggctgggaagtaaaaagtctgcgcgccagcaagctgcaactggtcgacagctacgtattgctcaaagatggcgaggcctggctgctcggcagtcatatcaccccgctgaccaccgcgagcacccacgtgattgccgacccggtgcgcacgcgcaagctattgctcaatgcacgcgaactggaaaagctcgccgccgccgtacagcagaaaggctatgcctgcatctgcctgtcctggtattggagcaagcacctggtcaagtgcgagatcgcactgggcaagggtaaaaaggaatacgacaagcgcgataccgagcgtgaacgcgactccaaccgtgagctgcatcgcgccgtgcgcaacaagggcaaggaagactagcccttgtgacgatgtagcctggggtgaacaccccgggctacatgcctttacgtcgctccgcccgagccacgcgctgaacttcctgacgcacttcttccaacacttcctgcacatacagcaggtgacgtgttgagacttctcgcgcctgctcggcccgcccctcaataatcgccaggtacagatcccgatgctgactaatcagcatgtcgcgggtttccgtgcgctgctggtacatgccgccgatgttggtcaccacattacgcttgagcaggtcgaacaacccgcgaatggtgtgcagcaacacggcgttatgactggcctcggcgatcgccaaatgaaaccgcgcatccgccgcgccctcttccgcccggctcacttcatcaacgcgcgtgtagcaatcctgtaacgcctcaaacgctgcagtcagacgctcgcggtcgacctccgtggcgcgctgcgcggcgtaatacgcacatgacgcttcaagggtctggcgaaactccagcagatcacgctgagcctcggggttattttccagaaggtgcagcagcgggtcactgaacgtcgaccccaaggaatccgccacatagttgccgccgccctggcggctgaccagcaaccccttggccgccagcttctggatcgcctcacgcaacgatgggcgcgatacgccaaactgctcagccagagcgcgctcggccggcaaacgctcgcccgacttcagcgtgccctcaaggatcatcccctcaagctgctcgacgatatcgtcagacaaacggcgctgacgcacctgatcaaaccccataactcactctccaaaatcccgaccactcgccgggccctctattctggcctatcgccgcgcttgcagcacctatcagaacgccttcgattgatcagaccagatcccctcgccgccccacccgcgccccatgtttcgcgagcggcaaattgacacaccccacccaaggcttttactctagccgacagcggctgtaaattggtattaccaattatccaagctgaccaaacaacaacaatcaggggccaccccatatgcaaacctggcaacagctctacagccctctcggcagcctcggcctgtccgcactggccgccgttattccgatcgtgttcttcttcctcgcgctggccgtttttcggctcaaaggccacgtcgccggcagcatcaccttggcgctgtcgatcctggtagcgatctttgccttccagatgcccgtggatatggccctggctgctgccggttatggatttgcctacggcctgtggcctatcgcgtggatcatcgttgcggccgtgttcctctacaagctgacggtcaagagcggccagttcgagatcatccgcagctcggttttgtcgattaccgacgaccagcgcttgcaggtcttgctgatcggcttttgcttcggcgctttcctggaaggtgctgccggtttcggtgcacccgtggccatcaccgctgcactgctggtcggcctgggtttcaacccactctacgccgccggcctgtgcctgatcgccaacaccgcgccagtggccttcggcgcactgggcattccgatcattgtcgccgggcaagtcaccggcatcgacgcgtttaaaatcggcgcgatgaccggccgccagctgccactgctgtcgctgttcgtgccgttctggctggtgttcatgatggacggcctgcgcggcgttcgcgaaacctggccagccgcactggtggcaggcctgagctttgccgtcactcaatacttcacgtccaacttcatcggcccggaactgccggacatcacctcagccctggccagcctgattgccctgacgctgttcctgaaagtctggcaacccaagcgcaccgcgggcgcgcagattgccggcgccacgtccagcgcagcggttactgccagtgtcggcggcttcggtcagccgcgccaaacggtcgcttcgccctacagcctggggcaaattttcaaggcctggtcgccgttcctgatcctgaccgtattggtcaccatctggacgctcaagccgttcaaggcaatgttcgcggcgggcggttcgatgtacagctgggtcttcaactttgcgatcccgcacctggatcaattggtgatcaaagtcgcccccatcgttaccaacccgacggcaatccccgccgtgttcaagctggacccgatttcagccaccggcaccgcaattttcttttccgcattggtttcgatgctggtgcttaaaatcgacgttaaaactggtcttaccactttaaaagagaccttctacgagctgcgctggccgattctgtcgatcggcatggtgctggcgttcgccttcgtcaccaactactccggcatgtcatcgaccatggcgctggtactggctggcaccggcgcggctttcccgttcttctcgcctttcctcggctggctgggggttttcctgaccggctccgacacctcgtccaacgccctgttcagctcgctgcaagccaccaccgcgcaccagatcggcgtcaacgacgtgttgttggttgccgccaataccagcggcggcgtgaccggcaagatgatctcgccgcagtcgatcgccgtggcctgtgcggctaccggcctggtcggcaaagaatctgatctgttccgctttaccctcaagcacagcctgttcttcgccaccatcgtcgggctgatcacgctggcgcaggcctactggttcaccggtatgctggtgcactgagacgtgcacgtaatagggtaagaatcgacgccggacaaccatgccggcgtctgctatttctggaggaccgatgagcctgcctgctgctttcctgagcgacgtcgcacaactgatcccgaaagatcgccgcttcgacgatcctctttccaccctcgctttcggcaccgatgccagcttttaccgactcatcccacagctggtggttcgcgtcgagtcggaggacgaagtggtggcactgctgcaattggcccagcgtgatcgcgtgtccgtcaccttccgcgcggcgggcaccagcttgtccggtcaagccatcagcgactcggtgctgatcgtgctgggtgacaactggaacggccgcgagattcgcggccaaggcacgcagattcgcctgcaacccggcgtgatcggcgcacaggccaatgcctggctcgcaccgttcgggcgcaagatcgggccggacccggcgtcgatcaatgcctgcaaaatcggtggcatcgtcgccaacaacgccagcggcatgtgctgtggcacagcgcaaaacacctaccacaccctggccggtattcgcctggtactggctgacggcagccgcctggataccgaagacgccgccagcgtcagcgcgtttcgccatcaacacggcgcgctgcttgagcgcctggccacactcggccgcgagacgcgggcaaacgctgaattggccgccaaaatccgccacaaataccgtctgaaaaataccaccggcctgtcactcaatgccttggtggattttgacgagccgctggatatcctcagccacctgctggtgggttccgaaggcactttgggctttatcagtgcggtgacgtacgacacggtgattgatcacccgaacaaggcgtcagcgctgattgtgtttccggatgtcgagacctgctgcaacgccgttacggtgctcaagacccaaccggtctcggccgtcgagctgctcgaccggcgcagcatgcgctcggtacaggacaaaccgggtatgcccgctttcgtacagcagctatcggaaaatgcctgcgcgctgctgatcgaatcccgcgccgcgtcgccgtcgttgctgcacgaacaactggcgctgatcatggcgtcgcttgcgccgttccctgtagaaaaacaggtcgacttcaccgaagacccaaccgaaaacgcgcgcctgtgggccattcgcaaagacaccttccccgccgtcggcgccgtgcgtaaaaccggcaccacggtgatcatcgaagacgtgaccttcccggtcgagcagttggccatcggcgtgaaccgcttgatcgagctgttcgacaaacatcactacgacgaagccatccttttcggacacgccctggaaggcaatctgcactttgtgttcacccaaggcttcaacagcagcgaagaagtcgcacgctaccaagcattcatggacgacgtagcccagttggtggcggtggagttcggcggttcgttgaaagccgagcacggcaccggccgcaacatggcgccgttcgtcgagctggaatggggcagcgacgcgtatcagttgatgtggcagctcaaacgcctgctcgatccgaatggcattctcaaccccgacgtggtgctcagcgaagacccgcaaattcacttaaaacatctcaagccattgcctgccgccgacgagattgtggataagtgcatcgagtgcggtttctgcgagccggtgtgcccatctaagggcctgaccttgagcccgcgccagcgcattgtgatctggcgcgacattcaggcgaagaaacgcgcaggcgtcgacaccaccgaattggaagcggcctaccactatcaaggcatcgacacctgcgccgccaccgggttgtgtgcgcaacgctgccctgtaggcatcaataccggcgacctggtgaaaaagctgcgcgcacgcgacgctgaccgtacgaaaactgccgactggctggccagccatttcgccaccgcgctgcaaggtgcgcggtttaccctgcatgtcgccaatggcgcgcgcatgctcctgggcgcgccgcgcctggccaagttgtcagcaacggtgaccaaactgtccaaggggcaaatcccgcagtggaccagcgccatgccgcagccggaaaaagccattcgcttcagccccgccgtggccgatgagcgaccacgggtggtctacctcgcggcttgcgtctcacgcgccatgggcccggcggcgggtgataaagagcagatgtcgctgtacgacaaaacccgtggcctgttggaaaaagccggttaccaagtcgtgttccccgacaaccaggacagcctgtgctgcggccagcccttcgcctccaaaggctatgccgaacaggccgaacacaaacgccaggaactgatcggcgcgctgctccacgccagccgtggcggcctcgacccgatctattgcgacaccagcccgtgcaccctgcgattggtgcaagacctcgccgaaacgcgcctggacctctacgacccggtaaggtttatccgcacccacctgatggaccgcctcgactttacgccgcaagaagcgcccatcgccgtgcacgtcacctgcagcacccagcacctgggcgaaagccaggcgctgattgatctcgcacggcgctgctcaaaaaacgtggtgatcccggaaggcatccattgctgcggctttgccggcgacaaaggcttcaccacgcccgaactcaacgcccactcactgcgctcgctcaaggacgcggtgcaatattgcagcgaaggcatctccaccagccgcacgtgcgagatcggtctgagccagcatggaggcattgattatcacggcttggtgtacctcgtggaccgggtcacccaggcgcgtgcgcattaaatagccaatgaaaccgaacccctgcgcgccggcgtagtcatctgcataggcctcgttgaacgaggctcatcagtgatgtcactggcagcccttgaacgccagtagcgtcgagccctttttcgcaaggagataccctatgaagcgttccgctcttgctggcttgttcattaccgctgcgatgatggcctcccctgtgtttgcagccggtgaaaaagacctctgccagatcaacctggacaaaatcaacaacggtaaagcgctgctcgccaccgacaccagcggtaaaagcggcgagattgacactgcggtctcccaggcaaaggccgcccacgcggccggtgatgacaagacgtgcatcgaaatcacgtccaaagccatccaggatttgcagaacagcgagaaaggcaaccagtaagcccctcactcgctcgcggccaaccttcgggttggccttccgcgaacgtttggcgtacactgcacaggcttgtcactcactaagaaacaacgagttacaagcacggggccgtttaggattcgacgccggtcgcgaaactttaggtgcatgccgagttggtaacagaactcgtaaatccactgttgcaacttcttatagttgccaatgacgaaaactacggccaggaattcgctctcgctgcgtaagcagccttagccctgagcttctggtaccttcgggtccagcaatcaccaggggatgtctgtaaacccaaagtgattgtcatatagaacagaatcgccgtgcagtacgttgtggacgaagcggctaaaacttacacaactcgcccaaagcaccctgcccttcgggtcgctgagggttaacttaatagaaacggctacgcatgtagtaccgacagcggagtactggcggacgggggttcaaatccccccggctccaccaattcgaagcatcgacagaacccgcctagtgcgggttttgttgtatctgggggtcggaaagcccgcagtaaacgctgcaaggatgagcactgagttgaataaaaattcctacgcctacctgatacccgtcgtcgttggcgtacaagcgcttttagccttcacgctgatctggcaaatcggcatctggccgacgattcacttcaacgccttggctgaaaaaacctgcctgatcgcctcgttgtgggtgacgctggttacggtcgcactgctgtggcgctacaagaagccgcttatccagcagaagaaaaaacgcgaatggccgaagctggtgcttggggtgtttatcgccagtggcgtggtgctggtgcacctgtttgcagcggcgatttacctgacaagtgcggtgcccggcagctacatcagcacgtatgaatattcgccgtccggacgctatagctgcagtggtatcaaggtgttcgacgcgcagttaaacaaacgcatcaaagtctgtcagccgggagggaactacggcggcggtcaggctcgcgtcgataaacgcagcgggcctctggggatagtggtgacatcgtccgcgttgctctgatcgcggaaatggcgggaacgccggcctcggtttctcctcagcgagccttacaaaaaactgacattcattcatgaaatattcagaagtgctgacagatactagccgatcgccacggccgttcccccgaacggtcccttgcttcggtagccagaaccatgacgcgtcccgctcctctgctgctccttctcgccggtttgttgttcttctttgccctcggtggccatgagctgcaaggctccaccgaagcccgtgtcgccggcatagccatggcgatgcacctggacaatgactgggtcatcccccgcctgtttcgcgaacccttcctggaaaaaccgcccctgagcctgtggctggacgccggtgcgattcgcctgtttggcgcaaccaccggggccgtgcgcctggcgtcggcgtttgccgggctgttcagtgtgatgctgttctacgcaatgctgcgcaggttcgggcggccgaaaaacatggcgttctgcgctgcgttgatcctggcgaccatggccagctactggggcaatgtgcgcggcgtgggtgaagattcactgctgagcctcggcgtgaccacggcgctgctggcgttctaccaggccgtgcggcccgagcgtgaaggtttcagtgtgtgggcctgggcgttgtttacgctcgggatggtcattgcgactttgagcaaaggtgtactgggcctggcgatgccggggattgtgatctttgtgtacctggccagcaccagcatcatcgataaacgcctgcgcatcggcgactggcttaagcccgcgctgttcacgctgctggcgctggtgccgctgctgatctggctggggttcctgttccagcgcggcggcatgcaagcggtggccgaagtgttgtggaccaacagcgtcgggcgtttcagcggctcgtttgtcgaggccgggcattacgaaccgttctactactacatcgccaaactgcccgaagccttcctgccgtggaacatcctggtgtacctgggcctgtggcacttccgtaaaagcctggtacaaaaccgctaccgcctgtttttcagcgtgtggctggtggcgcagttcaccctgctgacgctggcgtcgagcaagcgcgtggtttacctgatggcgctgacacccgccgctgcggtgcttgctgcggagtacgcgggagtggttttggagtggctcaaagcgaacaagccggcgctgtaccgctatcaccgtagcgtgatcggcggggtgttcacgttggcgatcgcctgttacctgacagccgcgttctggtttgcgcccaaagccgacgtgcgccagtcgttcgtgccggtgatcagccaggttcaggcttatcaagcccaaggcaagcaagtggtgttgttccagcccaacgagcgcatcgccggggccagcgtgttttatctgcaggcctacttgccaatcctgcaaaccgaagctgagctgcgcagctatctcacggccaaacccggcaacgtggcgttgctggatcgcaccgagcagctgagcgagaaggtcacggtcatcaaggaaatgtcgatcaaccgccagccttacttcttcgtcgagcagtaaggccggcgcagggcatcaatgcttggtgagcttgtccagataacccatggcaaacgccgagaccacaaaggtcatgtggatgatcacgtaccacatcaaatgctgcggatcgacgttcttggcgtccatgaagattcgcagcaggtggatcgacgaaatcgccacgatggaggcggccactttcatcttcagcgacgaagagtccatggtgcccagccagttgagcttttccttgttctcatcgatatccagctgcgagacgaagttctcgtagccggaaatcatcaccatcaccagcaagccgcccaccagggccatgtcgatcaacgacagcagcagcaggatcacttccgactccaacatggtgaagatgttaggcaggacgtggatgatttcctggaagaacttcagcgccagaatcagcaagcccagggaaagtcccaagtagatcggcgccagcagccagcgtgaggcgtacatagtattttcgataaagcgttccattggatctcacacagctatgctaaaaatggccgcgagtataccagtcgcgtccaaacacctgtaaccgcgagaaaactgacctgggcggcatctgtaagagaatttttctgctagtgtcgagcccatcaaatcagctcaatgctgtggaacaggaaaactcagatgatggatgtgcgatcccctttggcctctttcggcctgtgtgcggtgttgctgatggccggcggctgctcccccaaagaagagcagaagcaggcgaccctcgaagagaaaaccgcgaaattcgagcaatcgctggacagcattcaagaccccaaactgcgcgatgccattgccgaccttggcggttcgctgctgttgctggaacgggcgcgaaccaagctggccaccaagcccatcgaagccgagtacggcgaagacaccctggccctgctcaagcactaccccacgccccaagccttggttgacacctacatcaacggcctgttcgtgctgcgcaaagcctcgcactccgactatttgaccgatttgcagccggtgttcccgttcaacttcaacaccccggaccaattccccttcccccacggcctggaatggcagtcggtgacgttgagcaacaacaaagtcatccccttccagccggaatggtcggaaaccgatccgggcatccagctgagccccagcagctccaacctgaccaaccccgatgacctgacggtgacgtacccgttcatcgaaggcgtggagaccgagaacaaaagccagccgcagcccgtcagcctcaagggcgcggtggaggtggtggcgccgggcaaggtgttgaccttcgacttgacgaaaaaggacgtgggccacaagcgcaccgagggcaatatcaccctcaacctgctgctgcttgaaaaaaactacgccgagatcgagctgaccaacagcgcgccgctggcgccggaagtcggcgacgaatcgccgaacccattgctggtgcaagcgcgcgacagcaccgggcaatttcttacccgctcgggttcgatcaacgaaaacgccgcgcaagtagcgttctacgaaaaacaattggccgagatgcaaaagcagacggcctggtcggacgcctttgaaaagcaactgacagacgagcaaaaagccttcgaacacaaacagaccagccattacgccaaggtgtacttcaatggcctgatcgaaaacctgcaagtcaacgtgctggatttttccaaagccacgctcacccgcaaagacctcgacctgccggtgctgcgcttcgacaagaacagcctgcagagcaccgtgcaagccttgccgatgccggtcacggtgtatgacgacagcgcgccgagctggctcaaggacgcgtcaatgactgaggagcagctgaaaaacagtgtcaccatcagtcaatcgaccgaagacgccagcgccgcgaagatcgtgtttgaccacccgttcacgttcaacgacgacctggtcggcgccgagcgcaacaacagcgatgcgccgattaccttcttcacggcggacgacaaaggcgaacgcggcgagcccatcgagctgccgaccgaagcctttgagatgaatgcaggaagcggcacgctcacctacgacctcaacctgtttccggaaaccccagcgtttgcggtgggttcggtgccgctgttcctggccaccatcgataaagccacgattgatatcgccaagctgcccaagggcctgtcgctcaaggacaacgcgctgatcgtcgatcaaaaggaatttcccgccgacagctggcgcttctacgccaaggacgccagcggcaactacctcaaggaaatcctcagcgtcagccaccgcgccgaggaatacggcacagcgctgtttgacgtgcattatttctacggccagccgaccacactggaaagctaccagcgcaccgacctcgacaccgtgcaatacggctttgaggtcaagctggacaagcccgagagcaagtgaacggattgttcccacgctctgcgtgggaacacatcccgtgacgctccgcgtcaccccgcgcaaggctggagccgcacgcaaagcgtccagggcggcgttaccacgcagagcgtgggaacgatcattcacaaggccaggcgctcatgtccgccattgagttgtcgcaaatgggcctgcaggtgcaagcaccagatctgcgggtcatccgccagctcatagccgtgcagcgtcaggctttcgacgattgatcccagaatggtttctgccacgaaaggtccatgaaacgggccttgggacttgatggtggaaggctgttcaccggtcattccggcggcaaacaacaacgtccacatcccgttatcccccgcgagagggcgaatggagcattcgatacgggtgaccagccccaggcattggcgggtaaggcaaaggttgcgcggcatggcggcgaccctcggtagaccggtgttcaacctcaatcacacggcgaggctgtctctatcctgcgactccagtggatatccttagaactcagaatagaagaaaaccagtacaaaccaaggttgtagggaccaacgggcgttggtcccggaaatgggagtcaattttgtgacgaaacacagtcgattcaatgtgggagctggcttgcctgcgatgactgactcatagccgacacttctgctggctgacccaccgctatcgcaggcaagccagctcccacaagatcaggttggcttggcttcggccagcgcctgctgcgccaattccttctccgcctccttcaaatcatcctcgctgatcatctcggcaatcgcgcgcaaacgctcgaccacgcgcgcattcacgctgccttcggggaattgcccttcttcgtccggctcacccgcaggctcaccgaccaacaagctcaacgcctcatccgcctgacgcacggcatagatgtggaactgcccgttgcgcacggcctgcagcaccttctcgtcgagcatcagcgtggcgacgttggcctgcggaatgatcgcgccttgctcaccggtcaacccgcgtgcttcgcagaggcggaagaagccttcgatcttctcgttgaccccgcccaccgcttgcacttcaccgaactgattgatcgagccggtgatggcaaagcactgcttgagcggcgtcttcgacaaggccgaaatcaaggtgcatgcctcgcccaaggacgcactgtcgccgtccacgtacccgtaggactgctccagcgcgatactcgccgaaatcgccaacgggaattcctgggcataccggctgccgaggtaaccggtgaggatcatcacacccttggagtggatcggctggccgaggttaacttcacgctcgatgtcgacaatgccgctgccgcccgggtacaccgtggcggaaatccgcgccggcacgccaaacgccgaatcccccacctccagcaccgtcagcccgttgcacttgccgaccgccgcaccggcagtgtcgatcaggatcaccccagcgagcatgtcgtcgagaatccgcgccgatacgcgacccgtgcgcgtggccttggccttgagggcgcgttcaatatggccggcatcggtcatctcatcgcccgccaggtggcggataaagtccgcctcgctgaccaactggaataaatcgccgatgcgcgccgacaaacgcccctggtgttcagccaaacgtgcactgtaagtcgccagccgcgcgaccgcgtccgacgtcagcggcgccatgccttcctccgaggtacgagttttaagcaactgggcgaactgctccaggctctcgtcgaccatcgggatgtcttcgtcaaagtccaccaggacgcggaacatctcctggaagtccggatcggcatcttgcaacgcgtagtacagctggcgcgaaccgatgatgatcaccttgacctgcaacggaatcatttgcgggttaagcgtcacggtggccaagcggcccagctcgcccagcggcgattccatcttcagcttgcgcgactgcagagaacgcttgagggcgtcccacacaaacggctcgccgagcattttttcggcttccaggatcaggaaaccgccattggcacggtgcaaagcgcccgggcgcagttggcggtaggtggtgtacagcgcgccctggtcggtgctgtattcgatacggccgaacaggttgtcgtaagtcgggtgcggctcaaacaccacgggcgcgccgccgttgaccggatggccgaccaccaggctcgggcagtattgctcttcgagcagcttgcgcgcctgggcgtcggtcttggcgtcatccaccaactgctcgaccacggttttgagcaggtacacctgcatggcttgcaggtagccacagacggcggcgttttctgcgtacttttccgacagcggcgccagcaaaggctgcagggccagggtgatggtttcttcgttgaattggcgcagttggttgttcgactcacgcttccactgcggcaggctggccaattcttcgttgagacgctcttccagctcggaaatatccgtgtggaagcgctcgcggtcagcctccggcagctgcgagaactcggcctcgtccagcgccttgccgtcgagcatcggcgtgaacgcgatgttggagctgtcgcggtacagcgccacgtctttttccagggccaggcgctcgatcacgtccagggccttgtcgtaacgctggttgaaggcgcggtcgatcgcgcttttgcgctgttgataagtcgggtgttcgaacaccgccgggaacgtggcgacgaggttatcgaccaaagcgttgatatcggcgatgaacgccgccgcgccgccgcccggtaattccagggcacgcggctcgcgcggctcatcaaaattgttgacgtagacccagtccgccggggtctgcaggcgtttgccttcggccttcaggtagcgttttacgaacgaaaagcggccggttcccggctcgcccatgacaaacacgttgtaaccggggcgtggcatggccacaccgaactgcaaggcttcaaccgcacgttcctggccaagcacaccgcgaaagggctccaaatcattggtggtcgagaagctgaactgttcagcggagaaagggcgagtcagcgcttcgggcgctagacgcaagctggcagcaacaggatcaggcatcgggcttccttacatcaggcggggcagatgacggcattctggctcccggttactcgctctggcaaggcgcgactgtgggaaagcatagccaggggatgggtcttacaaaataatcgcggctgccgtttgcaaaaacactgtttgttttataaaaaatcacggaaccctaggaacgtgcctaaactccaaactgcgcgggttggactaataactggcccctagggcgctgcgacgcgcctgaacccttgtccattggttttgcacacaaagagaacaaagctatgaaacggatccttcttggtactctcttcaccgtcgtctccctcaatgcaatggctgaagcacccggtggcccgaactgcggttggggcaacatgttgttcgaaggccagcgcggtactcctgcgcacttcctcgcttccaccaccaacggtacttcgggtaacgccaccttcggcatgacctcgggcaccaacggttgcagcaccaacagcgccctgacctacggcggcaagtcctggattgccatgaatggcatgatgaacgagctgtccgaagacatggccaaaggcaacggcgaagcactgaccacctacgcggtggtactgggcgttgcaccggaagatcgcgagcacttcgctgccgtgactcacgagcacttccagcagatcttcagcaaagctgacgtgaccgctgacgacgtgcacaacaacaccctggctgtactgaaaagtgatgcccgcctggcgaaatacgctacccaggcttaagctcgacccgcccgcgcctttcgaggcgcgggttttattttggacccgcctcccctttgggtctcactatttccgacttaagttgcccctatgctcaaacgctttgcctggttggcactcttcgcctgcgccccgctgtatgcggccccgcatattgatgatcaacgtttgcagcaattggccaacgatccgttctggctttcgttgggccattacgaagccggcaagctcaaaggctggcgcagctatgtcagcgacaagaaattcttcctcgccgccgatggcgcacaccatccggaccaggaactgaaagccaccgtagacgcgctgtatgcccccgccagcctcggtgagaaacacccccaatgtgtttaccccgcacgcacccgctggctcaaggatcagctgcagctgaccgacctgcccgccgtggactgcaaagaattcaagcaatggttcaaggacgtcgcgccccatagcgcggtgatgatcttcccggcggcgtacctcaacagcccgtcgtcgatgttcggccacaccctgctgcgcatcgaccaggctgacgtgcagagagacaagaccgccctgctcagctacgcgatcaacttcggcgcctacatcgaaggctccgacaacagcattctctacgcctggaaaggcctgatgggcggctaccccggcctgttcgcgctggtgccgtatcaggaaaaactctcggaataccgtagcctcgagaaccgcgacctgtgggaataccgcctgaatctcacccaagtcgagaccgagcgcatggtcgagcacgtgtgggagctcaagcagatccagttcgactacttcttcttcgacgaaaactgctcctaccgcctgctcgaactgctgcaagtggcgcgcccgagcctgcgcctgaccgagcaattcccactgacagccatcccgaccgacaccgtcaaggcggtcaaagaagctggtctggtggagaaaatcgactatcgcccgtcccgtgaacgcgagctgctggaacgcgccaagccgttggatggcgatgagcaacaatgggtgctgaaaatcagcgatgaccagaagcaattgcaggagccggccttcaaagccctgccccgcgaccgccaggcgctgatcatcgacgcggcttatcgtcttggccgctaccgcgccaacggcctggagcgcgacaccgaacgctcgcaacgcagcttcgaactgctgcgcgcaattaaccagaaccctgcgcccgacctgcagatcgaacgcccgggcttgccggaagacggccatgaatcgcgcacctggcaagccggcatcggcacccgcggcagcaaaaccttcggcgagtacggcctgcgcatggcctaccacgacctcaacgacaacgccgaaggcttcccgctgggcgcgcagattgaaatcctgcaaatgaaactgcgccagtacgaaggtaaccactggcaactgcaacaactggacctggccaccatccgctccctgaccccgcgcaacgcgctgttgcagccgtggtcatggcaagtgaccggcggcctggaacgcgtgccgggcaaacacgacgacgaaaccctggtcgcccacgtcaacggcggcgccggtggcacctggcaactcaccgacgacatgctcggcttcgccctcggcaccgtgcgcgtggagcacaacaacgacttcagtgaggccatctccccggcagccggctttaacaccggtgtgttgtggaaaaatccgctggggaatttgagcctggaagccaagggcgacttcttcaccaatggcgaagtgcggcgcagtatcagcctgaaccagcagtgggaattgtcgcgcaacctcgggctacgcctgagcgcccagcgcgagtacagccatttgtcgacgcctgtgaatgaagtgatgcttgaagtgaagtggtatcactactgaccaaaacgatacaaagatgatcatttccatgctccgcgtgggaatgcatcctgtgacgctccgcgtcacgaccttgaaatcggacgcagagcgtccacggcggcattcccacgcagagcgtgggaacgatcagtgccggtgtatcagtcactgatttccagcagccccaccgccatcgcaggcaagccagctcccacactggtttgtgcctggccacatttgaactgtgcccgccaccgttcaaatgtgggagccgggcttgcccgcgatagcggtcgtccaggtaatgatgtattgactgacccaccgccttcgcgagcaagcccgctcccacatttttgcctcgcgtatagtcaggtgcatcccattgcccgcccaatcaggagctccatcaacatggctgttaactgcaccacgctcgaagaagtccgcgacaacatcgaccgcctcgaccaacaaattgtcaccctgctggccgaacgcggccgctttgtctcccaagccgcgcgcttcaaaaaagacaccgatggcgtcaaggcgccacaacgggttgaacaggtgatcgccaaggtgcggggtttatccgagacggtgggtgccaaccctgaggtgactgagcaggtgtatcgcgcgatgattgcggcgtttattgagcaggaattggctgaccatgcagttcttgcaggccttggaaatacatcacccacacacacaaatccgtagccagcttctaacctattgaaaaatagacaggaaatttcggacatttttttagcttttttcagtcaagccaaactgcctcttacttcactctctctatagggatttggactagtatcggatggcaatcgaattgccacccatctatacacggatctgaataggtaagaggctcattatggatttctttgaaaagctcacaagtctggcagcaaaagttcggctacaaggccctgccattcaaacagaagaagcgacaaaaaatgctttcgtaatgcctttcatcaacaccgtattgggctacgacgtatttgatccacaggaagtgacgcccgaatttgtctgtgatgtagggacgaagaaaggtgaaaaaatcgactacgcaataatgaaagagggtgaagtccagatactaattgagtgcaaaaaaatcggtgagtcattaagcatcaaccatgcatctcagctttttcggtattttcacgttacgagcgcaaggatttcgattcttaccaatggccaggtctataggttttttaccgacctggacgcgcctaacaagatggacgaaaagccatttttggagttggacctgctggacattgatgagtacgccgttccggagttgatcaaactcaccaagtcggctttcgatgttgactccatcatcaatgcagcaggggagctgaaatacgtcagccaactcaaaaaactcattggcgctcaagtcagcaagccagaagatgatttcgtgaaattcttcgcgtcccgagtttacgagggtgtaatcacacagagagtacgcgagcaattttttgagctgactcgaaaagcgttagctcaatttctgaacgaccagatcaacgatcggctgaagtctgcaatgagtggcgcaatacaaccgacgatggcctcaatccccgtcgtgaacagcgcgaatgcagaggcgcaggacagggacgagtcagaagataaaattttgacgacgctcgaagagctcgagggttatcacatcgttcgcgccctcgtccgatccgtggtcgatgcaaagcggattgttcagcgagatacccaaagctattttggaatactgctggacgacaacaaccgcaaacccatctgtcgccttcacttcaatcgcagccagaagtacctcggaatattcgacgaggaaaaaaatgagacccggcacgcgatttcgtctgtcgatgatatttacgagtacgcggatcaattgaaaaaaacggtaggctattacgactaacggctggtttcggataggcgcaattgtcgatatctccagtggcgagcgggcttgccccgcgttgggctgcgcagcagccccaatatagtcaaccggggagtatcagatacaccgcgttcgtctttattagggctgcttcgcagcccaacgcaggacaagcctgctcgccacactagcctgccaagtacaaaggaggcattgccaggttttaggtagcggggcttatcgcttgggtaaggtcatccaccacggctttgcccatctcgcacagataatgcgcggcccaggcgtattgctcgccgcgcacgtccatggcggcttccatggcgagtttcttggagtaaaaaagcagggtggaggcgtgttccagggcttgctctatcggcatgccggcgttgacgcggaacagcgttttttgattttcgccgtagtcgccgaaggtgacgacgccgagggtagtgattgaggacaggggtggatcggggacgactttagacatggtgtttctcttaggttaagaagtagaaactgccgcagcatgtcgctaaacatgaagaggtggcagctgtacgcgggttagcgaaccggtaacctagaaacccggtagacccgaaggtctcccgcgcacagccgccataacactataaggcaggcaaaaaaatgccagccaaagttgttgaggaggtcgtatctacgtttctcgggtcgctaaacccagtcgctgttttgcagcgacccgaggaggctagacactcaaatcctatggcgcaatagcccaaggattctctaggaaacgtcctgcaatttaaagagaatcgtcgttgatggccctttaatagatcgttcccatgctccgcgtgggcacgcatcctgtgacgctccgcgtcgcgaccttaaagcagacgccgcgcgtgggaacgcgcactggccctttaacccaacacctttctcacctcgctttcacgcctccccgacaattccctgactagactcctttcatcagccgtgaaacggccagggagtacgccatgtggcggtctgcgttaatgctgtgcgcggtagtgtggttggcgggttgccaatcaacccatcaggagttgctggccaaaggttatccaccggcctttgccgatggctttgatgacggttgcagcagcggtcgtcaggctgctggagtgatcagcggggagtttcgcaagaacgtgccgcgttatctgaaggatcgcgagtacgccgaaggctgggaagatggctttcggcagtgcaaggcgatgcgcgaaaacgaagaattgcgcgactacaaagacaatcactgggacgaccgtgagcgcgcctggcaacaggagaaagaccgcgacgccggcaaggcttatcgctcgcaataggtcgctgatcgttcccacggtccccgtgggaatgcaccctgtgacgctccgcgtcgcaacctcaaaataggacgcagagcgtccagtgctgcattcccacgcagaacgtgggaacgatcgcgcggcgaacatggcccaaactccatagagggagaatgtcatgagccgagcttttgttaacgaagacaacgccgccgcccaggccgaccaaccggtggagcgtcaggtcagtgagcaacccaatcacctgactgcgcaagggttggcgcaattgcaggccaaggtcgcgcagttgcagcacgaatacagcgtcgagtccgccaaagacgacaagcagcgtcaggcggatcttgagcgggatttgcgctacttcaaccagcgggtgcaaagcgcccaagtggtggcgccagcgacctcaaccgtaaaggtgcagatcggcagctgggtgacttttgccaatgaacaggacgaacagcagcgcattcaattggtcggtgaagaccaggccgacgccagcgccaacctgatcaactggggttcgccgctgggccgtgcattgctgggcgccgaggtcggcgacgaggtgctgtggaagcgccccgtcggcgatcagttgatcgaagtgctgcgcgtggagcccgaggcttagacgatgccttgggccagcatcgcgtcggcgactttcacgaagcccgcgatgttcgcgcccttcacgtaattgacccggccattttcttcgccgtagtgcacgcacgcgtggtggatcgactgcatgattgcgtgcaatttgctgtcgacttcgcctgcggtccacagcaggcgcatggcgttctgcgacatctccaggccacttacggccacgccgcccgcattggacgctttgcccggcgcgaacagaatgcccgcctcgatgaagatatccacagcctccaaagtggtcggcatgttggcgccttctgccacgcacatacagccgttgcgcaacagcgtgcgggcggcctcgccgtcgagttcgttctgggtcgcacagggcaaggcgatgtcgcaggccagttcccagggcgttttaccggcgcgaaattccagcccgtaacgggaagccaattcactgatgcgcccgcgctgcacgtttttcagctccagcagcgccgaccattgctcctcggtcaaaccgctttcggcgtacagggtgccttcagagtcagacagggaaatcactttgccgcccaggtccatgactttgcgcgccgcgtattgcgcgacgttgccggagccggagaccgccacgcgcttgccttcaactcgctggccgttgcgcttgagcatttcttcggcgaagtacacacagccgaaacccgtggcctcggggcggatcaggctgccgccgtaggtcatgcctttgccggtcagcaccgaggtgaactggttgctgaggcgcttgtactggccaaacaggaagccgatttcacgcgcgcccacgccgatatcgccggccggcacgtccacgtcggcgccgatgtggcggtacagctcgctcatgaacgcttggcagaaacgcatcacttcggcgtcgctcttgcccttggggtcgaagtccgagccgcctttgccgccgcccatgggcaatgaggtgagggagttcttgaaggtctgttcgaaggcgaggaatttcagcacgcccaggttcaccgacgggtgaaagcgcaggccgcctttgtaggggccgatggcgctgttcatctggatacgaaagccacgattgacctggaccttgccgtgatcatccacccacgacacccgaaaggtaatcgcacgttccggttcgcagatgcgctccagaatgcccgagctcaggtagtgcgggttggcttcaagaaacggccacaggctgcgcaggacttcttctacggcctggtggaattccggttggtcggggtcgcgtttcttgaggcgggaaaggaaggattcgacagattcgatcatggaaacgtctcggcaaattgattgtttttaagggagattgagccggaccttagcaattcatgttgcacctgaaaagcgcaaaatgtcgcctttgtgaatttaaatggtgcactggatataaataactgggcttatttgcaccaggaaagggatttcaaatgaagggatgcaccaacagttaaaccgctatcgcaggcaagccagctcccacatttgacatgtgtttacagatcaacatgtgggagctggcttgcctgcgatgaatccaacgcggtccccctgaatcacacgcaaaaaaaacggagcccgaaggctccgttctttcccaccaacccaaatcaggccagttttttgtgccgtacacggtgcggctgggcagctgcttcgcccaagcgctttttacggtccgcttcgtactcggtgtagttaccttcgaagaacaccgcttgcgagtcgtcttcgtacgccaggatgtgggtcgcgacgcggtcaaggaaccaccgatcgtgagagatcacaatggcggcgcccgggaagtccagcagggcttcttccagggaacgcagggtttcaacgtcgaggtcgttggacggttcgtcgagcagcaacacgttgccgccttctttcaaggtcagggccaggtgcaagcgaccacgctcaccaccggacaggtccttgacgaacttctgctgatcgccgcctttgaagttgaaacggccgacgtaggtacgcgacggaatttcatagttgccgatgcggatctggtcggaaccgtcggagatttgctggaacacagtcttgctgccgtccaggtcttcgcggctctgatcaacgcaagcaagctgcacggtttcgccgacttcgatggtgcccgaatccggagtttccttgcccatcagcatgcggaacagggtggatttacctgcaccgttaccgccgatcacgccgacgatcgcgccttttggcatcgagaacgacaggttgtcgatcaatacgcggtcgccatagcctttggtaacgttcttgaactcgatgaccttgtcacccaggcgtggaccggccgggatgtagatctcgttggtttcgctgcgcttctggaattcctgcgattgcatttcttcgaagcgttgcagacgtgccttggatttggactggcgggccttggcgcctttgcgcacccactccagttcttccttcatggctttttcgtgggccgattgctgcttggattcagcggccagacggtcggacttggcttccagccaaccggagtagttgccctcgtaagggataccggcgccacggtcgagctccaggatccagccggcgacgttgtccaggaagtaccggtcgtgcgtgatcgcaaccacggtgcccgggaaatcgtgaaggaagtgttccagccaggcgacggaatcggcgtccaagtggttggttggttcgtcgagcagcagcatgtcgggggccgacagcagcaggcggcacagggccacacgacgtttttcaccaccggagaggaattcgaccttggcgtcccacgccggcaggcgcagtgcatcggcggcgacttccagctggcgctccaggttgtgaccgtcgccggcctgcaagatggcttcgagcttggcctgttcggcggccagcttgtcgaagtcggcatccggttcggcgtaggcagcgtagacctcgtccaggcgcgcctgggcgtccttgatgacgctgacagcctcttcgaccacttcacgcacggtcttggtcgggtccaggatcggctcttgcggcaggtagccgatgttcagttccggcatcgggcgggcttcgccttcgaactcggtgtcgacgccagccatgattttcagcagcgtggacttacccgaaccgttgaggccgagcacgccgatcttggcgccggggaagaaggacagcgaaatgtttttcaggatttcccgcttcggcggaacaacttttcccagccgatgcatggtgaagacgtattgagccatggtgaacctagcgtcagtgactgatgaattaagcgggcgaagcccgtgcaggccatgcgccgcgcgggccgttgacggtggtcaatgccttcgtgcgcaaaaagcctgaatgtctggggctggaacgcccccgcgtaaccggcaaagctacctgaatgcgcttggtcagtccagcgaggcggggctggcactttgccacaagtcaaggcatgctagccgccctccgggcgtccggcttatagtgcacgtcgcgcgccagtccagccaaaccgcaggatcacagcttgtccaaagtcacgccgcccactcccctgcgcgccgctcatattgcgccgggagcgcccctgcacggcaccctcaaaggcgcattggcgacgcttgtcctgatgttgctcgcgttattgttctggcagttgctggaccaactgcagcaaaaccagaaaaaccagcagcaatacaccatcgactacagcgccgacctggctgaacagatcagcctgaacatggccctgagcgcaaaaatcgccttgaatttgctgccgatggtcgagccaccgcgcaacgacgaacagcaacaggccttgatgcgcaccttgcagcgctcgctgccggagctgcgcagcgtcgccctgctcgcccccagcggcgcgatgatcagtgacagcgccaaagacagccaggacagcgcctggctggaagaactggtgcagcgcagccattcgcaaccttattacctgagcaacagccccgacggcaccatcatctatttattgctgcaccaacccagcggcggctcgcggatgtactgggcgctgcgcctggcgcccgactacctgagcaacctgacccgccaggacggccagggccagcgcccgatgtgggccatcgagaaccgcctgaaccaccgagtggtcagccgtgacagcggcatgccggcgcagtgggcctctgcgctcaccccagacgaattgaataaaagcgtgctggtcacgcccctgagcaaaagcgactggcagttgcgcgggctgtttgaccgcagcgccgtgctggagcagctgctgccggcgtttatcggcaaatgcctgctgggcctggccttctcgctgatcccggtgatcgtgctgctgaacatgcgccgtcgccagcgccaggtgaatgaaggccgccggcgctatcaggacattttcgaaggcaccggcgtggcgctttgcgtgctcgacctgtcgggcctgaaggcgtttttcgacaaggctcacatgcaaacccgcgagcacttgcaggcctggctgcacaacaacgcccaagaacgccagcaactgctcaaggaattgcgcgtcaccgaggtcaaccaggtggctgtgcgcctgttgaacgtcagttcttgcgagcaggcctgggagcgcctgatcgatgactgcccgcgcaacgccacggccatcggctaccaggtattggaagcggtattgacccagcaaaaacagctggagctggaaatccagctcagcgacgtcgccggcaatgatcaatacctatggctggtgatgcgcctgcccgagcagcacgatgacttcaaggccgtgatcctgagcatcagcgacatcaccagccgcaagctgatcgaactgtcgctggtggagcgtgagagtttctggtcggacgtggtgcgcaccgtgccggatcacctgtatgtgcaggacgtgatcagccagcggatgattttcagcaaccaccatttgggccacaccctcggctacaaccgcgccgaactgcagcaaatgggcgaatacttctgggaaatcctgctgcaccccgaagatgccgagtattaccacgacttgcgccagcaacagcgcgaggtcggctacaccacccaactgcaatgccagctgcgctttcgccatcgcaataaccaatggcggcgcttcgatatccgcgagcaggccctggcccgcgacaagacggcggtggtcacgcggatcatcggcgtggccaaggacatcaccgaccagatcgaagccagcgaatccctgcgtgacagcgagcaacgctaccgcatgctggccgaaagcatcagcgacgtgatctgctccaccgacagccagcttgcgcttaattacatcagcccgtcggtcaacgccgtgctgggttacgacgtggattgggtgttcaagaacggctggcagtcgatcatcgccaacccgcaacaactgaccggcatctatagcctgatggagcaagtcagccgctcgctgggcgacgcaacggcgctgaacacgctgcgcgacgaagtacagacgcagttgttcctgttcgactgcctgcgcgccgatggccgcaaagtgccgatcgaattgcgcctggtgctggtgtgggatgagcacggcgcatttgaaggcattctcggtgtaggccgcgatatcagccagcaacgccgcgccgagaaagacttgcgcatggcggccaccgtattcgaacactctacttcagcgatcctgatcactgacccggcaggttacatcgtgcaggccaacgaggcgttcagccgagtcagcggctatgccgtggcggatgtgctcgaccagttgccgaacatgctcactgtcgacgaacagcaggaagcccacctgcgttatgtgctcaagcaactgcaccagcacagcacctgggaaggcgaagtgtggctgaaacggcgcaatggcgagcattacccggcctgggtcggcattaccgccgtgttcgacgatgaaggcgacctggccagctatgtgtgtttcttcagtgatatcagtgagcgcaaggccagcgaacagcgcatccaccgcctggcgtattacgacgccctgacccacctgcccaaccgcacgctgttccaggaccgcttgcacaccgccttgcaggcggcggaacggcagaagtcgtgggtggtgctgatgttcctcgacctcgaccgtttcaagccgatcaacgactccctcggccacgccgccggcgaccgcatgctcaaggaaatggccacgcgcctgctgggctgcgtggctgaagacgacaccgtggcgcgcatgggcggcgacgagttcaccttgctcctgcaaccgcgcgtcagccgtgagatggcgctgaatcgcgcgatcaccgtggccgagcagattctggccagcctggtgaagccgtttgtgcttgagggccgcgaattcttcgtgaccgccagtatcggcatcgccctgagcccgcaggacggcaacgagctgagccaactgatgaaaaacgccgacaccgcgatgtaccacgccaaggaacgcggcaagaacaacttccagttttatcaggcggacatgaacgccagtgcgcttgaacgcctggagctggaaagcgacttgcgccacgcgctggagcagaacgaattcgtgctgtattaccagccgcagttcagcggcgatggcaaacgtttgaccggcgccgaggccttgctgcgctggcgccacccgcgccgtgggctggtgccaccgggggatttcattccggtgctggaagagttggggctggtggtggacgtcggtgactgggtactcagcgaagcctgccgtcagctcaagacctggcaccagaacaaggtgcgcgtgccgaaagtctcggtgaacatctcggcgcggcagttctcggacggccagttgggcgagcgtatcgccaccatcctgagggacacgggcttgccgcccgcgtgcctggagttggagttgaccgaaagtatcctgatgcgcgaggtcaacgaagccctgcaaatcctcgccagcctgaaaaacctcggcctgagcattgcggtggacgacttcggcacgggctattcgtcgctgaactacctcaagcaattcccgatcgacgtgctgaagatcgaccgcacatttgtcgacggcctgccgtccggcgagcaggacgcgcaaatcgcccgcgccattatcgccatggcccacagcctgaacctggcggtgatcgccgaaggcgtagaaacccatgagcaactggacttcctgcgcgagcatgggtgcgatgaggtgcagggttatctgttcgggcggccgatgccggcgaatcggtttgaggcgcagttcagcaatgatgcgctgttcatgttcgactgagatcttgcggtgcggctgacggcctcatcgcgggcaagcccgctcccacattcgagcgcatttcaaagatggaactcggtcaagtgtgggagctggcttgcctgcgatagagccagtacaggcaccgcccatccctgaatgagccccacttgtccgcgacatgatgtcctttcatatgccatctaaaacccattgggttagaatgccctccttttctgcccccgatccttgaggaccgccatgttcagccgtgatttgactattgccaagtacgacgccgatctctttgccgccatggagcaagaagccgtgcgccaggaagagcacattgagctgatcgcttcggaaaactacaccagccctgcggtcatggaggctcaaggttcggttctgaccaacaagtacgccgaaggctaccctggcaagcgctactacggcggttgcgagtacgtcgacgtggttgagcaactggccatcgaccgtgccaaggaactgttcggcgccgattacgccaacgtccagccgcacgccggttcccaagccaacagcgccgtgtacctggccctgctgcaaggcggcgacaccatcctgggcatgagcctggcccacggcggtcacctgacccacggcgccagcgtttcctcctccggcaagctgtacaacgccgttcaatacggtatcgatgccaacggcctgatcgactacgacgaagtcgagcgcctggcggttgagcacaagccaaaaatgatcgtggccggtttctctgcctactcgcagatcctggacttcccacgcttccgcgctatcgctgacaaggttggcgcttatctctttgttgatatggctcacgttgcggggctggtcgctgctggcgtctacccgaacccggtgccttacgctgacgtggtcaccaccaccacccacaaaaccttgcgcggtccacgtggcggcctgatcctggcgcgtgccaacgccgagatcgagaagaagctgaactccgctgtgttcccaggcgcccagggtggcccgctggagcacgtgatcgccgccaaagcgatctgcttcaaagaagccctgcagcctgagttcaagacttaccagcaacaagtggtgaaaaacgcccagaccatggccagcgtgtttatcgagcgcggctttgacgtggtgtccggcggtactgaaaaccacctgttcctgctgtcgctgatcaagcaggacatttccggtaaagatgctgacgctgccctgggcaaagccttcatcaccgtgaacaaaaactccgtgccgaacgacccacgttcgccgttcgtcacctccggcctgcgcttcggcaccccggctgtgaccactcgcggcttcaaggaagcagagtgcaaagagctggccggctggatctgcgacatcctggcagacctgaacaacgaagccgtgatcgacgcggtgcgtgagaaggtcaaggccatctgcaaaaagctgccggtatacggcgcttgattgcagttgcttgaataaaaagcccggctcaagagccgggcttttttatgcttgaaatgtcgatcgttcctacgctccgcgtgggaatgcagcccaggacgctccgcgtcccaaagcgtgacgcagagcgtcacaagaggcgttcccacgcggagtgaactgacccccaaaggctggacacaacctttgggggcgtcatgggtaagtacacagagcaagcaaaactcgt

SEQ ID NO: 50 - DNA, 98584 bp, Pseudomonas poae FL10F
taggtcatcgtcaagattaaattccagaacccctgtttgctaacgcaaacaggggttttgttttgggcggtcggaaagccagtggaagcgctgaccattgccaacgacacaacttacggtctccagacttacattctgacttcaaatctacacagagcccacgcactcgccacccgcatcgatgccggtcgcgcactgatcaacacactgctccacgaagcgcgcgcgcatgaacaatcaggcataggccgcgagtacggcacgttcggtttcgaggccttattggagccaaaatcagtcctcgtctgacaaaacagcatgccgttggggaaatcgatgcaaagtgtttctgcatttttggtatggtgcagcacatttttacaaggattgatctttcatccgcaggacgcggcgtccaccttcttcaacgagatgctgtagaaatgcctgaaccgataccgatcaaggaccacgaaaaagaaaaccgcctggtcaacaagcgcctgctcgcctgtgcgctgttggtcatcggcatcacctgcgccctggtgggccgcatgtatttcctgcaagtggtgcagtacgactaccactccacgatttctgaaaacaaccgcgtccacgtactgcctattacgccgacgcgcgggttgatctatgaccgcaacggcgttgtgctggccgacaaccgccccagctacaacctgacgatcacccgcgaacgcaccaccgacctcaagggtgagctggacgccatcgtcagcctgttgcacctgcccgccgaagaccgcgctgtgtttgacaaggcgctgaagcaggcgcgtcatcctttcgtgcctgtgacgttgttctacgagttgaccgaggaacagatcgccgtactggcggttaacgagttccgtctgcccggtgtggacgtcgagccgcaattcgtccggcattacccgctgggcgcgcacttcgcccactcgattggttatgtcggtcgcatcaacgagaaagaatccaaagccctcgactccgtggagtaccgcggtacgcagtccatcggcaagaccggcatcgagcgtttctacgagtccgagctgcacggccacgtgggctatgaagaggtcgagaccaacgcccaggggcgcgtattgcgcgtgctcaagcacaccgacccgatccctggcaaaaacatcgtcctgagcctcgacgtcaaactgcaggaagcggcggaagaagccttgggtgaccggcgtggttcggtggtcgccctcgacccgcaaaccggcgaagtactggcgatggtcagcaagcccagctttgacccgaatctgttcgtcaccggcatcagcttcaaggaatacgcggcgctgcatgattccatcgaccgtccgctattcaaccgcgtgctgcgtgggctctatgcgcccggttcgaccatcaagccggaagtcgccatcgccggtctggacagtggcgtggtcaccgcccaaactcgcgtgttcgatcccggctactaccaattgcccgattttgaccacaaataccgtaactggaaccacagcggcgacggctgggtcgacatggacgccgcgatcatgcgttccaatgacacctacttctacgacctggcccacaagctgggcatcgacaggctgcacgactacttggccgagttcggcctcggccagaaagtctccctcgacatgttcgaagagtcagccggcctgatgccttcccaggcctggaagcgcgcgacacggcgccagccgtggttcccgggcgaaaccgtgatcctcggcatcggccagggctacatgcaagtcacgccgttgcagctggcccaggccactgcgttgattgccaacaagggcgtgtggaaccggccgcacctggccaagaccatcaacggtgtcccgccggtggatgaaaacccgatgcccaacgtagtcctcaaagacccgcgtgactgggagcaggttaaccacggcatgcagctggtgatgcatgacccgcgcggcatcgcccgggcagcggcgctcggcgcgcaataccgcatcgccggcaagagtggtacggcacaagtggtggcgatcaagcagggcgagcgttacaaccgtaacaaaaccctggaacgccatcgcgacaacgccttgtttgtcggcttcgcgccggccgaacacccgaaaatcgtgatctcggtgatgatcgaaaacggcgaggccggtggccgtgtggcaggccccgtggtgcggcaaatcatggacgcctggctactcgaccaggaaggccacctgaagccgcaatacgcgacgccggccaaagcccccggtgacccgcacgtctaaatcaggccttccactcgtcccactgctcaacgccctcataggcaagccagggcacattgtgggccgtccagatgtgcgcggtgggccgtacgcccggatcatcatccagcgtcgccacccgcacaatcacatggggctgatgcccacgctccgccatcaggtgtgagccgcagcgcgagcagaaatgccggagcttgcccggtgacgattcaaacgaggacagcagcgcttcgccctgggtccagcggaaatgctcgcgcatcaccccggccgtggccacaaacgcggcggcatgcaccttgcggcagctgtcgcagtggcaatggctgatgggcatgtccaggttgtccacttggtagcgcacggctttgcagaagcaacttccattcaacgggtcagtcatacacgtattgcctgatcaaggaggggctcatcatcgcgcacaacccaaggttgcgcatcggtcgatgtcgcctactgtcaatggaggaggtgacttatgcacgtattagatcgcatcgaacgaaaagtcctgctcaacgcttcacgtaaacaggtgtgggaagcactcactgacgccgagcaattcggcagctggtttggcatcgccctcaagggcaaacactttgccgccggggaaaccatcaaggctcagattacttatcctggctatgaacacgtggtttggaacgccaagatcgaacgcatcctgccgcaaacgctgttctcgttctggtggcacccttacgcggttgataagggcgtcgactacgacagcgaaacaccgaccctggtggaattcaccattgaagaccgtgcgccgggcattctgctgcgggtagttgaatccggctttgacgcggtgcccgaaggccgacgccagaaagccttcaagatgaactcccgcgggtgggatgaacaaatgaacaatatcgaaacctatctgggccaggcccgtcgcgcctgagcctcacgggcatcgtgctgatgcccgcccttattgttgtcagccttcgtgagtcagcggtgcgcaaatccgctgatccactgcttagtcacgcgtttagaaatccaccgtcgcagacagcttggccacgcgcgggtcgccttgggtcagatagccgcccaacgccgattcccagtacttggtattggcaacgttctccaccgtggcgcccaaggtcacatcacgctgggcgaccttgaagttgtagcgtgcgcccacatcgaagcggttccaggtcggcaggctgagattgttggccgggtcggcgtattggccgccagtgcgcagcatgcgcccgttgacggtcacgccttgcaggcccggcacatcccagtccacgccggcgttaagctggaacgtcggtacgcccacggcgcggttgccgtcgttggcgccgttctgggtgccgttgacctcggtgtgaataatcgtcgcaccgcccaacaggcgcaggccggcaatcggctcaccgaatacgttcagctccacgcctttgttgatttgctcaccctggaatacaaaggtcgcactttgatcggcgttcagttgggagaagccctgagtcggttgctcgattcggtacacgcccaaggttgcgccgtagctgcccatatccagtttcaccccagcctcagtctgtttcgagcgcgcgggtgcgaaggtctggttggcgttggtgaccttggagccgccaaacgtcgtcggtgcagttggcccggacgccaggccttcaatgtggttggcgtagaacgacacatggtcccacggcttgaataccaggccatacaccggcgtggtgatgcccttggcgtagttggcggtgcgctcgccggttccgtacgcataaccctgaaccaccagttcctggcgacgcaggccggccgtgaacagcaagcggtcatccatgaacccaaaggtgtccgacaccgccgcgctgcgggcgaaagtcttggcggtgatgcctgggtcgttcaggtcgctgccagaggtgaagccgcccttggccggtgcgctcacgtccgccgggttgtaaatattcgtcggctggctgccggacgcgaagtcaaaggcgttgcgggcctgggtccagatgccggtcaggcccaggttcaatttgtggctgaccgcgccggtctggaacttaccgttgaggccggccatcaggctggtgttgtcttcctggtgcgcgatgttcgagccgctgacggtggcgttaccgagtgagtcgatcagggtgaccgacgaataacgcccgatctcgttggtgtgcttggcgccaccggcgatgtaggcggtccagttgtcgttgaggtcgtactcgccacgcagcatgccgaaggtgtcttcaaggctggtggtgccccagttcggcgcgtagttggtatcggcggatggggcgctcggaagatgggtcaacccattgccgagcaataccgtattgcgcccgccgttgacctgctgcttctgatacacaaagtcgcccgacacgcgcagcgcatcaccgcggtaatccaggccgacggagaacagcttggaacgctggttttcatcatcgatgccggtatcgccttcacgctgggacaggttcacccgcgcgccaaagcggttgtcctcaccaaaacgctggccgatgtcgaggtggtcgcccacgcggccatcgttgctgatgtctgtgctgaaccggcgcagcggcacatcatcggcgcgcttgggttgcaggttcacaccgccgccaattcctgaaccgcccggcgttaccccgttgataaaggcgttggggcccttgaacacttcaacccgttccagcgcgtcggtggacatgatctggcgcggcaggatgccgtacaaaccgttgaaggaaatatcgtcgccattgagcggcaggccgcgaatcacaaaggcctgggcctggttcgcataacccgaggcctggcgcacggacgagtcattgagcagcacatcgccgacgttttccgcctgctggtcgcgaatcaatttctcggtgtaggaagacatgctgaacggcacgtccatgatgtcctggttgcccagcacacccagttgcccgccgcgtgccacttggccgccggcgtacaccgggggcagggcgttcggcgcgggagcgtcggcattgatgttggtggcacccaattccagtgtattgccgtcctgacggttattcgcatcctgcggggtgactggggtttcagcatgagcagcaaggctcacggagcagcaaagggcgagcaaggtggggcgaaacggcacgcaaagtcgggtacgggagggcatggtcgatcctgacggcgaaccgtcaatgtgaggaaaagggcaacaacgttgcgcgtcctcgctgcgcggatacgactccggcgcgaatgatagtgattgttattaatgtttcgcaacaaatttgtgagattgcggtctgcgtgcgcgttaacctgccgcgttatgcggatgccgagtagaatcacgccctgaaagcgattcctgaggtgcggtacggtggatttacagcagggttttgtcctgacccggcattggcgcgacacggcagcgggcacggaggtcagtttctggctggcgaccgaccaaggcccccggtgcgtgcgcctacccgtacaaacctcggtgatgtttatccccgaggcctaccgcaagccgctgggctggttgctcaacggcgagcgcgatgtcgaactgcgcccgctgcaactgtgcgatttccaccaccgcccggtgctgggcctctacacccgccagcatcgtcaattgatggagctggaaaagcgcctgcgcgccgccggtgtggatgtctatgaaggcgacgtgcgcccgcccgagcgttacatgatggagcgctttatcactgccccggtgtggttcggcggcacacctgacgccagcggcaccttgatcgacgcgcaaatgaaacccgcgcccgactaccgcccgccgctgaaactggtgtccctggacatcgagaccaccgcccaaggcgatctctactccatcgccctcgaaggctgcggcgagcgccaggtgtacatgcttggcccgccgaacaaaaccgacgcggtggacttcaagctcgattattgcgacacccgcgcgcaactgctcgaacgcctcaaccagtggctggccacccatgaccccgatgcgatcatcggttggaacgtggtgcagttcgacctgcgtgtgctgcacgaacacgcccagcgcctcaacgtgccgctgttgctcgggcgtggcggcgaagccatggcctggcgcgaacatggcagccgcaatcactacttcgcagcggcggcggggcgcctgattatcgacggcatcgaagccctgcgttcggcaacctggagctttgaatccttcagcctggaaaacgtcgcgcaaaccctgctcggcgaaggcaaggacatctccacgccgtaccagcgcatggacgaaatcaaccgcatgttcgccgaggacaagcccgccctggcgcgctacaacctcaaggactgcgagctggtcacgcggattttcgagaagaccgagctgctcaagttcctgctcgaacgcgccagcgtcaccgggctgccggccgatcgcaacggcggctccgtggcggcgttcactcacttgtacatgccgctgatgcaccgccagggctttgtcgcgccgaacctgggcgacaaaccaccccaggccagccccggtggattcgtcatggactcgcgccccggcctctacgaatcggtgctggtgcttgattacaaaagcctttacccgtcgatcatccgcagcttcctgatcgacccggtggggctgatcgaaggcctcaaacaccccgaagacagcgagtcggtggaaggctttcgcggcgcgcgtttctcccgcacccggcactgcctgccgtccatcgttacgcgcgtctccgagggccgcgaagccgccaagcgcgaccacaacgcgccgctgtcccaggccttgaaaatcatcatgaacgccttctatggcgtgctcggctccagcggttgccgcttcttcgacacgcggctggcgtcctcgatcacgatgcgtgggcaccagatcatgcgccagactcgcgagctggtggaggccaagggttacgaggtgatctacggcgacaccgactccaccttcgtctggctcggcagcgcgcatgcggcccaggatgccagccgcatcggccgggaactggtgcagcacgtcaacgattggtggcgcgcgcatttgcacagcgaatacggcctgcaaagcgccctggaactgcaatacgaaacccacttcagccgcttcctcatgccaaccattcgcggcgccgaagagggcagcaaaaagcgctacgccggcctggtcgtgcatgccgacggccgcgaagacatgatctacaaaggcctcgaaaccgtgcgcagcgactggtcgcccctggcccggcagttccagcaggagctttaccagcgcatcttccatcgccagcctcatcaggactatgtgcgcgactacgtgcgccgcaccttgagcggcgaactcgacgacctgctgatctaccgcaagcgcctgcgccgccaactcgacgactacgaacgcaacgtgccgccgcatgtgcgcgccgcgcgcctggcggatgaatacaacgaccgcctggggcgcccgcgccaataccagcgcggcggctggatcagctacgtgatcagcgtcaacggcccggaaccgctggaagtacggcaggcgcccatcgactacgaccactacgtgacgcggcaactgcagccggtggcggacgcgatcctgccgttcgtcaatgatgatttcgccaccctggtcggcgggcaaatgggcctgttctaaaacgcttgcctcgagccgatcacagcctgcactcttggcctctgatgaccacccgcagacggcgcagctttccatgacccagatcaccttgaccggcactcacgtcgaactccaacccttgcagcgcgagcacgcgagcgccttgctcgacgccgccgccgacggcgagctgtggaaccttaaagtcaccaacgtgcccggcccggacactgtcgacaagtacatcgacatcgccttggccgggcgcgatgcaggcagcgtgattccgttcaccatcgtgcgcaaaagcaccggccaggtggtcggcagcacgcggttctggaaggtcgaccgggccaatcgcaaactggaaatcggccacacctggttggcgcagtccacgcaaaaatccgcaatcaacaccgaagccaaactgttgctgctgacctacgccttcgaagtcctcgactgcgtgcgcgtgcagttcaccaccgacgaactcaacgaaaaatcccgcgccgcgatcctgcgcctcggtgccgtgcaagaaggcatcgtgcgccacgaacgcatcatgcccgacgggcgcaagcgcaactcggtgcgcttcagcatcatcgattcggaatggtcgcaggtgaaggccaacttgcaggccaaattgctgcgataaggaggaaacgcccatgtacacgctctacggcattgatgaatccggctcctgcatgatcgaaatcgccctgcagcgttgcgcggtgccatggcgtcgcatcgacgccagctcctgggcggacggcgagggcagcgaggccttggcgcgtatcaacccactcaaacagattcccacgctggtcacgcccgacggccaagtgctgactgaaagcgccgcgatcctgatccacctgggcctggagtttcccgcctccgatctactcgccggcaaccgcgcgcagatcctgcgtgggctggtgtacatcgccgccaattgctactcggcgatcggcatcatcgactacccgcaacgctggctgggccccgccgatgaagcgctgcaagcccaacttaccaccggcacgcggcgctatctgcaccatgcctgggtggtgtttgcccagcagtttgccgagcagttgtttgcgcccacgggtgtgccgaatgcactgggcatcatggccgcggcggtgtcgcgctgggatgaggcgcgggaggtgctgaacgacctgtcgccaggctttgcccaggcgctggcgcaggtggacgccgaccccgtcgtgtcgcctgtatttgctcggcattggccggagtggggcgtctcgtaatgtttccgcaatctaaagaaacaatcaccgtagtgcctgtccaaccccttgcgtagcagacttcctgacctacgcttcttaacgaggtgtaggaatcatccttgaaattgactgtcgcagacatgaaactcaagaaccctgcatggaattcaaaggaggtgcgcatgctcatccggtcgctgaccctggctaccttgatggcttttacggggccgctgttggccgcggatgatatcaacccactcaagcaggacttgaacaagtcccgcccgctggtagtggtggaacttgattccggcaacgaaacattggcaaccctcaagaaacagctggacgagcctgccaacaagcagtcctttgaagagcgcaacatggtgttctacaccgtgaagttcggcagcatcggtgccgaaggggagaagttcgccaaggacgccaaagacaacaaaaagctcacgccgccggaaaccaacgcgttgatccgcgccctcaagctgggcgccggcagcggcaccaaagtgattctggtgggcaaggacggcgagaaaaaactcgagaagaccgtgccaccggataccctcgatctgaaggagttcttcagcgccatcgaccagatgcctatggctgaaaaagaactcgccgcgccagcggaaccagagcctgccgccgctgcgccagccaagggcgccaaggctgccaagcccgccaaagccaacagcaaagctgcccccgcgcaactcgatgattaaacacacataaccccttgtgggagcgggcttgctgtggcgagggagcttgctcccgttcggcagcgcagctggagccggcttttaggggcgcttcgcaccccagcgcaagcaagcttgctcgccacagcaagcccgctcccacaggggtttagcggtttgctgaaggtttagccgccttacgcaccggaaacggaaagtagaaaaaccgtaaaaacgccacccgcttgatcacttccccgatcaacaacggcaccaccaccgcgatcaccagccccacacacgccgccaggaagggatgcacgcccagacgctccatcaggtcgacgctcttgtgctggatctcgccatgaaaaatcaacaggatcagggtcgattgcccgatgtaggtcatcacccgggtcagcaacgtcgacaccatcaacacctgcgccagcgcccagcaggcgtacacgccgatcaccgccagcaggctggtccacaaccagctgtcgtagcgacgttgcgccaggtccatggtgtcccaggtcggtatgaacaccacggcaaatagcaccaccgacaccaacagcgtcagccacgagccggcgtgcgtgcgcagccaatcgcgcagcaggtagccgacaatgaagtaagtgctgctgatcaaggtgatatccaggctgaacggcagccccggcagcacccagttgtggccgccgagcgtcaccggcaattgccagaacaacggcaacagccaaatcccgagcagcagttgagctgcgatcagcaggccgctcatccacagcgacagcttcaagcgctggatcagccgcagcatcacccaactgaacagaatcgccacccagaagtgcggcaggaaccacatggcctgccacggaatggtgtccaccgaggcatacagcacgccgccaatatccggcagcagcggttgcccgcgcaagacggcgcgcacgatcacgtacaccagcatggtgaagaaaaacggtttgagcaggccgtcggccttgcgtatcgccatctccacaaacggctgttcgggcttgaagaacacccccgagaggaaaaagaacagcggcaagatgaatgaggcgaggatcgggtaaagcaggtccggcgaagtcgcgacgaaccagctgtgggcgaacacgatcaccaggatgccaatgcctttggcgatgtccatttgtatccaacgatgtttcatctgacggttcccgatcgatcgttcatgctttgcgccacggcttcagccacagccccatgcccagcaacaccacggcgcctgccagggtgctcaaccccagttgcagccacacgccttgaatccgaaacagcacaagcgccgccaggcccatcaccacggcactgagcagccattgccgcgcccagggcagggctgccagcaactgttggcgctgcatcaacagcagcgccgtacagatcacgcccgccagcgccgccaacggaatacccgccaggccaaacacaaagggcagggcgcccagcaacagcacattgaccaggctgccgagcagttcgcaacgcagtggctggcgcgtgtcgccggcggcataggcatagcgtgcgagcaacgcattccaggcgccgaacaccagcggcacggcgaaccaggccagcagcaagggcagcggcgaatccgctgattgcttgggcagcagcaacgccaccaggctcggggccgcggccaccaggccgacaccggccggcaaggtcagcacgctggcggtttccaggccgcgcttgagcagggccaggcgctcatcgccctgacggcggctcatcatgcccagcagcacttggttgaggctcatcaatgcaatcagcggcaggttcatcagcttgcgcgcgaggttgacccaggtcactgcgccctcacccagcagcgacgccaccaaccgttcgatcaacgccaagccctggctggcgccattgctcaacagcagtgggccgatgcgctggccgagttcgcgcagcggcgtgaacgtcaactgccagcgccacggccgccagccctgacgccagatcgacggcagtagcgccagcggcatcaacaggctgccggccaggcacgccaaggcaaggctgtgcggctgagtcgcggtgcccgccagcgccagatacgtcaccggcggcaggttgaacagcagcgaacccaaccccgccagcacaaagcgctcactggcctgcagcgggatactgaacagcgcatgcagcatcagccccggcacgcaccaggcgacgatttgcaggttgctgctggcaagcagcgtcgcgctggcggccagccccgggccgagcaactgcaccagccacggcgccagcagcgtcagcaacaggctggtgaccagcgcgatcagcagcagcgccgggaacaacaccgccagccagtccaggcgttcgccgtccttgcgcgccaggtacagcggcagcgcggcggcgctcaacacgccaccggccaacgacatgcgcagggcttcgggcaaaaacagcgcgatcaggaacgcatcactgcgctcacccgcgccccaggccgccaccagcaaccactcacgggcaaaccccaggcacaggcccagcagggtcgcgagcgtcagccagacggcggagccgagcatgattaaggccttgcgccgtcaagcatcggcttgcgaaatgccaccgccttgacctgcggcaggcgcgccggaaacagccgccgcgcctccagcacattgaggccgaccatcagccagaacagcgccaccatcaccacggcaaagctgaagtagtggtcaaacagcccgctcaccagggccgagagaatcccggcggtggtgcccagccacagcgcgttgtccttggtcaggcggatcgggcctttttccgggcgtgcttcacgccaccagcgcacggtgacggccacaaacagcaacatgccgacgatgccggttttgtagatgaaattcagccagaggttggagatccccaggaaatgggtgcccggcaccggcgggtcgaccttgaagccgatgccgaacgggtacgccgccacggcctgggggaacatgcggtattcgtcgaagcgcacttcggtactggcgttgtccgaagaaaaaatcgtcgccaggcggtcctgcaacggtgggtaggccatcaccagcgcgaccgtcaacgccgcgccgatcatcaacagccgcccggtgtagggcacgcgccgcgtggccatccagatcagcaccagcgccaggctgaccatcgccccccggctactggccaacaacaacgcggcggcgccgaggcacgccacgcccaggcccagcccgcgcttccagccttgctcggtcatgccgtagcagaacgccagcggcagcagcagcgccatgatcccgccaatggcattcgggtgcatccacggcgagcccatgcgcgacgacatcgcttccagtccgaatttcaacatgtcgaagttgccgtaattgaacaccgccaggatcggcgcaatgccggccccggaacgcgtgcgcacgaacaccgcaatcgacagcaccagcatcgccagcgtgcccagcagcagggcgatcaccagcgcttcgcggtgtttgtaatcggtgagcaacttggcgcacaggaacaccgccgacaggctcagcaaccagcgcagccaattggccacgccgctggtgtcggcgtggatggtgacctggccgacaataaacgggaacacgctgaacagcatcagccacagtagcatctggtcggtggggcggcgtgccaggcgtggtgtgtcgggcacgcgcgccagaaagctgtgccacagcacggcgccccaggtcagcgcgaggatggcttcgctcaccgtactgcgaatgcccaggttgacggtggagtagggcatgaaggtcgcgatcccggcaaacagcagcaagccccagaacgggaagcgcagaatggtcaccgcagccgccaggccgatcaccgcgaggaaggccttggccggtgacagcagcaaggcgagtgcgccaaacaacaggccgaagaggattgcgacgaggctggccagggagaatctcatgtcaattcctcgatcagttcggccaggcggcggcgataggcttgatggttgaaacgctgcgcccatagcttgcgttgttcgggtgactcttcggtagggcgagccaccaggtcgagcatcaattgcaccagtgccgggccgtcggtgggcgaaaaacgcggggccgacggcggggtgatttcatccagcgaggttccgctggcgaccgccaccggcgtgccgacgctcaaggcttcaatcaccggcaaaccaaagccctcggcatacgacggctgccacaggcgcgcagcctggcggtacagcgcgtgcaactcggcatccgacacgccgctcaaggcgcgaatgcccggcaggctgcgctgggcctcgggcaaatgttcgaggctgcccaccagcactaactccggcacggcggctgacaggctgcgcgcctgctgccaggcgtccaccagaaatggcacgttcttgcgcaattcacgggtgcccaccagcagccagtagtgcgcgggcaggttgcgcgcgctgaggtccgccgccaattcgacaaacccatccacctgattgggcagcacccgaatcttgcccgccgccttgggaaacaaccgcgcggtttcatcggcgctgtactgcgagggcgtccacacgcgatcggcgctgtgcaccgcatacgcaatcgacagccgatcactggtcttgtagatcaacgctttcaaccggttggcgtggtagttgttcaaggtgatctggaacaggtcgtgcaacagcaccacggtgcgcaagcctttgggtttgggcggcaggggcaggcccatattgaaggtgctgatgtacaggtcgatgtgctgttcgcgcaaggcacgcggcaaaaagcccgcttcaaaacgcaggcgattctgcggctggtgcatcgcggtttttgcgcagccccaggccgggcactgtgcctgcaagcgggtttcgtcgcccagaggcgccacggtaaagcgcgtcagctctacatccggcagcgtgcgcagggcattttccagcgcgtacacctggcggctgatccccgattgtggcgaggtgccgacggtgcggtaatccaggcctacacgcatgcgggctccttttgattgagcggcgcgagcatcgcatacaccttttccagctggctggcggcgacactccagtcatgggcacggcgcacgtatgcgcgaccggcttcgcccatgggcgcggcagcttcgggaaattgcagcaggcgcaccacggcatccgccaggctggcggcgctttgtccgccgaggtaatccaggccttcaaccaggtccaggccggagacgccttgctcggtactcgccagtggcagcccggcggccagtgcttcgaggactttcaacttggagccgccgccatggcgcaacggcgccaggaacaccgaacagctcgattgcaggttcaacaggttcggcacaaacccttgccactcgatgcgcgggtcttgccagcgttcacgccaactggcgggcatgccaaagccgcacacgctcatgcgtgcgtcggggcagcgttcccagactttgggcaggatttcatccagggcccactcgatggcgtcgacgttgggtgcgtattcatagttgccaaggaacagcacacggcgggtcgatgggtccggacgggcggcggcgaagtgatcgcaatccacgccgttgaccaccaccggcaccggtttgccggcgatcctggccagcacttgtgcgtcactgtcggtgaccgccaccacctgcgccgcctggcgcatcacgcggtgttcccagcgcgtgtagcgccactgatcgtagcgaatgaacggcagcgcccagcggggcaggcgatcgtaggtggccgcaccgagcgccgattcaacgttgtgttcggtcaacacgaacggctgggatttgcgcgccagcgcgtcttcgtacggctggaacgtgtagctgtgttcgatctgcaccacgtcccaatgttctttgagcaattgattgaacgtgtcctgcagcgcgccggacaggccattgacgctggccagcagcgggtagggcgcaaacagcccggccaccagggttttcaggctgcgcagcgggcggcgcggcaggatgatcaactgctcaagaaaggcttccagcacctggcgatcggtcagcgataccgggtgtttgtcgtgcagcagtaaggtgatgcgatgcccgcgcgcggccaggctgcgcagcagatggaactggcgcgtcttgccgccgctggtggcgggccagggcgaatagggcaggatccataaaatgcgcatggcgagcttcaatcccataacagaatttgcaggttcgacttgacgggtacggtcaacccatcgctgccgctgaccggggtttgtgtaccgcgtagcgggtcgtatagggtggcgctggtcaggcccggcaaatgcgcgttgccgccttcggccgaccagaaaaaccacaatttgtggccgtcggcacgggtccagccgatgctgaacaggccgtccggcaattggtcggcgctgggcgggtcgccgggagtgagttgcggcccactgacgtcgaggaaatttttcagcgcggtgtagaccggcttggggttggcgtcgatgtcgagcaagccgtagaactggtcacgcacgctggcgcgctggtcgaggtcgctcaaagtgaacaggaagattttgtcgtaatccatcgcgctcatcagggccacgcgacgcaccacgtaatcggcctggccctgcagggtgatgaggtcctgggcgtcttttggccccgggtaggttgaccagccccactcggtgctccacagcgtgtgcacgccagcgttgcgcagggcctggttgagggcggtggtcttggcgataaagtccaggttggaagggtcgttgccctcgggcagttgggtgtaaggatggtaggaaatggtggtgttcaggctggccacgccgagggcgcccagggcgtcgaacatggtctggccattcggcatttcgctgaaaaaggccatgccggccgccaccaccggtttgttcgggtccaccgcgcgcagtgcgccggcggtggcggtcagcaggttggcatagccggccgggtcggccaccgggcgccagaagccgagcaggttaggttcgttccacacctgccaggcgttgacgctggggtagcgttgcgacaacagcgccatgcggttggcgaacacgttcgggtccttaggcgggtactggtcctgatacggcgcaccggccggcgccgtggtcgcgaaaggcgccgagccgacgaggtagaacactgatttgagctggttggtttgcaggttgccgaccaactgatcgagtgtggcgatctggtactgattctctgcaggctccagctgatcccaatgcaaatccaggcgcacccactccaggcccaaggccttgagacggttgatctgcagttgatacaggctggggctgaaccacaggaactgcgcgttcacaccgaggaagtccttccacaccaccaccttgttgcccttgagcacatggctctcggcgtcggcctggcgcccccacatgaaagccgtcaggccgagcgcagccaccaccgcaagcgtggccaggtaggtccgtttacgcgccataggaagctcctgcaatcgcctgttcaaagagctgtttgaacttctgcgcggtcaacggccacagacgttcacggccaatttccccggcgcgctcggcccaatcccgggccaacagcggggtgcgtgccaggcgcagcagttgtgcgctcaaggccgccacgtcgccttgtggatagatcgcgccattgccgctggcgacctcttcggcaaacgcacgcgcatccgaagtgatcgccccgcgcccgcatgcagcggcccaggacagcgcgccgctggtgccacgctggcgtcccagcaggccaagttttttcgattcgcggtacggcagcaccatcacatggtgtgcctggatcgtctgggcaatctcgctggccggcaggttcagccgccagtcgatcacgcccgccaggccgagttcggcaatttgagcgttcaactgctccagataattgccgcccgcgccaaaggccatttcggcagccgtgccaccggccagggtcaggcgcacgcggtcacgcaattcgggagcttgtttgaagacgtcggccagggcctgtaacaggtcttcaatgcctttgccgcggtagataaacccgaaatacagcaggtgcaacgtgtccagcgccggtaatggcgccggagcaatggccaggttggcgtggttgatcaccgccactttgccggccggcaattgcatgcgttggctgaggcactcggcacccaggcgggtgagggtgatcagccgcgtcaggccctgggcgacgtggcgttcttcgcgcaacgtcagcgggtctgccaacaccaccgccgcctggggcagcgggctgggcaaacgttccagcaggttcagcggaaagggcaggtgctcgcggcgccagacgatgcgttccgggtcatgcacggtggccgtcaacggcagcgtggggtgcgcggtgcgcaactcgcgcagcgccaggaattcccccagccgcccgccacccagctcggcgtggaccaggtccacgcgctgccagtcgaatcgggcgattgcctgccggatcgcttcggtgctgccgtccacgccactcaacggtgtcgccaccgtcacgcccagctgctccaaggccgtcttgaaatggttcgcgtagtcggcgatgccatttttttccggtggcaatggggcgagcagggcgatgcgcatcagaacgccccccggtacttggcgatggtcctgagcaccttggccggcacttcgaatttgcgccggttgatgatgatgccgtccaccttgccgaacgcggtgttgaggatcgacagcgcgtgttccaccaccggcaccgtgcttttctgcgcttccaccaccaggccgatcaggtccgcgcggcgcagggtgatgaacgcatcacggttatccagcagcgccgaggcgtccagcagcaccacttcgccaggttcggcgatggccactccgcccacgcgcacattgatgccgttctcctgcagcaactggcgcagttgctccaccacaaaggtcacgccttcgccgtggcgtgccgaggtcagcccgagggtcaggccctgctcggcaatgcgcttgggctgcagcaagctgtatagccggtagatgctcgcattgaacgcgttggtactttgcgcggtgctggtgtccagctccggcaaggtggtccacagcggcaggccgaacttgcgctccaccaggccaccgtcgtgaatacgctggtcgagcaggtagcacaggtagatcaccagcaagccgacgacgattgcaaacgggatcgccaacaccagcatcaccagggttttcgggaagatgcggccagggttcagggtggcttcttcgatcaccgcgatgttgctgatctggctgttatccagctcgcggtcgatgcgcgatttttccaggttgtcgacatacaacgcgtagttgcgctcggtggcactcagctcgcgggaaaggcgtgccaactccggttcaatctccaaggcttgcttgcgctgcgcttcgaggttgaccagctgtttctgctgctgcaccagttgggtacgcagcgcctggttgttgctcgattcatccagcagcacgcgctgcaagtggatttccagggtgttcggcgcacggttttccgaggcttgcacggtattgctctcattcgccacctgggcctgcatcgcccgaatcgacgcgtccagggctttgaccggcggcgcgttgtcggtgtaggtgcgcatcatgtcggctttttccagcagcttctggttgagcaggcgacgcaaatcctgctgctgcgggttcaatgcaatctggcgaaccgtggtcacttccttgggctggcttttgagctgggtgcgcgtgctgtcgatggcgctgtcggaggaggcgatcagccgggtggtattgaaggtctcgccgcgcagcacgttgatgcgctcggacaagtcctccaggcgatcggtaatgctcgccgcaccaatctcattcaagtgcgtgaggatctgctgcttgtagctcttgatctcgttggcgctggtgttgacctggccttcatagaaagcgtacaggctcttgcgccccaaggcctgggtgcgctcggcgatgtaggtctcgacccaatccttgaccaccgcctgggcaatctcggggtcgccccacttgaagctgatgtccatcactgtggagcccgcggcgtggctgacctcgaagctcttctccaggctggcggcgagacgctccaccggtgtggttttttcgacgatgccaacggtttccagcaccacgcgaatgccgtcgaacaccgcgcctatgccggccttgacgtagtgcttggtgcgcttccagaagccttccggcggcggcgcgttgtcgatcacttccaggtaatgctcggccaccgtgcgcacaatcgggcgaccggtgagcaagcgttcctcatcgacaatcgggtcgcgttgggtgctgggcatcaccagcgcctgacggttgctgatctcgatcggcagggtcgaatcgcgccctggcttgaccagcaggcgcgcggtggactcgtacttggccggcagcaaaaacgcgcccagcagaatgatcaccagcgccgcgatggccgccagtttgaactcgtgccggaagatgaaaaacaggcgcagaagatcacgaaaagaacggatctcgatcatgggatgtcgctcctttagttattgccgccgctggttttggtgtagttgtagccaaccccaatggatttggtgaacgggatcagttggttcaagtaggtatccaccccttggatgcgttcgccgacgttggatttgggcacgaacaccacgtcaccgcgttgcaggtgcaccggtttacgcccattcgggccgggcttgaggtattggctgaaatccaggaagtaggcgtggtaggcgccctgggcatcttcgcgcagcagcgcgaccatgctggcattgcccgacgggttcaccccgccggcgccgacaatcgcttgttccagggtgttggccgtgccgagctgcaccgccgtcgggttattcaccgcgccgccgacgatcaccgagttacccggcgcctggttgatgttcaccgttacccgaggctcgcggtacaccggcgcgagcttgttgctcagctcggtcgcgaggtccgatggctggcgcccggcaacctggatcggccccaggaacgggtagttgatcttgccgtcggtctgcaccgtgtacagtgtcagctcgtagatagtgctgacgttgaacgccgacagcgtcggcatttccccggcatcgcgcacgatacgcaactggtcgccgatgcggatgcgttccaccgccggcggcagctgtgcaagctggtcgagggcgcgcttgccgtcttccacggtctggtcgtccgggggcacgatgcgagccggcgtattgcaggcggccaaggccatcatggccaggatgagcacggtttttttcatacggggggacttcctgttggtcatgctgctcacctccaataaccggggaacatgctgatgcgccgcttgagggcgatggggagccggcgttccagatggcccagccgatagccgagcaacttgaacgcgctgcgcaccagtacttcgggtacgcggtgcaatgcaccggctgcgcgcaatgccgcaagctcagccagtacatagcgtttaccttcaccgccggcatcgccaaaggcctggcgaatccacggctcgcgaccgtaaaacacgccaatgtcgaagtagcggtgaaactcatccatgagtcggtaatcgtgggagtggtacacccgcgccgacgcggcgtagcgcaccttgtagccgtcgagcagcatgcgcgccgcgacgtaggcgtcttcgctgccaatcacatcggcgggggaaccgccgaccgcccgcaacgcgccgcggcgggacacgctggatgaggccgagctggagcagggcttgatccccagccccggcgcatcggccaggcttttactgcggctgtgttcggggtaattgaagtgccgcgattgcgcgcccaacacgccggcgccggggtgcggcagttggcggccgtaggccacgccgttgagcgggtcttgctgcaactcgtcgagcaggttggcgaaggtctcggggtcggccggtatcgcgtcctgggtcattactatcagcgcgtcgccgctgacttgctcactggcccagcgccgcgtgccgccgtggttgaaatcacgcgcgtcaatcacctcgacccgcgcaccgaagtcacgaaagcgcgccacggtgtcgtcgctggaggcgctgtcgaccaccagcatctcgtccggttgcacggtctgcattctcagtgcgggcagcaaccgcgccaggtggctggacgcgttgcgggtcgggatgatcaacgaggtacgcatatcactttttcacttctgcggcgggcgcacgcccgtagatgtcatcaaagcgcacgatgtcgtcttcgcccaggtactcgccgctctgcacctcgatcatcaccaggtcgatgatgccggggttggtcaggcggtgtttgtgcccggccgggatgtaggtggactcgttggcgttgatcaggaattcgcgatcgccattggtgatctgcgccgcaccgctgaccaccacccagtgctcgctgcgatggtggtgcatctgcaacgacagcgaggcctggggcttgaccacgatgcgcttgatcttgaagcggctgctttcctccagcaccgtataggtgccccacggccgggtgacggtgcggtgcaggctgaacgccggatggtcctggcgcttgagttcggcgacgatgtaacgcacatcctggctgcggtgggcgtcggcgatcagcagagcgtcgggggtgtcgacgatgatcaggtcacgcacgccgacggcgccgagcacgcgcttgggcgagtcgatgtagcagttgtgcacgtcatgcaaaatcgcttcgccattcacctggttgccctgcgtgtcgctgggtgtgagctggcgcagggcttcccaggaaccgatgtcgctccagccgatgtcgcagggcaccacggcgacgtgcttggatttttccatcaaggctacgtcgatggaaatatccggcgcggcaccgaagccttcggcgctcaattcgcgctggcgtgaggttttattctgcagggcctggctgtgctccaaggcagcttttgcggcggccagcacgtcaggggcgtgggcggcaagttcgtcgaccagggtactggccttgaagcagaacatgccggcgttccacaggtgtttgccgccgtccaggtagccttgagcggtggccaggtcgggtttctcgacaaagcgtttgacccggttgccggtgcccagcgcttcgcctttttcgatatagccgaagccggtttccgggtggtcgggctggatgccgaaggtcaccaggtagccggcttcagcgaggtcgcgggcttgggtgacggcggcggcgaacgcgtcttcgtcgctgatcaagtggtcggccggcaacaccagcagttgcgcctgatcaccgaagtgttcctgcacatgcaacgccgcgaccgcgatggccgccgccgtgttgcgcccgaacggttccagcagcaggtccagcggcaagtgcgccttgttgaccacgcggtagtcatccagggtgcgaaacagcaggtcgcggttggtcaccgtgagcacgctttccacgcccggcaggcgcgcggcgcgctcgaaggtcttttgcaaaaggctctggccatcacgcatgcgcatgaagggcttgggcatgttctgccgcgacaccggccacagccgtgtgcccgaaccgccggaaatgatgcagggaatcaatccgttgagggtattcatcaatagacctccttggtggagaggacggccgggaccgtcatgaagacgatgtacaggtcaaaccacaccgaccacttcgagatgtattccaggtcgtactcgacgcgcttctggatcttgaacagggtgtcggtctcgccgcggtagccgttgatctgcgcccagccggtgatgcccggcttgacccgatgccgcgagctgtattcgctcaccgccacttcaaacgggacgcccgccgccttggtcgccgtggcgtgagggcgcgggccgaccatggacatgttgcccagcagcacgttgaacagctgcggcaactcgtcgatgctggttttgcggatgatgcggcccacgcgcgtgatgcgtgggtctttgcgggtggtttgttgctcggcggtgaagtcgctctgatcggtgaacatcgagcggaatttgaacacgcggatttcgttgtcgttgtagccataccggttctgacgaaacagcaccgggcctttggagtcgagcttgatcgcaatcgccgtcaccagcatcaccggggacagcgccaccagcgccaggctggccaacaggaaatcctcacagcgcttgatcaccggcgaccacccacgcagcggcaactgcgaggtgttgaacatcaaaatgccgcccacgtcggtgatgcggctgtggccgtagcgcagggcggccatgtccggcaccagcatcacgttcaccgacatctggcgcaggcggttgaccagcccgtggatgcgttgctcggccgcccacggcaggcagatcatgacttgattgacctgctcggcgcggatcagcttttccaggtcacgggtattgcccagcaagggcaggttgctcagttccttgggaatgcgctcggtgcggtcgtcgataaaaccgatcaggccggagcggatatcaccattgcgttgcaggtggtcggcgacatgcactgcggtgtcggtgaagcccaggatcaccgtgcgttgcaggtattttcccttgcgcatcaggttgcggtacaggcgcagcatcaccaggcgctcaaggcagaacaggccgagactggcgaagtaccaggccaccaggttacgcggggtcaattgggggaaaaactgcaggatctggtacatgaacagcaaaatgcagaacgccgccgaccaggcaactatcttggcacgcaggcgcaggcggttgctgaacagctcttcggaataaatgcccagggcctggaacagaataatggtcagcaccgcgaaaaacagcagcaggccgagaaagtgggagcgcagctcaggggccagtgggtcgaggaacaacaccaggaccagaggcggcaaaatggcagtcaggccatggatcaacttgacgaaaactacaaagaattcaacaaaaccggcgcgggtcagaaacaggctgtcgactgacgacttttctcgcataaaaacatccctcattgcactccagacttactgttctgcctgcttaagtagtgggcaagatgaacgacggctactctgggtaaaacgcaactgtcccttcagttggaactatccaaatgaaggcgtttgcgggggcagtgacttaaggagtgttcctttgaattgctttgtcaattaattgaccgtggtgcggaggtggcgtgctagacacgttaattaatcttttttgtggcattttattgactttccttgtctggacactcggtgatggggtgtgtttttgagtgtaggaacaaatgtgagaattttcctgccagatgcggaaaccttttttgaaaggtggtaggaaaaggggacagtaagagcacgctaagtgccggaaagtagggctttaagggagaacgaagttactttcaaagggcagatgaaaatgtatccagcacaattttttgtgggttttttgacggccatttaacctgttggctcttattcggcgggcggcttgggcatgatcgatttcacaacgttgctgatgttctcgggtgctgtcttgctgttgctgctatcgccggggccgaacatggcgtttgtgatcagccatggcgtgagtgatggctggcgcggtggtgtggcctcaagcctggggatctgcgtggccgatttagtgctcaccctgttgactgccagcggggtgacggcgctggttgccagttggccgccgtcgtttgatgtgattcgctacgccggagtcgtctacctgttgtggctggtggttaaaaccttgcagaacagtgcgcgcctggacactgccctggtcaagcgcgtgcgccttagccgtgtgtttgtgcaggcgctgctcaacagcctgctcaaccccaaggcgctgctgtttttcctggtgtttttgccgcagttcgtccggcccgaggccgggagcatcgcggtgcaactgctggtgttgggcggtgtgctgaccctgattgccggggtatttcacgcgctgctgggggttttcggtggcgcgctcagccgggtttttgccgcaaatgcccaaagcgccaggctgcagaaatggggcctggcgagcgtgctgatgctattggcggcgcggctggcgttgatgtcgcggccagcgtgatgcagtggtggcgagcgggcttgtttgtagcaagcgggcttgttgtggcgagcgggcttgccccgcgttgggctgcgcagcagccccaaaacctgcgccctcggtttgcctgaggaaacgcggtggctgtgctggggccgcttcgcgccccaacgcggggcaagcccgctcgccacaacaagcccgctcgccacgacaagctcgctcggcactaataagctctcagcccaaccgagctgccgcccgcgccacgatctcgccacgcacccgacgcgattccgctgtgcgctttctggcttcttccaacacgtgcttgggcgcggtctccgggctgcccgaatcgaacggcggtgccggcgcgtattcgatctgcaactgcaccaattgcgcggcagcctcgctgtacaactcggcggccagggtcagcgcaaagtcgatgccggcagtgatcccgccaccggtcaacagattgccgtcacgcaccacacgcgcctgcaccgggatcgcgccgagcggggcgagcaggtcgtggtaagcccagtgggtggtggccttgcggccacgcagtaaacccgcagcaccgagtaccagcgaaccggtgcacaccgacgtcacgtaacgcgcggtctgggcctgggccttgaggaagtccagggtgtgcgggtcttccatcaaggcgccaacgccggagccaccgggcacgcaaatcacgtccaggcgcgggcagtcggcataggtcatggtcggggtaaacaccatgccggtactggaggtgaccggcgccaggtctttccacaccaggtgcagtttcacgtcgggcagcgaccccaatacgtcatacggcccggtgaggtccagttgctgaatgccggggaacaacagaaagccgatctgcaaggtcatgaatgaagctccgataaaggggtagacggcttcactctagaggcctaggctttggcgaatacgccattgaacccacacattacgccaactatgcctcggattattcacgtactcactttccctaacgcccaggtgcttgatgtgaccgggccgttgcaagtgttcgccaccactaacgacctggcgcgccagcgaggtctgccgttgccctacgcggtgtcggtgatcgctgcgcagaccgagccggtcatgacctccgccggcctggcgctggtggccgagccgctgcccgcggctgacgcgccgtgcgacacgctggtcattgccggtggctggggcgtgtacggcgccgccgaggaccttgagttggtcgattgggtcaagcaaaaagcccagcacacccggcgcatgacctcggtgtgcaccggcgctttcctgctcgccgccagtggtttgctcgacggctgccgcgtggccacgcactggacgcgctgcgaggaactggcgcgcaaattccccgcgctgaccgtcgaatccaacccgattttcatccagcaaggcgcggtgtggacgtccgccggtgtcacggccggcatcgacttgtgcctggccctggtggaagaagacttgggccgcgcggtggccctggaagccgcgcggcacttggtggtgttcctcaagcgcccgggcggccagtcacaattcagcgcggcgctggccctgcaaaaaggcgacagccgcttcgccgacttgcacgcctggatggttgaaaacctcaccctcgatctgaacattcccaccttggccgcccaggccggcatgagcgagcgcagttttgtccgtcactaccgcgccgaaaccggccaaacccccgcgcgggcggtcgagctgattcgcgtggaaactgcgcgccggcaactggccgacagcacggcgtcgatcaaacgcatcgccgtgcaatgcggttttggctgtgaagagaccctgcgccgcagtttcctgcgcgctttgcaggtcacgccccaggcctaccgcgagcgcttctgcgacccggcttgaaccagaacgtacacagttgtatcaatgtgcttcagttttcgaatcagcgctgcccgctgagtcaggcgcgatcgagtagttcgcagatcgccgcgagcgtcgcctgcggtgcttcctgggggatgttgtgacccacgccgggcaagacgtcgcggcggtaatagccgctgaagttttccacatcgtcatccaccgctggcgccgggcccacgccatcatcggcgccacacagcgaaatagtcggcactgaaatcggcggctgcgcggctaaagcctgttcgatgccttccaatgccgggtcgcccggcgcgtacatgaagcggtggcgataggagtgaatcaccacctcgacaaaatccgggttatcgaacgaaggcgcggtgttgccgtacaggtgtggcccttcagcccaggtcggtgaccagagtttccacaacaactcgcagagctcgcggcggttggccgtcagcccgtcgaccccgcgctgggtgtggaagtaaaactgataccacaaccgatgctccgtttcaggcgcccgtggcttgagcgacttggcaatgttctggatgttgtaaccgtccccggtcaccaacccgcgcacccgctgcggccacagcgccgcgacgatgcatgcggcgcggccaccccagtcataacctgccagggtcgcttgctggatggacaaggcatccatgaaatccagcaggtcctgggccaacgctgcctgttggccggaacgcatcacttgatcattgataaaccgcgtcgggccatacccgcgcagatacggcaccagcacccggcacccacgcgcggccagcgccggcgcgatggcatcgtagccgcgtgggtcgtaggggaaaccgtgcagcaggataaccggggcgccgccttccgggccgtgggcttcgtaggcgatttccaacatgggcgtacggatgtaaagcagcgtggcgagagaagtcatgacttgagaacctcggcttccagtgggttgatgtttccatctgcggtcaaaccggctgcgatgccaaccaacgcatcagctgagggtcggtcaatacgagccttatggaaatagaggcttcgttcgaatgcttgatgcaggtcgaccatgcgtccttgctccttaatcttgcgcttccgttgtctgattgatgtacttcgttttatcgggcgtgaacgtcaccaccctgtgagtgcgcgaacaggttttaagaacttcctctgccgggtcaatatccagattttcactccgccaacagccccaacaccacaagatcatgccgctggccattccagaacccggcctcgcgcaatataccttcagtgttaaagcccaaacgctccaacaacgccagtgatgctgtgttgtgtgggtggaccatggcttcaacccgatgcaattgcatgtgcgcaaagccccaatcgagcatcgcccgcaaggcttcgctcattaagccttggccacgggctgcgggtgccagttcacaggacagggcgcaactgttccagccgcgattccatttgaacaggccgcaactgccgatcagttggccatcctgttcaatcccccagcgtgtgcctgggttgggctgcgtgcgccattgggcgaaggtgtcgatcaaggcgtgggcctgggccaggtcggtcatcgggtcggcgccaaaccagcgcatgttggcggtgtcgctgtggatggcaaacaacgccggggcgtcggttgcgcgtaattcgcgcaggcgcaggcgttgggtggcaagtgttgggaatgtggtcatggggcggtcgtcgcgatcacttgggcacgatctacgactttgccgaagtgatgccgccacaggtctacgcccaactttcccgagcggtccagcgacgaacccacggtcaaatcgctgatcaacgtcggctgcaatcctgcatcaaacaacgcgaacccggccgccaggacacacgtgtcggtttgaatgccacacaccagcacacgctccggcgcgaggcttttcaggtaggtgacggtctcgggcgtgggggcgtagccgtgcttgataaagatgcgctcggcagcaatcaggctgttgtcgtccggcgccggttgccagcccagttggcgggcgaagggggtgacgctttcgtcatggcgttccacggtggccactgttggcaggcgcccgagcagggtgttgatgccgtcgaccagccacgcgggtgggctgaagctgggttgcacgtcgatgatcagcagtacttggcgcatggggttcctgttggaggcttgggggctgactgacgaccttatggtgggaggtgaactgcggtcaaatgtgggggcggcggtgcgacgattcgacttgctcgcgagggcggtgtgtcattctctgcatgtattgactgacactccctcttggcgggcaagtcgaatcgtcgcaccgccgcccccacatttggatctcggtatatcagggagcgctgtgctttcgggaccgctcagggttgccagttgtcttctctgcgtcttgtgagccaatctgaccttgcaagctgatcacatatctaatgtgggagcgggcttgctcgcgaaggcggtgtgtcagtttctgcatgtattgactgacactccctcttcgcgggcaagtcgaatcgtcgcaccgccgcccccacatttggatctcggtatatcagggagcgctgtgctttcgggaccgctcagggttgccagttgtcttctctgcgtcttgtgagccaatctgaccttgcaagctgatcacatatctaatgtgggagcgggcttgctcgcgaaggcggtgtgtcagtttctgcatgtattgactgacactccctcttcgcgggcaagcccgctcccacatttggatttctgtgtagcaggaagagctgtgctttcaagcctactcaggttgccatgtggtctattccccgtctcgttagccaacctgatagtggaagctgaaccacaatctaatgtgggagcggcggtgcgacgattcgacttgcccgcgaaggcggtgtgtcagtttctgcatgtattgactgacactccctcttcgcgggcaagcccgctcccacaattggatttcggtatatcagtagcagctgtgctttcgggcctgctcaaggttgccaggtggtcttttccccgctgagtttgcggtccaggaaggtcgccgcgctgatcagggccaaatggctcagcgcctggggcgtgttgcccaagtgatgcgcctggctgtcgaactcttcggcgtacaggcccagcgggttggcgtagcgcagcagttgttcgaattccagatgggctttctccacttggccggcgcgggccaggcattcgacgtaccagaacgaacaggcggcaaacgcgccttcggtgccttgcaggccgtcgatctggctgtcgtcgttgcggtagcggtagaccatgccgtcgcgcaccaggcttttctggatggcttcaagggtcgacagccaacgcgggtcggtggccgccacgaagcgcaccagcggcatcagcagcatcgaaccgtccagtgcggtgctgccgatatgctgcacaaaatgcccgcgctcttcattccagaagttgctccagatatccgcgtagatcgcctggcgagtctggtcccagcgggcaaacggggcgggcagcgaacgcttggaggccaggcggattgcgcggtccagcgccacccagcacatcagccgtgaatgcagaaagtgatgttgttccccgcgcatttcccagatgcccacgtccttggtgttccagatctcgcagacctgatccgccacttccacggtgtgtttccagccttcgtgggaaatcgcttcgccgtacttgttgaccaggtacaccgcgtccatcagttcgccgtagatatccagctggatctgatcaaacgcttcattgccgatgcgcaccggcttggcgccgccgtggccgctgaagtgatccagcgtggtttccggcagctcctggcggccgtcgatgccatagagaatattgattttggtcggttgaccgcagcagtcgctgacgcggcctttgagccagcgcatgtaggcgttggcttcttcgataaagcccaggcgcatgaacgcgtagacggtgaacgaggcgtcgcggatccaggtgtagcggtagtcccagtttcgctcgccgccgggggtttccggcaggccgaaggtcgcggcggcaataattgcgccgtgtttgcgcgaggtcagcagcttcaacgtcagggccgagcggttgaccatttcgcgccagcgcccacggtaattcgattgcgcgatccagccgcgccagaacttcaaggtgtgcgccagggccaggtcagtgcagccgttgttgacgcgcgggtcgtcctggccgccgagcacgaactctgcgctttcttcctgggccagggtgaagctggccacggcggcattgtcttcgatctgcagcgcgtggctgctggccaggcgcatgccgggcaggccgtcggcggcgaagtagacgatgccgtcatcaagactggcttgagtcggggtgcgcgcatagtcgtggcgcacggcgcagcgcaggtggatttttgcgctgccgctgaccacgcgcacgcggcgaatcagcagcggcaggtcgtcgatttcttcactgatgaccagcaggtcggtgatttccaccacggcctcatcgctcagccagcgggtttgcagcacgttggtgtcgggcaggtagatttgctcgcgacgagcgtttttcagctccggcgtcagttggaaaacgccggcgtcaggggtgtcgagcagcgagcagaagaccgacgggctgtcgaattccggccagcagaaaaagtcgatgctgccgcggtcattcaccaaggccgcgctgcgcatatcgccaataatgccgtgggcatcgatggcgctttggggttcgttcttgaaatcaaccattgccacgaaactccggataaaggctcatgccgccatcaataaacagggtgctgccgaccacgtaatccgacgcgtcgctggccagccataccaccgcattggccacgtcttcgacatcgccgacccggccgtagggaatcaacttcaacagctctttttcggcggcgccttcggtggcagcacggttgatcgccgtgcgaatcgcccccggcgcaatgccgttgatgcggatgcgttgctcgctgacttcctgggcgagggtgcgcatcagcatctcgacgccgcctttggaggccgcgtagttcacatgcccggcccacggaatgagctgatgcaccgagctcatgtggatgattttgccggcggcgcgcgacacgccctcgcgcacgccctggcgattgaaaatccgcacggcggcacgcgcacacaggaattggccggtgaggtttacgccgatcacggtgttccagtcgtcgagggtcatgtcgaccaggttggcgtctttttgcaggccggaattggccaccagaatgtcgaggtggccgaaggcatcgagggtttgggcgaacaggcgttctacgtcggcttccttggacacatcgccgccgatggcaatcgctcgaccgccgttggcgttgatctgcgcggcgagggcttcggccggcgccgcctgggagttgtaattgagcaccaccgcggcaccggcttcggccagtgccttggcggcgcctgcaccgatgccggaactggcgcccgtgaccagggccacttgttgctgcaacgaaatctgcattgcccacccaccgttttatgagagtcctttctgctgactggcggcgcatggcggaagttcaccggttgtctcaaatgcgacgatggctgagggcattcaaaaaagatgactttttgaggcctgtgaaataaataggttgtgcatcttttttgacatgaccgcttcatgggcttttcagttttgttgataaaagcctctgaaattttcgaaataaatgaaccagcttcggctggttttttatcaaacccgccgaggcaagcagaaatcggacgggggcagacgttcatgatcatccccaaaagtcgtaatgcccatgtcaaggccactcccggtccaaagccggttactcacgacttctcctcctcggggttcagccaatcaaggacctcctggcatatagctggatcgccgaagtcggcgatcaaggtaagccccgtgcacgacaaaaagtaaacgtattccttgcatttacagagatcgtggcacctctcaagtcctaaaggccgaagtgaaaaggcctaacaaaggaaaccttctgtaaacctacttttttcactgttaaccgcactggttaacagtgaaaaagtaggtttacagtctcagcagtgcaccgagttgacttgtcaggttgggagttaccgagacgccaattgaattacagtcgttccggtcagcacggttcttgactatgagctgagataaaaacgtggacgaagcaatggccaacttttgcttcggcctggaggctgctccaatgcgccagttctgtcccgcgctattcgctcaacctgatcgctcccctgtgtagtgactgctgggccggcattgccagagagagttgtgctcattgaaaatccttgggcgtttgaacgtgccgtcgaagctgggttagcagagcggtgtgggttgatagcgacattcggttatgggctttccagaagcggagaggcgtatggaaaacagctcctaggcctcttgggcggcagttgggctgccctgatccagttgtggaggaaccccgaggtagctgagctcagtcgtttgctcatgcatccggtaatcgagttttggggggacttcgacctggaggccttccggatctaccgaagcttactcaagcaccttcctcaactggtgctcagccctctctacacaacgctgcaagctcacctgctgaggggggaagggcacgagtatcacttgattaccggcaaggaaggccaggctcccctggcaatggatgagttcaccgatatgccggagctgagaaagttagctgagttgtgtgcggtgcgcggccttgatcaggagtatctatcgttgcaagagaccgcagtcctgggcactgatgggaatctacaactcaagtaaaggtgcgaacagttaactcactgatacctatcgtgatctttcttctttaggaaggctgtatggagtaaatctgagggagaaagttagctcgcttcctccctcccagcagcaaatagtctagaacctcagacaccgtcacggaaggatccgaaagatcttgcaattcagaactaaaacggtacctataacaaccgctgctcaacgatgtctggacaggcagggttctgaacgacataaaatcctaaggccgcatgggcggctaatgacgcagggcgaggatgacgataccgagcgtgcgttccagcagaaaaaaaggcaattggcttatgaagcattccccacgtatgtgggaatggtacattgcgagcgctctccaaatctccatgatggggaaccactacagccgaatattgctgagatgcaagagcacgcaagtccatgtcatgatcactatgcatccgagcatacacgtagtcacctggcaaaagcgcttctagcccaccgcaagcagcaaccacaacaattccttcaccattttggtcactacaggaaggcttcgtcctggccaatgctagataattagtgctatcaaatcttaccgtgcatgagtctagagctttaacttttttaacgattgcggaagacctaagtgcgagaaaagaagtacctatcggaaaaaaaatcgttgccacttgattgcaaatggcggcatcccattcaagcaagcgccagtgatcggagtccaagtgtgaaataattgctgtaaggtttttttgggttaagatcgaccgaagatcatttcgaaaaataccgccacctgaatggtaattacgttgatagtcttgccttgtgacaggcttcccagcaccagcgtctattaaaaactgttgatccgcataagtgtatacggaacacatgccctgtcccacatgaaacgtgctgagcgatgcaactgcccatgggttgttcatcgctatgggttgagcttcatcaagaggaggtaaacgaatttttttatttaaaacattgatggcgcggatattaatgtattgtggtccggactcaatgaatgcttcataagcgtagctgctcgctgagcgcgctgtcggctcgaaatcaacatgaatccaaaggcagcctaagtcacttagaaaatctccatgcttaataaaactatctccccatcggaaagataattgaatggctttccaaaataccattgcttcaatgtcaatcacataggtttggcatcctctctcgtctagaaaggattcattctcgaaatcattagatgagactccgaatagtcgaacgcactcttgttggggaggatagtcttggattgtctcaactttatctagctgtgcaaaaaatcctcccgcaggtaaggaatttgggggtagctgatcattagataattttcctcgcacggcgaatgtcctctgggtctaatcagcataatttgcggattttgtgtcgtggcttatgcctatcacggctagcgagcgattttcaatctgattatattccgcaagtaggttttatgatcgagatagaacaatttttttgaatctctcgtggcccagaaactcgaattttcgctgaaacaaggcggccaaccgagcatctgctgtcgcgaagaaaacctgcttgcgcatactaacggcaagatcacgcagatagtccaggaatgacagcgcgttcaaatcatcaatgtgcgcaatagggtcatcgatcaacagcaccggaggggcagtttctgcgctgcggttcaacgctagaaatatcgaaagcgctaaagcggcacgctggcctgtactaacctgcgtagctgaatgcgtacgatgcccatctcgtgtgatgaggagatgctctccattgaagtctcccagcgtgtactctgctggagaatgaatcctggcgaatatctcgctgacatgtccacgtatcgactcaagagcttcctgcgttgctttctcgagggaatggttttcaacgatgtccgccagtgcgttaatggctattgtgagattgtccctccgggtcgttgcagccttgagaaggtcagagctctgttgaagctccaaggtttttgcgcttagctcggtgcgcgcttctgtttccatattttccgcatgcagggcacggtcgaatgcattaattgcatcctcgacagcctgcaaaatcggttctagtggttgttcttccgcaatagtaattaattgggcggcatcctcgaagaaaagcgttgaagcgtggtgtctttccaactgccgttggaccaaaagaatcagctccttggcgttttccgctgaaagtcctgttgattctgcaattgcgctcacctgtgcattcgtaagcttcaaagcttcgcgcacatcaacggcagattcgttcgtttcctctgtgctcgcctgaatctctgcgatgcgtgtatttatgactgccagactcgaataatcctgtttagtccccaaccattggattgcggctgcctctgcgccagagaaacctgcttgatcggccccatactggtcgagcgaacgcatggctgattccaggctttccagctcgatactcgcttcgatgaactcatgatgtttcacaagcaggctttgatgtaaatcgcgtacggtagtcgaatcctgtgcgccatttgcatcgtgaaagcgctgcaatacctggagcgcagctatcacttcacgctcttgttggacacgatctctagcaaccagtgctgcctgatgaagaccattggtgaagcttgaattgtcagaagaggttagcaattcgattttatgaagcagctccccatctaaatggggggtagagcagacagggcaatgcagtgcatcgcctgtgtgatcaatgatggattggacaagtccgcgtagatcagcacgaagggaaattaacgactgaccaagacgctcctgctgcaacaggctttcggaggctgatttctcctgctgctcagcgagagcgaggctgtccgtggcgacctgaagagcttcggagagcccacgaacggcatattcaacaggtagctcatggacgtcgtccaaagacgttcccgcgagggcgattcttgcatcagaaaccacacgcttggtctgctcaattgatctggcaagcgctggtgcaccggcctcgcagtagatcgaccatatttctagatcaccgagttcttccttgtagctctcaatcagagcttcatactcgcggagctcctggcgcttgtgtaggtctgactcttccagttcccgaattttttcgagcgcggtgagcaaagcctgcgcgctctgccgtagttgagtaattgtggcaggcgaggtttgtgccagattaatagcttggtttagccctcgcgaaagcgattcaaggcgagttcggtccgaggtagacaaaggctcattgtcaccttcttgaatccagatagccccgagctcacgcaaactcgcacgaaatgattttgcaaaggttgaggattcagtaggggagtcctgtaatcgcttgacctcgttacctagcagttcggtctgcttaagcagggaaggaatgcgttcgctgaaactcgtgcgcttcgccacggcgtcatcatgcagcttgtagagatcggtccaaagtgccgatgtttctccacctaccagcaacaaactcaggtcttgttttagtttatctggggtcgattcaccggagaggcggaatgcagcatcggtgtccaaaaagttgaatcgagtgaatgactgggcgagtgcgccagtatttggatttgagcgtccataccaggcgagattgcgcgccttaagggtggccggcaatgtggtgctcttaacagtgagtaattcaccggatgcagtgaggacgtccgcttcgatatttttgaatgtggcttcaggatcgcgacggatacgcccgcaatacaaggcttcgatggactcaagcaacgatgttttgcccgcaccgttctgtccgaatatcaaattcacatcgccaaactgaaactgttttccgctgatggccgatctaaattcgcctacctgaaaccgacgaatcaacccagcgctcagaggatcagagagtggctgaggaagcggccgcgttaccggaattgcatcggcactaaaggcttcccctgaaccgatcagttcgatttgttgggttcgcgcgcgtttctccaacaagctgctgagagctgccgcccttaaaatttcttcccattgaacgctagcatctgtggataccaatgcgctgttttgttgagtcgagagagtatcaaaacgaacgaggagatcctcctcagtaagcacaaactttctcgcaaaatgtcgatccccctcgatgcgtgcttttgcttccaaaaagcgatcgtcgatctgcgattgagggcctgcccaaaagtacagatagctgttccagcgctggtcgccatcagccgtgaagaattcacttccaatcaagccttcttgaaatttcgcaagattcgctgcccgctggatgacactgtctgatagatcgatgtaagccgttgcgaaggtttttccttggtagatgcgttccccacgaaaaatgccgtcgcccaagtcttgaacccgggagagtttttccgtgatcgtgtgacgtaacgaggctgaatcaaccatatgagggttccgtgtgatcgagcggagtaacagcgagaaattcggtcttgtcgtctgctgggtcatcgaagcgggttagagcatcaattcccgcaaacttgagttcaccaaactcccggtatgctatgcacaaccgcttttggtgggggccaccggcttggcgtagcagctcataaagtttgtctgcgatcatttctaattcgtgaggtgggggcaagtcacctaggtaagcgatgagcgtgggtttgttatctgatgtcatcacattgaaattaggatctgccgcgtcccatcgcaaaatagacgttgcatcgactccatccacctgcggaggccattcaacgcggttcagtatttcatggtgaatttgagccgctgtactaagtcgttgatgacgaaaatctcggttttcacggtcctgaacgacggtcaatctgcgcacgacttcgtcagggccgattttgcaagagtcgatatccttcagtgcgcaccaatttgggcgaccagtgatttgtccggcgcttaacgccaatgcacgttcaatggacaaggggttttgggtggcaattacatgctgcagcgctgattgtgccagcgggttaccagcagcaagcgcggcgaaccccgcatcaggtgtctcacctgctacccactcttgatttgcagttgcccatacgtatcgctgcaatgcagttgggccgtttcgattggccatgattgcctggccaagggttaacactttcggtactcgtagctcgaacaccgcttcgtcatagtggaaaacaagagcgtggcgtcgctcggtcatataggcgtagtagaggcccatattgtgattcggtatgacaacctcatcattggatgagcaatcctccgcagagcagtaccacgtcgatgcagcggcgttccgccaagcttcgggagcggttcccggggggccgtattggacgatggactgcgcccaatttaggcagacgatgtggcaattactcgagcgcgggtctgtgttgaatgttgtggtgcgatagtttcggtatgctgcgttacgcggactgggattgagctgaatatgaatcagcgtagagcgatcattgaagtcagccagccattcatcccttaacgcaaaggcatcagagcagatgatcacggcggcggaaagacgaccactacggccgcgaaacctatagatctgagttcctcgacgtaaccatcgttcttccagaaatagggcgtctctagaagggaatgttttgaattgaacaagcgcgaccagtctagaagacccatctggtcgtgtggcctgaaacatcaaaactacaggatcgaagagatttcgatcgatttccaagccttgccatggctcatgaataactaagcagtggtctgtaacgttccgttggaattgcaccagcgcctcttgggtgatgctttcgcagcccaaaacccagaggaccccttcagctggcgtgatgccggttattatagcctcttccagcgttgcccacggcatgaagtattcaggcgtgacggcaaggtgcgcgcctctttcacgcgccatccttagcatcgacaagctcttggccctggcgaggggcacatcgtagttaccaatgcgctgctctgaggcaaaaatcggcccacagggttgcagcagtaagcacgtgtagctggcctccgtcggccgcaacatttctaggtcgggctcttgaagaccgtgttccatgagggctaacgatacatcgcgcgtcggcatacttttttgtcttccgtgagtagcctcaacaatagccgcaaaatggtggtgttgggagtcagtctggcgaatgaatttttgccgaacttcagcgtaaacctctcgcatgcggagcgtactcagatcacttgacccaatggatcgggtaatgatttttgcgtagaagaacgctgagccggtttgcccgacctctgctgcgaaagacttgacctacgatttacatttttcgaaatacgaccaagctttctgctaattcttgctttccgccttgctgtggggaggctcgcatcgagcgaaacgcctcaacgtttaccgcttcaaatccacagacgggtgcgagctcggccaggatcgtggctacgggaatgtgaatgttggcataaagactgtcccccacaaccgcccatgcttcaccctgagggttcaagcgactggccaaagacttcatcacgccggccatatccgcaaaatagccatcgaccatgttgggaatccatcgactccaaagcaactcacgactagcatgcagcttctgcgatacgtcattcaacgttgccgattcaagtgggcgcggtgcgtagttgcgttgaatctgaacgtgggaggccaatgtcgactggcgcaatgagcggttaccagcggagtcgttcaggtagcccagcgcccacagttcaacgttgtatacatcggtgtaatcgaacgaattgggatagggtggcgaaaatactgcgagatctgccataggcgcatccgtaatcgtttcgcggcaatcaccacggatgagggtgtacttcgacacggggcgagatgcatagcgggcaatttcgtaaagcgctttttgcacccggttcagaaactgctgatccaccgtccccgggctgtgctttcgtaactgccaattttgcctgtaacgacgtcctttgccgctgatgagcacgttgcttacttcaatcagaaagcccccaaggatcgccctgaagaacatctgatgggtcggattggctaggctggcaattgctgtacggtaggactcgattctctgcgcgacgtcatattcgaacagccaacgtttattgacgcctggggctacaaacgtggctggtagccagctcaagtcgtggtcgcctcgcatgctgcgaaccgcgcgaatgatcaaacccaagtcgtgagttagggatgtgctgtcataggcggaaagtttcgcttcgatgaggtcagccagatagggatttacctccatggtaatggggtcaacgcctaaaaactggcaggccaaggccgttgttcctgagcctccaaaaggatcgatacaggtgcgaacaggaagttgactctccctgaccgcccgggcgacgagttctggcgcgaatgcttccttgaaatgccgccaggtctgaaagggcagtttttctgcacccgcattcgtgccaagtgtgttgattttgcgacctttagtccattggtcaaatgcgatctgcattcgctgtcctctctcatctaaaacgaattgccatggtcgaaattctgatgctaaatatacgcatattttaaaataaatatgcgtatatttatatgatccgcaaagacgctgcgcaagacgtcgggcgctcgctcgccaaatttttcaaacgcaaaggcttgacacaggcacaggtggcagagtgctatggtgtctcgcaaagttgggttgggcgggtgtataagggagagttcggagtacgtgctgaatccgtccagaaaatgtgcagcgacgccaatgtttcattcctgacagagtttccagaacatgaccaagtcaatacatcaatcaggcttcgtcttgctcgcctcctagacagtgtatgggagggaacagaagaggatgcgaaggtactcacacaagcgctgctggcaatcaagacgttacgtcgcagctgacggttcaggcttcgcttgaacagcatgtatatagggagataaatgtgcgttccagcatcagccttccagttattgagcggttggtaatccgaaacttttcgctctacccgggcgagcacggcaacggactggatgtcgctttcgacaatggcatcagtgtcattgcaggcatcaatggtattggcaaaacgactttgctgaccttattgctaaggttgctgctcgggccgagcaatccggaaaaggcgaccaagaatgtcgggcgcgtaagccagcgacgtcttgtggaaccgaagaaatttgatttcttcgcgagtcgggttcctgaaaaattggacgatgacgcctatgccacgctgcacttcagcgttgggcaacggaaagttgaagtttcgcgatacatgcgagatatgcgcctaaaaggcgtaaaggtttccgggcgcaaacatacgccggcaagtgagacagagtttattgaagagctagccgctatgagtggtgtgttgtcggcttacgactttcacctggtcgtcagatacctgcaattttttggggaggatcgtttaccgttgctttgggagccggcggctcagtttgaattcttcaaggtgcttttttttgacgagtcagtcgccgatacattgaacaaactgttcgcaatgattcaaaaaatcgactctgaataccgcaatagaaccaatattttaaatcgcagaagaagtttgctgccttcacccgagcgcccaacggtggcgatcgaggttcagacaactcaaggtcaactcaaagaagccaaggtggcagccgctgaggccgaagctgagtacgtgagtttaaagctagagttcgacatgttgcagcgcgagcaaaatcagctgctgcttcaagccgatgatggccaaatcaagctcgccgaacttgaggcccaattctcgcaggccgacgcgaaatttattcttcaagctttgcctacgcttggggacaaggagcgttttttgatgcagggctatgccacgggatgcggctgtttcatctgtggtgcaaagtcaaaaaaactgctatcgggtatcagcaagaaaatccgcaaaggacattgcttcgtctgcgattctcaaaccccggcctcgaccccagcagacgtcattcccataagcgcaaacgagattcataaaatcgaggcggaactggatgctattcgaactcacttggttgcgagcgacgtcaagctaaatgatatagatgaacgtactgccagaatcgcaccgctattaagatctgccgcgaccaagcgtgcgcttactctacaagccgtcgaagccttggatatgttgcggcccactgatgatgggcagcaggcctatgacgtttattcggagattgaccgagagcaagcagagttggatgtactggctgacaaccgcaagcgttatacatcggaataccgagcagccgtcgacaatgcgcaagaagagatgtccgcacttaaggctgacctcgaaacacgcctgacgaattacgccatggagtttctacaggagcgtgtcagtgttgcgttcaatcgccagacaccgttcaagatcgccactggcgcagaccgtgtcaacattcctgccttcaccgtcaagatgacttccggcacccataaactccctagtgagcgatcaaacagtagcagtgtttccgaatcccaaaaagaatttcttgatctggcatttcgcatgactttgctcgacatgatcaataatcaaggccagaaaatgctggtgattgagacccccgaagcgagcttagacagttggttcatgcgtcgagcggcggatctgatgcgcagctttgcgcctgaggactctacggcaccgagaaaggtaattgcgacctcaaaccttaatggcacggagatgattcctgctcttttaggcctggtcgacgcaaagggcacgatttcgaagctaccgagtcatcgatccaaccattttataaatctgcttgagctgaccccttcgcctgcggcgcttgccgaaagtcgagcggcgcagctgctgcaagaagagcttgggagattcttggatgctaagtgataaggcgcttcttaagcgtgattatgaaaagctacagtttgtgaggtgggtacttttcctgatcacagcggcagaatctgcaggattgaactcattaagccgagctagattgcatgcgctgttgttcatgtcttttgcctccgcgcggttttatggattacagccgttgcgccagcgtgcgcaacgaactcctcatgggccttattatcgggcagcccatttggccttggggcatcttgtatttgccgatcttgtcttcgtatcagactttaaggcgcatccgtcgcctaaggatctgcaatttgacggggtattcaagcttacaaaaaacggcttgcaggtctgcagggcgcttcgacaaaccgacatgggtcggagaatttatagtttcctgcttgatatctgtcttggcgcggtgcaatcactagaggcggaaggtattccggaggaaaaggaagaccaatcactcgagcggatgctggttcaggatctaacgtatgtatctgccttaaatcggccgggtgagatgcttctgatcgaagaagacggcagcgaaagcacgccgaccgtagaagggctcaagaaaattcaatccatgcttagccagaaacttcttatcaacagaaaggacgtgctgagtgcctatcagtcgattttgcaagttcgagcagaggtggcatgaatgaccattgaaccgacgttcacttcctctgagcaaggccatcttgagaggcttcgccctggcaactctggcagtccggaagatcaatttatccaagaagttatcgatttctatcgctattggcagagcaagcggtctcttggtgattacggagacacgcagcaggcgcttttgatgattttttcggaggctccagacgtcgactgggggctaaatgattatgtccccacaaaaacctcagtgataagaaggcgctcaggtacggtgagccaaggcatagccatttgcaatcagaacttccgcttgatggtaaaactgcacgacgcattaaccgtcgatgaggcgtatgacttcgttgagcgccaccttgctgaccagcacacgttcgtaattgccaaattcggccagcaaaccatgcaggtccatcgtgcaggccagccgctggacgactggattcacaccccggatgaaattgtgatcaagaacacggatgagcaaattacgccggacagcttggcggaggatctacgcctctttcaccatgaatggctcagcactccgcttgctattggtgcgcgaaacatgtgggagctgaatgcgaccaaaacccaatacgaactgcgcagttggccagaacgtaatgttcagtcgtacttattgacttacttgagagcctcctaccgaaaatcaggagtgtttattaatgaggaaattagtaatcagggagggaggacggatttgtatgtgcagcgagaaaccagcccaggttcaaataagcaagtcaatacagtcatagagttgaaggtgctatcatctaagaagtcgtttgaaagcaatctacaatgggcaaaggatggggtgactcaggccaagggatatgcaaatgcgaataccgacgcggctttcgcatgtttatacgatgctcgacgcaataaacttgctatgccagatctgccggattttgcgcaggctagctccgttcggcttgagcactacgagatggcggtgccgctcgcgccggcaaaggaaaaacctgccaagctggccaaagcgcagaaagtatctgcccagaagttggctaaaactgccaagggtccataagccgcgctacagtctgcccatccccgatattgggtggggggaagccgatactatatgagcaaacaatagcggcttcgattagtgtcacaggttctgttcctcgtcctgtatcaagaaggcaattcagccatccactgatgtgggaggcacaactccagcgagcgcagaggtgccggctgttacgactgccggtgcatcaagatctgaaagggtttgccgaaagggtctattgcttgaagaacgatgatcgtaggtgagacggattcaagggtgtactcgtcggacatgccattaggaaaagcgtcactcagtactggagatggcttgcccgaaagtttttctatcaactctggcttaaaatctatccctgcgacctcaatagacttcgtcgtcgagtgcatattttgcatcgtgatagacatccgtttgctgtcggcggtccagttgccagcacctactatgttgtagctgaacttatagctttgccccttgaacttgccctctagtgaaataacaccggaaacattgtacttgccttcatggaatagcagcgtgcggcctttaaaactaagggttccattcgttattgggtaggagtaatcgctgtcccagcgcccgacgatatgcggattgaaattgctgatggggttgaagatgaagtagacggcaacgatacctgctaggctaccgaagaaagagatggtagaggccacgactttcatggctggggaaaggcttttgaaacgagcaacgagcatggaaaagtccttcttaacattgataaatgatcttcgggtatacaaagccaggtcactgagctctatttatatattttcggctaaaagcttgattgctgtaggcaaaaaattttgattagttcgagttttgtctaggcaacaggcttccaacatcctaggccgatgataattgatgtgtacgacgcatgcaccggtacacagcgccatcatgggaattattcctgaagtgttgatccacaaaagaacttcgcggtctgtcgccgcacgaactgctctttttcacgcatccccaaaccacaccaaataacggatgcccattagtcggtccgctttgtgtaatcgctgaaagtctcgttccttgagataccgagcctactcccgggcaaccctgaggaacgcggctcttccggtgagagccgctctatgtgctacgttcgttggtttctgagcacgcagccttctgccatacgtattgccgacatttcaacggtgtcaattcagtggttttatggctttcggacagacgtttcaactgagagatggactgtcgccatcacatttctctgcgcacgctttacagaaaatcaatcagttaggagaacttttgtatcatttatttgaaagaagtctcatcttttttgaatcactacaatggctgtttaaacggctggtgattgccccgcttaataggaagcattactattcacgccccgcctccccagtgctcacgcgatgatccctcagccgccccgcagaacaggctttttcgagcattacgaagagttgatcggcacctggacccgccgtctgagaaaccgtcagcaggctgaagacctggcccacgacaccttcgtgcgggtgcttgagtcgcgttcgagcgaggttgcgcaaccgcgcgcctatctgcatcaaacggcgcgcaacatcgccgtggatgcctaccgccgtgaagaccggcgcgaggcgctggcgctggatgcctttgagcacagcgcgccccacagtggcgacccggagcatttcatgcacgcgatccagttggcggactccatcgagcgggcgttggccgagctgccgcttaactgtcgcaagatatttatctggcagaagatcgaggggctgacccagcaggaaatcgccgtgcgcctgggcctgtctaaaaacatggtggaaaagtatatgatccgcaccttgcggcatctgcgtgaccgcctggatgcgatggccccatgacccgcttagatgaaacaggatcttccatgatggatagccgtgctcgcgacgaagccgcgcattggtttgtacgcctgcaggacgccgagttgagcatcgaagagcgccagcgcttcgacgcatggcgggcagaacggcctgagcaccaatatgaattcgacgtgttgcaaggtttgtggagtgccactgacctgctgcccaaagcccgattgcaagccttgtgcgatacgccggtcgagcgccccaaacgccgggccattttgcgatacgccgtcgccgccagtgtggtggcggtcgccttggggctgggtttgttcagcgggcttgaacacccaaaaccctacagcgccgagttcagcacgcgcctgggtgagcatcgccaggtggccttgcccgacggttcggtgatggacctgaacagccgcagcgtggtcgcggtgcactatgaaaagggccggcgtggcgtcgaaatcaaacagggcgaagcgatgttcagcgtcgagcacgacacccgccggccatttgtcgtcgccgccggggcagggcaggtgacggtcaccggcacgcgctttgacgtgcgccgcgatgatgaccagacccgcgtggtagtcgaagctggcacggtcaaggtgcaggggcgtgcgtccgatcagatcgtcacgctgacggcgggccggggtacgcaagtcgatgccctggggcacgtcgctgccgcatacgcggtgaacaccgatgaattgacggcctggcgcagcggcaagctggtgttcaataacgccagcctcggtgaagtggcgcgggaagtgtcgcgttaccgcgagcaaccgttgcgggtcagtaccgctgcggtgagcaacctgcgcgtgaccagcgtgttcaaatccaccgacaccgatgccttgctcaaagccttgccgcatatcctgccggtggccttgcgcaccttgccggacggcagccaggaaattatttcgcgctgaggttcaggtttttttcgagttcttcgtcttctcctgcaactgcaactggtttgcattaacagccgcacactcttgcgatcacaggattaggctcgacgtgaaaaaacttaccgtctccaacaataaaatttcccgctgggcacccttggccctggcgcttgctgtcagtgccgctgtgcctgccgcctatgctgacgacggtatccatatccgcgcccagccgttgggcgcggcactgagccaactgggccagcagacgtcgctgcaagtgtttttcagcccggacatggttgcaggcaaacaagcgcccgccgtcgacggcaacttgtcgcccgaacaagccctgcgccaactgttgcaaggcagcggcctggattaccagatcgatgcgggttcggtcaccctgcgcccgctgagcagtggcactggggaagccggctcgccgctggagctgggcgttaccgacgtcaaagtggtcggcgactggttgggcgatgcgaacgccgccgtggtgcaaaaccaccccggtgcacgcacagtggtgcgccgtgaagccatggtggagcagggcgcgatgaacgtcggtgacgtgctgcgccgcgtgcctggcgtgcaggtgcaggagtccaacggcaccggtggcagtgatatttccctcaacgtgggcgttcgcggcctgacgtcgcgcctgtcgccacgctccacggtgctgatcgacggtgtaccggcagcgttcgccccgtatggccagccgcaactgtcgatggcaccgatttccgccggcaacctggacagcatcgacgtggtgcgtggcgccggttccgtgcgttacgggccacagaacgtcggcggcgtgatcaacttcgtgacccgcgccattccggagaaattctccggtgaagtcggcacgaccttgcagacggctgaacacggtggctggaaacacgtcgacaacgcctttataggcggcaccgccgacaacggcattggcgtcgcgttgctctataccggcgtgaacggcaacggctaccgcgaaagcaacaactccaacgacattgacgacgtgatcctcaagacccactgggcgccgaccgatcaagacgatttcacccttaatttccactactacgacgccagcgccgacatgcccggcggtttgacgcagaagcaattcgacgccaacccgtaccaatcgatacgcgactacgacaacttcagcggccgccgcaaggacgtgtcgttcaagtacatccgccagatcgatgaccgtacccaggcggaagtgctgacctattacaccgacagcttccgtggcagcaacatcgccaaccgcgacctgaagaccatcgtctcctacccgcgcacctattacacctttggcatcgaaccgcgggtgtcccatgtgttcgatgtgggccccagcacccaggaagtcagcctcggttatcgctacctcaaggaaggcatgcatgagcaggccagcagcctgaacctggttaacaacgtgccgacgccgggcgggcagaatgacgggcacgtctaccaggaccgcaccggcggcactgtggccaatgcgtactatatcgataacaaaatcgatatcggcaaatggaccgtcacgccgggtattcgctacgaaaatatcgaaaccaattggcatgatcgcccggtggtcgccttgaatggcgtacgcaccgtggaaaagaaccgcaagatccaaagcaacgagccgttgccggcgttgagcgtgatgtaccacatttccgacgcctggaaactgttcgccaactacgaaacctcgttcggcagcctgcagtatgcgcagatcgggcagggcggccgggtcaatcagaccgccgatggcctgaacccggaaaaagccaagacctacgagatcggtacgcgctacaacgacagcgtctggggtggcgaagtgacgttgttctacatcgacttctcggatgagttgcaatatgtgagtaacgatgtgggctggaccaacctgggcgcgaccaagcaccagggcatcgaaacctcggctcattatgatctgtcgaacctcgacccacgcctggacggcctgaccgccagtgccggtttcacctacaccaaggccacctcagaaggcgatgtgccgttcaagggtcgcgacctgccgctgtactcccgcgaagtggcgacggctggcctgcgttacgacatcaaccactggacccataacctggacgtctatgcccagtccggccaacgtgcgccaggcaccggcaccacctacatcacccaaggcactgccgacggccagtacggcgatatccccgggtatgtctcggtcaacgtgcgcagcggctatgacttcggtgcgcaactgtcgaacctgaaggtgggcgtgggagtgaaaaacgtcttcgaccagcagcactacacgcgctccagcgacaacaatgccgggttgtacctgggtgagccacgtacgttcttcgtacaggcgagcgtcggcttctgaccggtcgttgatacgaacaatcgcagcccaagggctgcgattttttttgcctgtttcctacacaccttcgagctactttctgcttgatcaggaacctaatccgacggaaacgccacacaggggcagacctggtcgacttcgatgtcagcgtggagcgacaggttgataatcgcaccccttgccctggaggcacttatgtcggtatcggctaccactccatctgtatctgtttcatccagcgcggacaccccgcaggttgattcaaagtcccacgccaaggtcaatgttacggcgtcgactgcgccgtcctaccacagccacaacgctggaggcgtcaatttcaatgcatcgcatagccagaatgggccggtgtttggtcagccacagcaggcagcgagtcatcacagccacttcaataatcgcccggcccagaatccagatttctctgcaatgatgcagcaaggctcacatcagagctcataccacgcctcacaccacgcttcaccccaaggcggcacgcagcagcaccagcaatgggcaaacccttggttgggcaggcccaagccaccgactaacgctcatggcccctacccgatcacgctggataaaccagaccctatctactcgaagagaagcgacgatcaactgttgaccggtattctaagagacgccagggcgtatggaacgccgtgtaacccttcgactttcagcaggagcgctattgaagaaatggcgcaaaaagaattgggtcgcgaccctgcaatgaatcgagcaattcgcagcgccaaggaggctatgaggcgtcccgagacgatggatgcctggttccggcagggtgatccggcctcaatcagcgatctcagggcgttcagccaaaaccccaaccccttgaaatacatcactgataagcaagcagtccaggagctgatcagccatttcaatcaattggcagggggcttcggtaaaagcgaaatcgatctcaatgacctcaaatatctggccggtctaaaacggacgggcgacacttcaatcgaccacctacgtaacgtgagtgacaggaccgtcaatagcccccgtttgacgcgcatattggatgaactcttgagtgactccggggacaacaaattcagccaggcggggctcgtgttggcgtcctacgtgattgcataacgcatagcaataaggcgctgcgaacacttggcagcgcctcgtgcttcaaattgtgcaaggaactatttccacacactcgccactcaggaaatacctatccagcggctttatcggagccggtcgccttttcagaaactgaatcagggccaagacatgacctcaacttcgtttcaatcctgccaaaccgtcggctgtgacgcttttcccagcggccctgacgttgatcgctcaacatcccaggaaagggacgcggcgtcgaatgacgtcttccatgccgccttgtcgaacggatacgccgcagaaacccagcgaatgaaagcctatgccggccagcgtaagttccgggcaccggtggccgctgatttcgcccgcggcatggttgccccaggtcctgccggcgacccggatacccaggcgtccaggcactccaatagcgtgtgggccgcattgatcaatggccttaccgcatggcggcgtgggtaaacgcctgtctgatccgcctgctcacttttacatgctgtcatgggtatccagcggttgcccggaactattgagttcaactgaccacatatcggttgcttgctacccgggaatcgactcgaagatccaaagcgcctttgtggtggctttcaggcaagcatagatctggaaaaggtgggaactaacacatgaaaattgacagtgctgtatcgcgcgggcagtcgccggccatggaccggcctgaggcatgctggcctttgtcgtcgcccgttgcacacccgccttgcgaagatcacttcagcacgcgggatgtgcaacgccagccatcgtcgttgcgcacaagcgcgtccttgctgcgtaaccagttcttgcagaacgcgccgattgctcgcgtggacacaacccctccggggccgaaatcggcggataaggttttgttggacgtgttggcaaaagacttcagcgatctgtgcatttctctaggcatgacccagggcctgacgcagtcggccttgctgaaaattgcagctcaaccgttgcggggcgattaacgtgcgggaccgtgtgatcctggcagtcagggagattctcaaacgcccaaggttgaacgatgcgatcatcgacagtgacgggtatatcacccgcgacagcctgagcgccgccgccgcagccttgcgcggtaacagctcccctgaagcctttagccaggacccttttcatggtcagggcaacgccaaggtcgtgcaggctctgcaaggctatttcaagttattgagggataaatccaaggaccgcacggttttttttgaaacccttgaatacatggaaattgcgctgctcaaaaacgtgatgaatgaccccgatgacagcgactcacaaggcctgcccattctggatcccgcgaccgggctgcccgcaaaaaagtacagcgagcactgtgtgtacacagcaaaaaacatcattgaacggccgggtttattgcgatcattgcagcgtgtcaacacgctgcgcttgtttggtcgcccgaaagacgaagagtggctgtgcaataaaagcctggggcgctggctggagcaacacgaggcacacaaggcgaggtagcgacccggccttgggcgctgagcggttcacactttgagaattttgccgctgatggctacaccggccagcaacagtgcaatcagtataaaggccgtgctcaaactgctgccgtgggcgataaaaccgatcacggcgggcccggcgagaataccggcataacccagggtggtgatggccggcactgcaatatgctccggcatcaccttttgcttgcccacggcggtgtacagcaccggcacgatattcgaacaaccggctcccaccaatgcataccccagcagtgcggtttcccaggcgggcaaaagtgtcgcgagcaacatgccggcagtggccaacgcgccaccaatcacgatgacgcgtgtggcgcccaggcgtcggacgatggcatcacctgtgaggcggccagcggtcatggtcagggcaaaggcggcataaccaagaccggcgtaagcctcatcgaggccacgctcggcactcaggaacacggcgctccaatccagcacggcaccttcggccagaaacacgatgaagcacaagcagccaatgaacagcaccacgccttgaggcacggcaaacgccgggcccgagctttcactgccgtagggcaacaaatgcggcccggccttgagcagcgccgccgccatgatgacaatcaccaccagcgtcgcctgcagcggcgacaggcccagccccagcagcccggcgacgcccgctgcgccgacgatgccgcccaggctgaacaagccatgaaagcccgacatcatggttttgccgctggcgcgctccacaatcaccgcttgcaggttgaccgtcgagtccacggtgcccaggcctgcaccaaacaggaacaaaccggccatcagtaacggaatcgaactgaccgtggcgagcatcggcagggccaggcagatcattatcgtgccggccgtcaggacacggcggcagccaaaacgtgatgccagcgcccccgccacgggcatggcgatgatcgaacccacgcccaggcacaacagcaacaggccaagcgtgccctcattgagttgtgcgcgagctttggcgtagggcaccagcggcgcccaggccgcgataccgaaaccagcgatgaaaaatgcaatacgggtcgacatttgctccagccgcccgggaaccacgggcgctggggtggggatggcagtcatgaaaaatccttggttttgcgttcaacgaacgatgtccggtgcgacatccttgcacatcaggccttgtcgagcgaattgggttcccaggcaatagggatttgcgtgcaggtcggtaattttatttttaccaaaagggaacgagagggtgtcgggcgaccacataaagaatgtcgggcaggcgggaggtggcctggaaagtgagcaatccccgtgagaactggtgaaccccgggcgtcttgcggcggattgccactttccaggccacctctgaactgtcctcagattaacgtaggcaaatacgcccgcacttcaatcacatcggcgtcctttacccgaaccagcagagtcccacgaggcgctgtttccctgccgatgtagctctcgagcgcaaatgacggctggcctctgcgcacactgtcgcagaatggaaagaggacggcgttagctcgactgcgcacggacttcggcctgaagaaaacgtccatccaggggaaataggagtgttgggggcgcccggtttttcgacatggccaacgggtggtttcaatcgacgctatcccacacaatcgcagagtattttttctttttaatgttcagcgacgacgcctgtggatgaccccatgacccagttctacgatgcccgcggcaatatctatggcgtgatcagcccggccttgttaaggcgcgcaggcattgacgtgccgcacagcgccgctcaggccgcgagcactgcccaggcctgggcatcgttggcgattgcgtctgagtgtggatggggcacgctgccgcgtccggcggatgcgaaggcgcaccgctgcgatggtttgttggtcgggccgttcgacggtgcgccgccgtttgacctgctcatcgtcaataccgatggcacactcgccgagcgcagcggcaacggcttgacgatttttgctcaggcgctgaccgatcagggcttgatgacgcagggctgtgaattgcgggtgcatcacaacaaacccgataccgcgtcacccgttgcaacgtttgtggaacctgcgatctacgaacaggttgcggggttctggctggccttggggcagccggcgttcgggccttcagcggttggcgctgagggggtggatgggcgcaatcgtggcttcagtcatgtaccgcccctggctgtgatcaacccgcaatgggcacacagccagtttgtccgtgtcggcaatccccactgtgtgacgctcgtcgagcacgcttgggcgttacctgacaatcaggcgatgcacgagcgcgccctgtttgaagcgttgcaggcaattgcctttgcgccacctgtcgggtgcggccaaccctgtgttgccgggatcaatctgcaatgggccgctcgctcttcaggcaatcaggtactcgcgcgggtgtttgagcggggcgagggcccgactgcgtcctccgggaccagcgccagcgccgtggcctgtgcggcgtggcgggcaggctgggtcgaggctggggacgtggccgtggtcatgccgggtggcacggcgccggtacggttgagtgttcaggccgaaatattgctgagcgtcagtttattcgggactgcacgaccgcaagcctgaatgtgcaagtgctgctggactcctggatgagtgtcagccgtttctcttcaagatacttatgcgtgtcctattaacgtaggagttttcttgttgttggtagttttaaaaataatgccttgtcttgttttgcaaaagacacttccgaccacgccgtacgaatcttcttttttatttttgaaggcccgaatctcgcctgaaatcgctaagattcaatgcattcaggcgcttttttccggcagttaaatcaacgttcgacggaggaaagtctttcagtcaaaacgtgaagacgggtaactaaggatggttggcgattttgttttgccgcgatttaaattgatattttccgaacaaacttttacagaattaaatcgtgactttcaggtgctggctttcaacggcagcgagcatcttgatcagccctactttattcacctgcagttagtcagtgaagaccccgccctggatctcgacgcgctaatgcaccagccggtctatctggatttcggcgaggcggatacgggcctgcatggccaggtctacgccattggccgggatgatcccggggggcggttcacccgctaccacctcacgctggcgccccgcctggcgtgtcttgcccatcggcgtgaccaacggattttccagcagcgcagcgtgccgcagatcatcgctgccgtacttgcacatcacggtatccttgccgatgcctacaccttcgaacttggccctgtggtctatccgccacgcgcgttctgtgtgcagtacgcagaaagcgacttgcactttatccaaaggctgtgtgaagaggagggtattcactaccactttcgccacagccgggataatcatctgttggtgtttggtgatgaccagactgtgtttcggcgtttgcctgcgcagcattaccgcgcggtgggcgacttggcggctgatacgcgggcgatccggcgcttcgatgtgcgcctgcgaatccgcagtcggcaaaccgtgcgccgcgatcgtgactttgaacacccttcgctgcgcctgcaggaacaggccggtgcagcctccgtacacacccttgaagattaccgctaccccgcgggtttcaacggtcacgcacgtggcaagcaactggcacgccggggtttggaacgtcttcaaggcgattgccttcgagcactgggtaagagtgatcaaccggcattaagcagcggccactttctcgaattgcgtgatcacccggatccagcctgcaacgacctctggttgataaagtcggtacgccatgagggttatcaaccacaagtgctggaggaagcggggtttgagcctgctgcattccagggctatcgcaaccgattcaccgctacgccatggcgtgcggcgcatcggccgccgctcgaacacccaaagccgaccattcatggcagccagaccgccacggtgacgggccccgcaggcgaagaggtgcattgcgatgcctacggtcgggtgaaagtacgttttcactgggaccgcctggatacaaacgatgacagaagcagttgctgggtgcgcgtggcttccggctgggcgggcgatggctttggcgcgatgctgattcctcgggtgggcatggaagtactggtgaccttccttgaaggcgaccccgaccggcccttgatcaatggctgcctgcccaatgcatcgcacatgccggcttatcccttgccgcaatacaagacgcgcagcgtgttgcgcagccgcagtaccaggggcggcggcggggctaacgagttgcaccttgaagatcgtcacggcgaggagctcatctacctgcgtgcccaacgcgacctgcaacagcacgtgggccgcgacagtcgtatggaggtggccggagagcgccgtgaagtcattcggggcccaagcacggtacacctggaaagcgaagagcaccgtcacaccacgggtgatcgcaatgttgtgctgaaagccaacgatcgcttggatgtgcacggcaacagcgatacctatgttcggcagaccctcgtcatcgaagccgggcaacagctgtacctggaggccggtgccagtctggtgatcaatgcgggtgcacaaatcagcctccaggcaggcggagaacatgtgctgatccaggcgggtggcatcttcagcagtcggccaattacggtgggaggcttaccgcccgcaagccgctcgacggcgcctttttctgctgcgattgccccgaagatgtcggcggcgcagggcgctctcatggcgcaggcccggcagctgggcgctgactattgcccggtgtgtgagcaatgccgcgaaggcctgtgcaatatcccagggagggctgcttgatggagagtatgcccggccgttggatggcccgacagcatcaggcggggcgccgattgtgcttgatccttgacggaaaacacgccgcccgggagccgttgttgacggtccgccatttgccgcagtattgctgtctctacgctgagactgctgtggccgagctggcctctaccggtccgataatcctgctactggaccagttaggggagcccgcgctggtcgagttgctgcaacacccgcagacgaactggggctggctgtgcagtctgccgggcgatgatctgcaaggcctggctcgacactggcgcgaacgtctgctggtagggccggcaggcagccaagcggtgtatcgcattcacgataaccgcaccctggctcgcgcgctggcccacttgtcgatcgatgattggccggtctttctcggcccgctgatctctgtgtactactggcatgaggaccgctggtgcgagggcgaaaaccccgcaccgggagagtacccggcgcctgtgcctgcgccttggctgaacacgcccaacccccaagcgcaagccatcctgcacgccaacatcctgcgctacctgctgaccgaacacagcgaaggtctcgccgcgctagtcgaatttcaagaccccaggatctggctggcccaggtgttggaacaagcccgagcctggcagtggcgcgggccgcagcaacttgaattcctggtggtacgcaggttggaggaggcgacgcaaaccagcgggattcgctggcaaccgatgcaagaggaagcgcccggcgatcatttcgaaagggtgctggagcagtggcgaaggttgagggaaaaagtatgagcaggtgcatgcgtggcgcattagctgtgctgggagcggcatggctttcgggttgtgcggtagggccggttaaccactttacgttggaggtggatttgccggcgcaatttcgatttgttggcgcggcgaattaccgtcccgccagatatcaactctgcaagttgccgcagcgacggggtaaaaggcctgaacgaaaaatcattattgctgattacaaacccgtagccgggcgggtgagttatgacctgccgttgactgaaaccattgagggctgccccacggcgctgcgcagtgtggagttcgatttttatgcgaagtggggggcacgcagcactgatgtcggtgggtccctggggggtatctactttacagaccctattgaatccgaggatgtagcgggggtgccagcctcgggtgtgcaggagttgcgtgggcaatgtatgtggctttttcgcacggtcgggcgggcgcatacgatcaggaaactgctgagatgcagggcgttggacgagagcgggcagcggcaaaaaatgctggcgggtggggttgcacaacgagctctgctaccaggaaagacactcaggctggtgctgacacttaccgatgaggaggaaccggcttttgaccgacgatggatcgctgtacccggcgggtggaaacgctgccgagggacgagttttgaggatctgcagggcgcttgcgacgacgatgcacctgagtttaaaccgataacgatgccggatggacgcacctgtgatgtctatcccacgtgccaataacaaggagttgagtcatgagccaggacgcatggaagcaaccttttttcagtagcaagatgcctgcttgtgcattgaaagggcattgggcaagtttttgtctggttgatgaaatgggcagcgggaaggcgtacggtgggcttgcgtacacggtccacgacagcgcagggcagcagtaccgaggaagactgaccggcgaggggttcgccaagctacaagggttttactgcggtcccgtcgttctggttctggagcggctgtatgctgggaaagaggcgccgtattttggattgagcgggcgcgagacttacaaactacccatcaccgaactccaggtccgtgccgaacagacccgctttttcgctgccgatggtcaacgcactgagagtaacccggcacagcatcaagcggaccggttttatcaggtggaagtacgcgatctggtccgacatgttgctcacctgccgccattggcgccgcggacacatcaacctcaacagcacgcgctaagaatgatggctgagttggggtttggtccgcctcaaccggcattggcgggcgtggtgctgtttcctaacctgcacacggtgctggaagtacgaccgttgcgcgccctgcgaccggtgctctgcggtgatgatcaattttgtgccctgaacctgtatcaactggcgttgatgtccaccttgagttactgcgactttggccaggagcctccaacccgacccgtggatagtgtcagctttcccctggatccaagcgtggggaatgtgttcgccgaaaaacttgccggatatcaggaagcctggaaggtcgaccgtgagcaggttcaacgcttttacccgctgtatgaggacgttccctactccttgcgttttgaaattgtgcccttcgatccgcagttgtatccgcagaaccgtttggagcttggagacgaacaggagcatcctgctggcgtgcactttttcgacgataaacagttcggcactgatacgcaggcgtttatcactcatcacgaccaagtcatcctgattgcggtgcgaggcaccgccagtggcgccgacgcactgcgagacgccaatgcccatcaggtgccctttggcggcggagtaggaaaagcccacgagggcttctatcaggcgtatcaagcgatgcgcgatttcgtcctgcactacctcaatcagttccacgacggccagcgcattgtgatttgcggccacagcctcggtggcgccatcgccttgctcctggcagaagggctgcgccgaatctccggcgccgactacaacattctcctttacacctacggtgcgcctcgcgcggctgactccgagttcactgaaggcgcctcgtctctggtccaccatcgcatcgtcaatcacaacgacccggtacccagcgtgcccgctcggtggatgaataccaccgccaaactctgggttcccggggccgtagtgctgttcagcgcgcctgcttcgggaggcttgttattcgccgccgggctggtgcgcgtcggtggcaacccttaccagcatcacggagagcaacagcacttcatgccgatcaagctcccggatggcacgcaatcctctgtgttatggaagcccagttgtgagtccattatcgaggccggttgcaaccaagcgttgcagctccacggcgacatgcctgaccgcgccaacctgttgaaacagctgttccaggccaaccagcacttcatgaccgccagctacattccggcagcctgggccacgttgcgtcgctggcaacagaccgtcgatagccagggacctttggtcacgccaagggaattcgagttgatcgaccgtgcgcttgagaccatgactcagcaactgcgtgacaagaaccgtgagcttgatcgtcggcgtccaaccaaccaacgtagcgacgggcacgagcataaccaggcattgaacgctgaaatcaaccgcttgcgcaccagtcgccagcgtctggaatccctgcgctggcgtcgccttgaggcgcgtgatgtatacggcagccaagcccattccacccaactgccgcacagcctcaagcgttggttcagccaccgtgaaaaccgcgagatatcacaagttgcgagtatcccgccaccctcccacaacgaccgggggagggcacaaccactggatatcgactcgattgtttagccgggccgtttacaaaaacgccacctgcgccggttgccgcttcatcaacacgttgccgttacggatcgagtacagcggcaggccttggctgcggatgacttcgtagtcgctgtctgccgacaggatcaacaggttggccggtcgcccgggctccaggccataacggtcgcccagggccatggccttggcgctgttgtcggtaaccaggtccagggcgctttgcaggttgcggtagccgagcatgtggcagatgtgcaggccggcttccagcacgcgcaggatgttgccgttacccagcggataccaagggtcgacaatcgagtcctggccgaagcacacgttcatgccggcttcgagcagttcgttgacgcgagtgacgccgcggcgttttgggaagctgtcgaagcggccttgcaggtggatactttcggtagggcaggagacgaagctgatgcctgagtgcccgagcaggcgaaacagtttggcgcagtaagcgttatcgtaggagcccatggccgtggtgtggctggcggtgacgcgcgcgcccatgtcgcggctgcgggcttcttcggcgagcacttcaagaaagcgcgagtgcgggtcatcggtttcgtcgcagtgcacgtccaccaggcaaccggtgcgctcggccaggtccatcaggaacttcaccgagctcacgccttggtcgcgggtgtattcgaagtgggggatgccacctaccacgtcggcacccaggcggatggcttcttccatcaactcgcggccgttgcggtaggactcgatgccttcctggggaaacgcgacgatttgcagatcgatcaggtgcgcgctttcttcgcgcacctcaagcatggctttaagtgcggtgaggtcggggtcggtaacgtcgacgtgggtgcgcacatgctggatgccatgggcggccagggcctggatggttttcttggcgcgggtcttggtgtcttcctgggtgatggtggccttgcgctcgccccagcactcgatgccctcgaacagcgtgccgctcatgttccagcgcggttcgccggcggtcagggtggcgtcgaggtgaatatgcggctcgacaaaaggcgggatgaccaggttgccggcggcgtccaggtcgccggccgttaacgcaggcactgccgtttgtgcggtgatactggcgatccggccgtgttccaggtgcagatcatgcaggccttcacgattgcgcaggcgggcgttgatgatatgcatgggcaagttcctcttggctaataacagtcaggcagacagccgccagatcatccgggcgatgccgatgtccaggcggtcatatgagtggtccagcttcagcccacaaagggcttcgatgcgctggacgcggtgtgtcagggtgttacggtgcacggccaggcgctgggcggcggccactagattagcattctcgtaaagccaggcttccagggtcggcatcaggctcgggccatcgtgcaggtcgccagactcatgccgaagcatctgccactggtgcacgtacgcgtaacactgaggtcagcacgatgtaggtcagtgacgcggcaacaatccccaccaggggcgccacccacggcgagtgaaacgccagcacggtgcccaccgcataagccaccagcccaggccaattgaatgccggcaggcgagtctcgaccaggcgcgggtagtggccgcgatagcggtagaagaagtcggccatgatcactccgccaatcggcggaatcaccgtgcccagcaaaatcaggtagggcaccagcatgtcgtacatgccgagcagagccagcaaggtgccgatcaccgcgcctgccagggtcacggtcttgcggcgtttagtgcgcagcaaattgcagcccgcgacggcgaagttgtagatggtgttgtcctgggtgctccagatattgagcagcaacatggccattgccgccatggcgaagccttgcagcagcaacacttccaccacgtccggctgctgatagacgatggcgccatacgcgccgatcaacaccatcaagccattgccgatgaaaaacccgatcaggctggccaacaccgcgaccttggcggagcgggaaaaccgtgtccagttggtggcctgggtcgcgccgctgacaaaggtgccgaacaccagggtaatcgccgtggacaagtccagctcacccgtcggcaccacggccagcaggccatccagcccaccgacggctacggtggcgacccacatcgacaggaacagcaaaatgcccatggccggcactgcgatgtaggacagaatttccaacccgcgataccccacatacgccgtggcgcagaacaccatgccgaatagcaccatcaacccgagcacgctgccttggctcagttcgaaatacttgcccagcaccacggcggcggtggcggtaccccaggcgtaccagccgatctgggtgaagccgaggatcaggtcactgagcttgctgccgacttcgccaaagcagaagcggcccatcaacaccgagttcaagccgctcttgaacgcgatgtaacccaggcctgcggcgtaaatgcccagcagcaggttacccagggccacaacaccgagcatgtcggtaaagctgaacgccacgccgagcttgcccccggcaaacatggtcgcggtaaaaaacgtgaaccccagcagcaccatggccgtggacgccaggcccttgcgcgcatgcatcggcacttcgctgagggggtaatcgttgcccggttcttgctgcgtcatggccctgctccctgaatgagtgacgcaggcttgttgcaccgcgcgtgccaaatcagcggcagtgaaggacgctgtgcaccgtgcacagtattgatagccaaaccgtggtgaatcgccgggaggcgtgttctttatgcccagtcgggcacgaaagcggtgcagcggtgatacaaattggctcagcttctgctaaaggcgcttggtcatgtacacgcggcgcaggccctgttccacggcgcgatgggtttccatgtagccgcggcgtgtgtagagcgcgatgttctcggtcatggtttcgtgggtgtacagctgaatcgtcgcgtagccggcgtcgatagcgtgtcgctcggcaaattccatcagtaatcgcccgaaacccaaaccctgggcatcaggcgcgaccgcgaggttatccagcagcaaagcaccatcgcccgccagtagaataacgaaaccctgaaccgtcccggcgttgtccagtacctgcactccgccagcctcgactaactggcgatagtcctcaagcatcggcccgggcttgcggccgatccgcgcgatgtaaggcgagtaggcggcatcaacaatcgcttcgatggcagcaacatcattggcagtggcggggcgcagcattgcagtgtgctcctgtgaaaatagacagtttgcgggcgcttcgacgatcgcctcgattggccgcactataaaggtcgtcgggcataaaaaaaccacccgcaggtggttcttcagcacgccatcgcttactcgccgcgatagatgcagccgctggtgcaggtctcgtggatacgaatcgcactgagttccggcagcagcggtttcaactcagtccagatccacttggccagcacttcgctggtcgggttttccaggccggggatgtcattcaggtagttgtggtcgaggcgctcatacagcggcttgaaaatcgccttgatctccgagaagtcgcgaatccagccggtatggggatccaggtcgccgctcaggtggatcgccaccttgaacgagtgcccgtgcaagcgcccgcatttgtggccttccggtacgtggggcaggcggtgggcggattcgaaagtaaactctttgaagatttccacagtattttcagctcggtcaggtatctggcaggcggcgagtttaacagcttgatccctcgccgcgcataccgctgggtcatagcgcttgcaagtgctcgcccaacttgccgttgtccgcgaggtccaggaacgcatcgcccagccgctggctctcgctcatcgcggtctgccagtatttgttgcggctcgggtcatcgcccatgaagcgtttgaagtcgctgcggtccggcaatttgccgtggggcaggcgggccaggtagtccttggacggcgccagcagcaacacgtcctgcaagccctgctgattactgcgccgccacggcaggcctttgtcgaaccagccggggatgacccggtcggtgaagtgcgggtacagcacgatgtcgtcgccgtggtagggcaggtcgaggtggtagtccagcaggccgccgtcgcggtaggtgccagtgcctgcgccgggcaggtcgcgcacgccttgcatcaccatggggatcgagccggacgccagcagcgcctggcgcaggttgcccagctccaggttcacaaagcgcgaagggaaatcctgcagcggatgcagcggcggcgcctggcgcgggtcgtggatgattagccgctcgaagtgtcgcgacagccgtgcgcggccgcgcaggttatcggcaatcaccgatgacaggccgagcccgagccggccacggtggtcatcggcaagcaggccgtggcttttgaccaccatgatgttcaagcgatagtcggggttgtccaacacccgcgcatcacggcccgcgagcaggtcgtcgagcatgcgctggcagctgcggctgacctcggccatggtcacgcccttggcaaagctttgttcgttgtacaggcggccaaggtcgagcaggccttgcaccgggtcgggcaggcaggcactggcaaaccgccaggaaccgatggaggcgccgatcaatgcgcgttcgcgcggcgcgcgcggcagccagtcgccgaacagcgccaggtccaggccctggatgcccagcgccttggggccaccggccgcgccggggagggtgccgacatccgcaggcttgaggccctgttcgcgaatgcgtgcgaaggcgcgtttaccggccttgagcgtcaaagcgggaaacttgatgtggatggctgtcataccagtctctgttgaagcgagcggggcagtatagaaaaactcgcggatgatggggaaagatgccgattgaaaaatgccatggtggcaattcagtttcagttaagttgcagcgggtacggtggcctgcgtaggaaaaacatcctgaaacggagacttatcatgaagcgcctcacagcgctggtcgccgccggtatcatcgcctccacggcggcacaggcccgagcagtggaccccgacaagccactgaaattgcctggcactgttacaattgtcgcctttgatcagctggaggccgcggccctggcgctgcacccaggttcgagcctgctggacaccgacctggacgaggcctacggcaagtacatttatcaagtcgaactggaagatgccaatggcatcgagtgggaagtcgaattggacgcgctcaccgggcacgtactcaagaatcatcaggatacgtaatgaaggtatatcgacgcgccagcggttggatggtgctggtgctcctggctttttgttccagcctgtccgcccgcgacctcaaccaggatgaagccttggcactgcgccagcagggcgtgatcctgccgctggagcaactgctgcaacaggccatggcgcgccacccaggctcgcggctgctggaagctgaacttgagaaaaagcacggccgatatgagtatgaggtggagctggtgaccaccgagggcgtggtgcgcgagatcaagctggatgcaaccacgggtgtgttgctcaaagataaggaagacgactgatgcgcctgcttctggtggaagacaacgttcccttggccgatgaactgctggccggcctgcagcgccagggctacgccgtcgactggctggccgatggtcgcgatgctgcgtatcaaggccgcagcgaaccctatgacctgatcatcctcgaccttggcttgcccggcctgccggggttggaggtgttggcccaatggcgcgcggccgccctggtcacgccggtgctggtgctcaccgcccgcgactcctgggccgaacgtatcgaagggctcaaggctggcgcagacgattacctgagcaaaccctttcatccggaagaactgcacctgcgcatccaggcgttgttgcgccgctcccacggccacgccaaccaacccaccttgcaagctgccgggctgcacctggatgaaggccgccagtgcgtgctgcgtgatggcgaagagatccagctgaccgccgccgaattccgtctgctgcgctacttcatgctgcacccggaacaaatcctgtcgaaaagccacctcgccgagcatctgtatgacggcgagaccgagcgtgactccaacgtgctcgaagtacacgtcaaccacctgcgccgcaagctcggccgcagtgtgatcgaaacccggcgcggccagggttaccggtttggcgccggccctgcatgaggtccattcagcggcgcctgagcctgggcctgatcagcgtgatggtgatcgtcggcgtggtgctggcgcaaaccagcttgtggttgttcgaggccggtttgcagcgctacctggaagccgggctgcgcaacgacgccgagaacctgctggtggcgctggtgcgagggccgaacggtgtgcagctggacgaacaacgcctgtcaccggcctatcagcggccgttttccgggcattatttccgtatcgattttgccgatattcattggcgttctcgctcgctgtgggaccaggaactaccgcgcctgcccgaggccgggctcaagggtaacctgcaactgggcccggaaggccagcaactgctggtgttgcgcgcggactacaagcgctttggccagtcgatttccatcagcgtggcccaggactacacgccggtgcgggaaagtttccgtttgatgcgtcagatcggtctggtaatgggcctagcggccttgctgctggtgctgatcctgcagcgggttaccgtgcgccgtgccttgcgcccgctggaaaccgcgcgcaaccagatcgcccagctgcaacagggccagcgctcgcaactcgacacccaggtgccgcttgaactggagccgctggtggcgcagatcaaccacttgctggcccacaccgaagacagcctcaagcgctcgcgcaacgcgttgggcaacctggggcatgcgttgaaaaccccgttggccgtgctgttgagcgtggcgtccagtgagcagctcaaggcccatcctgaactgggcaaactgttgcgtgagcagttggaacaggtgcaacaacgccttaatcgcgaactcaaccgtgcgcgccttgccggcgaaaccttgccaggcgccttgtttgattgcgaaaaagagctacccgggctgctggccacgctgaacatgatccacggcgaacacctggacctgagctaccacgtcacgcccggcctgcaattaccctgggaccgcgaagacctgctggagctgttgggcaacctgctggacaacgcctgcaaatgggcggatgccgaaatccgtttgagcgtcagtgaagcgccgcacagctacttgttggccattgaagacgacggcccgggcattccgcaaagccagcgcgaccaggtgttcagccgtggtacgcgcctggatgaacagatcgacggccatggcttggggctggggattgtgcgcgatatcgtcgaggtgtggggcggggtgttgcagttgcaggagagtgaattgggcggcctgaaagtgctgatcgaattgcccaagcgccaggcctgatacaccacaacataaaaaatgtgggagcgggcttgtgtgggagctggctcgcctgcgatagcgtcacctcggtgtcacggatataccgaggcgcttgcatcgcgggcaagcccgactcccacattagtcattcgacattttgaagatttagactctgaactgatccatcaacccctgctgctgattcgccaaactgttcaacgcctggctgacccgcgctgattcattcgcctgttccgacagcgactcggtcacatcgcgaatggtcgccacgttgctgttgatctcctcggccaccgcgctttgctcttcggcggcactggcgatttgcaggttcatgtcgctgatcaccgtgaccgcctcaccaatctggcgcagggcggtgacggcctggccgacttgctcgacactgccttgggcctggcgatagctgttgcccatggagccgaccacatcggtggtgccgttttgcagttgttcgatcaccacacgggtttcttctaccgattcctgggtgcgccgcgccaggttgcgcacttcgtcggcgaccacggcaaacccacggccggcttcaccggcgcgggcggcctcgatggcggcgttgagcgccaacaggttggtctgctcggcgatgccacgaatcacttccagcaccgaaccgattttctcgctgttagccgccaagccttcaacttgagccatggcggtgctcatgtcggcggccaggtggccgatgttggtggtggtgcggtcgatcacggtcaagccttcgcgggtcgcctggtcggcatcgcgcgcggcttgggctgcctgggcggcgctgcgggccacgtcctgggcggtggcgctcatttcatgggaggcggtggccacttggtcaacctggcggtattgctgttccatgccggcgctggtttcggtggcaatcgcggcggattggtcggcggtgccacgggcgtcctgcaccgagcgtttgacctcggcaataatcggttgcagcttgtcgaggaagcggttgaaccaaccggccagttgccccagctcatcctgtttgtcgtaggccaggcggcgggtcaggtcgccttcgccactggcgatgtcttccagcatgcgcgccacgcccaagatcggccgggtcacgctgcgcgccatcagccacaccagaatcaggccgaccacggcggcaagcaggcccaggctcagttccagcaaggtgccgcgggtgttatcggcgtcgagttgcgccttgagcgcttcggcggggccgaccaggactttttccggcacatccagcaacacgccccacggcttgccgccgggaatcggtgcgaagggcgccagcaccttgagttgatggtcggtgcgcaggctgcggatctgcgtgctggcggccagcgcgctgatcaattgcgcgccgctggtggtgtcgacctggtccaggcgctggctgagtttgctcgcgtccgggctgtagccggcgagcaagccggtggggctgagaatgctgacctgggtctggccgtcatacagcttctggctggcctgttggctcactgcctgcaggctgttgaggttgatgtccaccgacaacgaggcgatgactttgccgttgaccatcagcgggaagacgatgctggtcatcagcacgttttgcccgttgatcacataaaagtaaggctcgatcacgcagggtttcagggtggtgcgcgggcaggtgaaccaggcgttggctttctcgccgctggggccgacgctggtgtcggccatgtcgctttcaggcagcgacatcgaggtcaatttgcccggcgtcggttgcgaccagtacagggcaaagcggcccttgtcgttactgcccagctccgcctggttggcgaacagctcatccttaccgtccagcgcattggcttcaaacaccagcgacaaaccgagcaggtccgggttggcctgcagcgcggccttgacctggcgggtcaggtcttcgcgggtgtcgaaggcgtcgaggaagcgtttctccgcctgctcgcgcaaaaacagcacttggcgagaaaaaccgtggccgtactggtaggcgtccatgaattgctggcgaatccccagggcctgcacttcaccttgggcctcgatgcgcgcctgggcggactcgtcgagcatctgcatgctggaggctttgacctgctgcgagctctgctccatgcgatacagcgacagacccaccagcagggtcacgatccccagcaggcagaggccggcgagcagggtgattttccattgaatggagagctgtctgagggacatcgaggagcatccttaacctgaaaacacagagagtcagggtatcggccgcatttttcagttctttattatttaaacgttcaattgaaagcgcttttgtggcgagcgagcttgtcggatcgccgcaccgtcccgttgggctgcgtagcggccccaaaaaagcgggagcgctgcgcactccagcgcgagcaagctcgctcgccacaaaggctcgccactcacaaaggagccgccacagtttttgacatgcgcgcccgcctgctgcaaagtgcgcgcccttctaataagacctcctaaagcctgcacgctggcagccaagcctatggccgcctgggcgcgggcatgcctgtttttttagtttctgtcttgaggtaaccatgattaacgcagtcatcgccgcggtcggcaccatgctggtgctcagtttgtcccgcgtgcatgtggtcatcgccattattgtcggcgccctggtgggtggcttgaccggtggcctgggcatcgaggccacgctcaaggccttcaacggcgggttgggcggtggcgcgacggtggcgttgtcctacgccttgctcggcgctttcgcggtggcgattgccaagtccggcctggcccatgcgttggcggacaaggcgctgatgctggttgatcgccaggaagccacgggcggcagccacgtcaaatggttgctgatcggcctgttgtgggtagtggcgattgcctcgcagaacatcctgccgatccacatcgcgtttatcccgctgctggtgccgccgctgctgtacgtgctgaccaagctgcaactggaccgccgcctgatcgcctgcgtcatgaccttcggcctgatcacgccatatatgttcctgccggtgggcttcggcaatatcttcctcaaccagatcctgctggccaacgtggccaagagcggtgtggatatcagccaggtcaacgtcacccacgccatgggtttgccggcgttgggcatggtcgtcggcctgctggtggcggtgtttgtcagctatcgcaaaaaacgcgtgtatgacctggagaaaatcgagcgggtcgagcaagtggcggtgcagtacaacccactgactttgctggtggccggcctggcgattgcctcggcgttcatcattcagctgtggttggactcgatgatcatcggcgccctggccgggtttctgatcttctcggtgtcgggcatcgtgcgctggcgcgaaaccgacgacctgttcaccgaaggcatgaagatgatggccatgatcggcttcatcatgattgcctcctcggggtttgccgaagtgctcaaggccaccggcgacgtgcgttcgctggtggaaacctcggcggcgttcatcggtcacagccgtggcgtgggcgcgttgctgatgttgctggtcgggctgctggtgaccatgggcattggctcgtcgttttccaccgtgccgatcctcgccgcgatttttgtgccgctgtgtgtgcaactgggcttcagcccgctggcgattgtgtgcattgtcggcaccgccggtgcgctgggcgacgccggttcaccggcgtcggattcgaccctcggcccgacctccggcctgaacatcgacggccagcatcaccatatctgggacaccgtggtgccgactttcctgcactacaacattcccttgctggcgtttggctggttcgccgccatgaccctctgacaccgcctacagatccctggcaattggccgatagcctctcaagtcgcctaataagagagaaaagccatgcgtctgagtttgaaggccaaagtcctgtccctcgctgtagtgccggtgttgctgtttgccgtggtcatcagcctgaccacggtttggattctgcagggccaggcacgcaacgaggtggatgaaacccgccagcgcctgctcaacgacgccaaggccacgctgcaaagttatgtggaagtggccatgaccaccatcaagccgctctacgacgccgccgcccccggcgacactgccgcgcgggcgcaggtggtcaagttgctgtccaacacccgctacggcaaggacggctacttcttcggctacgactccgagaccatccgcctgttcaagggcaacagccccgacggcgtaggcaagagcttcaaggacaaccgcgatcccaacggcgtctacgtcaaccgcgacctggtcaaggtcggcaaggacggcacccattacctgcaatacagctcgacccagccggggcagaccgaactggtgcccaagctcggctacaccgagtacttgccgaagtgggacatggtgattggtacgtcggttaacctcgacggcatcgaagcccaggtggcggtggtcgaggccaaggttgagaaacgcatggaaggcgtgctctggagcatcctcggcgtggccgtggtggtgctgttggtgattgccgccgtgggcctggtgacggccaataccatcttgcgtccgctgaacctgatgaaagccaacctcgacgatattgctgccggcgagggcgatttgacccgccgcctggccatcaccagccaggatgaactcggcgatctggccggcgcgttcaaccgctttgtcgacaagatccacgggctggtgcgccagatcaccgagatgacctcgcaactcactgggctggtgagccaggtgtccgagcaggcccagcgctcggaaaccgccatggaacgccagcgtcacgagaccgaccaagtcgccaccgcgatcaaccaaatgtcttccgccgcccatgaagtggcgcgcagtgcccagggcgcggccgttgccgcacaacagaccgacgccgagggccaggccgccaagcgcgtagtggacggcagcatcgcgcagatccatgcgctggtgaacgatatccgcagcagcggcgtgtccctcgacagcctgcaacaggacgtgtcgtcgattgtcagcgtgctcggcgtaatccgctcgattgccgaacagaccaacctgctcgcgctcaacgcggccatcgaagccgcgcgggccggtgaggccgggcgcgggtttgccgtggtcgccgacgaggtacgcgccttggccagccgcacccagaccagcacccaggaaatccagggcatgatcgaccgcctgcaaaaaggcaccgaagccgccgtggacgcaatgcgccgttccagcgatgccggtgacggcacttcggctcaggccaaccaggccggagcatcgctggacgccatggcgcagttgatcggcaccatcaattcaatgaacgcacaaattgccagcgccgccgaagagcaaaccgccgtggccgaggagatcaaccgcagcgtgcatcagattgccgtggcggtagacagcgtggcggatgaaacccaactgggcgcgcagacgtcccgcagcctggcggatttgggtcagcgtttggggcaattggtggggcagttcaggatctgatctttcataggttcagcgtatgttgacctaacgtatatacgaatatacctctcacagcccctcgaagacttgagcccccatcacagcgccttcggcctggcgccgtacctgcgcatcgcctacgccctggacgattactcgttgttgcaggcgtgcgaggcgatccgccagttctgcgcggcgacgcgctagaggtcgcgcatcaacaggccaaactgcaggtccatgtcggcaggaagcggcacatacaccgtgtgcccgtctcccggcgcaacctcgatggcttcgcccttggcgttatgcaggctggccaggtcgaagtgaaagttgccggtgggtgtcatcaactccagatgattgcccacggcaaagcggttcttcaccttgacctcggccagctcgccacggcgcgcgccggtcaattcgccgacaaactgctgacgttccgacaccgagctgccgttctggtagttctggtattcgtcgtgcacatggcggcgcaggaaaccctcggtgtagccgcgttgggccagtgactcaaggttagtcatcaggttgcggtcaaaggcgcgaccggccaccgcatcgtcgatggcctggcgatacacctgggtggtgcgcgcgcagtagaaatgcgatttggtgcggccttcgatcttcagcgagtgcacgcccatgtgcgtcaggcgctccacatgctgcactgcgcgcaggtccttggcattcatgatgtaggtgccgtgttcatcctcgaaggcgggcatctgctcatccgggcgattggcttcctgcaacaggaacacttggtcggtcggtgcaccgatgcccagggtcggctggcattgctcgacgatgtcgcccgtggtgttttccacggccggcgtggcctggtatttccaacggcacgcgttggtgcacgtgccttggttggcatcgcgcttgttcatatagcccgagagcaggcagcgcccggaataggccatgcacagggcgccgtgcacaaacacctccagctccatgtttggcacctgctggcggatttcgccgatctcttccagcgacagctcgcgcgacaggatcacccggctgatgccttgctgctgccagaactcgacgctggcccagttcaccgtgttggcttgcaccgacaagtgaatcggcatcaacgggaagtggcggcgcaccagcatgatcagccccgggtcggacatgatcagcgcgtccgggcccatggcgatgatcggggccaggtctttgaggaaggtcttcagcttggcgttgtgcggcgcgatgttcaccaccacgtagaagcgcttgcccagcgcatgggcttcctggatgccgagcgccaggttggcgtggtcgaactcgttgttacgtacgcgcaggctgtagcgcggctggccggcgtagaccgcgtcggcgccataggcgaaggcgtagcgcatgtttttcaaggtgccggcgggggcgagcagttcgggggcgaatacggggggcatgggctcaagtcgcaaaaggtcgcgagggtagtggagcctgggcgaggttttattgatccaggtcgcccttttgggattttgtatcgctgtgtatcggcgggggcgtgtcgacataggcgcgatacgtcaggcggtttcaatggcatcccccgtctcgacaaggtcattgccatgcgacttatttcagccctgttcgtcggcctgctggtggccttcgctctggtttccaaccaggttgccagccgtgaaagtgaaaatgcccagggcgccatgccgtcactggggggggcagtggaatggcttaactcgcctgagttgagcgcgcagtcgctcaaaggcaaagtggtgctggtggatttctggacctacgactgcgtcaactgccggcgcgcgctgccgtacgtgcaggcctgggcgaagcggtacgagcaggatggcctggtggtcatcggcgtgcacaccccggaatacgcctacgaacacatcaccggcaacgtcagagagcaggtgcgcaagctgggcatcacctacccggtggccgtcgacaacaactacgcgatctggcgcagcttcgataaccagtactggccggcccactacttgattgatgccaaggggcaggtgcgttacagccactttggcgagggccgttatgacgctcaggagcagatgatccagacactgttgagcgaggccagggcggcggcaccaagcccttgaatcaagcggtctatgcttgttggagaatcgagggcactccgaggtttcgcagcggactaagcaacagggcctacacagggcctttgcttttctgacatggaccggacatgaatcaaaccaacctgcaattcaaaaccctgctgttgctgctggccctggtgaccatcgcctttatctggatattgctgccgttttacggcgcagtgttctgggcggtgatcctcggcattatctttgccccgatgcagcggcgcctgcaacagcggttcagctggaaccgcaacctgacgtcgctggcgaccctgacggtgtgcctgatcattgcgattctgccggtgatcatcaccagtgtgttgctggtgcaggagggcgcgaacctttacaaaaacatcgaaagcggcaaattggacgtggcggggtatatcgagcaattcaagaacatcctgccgccgtatctccaacatttgctcgatcgcttcggcatgggcaacctggaaggcctgcgcgagaagatcgtcaagagcgcgatgcaaggcagccagttcttcgcgacccaggcgttcagctttggccagggcacgtttgattttctggtgagctttttcatcatgctgtacctgctgtatttcctgctgcgcgacggccccgagctggtgcgcaaggtgcgcacggcggtgccgctggccgagccgcaaaagcgccgtttgcagctcaagttcaaccgcgtggtgcgggccacggtcaagggcaacgtactggtggccgtcacccaaggtgcgttgggcggtttgattttctggtttctggatattcccagcgcgttgctctgggcggtgctgatggcgtttctatcgctgttgccggcggtgggcgcggggatcgtctgggggccggtggccgcctacttcctgttgagcggttcgatctggcagggcgtggtgctggggctgttcggggtgtttgtgattgggctggtggacaacgtgctgcgcccgattctggtgggcaaggacaccaagatgccggactacttgatcctgatctcgaccctgggcgggctgtcggtgtttggtttgaacgggtttgtgatcgggccgctggtggcggcgttgtttatgtccagctgggcgttgttcgtggagagcaagccacgggtcaagctgccgttgccttgaatatcaggcgtgcagcctgaacgtcgaggtttgttgcagctgtttttcggcggcggataacgaggtgagcgggccgctgatgggctcgccatcgcgtaccaggtaccaacaggccagcaacccatgcgcgcgaagcgaggcggggacggcgctgccgatgacggacatgatctggacagtgggcatgaatacctccatttgctatggaggccacgttacggggagaacccgcgcaagaaaaatcacctggctcgatagtcgacatcaacgccaagcgtcaatccaccacttgatcaagcatattcaccacttcctgctcactgagcaggcctttgcgcaccaggttttccgccagcagcgagaggaacttcgcgctgcggtggccttcgaggtgcttgagttcggtcagcgcgctgtagaccttgctggacgtgcacaagccagcggtgcggtgcgggttttgcgtgggcatggtcggtcgtccttgttgttattgggtggacagggtcaatagtgagtctgtttcgtggcgtaaacatgacagcacgcgtatcggcccggcaagtagacattggccttaatcatgtgcgattacagctcggctattgtcctcatagcgaccttggccgtatgaatccggactctacaggcaaaaaaaggccccgcgtgtaagcgaggcctgttcctgtcatgtcagttcagcgttaccagccgcgaccgtaatagccgtggggagggccgtagtagccgcgcggtgggccgtaatagaccggcgccgggcggtaataaacctgctgctgcacatacaccggtggcggcggtgcgtagtagaccggaggaggcgcggcatacaccggttggggctgcacatacaccggttgctgcacgtagaccggctgggattgactggcaaccacggagccgacaacggctgcgccgatcaaaccacccaatatggccgggccaccccaaccaccaccgtgggcggaggcttggcctgccatagcgagtgcgccgatcagcaaggcgattttggggattttacgaatcatggtcattcctcggttagcccctgcgcttgtggtctgcaatcaatagactcaaggattgtcgcggggatacttttaagacaacgtatttctgaaaaacagcacagccgataggtaaaggttgtgtaaggtctgtaccgaattgcttactcacaggagttttccatgcagatgcaccccaacaaggacacccagttgtgcatgtcattgtcggcgcgccccggtaatttcggcttgcgtttccataaccatctgtacgaacagctgggtctgaacttctactataaggccttcagcagccaggatttacccggcgcgatcggcggtatacgggcgctgggcgttcgcggttgcggtgtttcgatgccgttcaaggaggccagcatcgccttggtcgatgagctggacgactcggtcaaggccatcgcgtccctcaataccatcgtcaacaccaatggccacctcaaggcctacaacacggactacatcgccgtcgaacaactgctgaaaaagcacgcggtgcccaaggactcgaccttcgccctgcgtggcagcggcggcatggccaaggccgtggccagtgccttgcgcgacggcggttatgccaatggcgtgatcgtggcgcgcaacgaggcggcgggccgggcgttggcccagagcctggggtatgagtggcaggcggagctgggtgacctgcgcccgcagatgttggtcaacgtgacgccgatcggcatgaccggtggggccgaggcggaccacttggcgtttgacgctgaagcggtggatgcggccgacacggtgtttgatgtggtagcgatccccgccgaaacgccgctgatcgtgcgcgggcgcgccaaaggcaaacgggtgattaccgggctggaggtgattgcgatccaggcgttggagcagtttgtgctgtacaccggcgtgcggccgacggatgagcagttccaggccgcagtggccttcgcccgagcctgaaaacactgaagaaccaatgtgggagctggcttttgtgggagctggcttgcctgcgatagcctcaactcggtcctgatgaaaaaccgaggtgtctgcatcgcaggcaagccagctcccacattgttgctcgagttacgcctgttccagttgtgccaggcgttcttcaagcgctgcgattctggattcaagctcttcgatacgatccagagaaaccgcccccgtcgaccgctccaccggactcccgcgcgccgccagaatcacctcgatatccgccgggtcccccagcgcatgggtataacggtcttcccgctgcccggcctgacgcggcaccagcagcgccagcccgcgcgcaatcaaacgctccagctggtgcacgacttgctcggcatcttcaaaatcatgcatgcgcccgcttcgggtcagcagttcattgaccgtctgcggcccacgcagaaacagcaggccgatcaggatcacctgggccggcaccagctccagcgccttgtccacgcgatgctcccagcggtcggcgcggctgcccatcaccaggcgggtaaagccttggccttcgagggcacgcaggctttggccgacctggccttggctgaggttggtcaccggttcgcggctggtcttctggttgcaggccagcaccaaggcgttgagagtcaggggatacgtctccgggttggtcgcctgtttttcgatcaggcagcccaggatgcggatttccgtgctgttcaggcgcggctcaggggtctcggtgtcgtgctcggcggtcatcgcgctttccctatgcagtgaatgcactagcctaagcccgaaaaaataaaagacaagcggcgggcatgtctataatcgccgctggttccaaaccctgccattaccgcgagactgtcatgactatttccctgtacgccgcctccatcccggttttcaagcaaatgctcaacgccctgagcgatgtgctgaacaaagccgaagcccacgccaccgccaagaacatcgagccgaacgccttgttgcaagcgcgtctgttcccggacatgttccaactggtacgccaggtgcagatcgccgtcgacttcgccaagggcgtttccgcccgcctggccgagatcgaagtgcctaagtacgaagacagcgaagtcaccttcgccgacctgcaagccctgatcgccaaagtgctggcgtttgtcgacaccatcaagcctgagcaaatcgagggcaaagaaggtatcgagatcatcacccgcccaggcacgccgaaagagaagcgcttcagcggccagtcctacctgctgacctacggtctgccgcagttcttcttccacgtcaccaccgcttacgccttgctgcgccataacggcgtggaagtgggcaagcgtgattacatgggcgctttctaagcatccagatacaaaaaagcccggggcgtcctttgttgaacgccccgggcttttttacgcctgatgtttaagctggctgctgttccttgcctaaacacgccgctgcggtaaacagcacatcggtggatgaattaagcgcggtttccgccgagtcctgcagcacgccaatgatgaagccgacggccaccacttgcatggcgatctcgctgggaatgccgaacaggctgcacgccaggggaatcaacagcagcgaaccgccggccacacccgacgccccacacgcacacaccgccgcgaccacgctgagcagcacggcggtcggcaggtccacggcgatcccgagggtgtgcacggcggccagggtcagcacggtgatggtgatcgcggcaccggccatgttgatcgtcgcccccagtgggatcgacacggagtaggtgtcttcatgcaggcccaggcgtttgctcagcgccaggttcaccgggatattcgccgccgaactgcgcgtgaagaacgcggtgatgccgctttcacgcaggcacatcaacaccaatggatacgggttgcggcgcagtttccagaacacgatggccgggttgaccaccagcgccacgaacagcatgcagccgatcaacaccaccaacaggtgggcgtagccgagcagggcgccgaaaccggaggtggccagggtcgaggccaccaggccgaagatgcccagcggtgcgaagcgaatcaccacgcgcacaatcagcgtcacgccgttggacaaatcctcaagtacggttcgcgtggtttcaccggcatggcgaatcgcgacgcccatgccgatggcccaggccaggatgccgataaagttggcgttcatcagcgcactgaccgggttgtccaccacgctgagcagcaggctttgcagcacctcgccgatgccgccgggggcgcttaccgtgacgtcatgcgtggccagcaccaggagcgatggaaacagtgtactggcgaccaccgccacgacggcggcggcaaatgtccccagcaggtacaggaacaagatcggcttgatatgagtttcctggccgtgtttatggttggcgattgaggccatgaccagcacaaacaccagaatcggggcgacggctttcaatgcggtgacaaataccttgccgataaaactggtggctttagccgcttcgggcaacagcagggctagcagaatgccggcgatcaagccgatgaggatttgcgtgaccaggctgacgcgtgtcagtcgctggaagagggaaggggcggcagtcataaacagttgtctctagttcttttagtgggacgcagcattgcaggcaggaagccctggaggaagcaggcgcaaagtctaacatgctgtaggaaatgtccttgttggtgcggcattccgtcaccgcgcccgtaggctttggccaaatccagacatactctgttaacattctcgtctctcacctttcctatccgtcagcgagcccatcgggctgtcgttgatgtcgtcgtttctggagttttcatgctgtttcccatcctgctgctgtcggccgccggctttaccgtgctgaccacagaattcattatcgtcgggctgttgccgtcgattgcccgggacctgaatgtcagcgtgtcccaggcggggctattggtgacgttgttcgcctttaccgtggccgcctttggcccgtttctgacggcgtacttcgcgcgcttcccacgcaaacgcctgtttatcagcatcctgatcatgttcggcgtggccaacaccgtggccgcgttggcgccgaatatttgggtgatggcgttcgcacgcttgattccggcgttgggcttgccggtgttctgggccttggccagcgagacggcggtggatatcgtcggccctgaatatgccggtcgggccatcgaaaagattggctttggcatcgtctgtgccacggtgttcggcattcccgtgggcaccttgatttccgacatgtttggctggcgcactgcgttcgccatcctcgcagtggtggcgttggccaaggctttgctgctgtttatctatttgccggtgacccaaccgaagaacgacctggtcacactgcgctcgcagttcaagatcctgcgcaacccgctgatgcaggggcatattttgctgtcgatcctggtgttcagcggcatgtttaccgcctacacctacctggccgatatccttgagcgcctggccgggttcgacggcacgctggtgggctggtgcctgatggggtttggcgcggtcggcctgctcggcaactccctgggcgggcgcgcggtggatcgccacccgttgatcgcctccatggtgttctgcgggttcatgatcgcgggcatggtggccttggttccggcgatccactcaacgattggcctggcggcggcgatggcggtgtggggcgtgacccaggcggcgatgttcctggtcagccatgtacggttgatgaaggccgcgcctcacgcaccggcgtttgcggcgtcgttgaacattgccggggccaacctgggcattggcctgggcgcgatggtgggcgggcatgtgatcgacaccctcggcctgggcagcctgggctttgcggcgtcgggctttattctggtgtcgatcctgctggcgttgtggctgatgactgccaagccgactgccgccagcgcctgaatcatcagggcagggcggtaaacaattcgcgccgtgcaccttcggtaatcgccacgatgccggggtgcttgaccttgcgctccaccgaaatcgcgtagaacgactcggtgaccgcgtcagtctggccgatcagcgccacgccatactggcgcaccacctcatcggcaatcacgctgggcgcaataaagatgccgctgccggattggccaaacgcctgcatcaacgcgctgtcgtcgaattcgccgatgatcttcggttgaatctgttgctcggcaaaccagcgctgcaaacggctgcgcaccaccgtttctgcacctggaatcaacagcggcgcgccctgcaggcagcgtgggaaatcgccgccgtattggtcagccaatgcctgggtggcgaaaaagctgatgccgcattcgcccaacttctggctgtagcctttgatgtccaagtgcgtcggcatggggctgtcggagatcaccaggtccaggcgctggatcgccaggtcggccaataaacgttcgagtttatcctcgcgacaggtgatacggatcggttcgctcagctccatggtcggcgcgatcagccgatagacgatggatttaggcaccacatccgccaccccgacccgaaacaaaatctgctgttcattgggctctgcgcgcaacaacgcctccagttcattgccggtctggaacatttgctcggcatagggcagggcgcgccgcccgacctcggtgagttccagctgacgccccacgcgctgaaacagcgcaacaccgaaggtttgctcgagcaggctgatctgcccgctgatggtctgcggcgtgaggttcagttgctcgcaggcgcgcacgatgctgccagtcttggccaccacccagaaataatgcagctgtcggtaattgagcatggcgacctacacttcggaaaaagcgaagtatacgtgagaaaaatacgaatttttctgaactgttcatctgcatagaatgcctcgctatcgaggggccactatttggacccaatggttctaacgaggaatacatcatgaaactcaattccctgggcgccgcgtcgttgcttgcgctttcattggtaatggtcagcggttgtgatcaggtggaaaagagcgcgcagcaagtgctgggcaaagccaccgaatccgccaagcaagccatcgatgacacccataaggctgccgagcaggcattgagtgaagcgacacagggcttgatcagcccgcagaaaaaagctgatcagccagaaaaagaacccgaatcgagcagtaaagaagcctaattccccagcacaacgtcaggactgacctatggattaccttttacaactggctgccagccccaccgcctgggtcgcactggccaccttgatcgtcatggaaatcgtgctgggcatcgataacctgatatttatctcgatcctcaccaacaaattgcccgagaagcatcgcgccaaggcacgacgcatcggtatcagcatggcgttggtgttgcgcctgggcctgttgagcaccatcgcgtttatcgtgcagttgaccgcgccggtgtttgaaatcttcggccaggcgttttcgtggaaagacatgatcctgatcgccggtggcctgttcctggtgtggaaggcgaccaccgagatccatcacagcatggacccggagcccgaggaaaaagccagcacgggcgctgtggtgtccatcggtttcgccgcggcgattggccagatcctgttgctcgacctggtgttctccatcgacagcatcattacggcggtggggatgaccgagcacttgccgatcatgatcattgccgtggtgacctcggtcatcgtgatgctggtggcggctgaaccgttggccaagttcatcaacgacaacccgacggtggtaatgctggccctgggcttcctgatcatgatcggcatgacgctgatcgctgaaggcttcggtgcccatgtgccaaaaggctacgtgtatgcagccatggcgttctcggcggtgatcgagtgcctgaacatcgcacggcgcaatcgccacaagcggctgctcgccgccaggcagtaacagcgcaaatgcaaaagccggctgggctcacaagggcccagccggctttttgctgtctgatagaatccgctcacttgttaccttgaggtccaccatgaacgagccgattcgcctcacccagtacagccacggcgcgggttgcggttgcaagatctcaccccaggtgcttgaagtgatcctcgccggcagcggcgcacagaaccttgaccccaacctgtgggtcggcaacgcctcgcgcgacgacgcggccgtgtacgccatcgacgacgaacgtggggtggtttccactaccgatttcttcatgccgattgtcgatgaccctttcgacttcggccgcattgccgccaccaacgcgatcagcgatatctacgccatgggcggcgacccgttgatggccatcgccattctgggctggcccgtgaataaactggcgccggaaattgcccgtgaagtgatccgtggtggccgctcggtgtgcgatgcagcgggtatcccgctggcgggtgggcactccatcgacgccccggagccgatcttcggcctcgccgtgaccggcatcgtgcaaaagcgccatatgaaacgtaacgataccgccaccgccgggtgcaagctgtacctcaccaaaccgttgggtatcggcatcctcaccactgccgaaaagaagggcaaattgcgcgaggcggatatcggcctggcgcgtgactggatgtgcaccctgaacaaacccggtagccgtttcggcaaattggccggcgtgaccgccatgaccgacgtcaccggtttcggcctgctcggccatctggtggaaatggctgacggcagcgcgctgacggcgcgcatcgaatatgaaaaagtcccacgcctgcccggggtcgaggactacctggatcaaggctgcatgcccggtggcaccttgcgcaacttcgacagttattcgagcaaactcgggcgcctgcaagagctgcacaagcgcgtgctgtgcgacccgcaaaccagcggtggcttgctgatcgccgttaccgccgagggcgacgccgaattccacacggtggccgcagagttgggccttagccttgagccgatcggtgaactggttgagcgacagacccacgcggtagaggtgttttgatggcaactgacatcaccgactaccgcgacatcttcctcaacgaccggccgatgatggatacccgcgcgccgatcgagttcatcaagggcgcgttccccggggtgatcaatttgccactgatgaccgacgacgagcgccagcgggtcggcacctgctacaagcagcagggccagcaggccgcaatcgtattggggcatgaattggtgtccggagcgatcaaggatgagcgcatcgaacaatgggcgcagttcgccaaggccaaccctgacggttacttgtattgttttcgcggtgggctgcgttcgcagatcgtgcagcaatggttgaaggccgaagccggcatcgagtatccgcgcgtcggcggtggctacaaggccatgcgcacctttctgctggagacgctggagcacgcgacagccgagtgtgattttgtgctgttgggcggcatgaccggcaccggcaaaaccgaagtgctcagccagttgcgcaacgccctggacctggagcggcacgccaaccatcgcggttccagcttcggcaaacgcgcgacatcacaaccctcaaacatcgacttcgaaaaccgcttggcggtggacctgctgaaaaagcgcgcaggcggtatcgagcaatttgtggtcgaggacgagagccgcatgatcggcagttgcgcgttgccgctgccgttgcacaagggtatgcagacgttcccgatggtatggctggaggacagcatcgagggccgcgtcgaaagaattctgtgcgattacgtggtggatctgtgcgccgagttcgtccaggtattcggcgaaaacggccaggcgctgtttgccgagcgtctgacccagagccttgccaatatccacaaacgcctgggtggtgagcgcttccagcggctgcaggcggtcctgcaggacgccctggcagaacaggcccgcagtggcgcggtagacttgcaccgcgtgtggatcgaaggcttgctgcgtgagtattacgacccgatgtacgcgttccagcgtgaaagcaaaggcgcgcggatcgagtttgcgggggagcagagggcggtggtggagtacttgcgcgaaaggctggggtgactttattggcgccatcgcaggcaagccagctcccacatttgagggcattcaccgatcaaattgtgggagctggcttgcctgcgataaggccctcagcctcaccagtaacctaaagaatcaccgccccgatcaacccacacaccacccccaccaacatcgtcagccccgccaccgtcaccagcacccgcgcatcgaaatccttgcgcagcatcaacagcgacggcaggctcacgctgggcagggtcatcagcaaggccacggccgggccggtgcccatgcccagggtcatcatggtttgtacgatagggatctcggcggcggtaggaatcacgaacagcgtgccgacgatcgccagcggcaccagccacaccaggctgttggccatcgccccgtcgacgtgggggaacagccagacacgcgcggcccccaagaccagcacggccaggatataaacggggatcgtgctccagaacaactgccacagggtacgcaaccaacgggtcaggaacggctgcgactcgctttgactgacgtcggccaccgcatccagcgcggcttccggcacctgatcgggccgggcaattcgctgtgccaccaaggacacgcccaccaccaacacaacccccgccaccagccgcaatgcggtaaagccccagcccagcacaaagcccatgaacaccagggttgccgggttcaataccgggttggcgatccagaacgccagcgccgcgcccaccgacacctgctgacggcgcatgcctgccgccaccggtgccgcgcagcaactgcacatcatccctggcagggcaaacaggccaccgcgcagggtcgaccccaggccggctcgaccaaagaggcgtaacagccagtcacgggggatcaacacttgcagcagtgagcccagaatcaccgccagcacggcggctttccagattgccaggaaatacacttgggcataggccagcgcggccgccaggggggcggtttgctgatcattgagaatcgaggcgccgatgctgtggttatccgctgccacgaacgccttgaggtagtagggcgaccacttcacgtagtagaggccgatgcaggccaccagcacgaacagcgctggtttccaccagaacgaccagccccggttaggctgggtggagatgaggttgggcatggtgcaggtccgcagatgattcaatagcggggcatcatacgcctgtgtcagatatccgcagctggctgagttgcatccgggcaggtctgctggccgttatccaggccttgcttgtagttgcggctcagcagcgatgccttgccgttgtgccaggtcaacgtcagcacatacagggtgtcgtagtcactgcccgaccaatcgtcggtgatggtgtgtttttcacccgaggcttcactggcgaccttgttgatcagctccggcaggtagccgtgggaccacgcggtgtagatgatcgcgttgtggtacttgtcttccaccagctcgtccgcgaggtcgctggtgtcgttggcggagaacttgatgttgaccggcaggccgagcttgatggcgctggggctgatggtcatcaatggccgaatgtagctgtaggagttgtccttttcgccttcctcgacattacgcgtcgggttaggggcgaacacaaagttggccttgccgaatttctgcggcagcacggtggccaggttcatcgcacggttcaagccctggcagttgagctggccgaggccgccggcaggtttttcgccgtggcgcaggaagaccagggtttgcacgccgtccacgggttcggcgctgctgatgcgtgattccaggctcagaccgattgcgccgcccgccacgagcagcggcaacatgatgtatgaataacgtttaagacgtcgcgcaaggcacagaggcttgattctcattgtgggttcgagtcttcagtgcatcggattaaggcggacaagcccggccccagcgacgcatccggcgtcctgtggtttttccgtgtcgttgtaacagggtgtctcctttcaccgtcatggcgcacttaagagtgcatatcggcgctttggttcgcctgcgcgcaagattagcgcggctatgttgcgcaatgatgacccatgcaggacggcgtgcacgtggctattatgggggctttccgcctggggatttcccgatgaacgcacttgccgcctttccgatcaacagcaaatggcccgcccagcacccggagcgcttgcagctgtattcgttgcccacccccaacggcgtcaaagtgtcgatcatgcttgaggaactgggcctgccgtatgaagcgcataaggtcagtttcgagacccaggaccagctatcgcccgagttcctgtccctaaaccccaacaacaaaatccccgcgatcatcgaccccaatggcccgagcggccagccgctggcgttgttcgagtccggcgcgatcctgatctacctggcggaaaaaaccagccaattgctttccgaagacccggccacccgctacgaaaccctgcaatggctgatgttccagatggccggcattggcccgatgttcggccaagtgggcttcttcaacaaatttgccggcaaggcctacgaagacaaacgcccacgtgaccgctacgccgccgaatcccggcgtttgctcgacgtgctggaaaagcgcctgctgggccgcacctggatcatgggcgacgattacagcattgccgacatcgccaccttcccatggattcgcaacctgatcggcttctacgaatccggcgatttggtcggcattgccgacttccccaacgtactgcgtgcactggacggctttgtcgcacggccagcagtgattcgtggcctgaatataccgagctgaagcatgccgactttcgatttcaaacaactggatgtcttcagcagcgttgccctcaagggcaacccgctggcggtggtgcacggtgctgacagccttaccgaccagcaaatggccgattttgccaactggaccaacctcagcgaaaccacgtttttgctgacgccgcgcgatgcacgcgctgactatcgggtaagaattttcaccacgctcaaagagcttccgttcgccgggcatccgacgctgggcagttgccatgcctggctgcaggcgggcggtatgcccaaaggcgatgagatcattcaagagtgcgaaatcggcctggtgcgtgtccgtcgtgaaggtaacgagttggcgtttattgccccgccgttgttgcgcactggcgcggtcgaggccgtcttgctggagcgtgttcgccgtggtttgggtttggcgcccgacgccattgtgcgtagtcaatgggtcgacaatggtgcggactggctggcagtgatgcttgctgatcgcgaccaagtgctggggctacagccggattactcgcaactgcacggtctggccattggcgttatcgcgccctgtgacccgacgcgtgacgccatagacacggacttcgaagtgcgcgcctttgtcgctggcgacggtgtccaggaggacccggccaccggcagcctcaacgccggcatcgcccagtggctgttgcgcgaaggccttgcgcccgagcgctacgtggtcagccaaggctcggccattgggcgcgccgggcgtattcgcgtggcgcgccacggcgatgaaatctggatcggcggtgcggtggcggtgtgcatcgaagggcgagtacagctctagatcaatgaattgttacgggctgcgcaatacactattggccccttggcgtttgtactgccggggccaaggggcataagctttcgccccaactatttctgccgccatccaggaaacccatgaccagccagttcccccaagcccgtccacgtcgcctgcgccgctccccggagctgcgtggcttgttccaggaaaccgaattcaccctcaacgacctggtactgccgattttcgtcgaagaagaaatcgacgactttgtgccgatcaccagcatgccgggcgtggtgcgtattccagaaaagaaactggccggtgagatcgagcgctatgcccgcgccgggatcaagtcggtcatgacctttggcgtgtcccaccacctggacgccaacggcagcgacacctggaaagagcgcggcctggtctcgcgcatgtcctcgatcatcaaggacgccgtgccggaaatgatcgtaatgtccgacacctgcttctgcgaatacaccgaccacggccactgcggcgtgatgcacggcgcccacgtcgacaacgacgcgaccctggtcaacctcggcaaacaagccgtggccgccgcccgcgccggtgctgacgtaatcgcaccgtctgctgctatggacggccaggtccaggccatccgccgcgccctggacgacgccggcttcacgcatattccgatcatggcttactccaccaaattcgcctcggccctctacggcccgttccgcgaagctggcggcagcgcacttaaaggcgaccgcaaaagctaccagatgaacccaatgaaccgccgcgaagccgtgcgcgaatcgctgctcgatgagcaggaaggcgcagacgcgctgatggtcaaaccggccggtgcctacctcgacatcatccgcgacatccgcgaagcctcgcgcttgccggtggcggcgtatcaggtcagtggtgagtacgcgatgatcaaattcggtgcccaggcgggcgcgattgatgaagcgcgggtggtgcgggaaacgttggggtcgattaagcgtgcgggagcggatttgatttttacgtattttgcgatggatttggcgttggcggggatttgataccggcgcgtaaccccgtggcgagtagagttgctcatcacggggttaggattgcttgaacgtagccgtaattgccaagaaataaacattatgagtagttcgttagtgcgcgaaaaaattgtggtttttaatgtgcgctcttgtattgttttaggcagctaaggagagtttgcataaactttctttgatcatttacaggtgtgctgaagtaagttgccattgttttaaatactgtgtcaaagctatcgttgatagataagtagtggtcgattgaatcgataaaccactcttgttcgttttttgtatatgacaaaaattcatgtttggttaactcatcaaacagctctgagagctccttctcattgtttatatcttttgatgcgatcaatatttccctttctaggtcatcggtattttcaatgtcgtaggtaaataataaacctcgaattattgacatgcttggtttgttcttcatgtctcttctcattccgtatacgctgtcttgggcttgccttgattgtttagtattactcgtgcattgcgcttttggccatattgcatgccgtcatttgagtatccgtcgccaataattcttcccatgtccattggtctcagtgatgcggcatgaccatttcttctgaaaattagctgtgctctaaatattgagttcaattgatccctatgactcaggtatcgagtcgcggcaggtgggtatttaggctgtccaatgttaggtcctgatgagtaaacctcgataattcctgttgtcggatttcttgctgtattgagtctttccagctgagattcgagtgtagtctgagcgccgtgcttctccagaaaatgcgcgcctggtgtcgccttttcgagctcatccagtcgcctgtatgcgtttgcctctgcaagttcatcaattctcgcttgtcgttctgcacgtgacagttgtggtaatgcaggctctcgtttgttaacacttgttgtcgggcttttttcggtgacgcttggcgtgcatccatccccgcctggacatgtgtttaagcctagcggatccacccaccccgtaggattgggcacgtactggtacgcattgatcccacccgccagcttcaccgggtcaggtgtcaggtaacgaccaatatctggatt

SEQ ID NO: 51 - DNA, 91463 bp, Pseudomonas poae FL10F
gtcggggtaaggggattcgaactcctgacatcctgctcccaaagcaggcgcgctaccggactgcgctataccccggttttgaaattggctccgtgaccaggactcgaacctgggacccaatgattaacagtcatttgctctaccgactgagctatcacggaactacatatttcaaatgtacaacttttactgcgatgtaaccttctcttcgacccgtccgtatcgctacgttcatgtctctgaggcgcgctattctacaatcttaaaaacccctgtcaaccctttaaattgcttttaagacaatgatttgcgcttctttctgatttcttcttggggagaagaaacccgtgggctgacgttgctgcggggcgcactttacaagcctttgccttacagttcaacgccctatcgaaaaaaaaggccccgcaatgcggggcctcctcttatagccatgcaggctgggctcagtgaaagacgatttcgtcgttttccacggtggccgcaacgctggtccccggcatgaagctgcccgacaggatcaactgcgccagcgggttctcgatccagcgctggatcgcacgtttaagcggccgtgcgccatacaccgggtcgtatcccaccgcgatcagcttgtccaacgcctcgctgctcagttccaggtccagctcgcgctcggccagacggctgcgcaggcggcccaactggatctcggtgatgcccgcgatctgatcccgcgccagaggctcgaagatcaccacttcatcgacccggttgataaattccgggcggaagtgcgacgtcagcgcatccatgaccgcagcacgctgtgcttcacgatcgccgaccagctcctggatctgcgccgagcccaggttggaggtcattacgatcaccgtgttgcggaaatccacggtacgcccgtggctgtccgtcagacggccatcttccagcacctgcagcaagatgttgaacacatccgggtgggccttctcgacctcgtccagcaggatcaccgagtaaggcttgcgccgcacggcttcggtcagataaccgccctcctcgtagcccacgtagcctggtggagcgccaatcaaacgcgccaccgagtgtttctccatgaactcggacatatcgatccgcaccatggcctcttcggtatcaaagaggaactcggccaaagccttgcacagctcggtcttgcccacgccggttgggccgaggaacatgaacgagccgctcggacggttcgggtcggacaagccggcccgggaacgccgtaccgcgttggacaccgccaccaccgcctcttcctggccgatgacacgctggtgcaacaggctttccattttcagcagcttgtcacgctcgccctcgagcattttcgacacggggatgccggtccatttcgagacaacttcggcgatttcttcctcggtcaccttgctgcgcagcagctggttctcgggcttgccgtgctggtcgaccatttgcaggctgcgctccaggtcggggattaccccgtactgcaactcggccatgcggttcaggtcgcctttacggcgcgcggcttccagctcctggcgggactgctcgatcttttgctggatctgcgcagaaccctgcacttcggctttttccgaggtccagatctcttcgaggtccgaatattcacgctccaaccgcacgatttcttcctggagtttttccaggcgcttcttcgcggcctcgtcctcttcctttttcaacgcctgggattcgactttcagttgaatcaggcgccgatccaggcggtcgagcacttccggcttggagtcgatctccatgcgaatgcggctggccgcttcgtcgatcaggtcgatggccttgtccggcaactgacggtcagtgatatagcgatggctcaacttggccgccgcaatgatcgcgccgtcggtaatcgccaccttgtggtggacctcataacgctctttcaggccacgcaggatcgcgatggtgtcttcttcgctcggttcttccaccagcactttctggaaacgacgctcaagcgctgcgtccttttcaatgtactggcggtattcgttgagcgttgtcgcgccaacgcagtgcaactcgccacgagccagtgccggcttgagcatattgcccgcatccatagagccttcgcctttaccggcgccgaccatggtgtgcagttcgtcgataaacagaatgatctgcccttcctgcttcgacagttcgttgagcagggatttcaggcgctcctcgaactcgccgcggaacttggcacccgcgatcagcgagcccatgtccagagacagcaatcgcttgcctttgaggccgtccggcacttcaccattaatgatgcgctgggccaggccttcggcaatcgcggttttacccacgccaggttcgccgatcagcaccgggttgttcttggtccgacgttgcaacacttgaatggtgcgacgaatctcatcgtcacggccgatcaccgggtccagcttgccttcttcggcacgcttggtcaggtcgacggtgtatttgtccagggcctggcgcgactcctcgtggttcgggtcgtttactgcctcaccgccacgcaggttgttaatggcgttctccagggcctttttgctcacgccctggcccagcaacaatttgccaagcttgctgttgtcgtccatcgcggccagcagcaccagttcgctggagatgaattgatcacctttttgctgggccaggcgatccgcctggttaagcaggcgcgccaagtcctgcgacatattcacgtcgccggtagggttttggattttcggcagttggtcgagctctttgctcaactccttgcgcaggctgttgacgtcaaagcccacctgcatcagcaagggcttgatagaaccaccttgctgctccagaagcgcctgcatcaagtgcgcaggctcgatggccgggtggtcaaggcccaccgccaaggattgagagtctgataaagctaactgcaatttgctggttaaacgatcaatacgcattagtcaccttccttttgagcaggccggagctgtaaatacatcctgaatgaagaaacctgccagatacccctatagatgtggtcgattctggaagattcaagcggtggatcgttgacgcagatcaggagagtctagcggtcaagccagatcagggaggcaaaccgaccggtgcgagcgctgcggcggtaagaaaagaagcgtgggtcggtgacggtgcaggaaccaccaccataaacagcggtgacaccgcgagcggccaggcgcaggcgcgccaactcatagatgtcggccatgtacttgcctgggttacggcttggtacaaaggcttgggcagtgatcggcaattgctgcataaaggcttcgcgcacttccgggccgacttcaaaggcgtgcgggccgatggccgggccgagccagaccaacacgtcgtcgggctcggactccaggcgttcgaaagccgcttcgagcacgcctgccgccaggccacgccaaccggcatgggcggcggccacacgcgtgccggcacggttgcagaacaacgcgggcaggcaatcggcagtcattgatgtgcaggcaataccgggggtgctggtccaactgccatcggcttcggcagtgcgcgacggatcagcttcgaccacgttggtgccgtggacttggcgcagccacgcaggctgaatatcaaaggcatcggtaaggcgacggcgattttcaagaacggcctcaaggctgtcctcgacatgatcgcccaaattgaggctgtcgaacggcgccagactgacgccgcccgctcgtgtggtgacgcaggctttcaccccggccggcgcgggccagtcaggaatcagccagtcactcatccgataaacgcctcgcgatcctgcttgagcagcgacaacaaccagaccaaatcgtctggaagaggcgattcccagctcatccgcttaccgctcgtcggatgatccagctccaggaaacgtgcatgcagtgcctggcgcgggaaggatttcagcgattcgaccatggtctggctcgccgccggcggaatacggaagcggccgccgtaggccggatctccgaccaacgggaagttaatgtgtgccatgtgcacgcgaatctggtgcgtacgaccggtttccagcttgacccgcacatgcgtgtgggagcgaaaacgctccagtacacggtagtggctgacggcttgcttgccgccttccatcaccgccatacgctggcgctgctggccgtggcggccgataggcgcgttgatcttgccgcctgccaccaccacgccgataacgatgcattcgtaaatgcggctgacgctgcggctctgcaattgtgtgaccaactgcgtctgcgcctggatagtcttggccaccaccataaggccggtggtgtccttgtccaggcggtgcacgatgccgcagcgcggcacattgatgatgtccggcacgtggtgcaacagggcattgagcaaggtgccatcagcgtgcccggctgccgggtgaaccaccaggcctgcgggtttattgatgaccaggatgtcgtcgtcttcatagacgatgtccagctcgatgtcctgggcgacccattctccctgggcttcctgctcggcagtcagctcaagaatcgcaccgccatggactatgtctcgcgggcggataaccgctccatccacagtcaggcggccgtctttgatccaggcggaaaggcgcgagcgcgagtgctcagcgaataattgtgcggcgacttgatcgaggcgttggccgcccaattcggacggcacctctgcgcgaagttcaattttatcggacatgctcagactaggcgtggcacagcctttggtttcggctgcgcgcttgtggttaaatacggcgtcttttgccccgaggctttcaacggggcgctcatcataacaggacggccccgcccaagacagcggccgtcatagggacgcaagccgccatgcaagtgaaacacctgctgctgatcgccatcctcgccatgactgctgcttgctcgtcaacaaaggaagtcgtcgacgaaaacctgagcgaagtcgagctgtatcaattagctcaaaaagacttggacaataatagctacaccagcgccacagcgaagctgaaggccttggagtcgcgctatccgttcgggcgctacgccgaccaggcacagctcgagctgatctacgccaactacaagaacgccgagccggaagctgccaagtccgccgccgagcgttttatccgtctgcacccgcagcatccgaacgtggactacgcctactacatgaagggcctgacctcgttcgaccaggacgtgggcctgttggcgcgcttcctgccgctggacatgaccaagcgtgacccgggcgctgcccgcgactcctacaacgagttcgcccagctgaccagccgctaccccaacagccgctacgcgccggactccaagcagcgcatgatctacctgcgcaacctgctggcgtcctacgagattcacgtggctcactactacctgacccgtcaggcgtacgtggcagccgccaaccgtggccgctatgtagtggaaaacttccaggaaaccccatccgtgggtgacggcctggcagtgatgaccgaggcttaccagcgcctgcacctggacgccctggcggccaccagcctggaaaccctgaaactcaactacccggaccacccaagcctgaaagacggccagttcgtgcctcaggttgccgaagcggacaaccgttcgtggctgagcaagtacaccttgggcctgatcgaatcccgtccaccgctgccgccgggcgaaacccgcgccaaccaggacgtgatgaagcagtaccaggacgccaaggaagccattccttcggagctcaagccgcacgacgaaaacggcgacgtgatcgaagagcaggagccgcaggccctcggcaacaaccaggaccgttcgtggttcagctacatgaccttcggtgtgttcgactgattgttcgacgcaacgcaaaaagggagcccctcggggctcccttttttatgggccagcattattgcgctgtgcgcccgctacgaccttggctaaactggcgcattccttgtcgagaaactgcccatcatgcttcgtctactgttctggattgccgtcattgctgccgcggtatggttctggcgcaaattcaaaagcccggctgccaagcagcaacgcagcggcgagcccgacgcagccttgatggtgcgttgcgcccactgcggcgtgcatttgccgcaggatcgcgcactgagctcaaaccaacagtggtactgcacccaggcacacctggagcaaggcccgaagtctatccagcgttgagccgaccttcaggcgcatagggcgccgggtcgatgatcggtgtgcgccccagcaacaagtcgcaaaacaactggcaggatgccggcgcaagcaccaggccattgcggtaatgcccgcaattgagccacagccctttgcggcctgggacttcaccgatgtaggggatgccctccggtgagccaggccgcagaccggcccaatgccccacgacctcggcgcccgccagcgcgggaatcaattccaccgcagaagccttgaggctttccagcgcagcgtcggtcggggtcttgtcgaacccttcatgttcaagcgtgctgccgatcagaatgtgcccatcacgccgcgggatcgcatagcgccccttggccaggaccatgctcgacaagaaatctgacgcgcacttgtacaaaatcatctggcctttgaccggctctacgggaagtgccaagcccagtcttcccagcagttccccgctccaggcaccggccgccagcacgacctgatccccaacgatcggccccgcagccgtgtttacgcccacgacgttttcgccctcgaggacaaaaccgttcacctcacactgctcgtggatagtcacgccgggtaacgccgacagcgccgccttgagggatttgaccaggcgcgggttgcgcacattggccacgtccgccatgtagatcgcctgggaataccccccgcccaacaccggcaccgcgtcgtgggcagccgacacatccactttgctcaacggccggccttcacgggcagcccaggccagtgcttcggcctcgtcgtccaggtccagccagtacaaacccgtggtatgcacctctggatcaacgcccgtggcggcgaacaaccgttgcgccagttgcggataaaaatcctgggaccaatgcgccagtgccgtgaccgccgggctgtagcgccacgggtacagcggcgacacaatgccgccgcctgcccaggaagactcctgcccaagccctgcgcgctccagcagtgtgactgcctgcccctgggtggccaggttgtacgccgtcaacaacccgattactccgccaccgacaatcaccacttgctgttgcttagccatcacttgatccagccgataaaaagggaaaagcgcactcggcgcccactcatccagcactctcatcattgcccccagcacgccttgcgcgacatgtcaggcgccgcgcccggattgctgcgcacgccggaactgctcaagctgaactcaccgcaagggtcgcctgccatgactgagccgactgcaggcgcggccaccaggtgaaattcctgagggtttaatactgcgctgattctatagcgttcattgcccacactgacgccgcttgcatcaataaaagtgccgttgcgcgtgtaaaagcgctccaggttgtggacttgctcagacaacaacgcaacgatctcggcgcggtaggctttttttacatagctggtatagccggggtaagcgactgcggccagtaacgcgacgatcgcaacagcgatcagtaactcgatcagggtaaaaccttggcaatccttgcccattgatacgctccttattgaagttgacgccataaaactcgacgaaatttcggaccttgcgcttcgttgacctgcgcatacaccgtctccagcaccgtgcgcgactgaccactgaacccgacagccgtcacgcggaacaacgcggcaggcgtttgcgcgggcagaccaaccacgccctctgcctgccccagcgattgaacgccatacagcccgctcttcagggcagcccaattaacggctgaaacagggttcgccccggcacccaccaccgaaaacgcctcctgcgggggcgcgcaggcgctgatcgactggcagagcggcagcaccaaccctgtgcgttgcacgatcaattcacccagcctcagcccactttcagcagtctgaaatgattgattacgatgccagatgccaccggcaatcttttgctgggacacagctccttgcatcgacgccaggccgagcagtgataacaccagcagaaacaccaggctgatcaccaggaccatgccggtctgacgcaggtaaaaaccgtgatagctgagcataatcaccctaccccagccgattgcgcagcgcggccacgacgctgtagagctggtcctgaacacgcccggccgggtctcgcagcgtcatctggatgcgcacgctgcgtatcagcgattcgtccgccgggctggcgtcatagcgcaccacacgcgttgcgccgggcttggccgctacaccaaaactgacgtcgaacgcctgaacgttatccaccagcaccgtcctggccggcgctgcgggtgtactgaccttcaactgcccggcttcaaaggtgtaggtgagctggcgtagcgcaaaccggatctgcccaggcgccggtggtggcgagctgcccgcataggcctgggctgtaccggtgcaatcggagagcaccgtccagtcgggcttgccaccctcgcctcccgaatcggcggtgaccagcgtcagtgacctggcgctccctgcggcactccaactgaccggccgttcaaacgcggccggtgcgttatcgatataggccgtcgccaggcagccgaacatgcccgcctggcgcacatcctgaatgatcttgcccagcacaaaccgcgcatcatcctgcagcaacatggcggcctgctggctggcatgggtggcccgtgcgctgatgacgacctggctgcccccgagtatcagcaccaacccgatggccagcgccagcaacaactccaccaggctgaaaccccgcgcgcagcgactcattgcgccacctcctgcgcgccggcaatgcggctggtgagggtgaaggtttcccgcgcgccgcggcttttcgctcccctggcatcgtcccaactgatactcacggtgacctcgctaccgctgaccaccacagagcctttggcgctcgccccggcaaagccgatgatattggcttcgaaatcatgcaggtccaggtcacgtacgctggcggtagccgtactgggcggaccgccttcgttgcggccccaggagtaatcggcgcccgagttggcccgaacgcggtcgagcatgtcgtaagcaatgaagctggcctggctgatcatccttgagctgtcggtgtaggtgagtgcattgagctggataaccgccgcgcccagcaggccaacggcaagaatcagcacagccaccagtacctcgatcagcgtcatgccggattggcgccggggcaaagcacgggcagcgtttgtgttggagcaaacaagcattaccgtcgtcatccgtgtcgaaggccgaaaaaaagcaggagaaacctgctgtgcggcccaagactagcgtcggttttgggccggcgctgctctcggaacaaagggaaatactttggacataaaggccatcactgcacacccagagagtggcgctatacctaggcctaccacctgaaacactgactacgtccacggagggacggcacatgagacaacgcggcttcaccctgattgaactgctgctgagcctgcttctgagcggcatcctggcgaacctggcagtgccgggtttcaggggtttgcttgagtcgcagcaacgacaaaccgctgcgcagtcgctggccagcgggctgcgctacgcccgcaccgaggcgattgcgcgcaatcgtgcggtggtcattcatgcacggcaggaggactggagccagggctggcgagtgatcgtggacgaaagcggacgcggccactcggacgacgacaaccccgtgctgttggaacgacaggacagcgggaaaataccgattgtcgggaatgggccggtcaagagccaggtgcgcttcagcggcttgggcgaaccgatattttcagccggaggtttccgtgcaggcaccgtgcatgtgtgcgacacgggccaggcgcaaagcctgtttcaggtagtacttgcccccagcgggcgcatcagcctgcgcagcgacaccaccgagcagacgctgtgccggaaggactccggcacctcggcactcagagcaacgagcgaacccgcagctccttgggcatcgagaacgtgatgttctcttcacgaccggccaactcatcggcgccggtggcaccccaggcctgcagttgctggatcacaccgcgcaccagcacttcaggagccgaagcgcccgcggtgatgccgatacgctcgacgccgtcgaaccagctgcgctgcatgtcttcggcgccgtcgatcaggtacgcgggcgtggccatgcgttcagccagctcgcgcaggcggttggagttggagctgttggggctgccgacgaccagcaccacgtcgcattcgtcagccagttgcttgaccgcgtcctggcggttttgcgtggcgtagcagatgtcgtctttgcgcgggccaccgatggctgggaatcgcgtgcgcagggcatcgattacgcggctggtgtcgtccatcgacaaggtggtctgcgtgacaaaggccaggcgctctgggttctgcacctgcaggttggcgacgtctttttcgtcttccaccaggtagatcgcgccaccattactggcgtcgtactggcccatggtgccttcgacttccgggtggccggcgtggccgatcaggatgcattcacggccgtcgcggctgtaacgcgcgacttcgatgtgcaccttggtgaccaacgggcaggtggcatcgaataccttcaggccacggccggcagcttcggtgcgcacggcctgggaaaccccgtgggcactgaaaatgacgataacgtcgtccggcacctgatcgagttcttcgacaaagatggcaccgcgcgcgcgcaggtcttcaaccacaaatttgttatggacgacttcatggcgcacgtaaatcggcggcccgaagacttccagggcgcggttgacgatttcgatcgcccggtccacaccagcgcagaagccacgggggttggcgagtttgatttgcatgctgtgcctcgtgtcttgcagggcaagaaattggatcgactcaactctacaggagtgagcccctgtgggagccgggcttgcccgcgatgcagacgactgggtgtatcaggtacaccgaggtgatgctatcgcaggccagccagcgcccacataaaccagccccacaggagccagcgtcgttgatcagagcgctttaacgtcgatgatttcgacgtcaaacgtcaaggttttaccggccaacgggtggttgaagtcgatggtcacttgcgcgtcatcgaaggttttcaccacgccgggcagctcggtattcgccgcatcgttgaaaatcaccaacaggccttccgacaggtccatgtcctggaactgcgaacgcgggatgatctgtacgttttgcgggttgggctggccaaaagcattttccggcaaaatctgcagggtgcgcttgtcaccggccttgaaaccgaacagtgccgcttcgaagcccggcagcaggttgccatcgccgaccttgaaggtcgccggggctttgtcgaacgtgctgtcgaccgtgtcgccgttctccaggcgcagtgcgaaatgcaaagtgacttccgtgttctggccgatgcgttgctcagccaatacctgatcagtcattgacggtctctccggttttcttgcttttgaacatgtccaacgccagcatgattgcaccgacggtgatggcgctgtcggcaaagttgaacgccgggaagtaccagcggttctgccaatgcaccaggataaagtcgatcacatggcccagggcaatgcggtcgtaaaggttacccagggcgccgcccagcaccaaggccagggcgatggcgagccaggtgtcatcgcggcccaggcgtttgagccagaccaccagcacggcactgaccaccacggcgatcacggcgaacagccagcgctgccagccgccgccatcggcgaggaagctgaaggcagcgccggtgttgtaggccagggtccagctgaagtaatccgggatcaccacgatttgctggaacatctccagggcgccttcgaaatgagctttgctgacctggtcgatgaccaggatcagcacgctcagtacgagccagcccagacgtccgaaacggctggtgttaggcatagtggcgaacctcgccggcaccgctgatgttgtccacgcaacgaccgcagatttccggatgctcagggttcacgccaacgtcttcacggcagtgccagcaacgggcgcacttagggaaggccgacttgaccacttgcagcttgaggcctggtacttcggtggccacggcgtccgctggcgcctgggcaaacggtgccaggctggcggtcgaggtgatcagcacgaagcgcagttcgttgctcagcttggccaggtcggcgctcaggctttcctcggcaaacagggtgacttcggcttgcaggttgccaccgacggccttggccgcacgctgaacttccagctccttgttcaccgccactttgacggccatcacgccttcccagtactcgcggcccagttcgaagtcagccggcagttcggtcaggccttcgtaccaggtgttgagcatgaccgattcgttacgctcgcccggcaggtattcccacagttcgtcggcggtgaaggccaggatcggcgcgatccagcgcaccagcgcttcagagatgtggtacagcgcggtctgcgccgaacggcgtgccttgctgttggcgccggtggtgtactggcggtccttgatgatgtcgaggtaaaaaccgcccagctcctgcacgcagaagttgtggatcttcgagtagacgttccagaaacggtattcgccgtagtgctcctgcaactcacgctgcagcaacagggtacggtccacggcccagcggtccagggcgagcatgtcctcggccggcaggatatcggtggccgggttgaaaccggtcaggttcgacagcaggaagcgtgcggtattacggatacggcggtaggcatcggcgctacgggccaggatctggtccgacacggcgatttcgcccgagtaatcggtcgacgctacccacaggcgcatgatgtcggcgcccaaggtgtcattgatctttttcggctcgatcacgtttttcagcgacttggacatcttgcggcccgtctcgtcgacggtgaagccgtgggtcagcaactcacggtacggcgcgtggttgtcgatggcgcagccggtcagcaaggaggagtggaaccagccacggtgctggtccgaaccttccaggtacaggtcggcacgcgggccggtttcgtggcccatcgggtgcgaaccgcgcagcacgtgccagtgggtggtaccggagtcgaaccacacgtcgagagtgtcgctgatcttgtcgtacagcggcgcttcgtcgcccagcagctcggcggcgtccagcttgaaccaggcttcgatgccttcctgctcaacacgctgggccacgacttccatcagttcgacggtgcgcggatgcagctcgccgctttccttgttcaggaagaacgggatcggcacgccccagttacgctggcgggagatgcaccagtccggacggttggcgatcatcgagtgcaggcgcgcctggccccaggccggaacgaacttggtgtcttcgatggctttgagcgagcgcacacgcagggtgtcgccgttgactggctctttgtccatgccgatgaaccactgcgcggtggcgcggtagatcagcgggctcttgtgacgccagcagtgcatgtagctgtgcttgatggtgtcggtttgcaccagcgcaccgacttcacgcagcttgtcgatgatcggctggtcggccttgaagatgaactggccgccgaagaactccagcgaaggcacgtagacgccgttgctttgcaccgggttgatgatgtcatcgttgaccatgccgtacttcttgcagatcacgaagtcgtccacgccataagcgggcgagcagtgaaccacacccgtacccgaacccagttcgacgtagtcggccaggtacaccggcgacaaacggtcatagaacgggtgacggaagttgatcagttccagcgcggtgccggtggtggtggcgatcaccgaaccttgcagttcgtagcgtgccaggcaggcttcgaccatttcctcggccagcaccagcaggcggtcaccgacgtccaccagggcataggtgaattccgggtgcacgttcagcgcctggttggccgggatggtccacggcgtggtggtccagatcacgatagccgccggcttggccagcgatgccaggccaaaggcttcggccagcttggcgtcgtcggcaaccgggaaggccacgtcgatggtcgaggactttttgtcttcgtactcgacttccgcttcggccagggccgaaccgcaatcgaagcaccagttcacaggcttgaggcccttgaacacgaagccgcccttgacgatttcggccaaggcgcggatctctccggcctcgttcttgaagttcatggtcttgtacgggttgtcccactcgcccaacacgcccaggcggatgaattcggacttctgcccttcgatctgctcggtggcgtaggcacggcacagttcgcgggttttatccgcgcccaggttcttgccgtaagtcacttcgactttgtgctcgatcggcaggccgtggcagtcccagcccggaacataaggtgcgtcgaaacccgacagggttttcgagcgcaggatcatgtccttgagaattttgttcagcgcatgaccgatgtgaatcgtgccgttggcataaggagggccgtcgtgcaggacgaatttcggacgatccttgccaatttcgcgcaactttccgtacaggccaatactgtcccagcgctgcaggatctgcggttcgcgctgtggcaggccggccttcattgggaaggcggtgtccggaaggtttagcgtggctttatagtcggtcatttaaggctcttcggttagcgatgggcgctaggtgcggctagtgcacgggcggcggcgacatccgcattgatcgccgttttcaacgcctcaagcgaggcgaaacgctgctcttcacgcagcttctggtggaaaaccaccgtcaaacgccggtcatacaaatcaccggcaaaatccaaaaggtgaacttccaggtgggccttgccatcacctgcaaccgtgggtctgacgcctatgttggcgactcccggccacgattggccgtcgatgtcgacgctcaccaggtaaaccccggtaagtggcacacgacggcgcttgagttgcacgttggcggttggcgtaccgagttggcgcgccagcttctgaccgtgcagtacccgcccggcaatgcggaacgggcgaccgagcaagcgctcggccaaggcgaagtcggcagcggccagggcgttacgcacctgggtactgctcacgcgcaggccgtccagttcgacggtttgcgcggcttcgacggtaaaaccttgattcacaccggcgtgctgcagaaagtcgaaatccccgacgcggtcgcaaccgaaacggaagtcgtcgccgacctccaggtgctgtacgcccaggccatccaccagaatacggtcgacgaactcggcggcgctgaggctttgcaaacgctggttgaaggccaggcagagcacacggtctacgccctcttccgccagcagctgcagcttgtcgcgcaaacgcgccaaacgtgccggcgccgtttcaggggtaaagaattcccgtggctgcggctcaaaaatcaccacgcagctgggcacgcccaactcgaccgcgcgttcacgcagccggcccaggatagcctggtggccacggtgaacaccgtcaaagttgccaatagtggcgacgcagccccgatgctcggggcgcaggttgtggagacctcgaaccagctgcataacgcgcttcttgctcataaagtggtcgattataaccacacccagccccggacgacaggcaacagcgcaggccaaatggatcgaatcgataaaacaaccgttttatcgcggcaaactctctatcccagcgacttgcgattgaaatcgcgcagtcggaaaccctgcagcagcaacatcccgaagtacaccaccacgcctgcgaccaccaacacgcccaggcgcatgaagcgctccagcatatggccctggtcccaggctggcataaagtgcatcaagccgagcagtaccgccgacatggccgcaaccgccaccagcaacttgagggcaaacatgccccagcccggctgcggttggtacatctgctgcttgcgcagctgataaaacagcaggccggcattgatgcaggcgccggcgctgattgccaacgccaggccagcgtgggccagcgggccgataaacaccaggttgagcagttgcgtgacgatcagcgtgaaaatcgcgattttgaccggcgtgcggatgttctgctgggcgtaaaagcctggggccagcactttgatcacgataataccgagcagcccgacggaataagcgaccagcgcgtgctgggtcatgagtgcgtcatgcgcgtcaaactggccgtattggaacagcgagacggtcaacggctcggccagaatccccaaggccagggagcacggcagcaccagcatgaaacacaggcgcaggccccagtcgagaatgcgcgagtattcctgacggtctttgctggcgtaggtgcgcgccagggtcggcagcagaatcgtgcccaacgctacgccaagtacgccggacggcagctccatcagacggtcggcgtaatacatccacgacaccgagcctgaaaccagcagcgaggcgaaggcggtgttgatgatcagcgaaatctggctgaccgaaacgccaaggatcgccggcagcatattgcgcatcacgcgccagacaccggtgtccttgaggttcaggcgcggcagcacgagcatgccgatctttttcaggtgtggcagctggtacagcaattgcgccaggccaccggccagcaccgcccagcccagggccatcaccggcgggtcgaagtacggcgtgaggaacagcgcgaaaataatcatgctgacgttcagcaatgtcggcacgaaggccggcaccgagaagcggttccaggtgttgaggatcgcaccggccagggacgacagggaaatcagcaatatataaggaaaggtcacccgcagcagatcagtggtcagcgcgaatttttccggggtattggcgaaaccgggggcgctggcccagatcacccaaggcgcggcaagcatgccggcgatggtcaccagcatcagtaccagggtcagcaggccggacacataggcaataaaggtgcgggtggcctcttcgccctgctgggtcttgtattcggccaggatcggcacgaacgcttgggaaaatgcgccttcggcaaagattcgccgcagcagattgggcaatttaaaggcaataaagaacgcatccgtggccatgctggcgccaaaaatgcgcgccagcagggtgtcacgcacgaaccccaaaacccgggagatcatcgtgatagagctgacggcagccaacgatttgagcagattcattgaaagagtttgcgcctatagataaagagcaggcgaacaaagcgcccacttatgcgatactgcgcgcctgcaacagcacagagccaaagctcgcgagtttacaggtcaagcgccggaaataaatcacccgcctcttcagatcgaccactcagcagttcgcatcagccgcccttgacaacccatcaagtcatcggcatgattcgcggcctattttgtttgctatttcctaaaaagtctttcgaggagctcgacggtggccaacacaccttccgccaaaaaacgtgcaaaacaggctgagaagcgtcgcagccacaacgccagcctgcgttccatggttcgtacctacatcaagaatgtagttaaagccatcgacaccaaagacgctgaaaaagcccaagctgcttacgttctggccgtgccagttatcgaccgtatggccgataaaggcatcatccacaagaacaaggccgctcgtcataagagccgcctgaatggccacatcaaggctctgaacgtcgctgcagcagcctaagtggtaacaactgccgcgtaacccaggttgcgtaacagttaagaaatgccccgtaccgaaaggtccggggcatttttgtttgcctacagaatcaccacagctctccttgtgggagcgggcttgcccgcgatgacagtgtgtcagtcaccaaatacctggctgatacaccgctatcgcgggcaagcccgctcccacatttggactgcggtgcattttcaaggccaaaaaaaacgccccgaaccagtcggggcgttttgctacctattgatcaaaccacaatcaatggtgatgaccgccttcaccgtgaacgtggccgtgggccacttcttcctgggaagcgtcacggatggcaacgatcttcacttggaagttcaggcgctggccagccagagggtggttaccgtcgacagtcacgtcgtcgccgtccaggtcgcggatggtgacgatctgcatttggccgtccggcgcggaagcgtggaactgcatgcccacttccagctcgtcaacgccttcgaacatgctgcggctcaaggtgctgaccagttcggcggagtattcgccgtaagcatcttcaggttctacggcgacggtcagttcgtcaccgacgttcttgccttccagagccttctccaggcccgggatgatgttacctgcgccttgcaggtagaccagcggcgcgccgccggcggagctgtcgatgacctcaccagcgtcgttggtcagggtatagtcgatggagacagccttgttagcggcgatcgtcatggggcgagaccttttgcataagaatgaagaacggacaagtctaaacaaggatttgcccgaaagcgaacacaacccggacagacggggccgatcaacggcaaccttcatcatcggcttccggcaggacgacgacgggcactgggtcgccgagctgtcctgcggccacacccaacacctgcgccaccagccgccctggcagtcccgcgcctgggtactcgaccccgcgcaacgccttgaaaaaataggccaaccctttgcgtgcggctggtgtgcgcaacagcgcgaataacgataaccttggcgtctgattcccggtaggtactcagccatagagcgccaccgaagccatgcacctccagagaattcgcatgcagactttttttatcgcgcccaccgattttggtgtgggtctgacctccatcagccttgggctggtgcgtacccttgaacgggccgggctgaaagtcggcttcttcaaaccgattgcccagccgcacccgggcgacaccggccccgaacgctccaccgaactggtggcgcgcacccacggcctgaaaccgccacaaccgctgggcctggcccatgtggagcgcatgctcggtgacggccagctcgacgagctgctcgaagaaatcatcaccctgtaccagcaagccgctgtgggcaaggacgtgctgatcgtcgaaggcatggtgccgacccgcagcgccagctatgcggcgcgggtcaacctgcacctggccaagagcctcgatgccgaagtgatcctggtgtcggcgccggaaaacgaagtgctcacagagctgtccggccgcgtggaattgcaggctcagctgttcggcggccccaaagacccgaaagtgctgggcgtaatcctcaataaagtgcgcaccgacgaaagcatggaagccttctcggcgcgcctcaaagagcattcgcccctgttgcgcagcggtgacttccgcctgctcggctgcattccctaccagcccgaactcaacgcgccgcgcacccgcgacgtggctgacctgatgggcgcacagatcctcaacgccggcgattatgaaagccggcgcatgaccaagatcatcatctgtgcccgcaccatgcgtaacaccgtggagctgctcaaacccggcgtgctggtggttaccccaggcgatcgcgacgatatcatcctcgcggtcagcctcgcggcgatcaacggtgtaccgctggccgggctgttgctgaccagcgacacgctgcccgacccacgcatcatggatctgtgccgtggcgcgttccaggccgggctgccagtactgtccgtgagcaccggctcctacgacaccgccaatcagctcaacagcctgaacaaagagatcccgattgatgaccgcgaacgcgcggaaatcatcactgactttgtcgccagccacctcgatgcgcgctggctgcaccaacgctgcggcacgccacgggagatgcgcctgtcgcctgccgtattccgttatcaactgatccagcgcgcccaagccgccaacaaacgcattgtgttacccgaaggcagcgagccattgaccgtgcaagcggccgccatctgccaggcacgcggcattgcccgttgcgtgctgctggccaaaccggcggacgtggaagccgtcgcccgtgcccagggcatcgagttgcccgaaggcctggagattctcgacccggacctgatccgccagcgttatgtcgaaccgatggtcgcgctgcgcaagagcaagagcctcaacgcgccgatggccgagcagcaactggaagacaccgtggtgatcgccacgatgatgctcgcgttggacgaagtggacggcctggtttccggcgtcattcactccactgccaacaccatccgccctgccctgcaactgatcaaaacggcgccgggctgcaccctggtgtcgtcggtgttcttcatgttgttccccgagcaggtgctggtgtacggcgactgcgtgatgaacccgcacccgagcgctgcggaactcgcggaaatcgccctgcaaagcgccgactcggccgccgcgttcggcattaccccgcgcgtggcgatgatcagctattccagcggcgactcggccagtggcgaagaagtggaaaaagttcgtgaagccaccctgctcgcccacgaacagcaaagctcgttgctgatcgacgggccgttgcagtacgacgccgccgccaacgaaaccgtcgcacggcagctggcgcccaacagcctggtcgccggcaaagccacggtgtttgtgttcccggacctgaacaccggcaacaccacgcacaaagccgtgcaacgcagcgccgattgcgtaagcctggggccgatgctgcaaggcctgcgcaaaccggtgaacgacctgccgcgcggcgcccaggtcgacgacattgtgtacaccatcgcactgactgcgattcaagccgccaaccgacctatggatatctaaatgctggattttctacctgccaccgtgcgtggggtgatcgcgtccttgttgttggcgctgaacacgatcctgctgtgctcgtttctgtttatcgtcgcgctgttcaaggcgctgccgtttgccaaacgcttcagcgaatggctgatgaaccacacccatgaagcctgggtcaccaacaacaagggctggatgaacctggtacgccgcacgcgctggcacctgagcggccttgaaggcctggactatcagcattcgtacctggtgaccagtaaccatcagagctgggtggatatcatggtgttgcagtacgtgctcaatcgacgcactcgcccgctgaagttcttccttaagcaggagttgatctgggtgccggtgatcggcctggcatggtgggcgttgggcttcccgttcatgaaacgctacaccaaggcctacttggagaagcacccggagaagaaaggcaaagacctggaaaccacgcgcaagacctgtgcgaagtttcgcgacaacccggtgggcatattcaactttgccgaaggcacacggtttacgccgggcaagcatgcccagcagaaatccccatttcgctatttgctcaagcccaaggccggcgggatcgcgtttgtactggatgccatgggtgagcagttgaaatcactggtgaacgtgacgattcactaccctgccgggcgcccggggtattgggacttgctgtgtgggaatgtgaaggacgtggtggtgcactttgaagaagtgcaaattccggccgggtttattggcaagaattacgagcaggatggagagtatcggttggcgtttcagggctggattaaccagctgtgggaagacaaggatgcgttgctggagaagctgcacacagatttccctgccagatgatcgttcccacgctctgcgtgggaatgcttcctgtgacgctccgcgtcacgacttcaagagcggacgcagagcgtccagagcggcattcccacgcagagcatgggaacgatcagcccgccaccgagtaatcggtggcgggcttttttgtggcggcgaggtttagatcgcgccgcgctggcgcaacagttccagcacttgcttgacgctgtcttccagcgacagggcctgggtgtcgatcaccagatcggcattcaacggtacgtcgtacgggaaggattcgcctgggatgttatccccaccggcagcgtacaagccttgcgggtcacgctcggcgcacaccagcggcgacgcttgcacgtaaacggtgagcaggcggtcggcaccgatcagcgccttggcctgttcgcggccttcagcgtccggtgcaacgaacgcagccagggtcagcaggccggcttcgttgaactggcgcgccacgtgagcggcacgacgccagttctcggtacgcccggcgcggtcctgcggcaagcccttgttcaggtcgtgacgcaggttctggccatccagcacaaataccgcacggcccatgtcgaacagcttgcgttcaaccgcgtaggccaaggtgcttttgcccgcgcccgacaggccgctgaacaacacggtggccggctgctggccaaagcgcagagcacgctcttcggtggcgacatgagcaaggctgccgtgctgcgcagaaccgccgtggttgaccggcggcgcaatgatcatgcccgcagccacggtgccgttggtcaaccggtcgatgacgataaacgcaccggtggtgcggttgctgtcgtagccgtccagcgcgatggcggcgtcgaggctgaccttaacccggccgatctcgttcaattgcagcgaactcgccgggccttcggccagggtgttcacgtccacgcggtgcacgatgctggtgatggaacccggcacgtagctggtggcgcgcttgatgtcgtatttcttgcccggcagcatcggctcttcggccatccacaccagcatggcgtcgaaggcgtcggtcacttgcggcacgttgtcggcatgcaccagcaggtcgccacgggagatgtcgatctcatcttccatggtcagggtcactgcctggcctgggccggcgtgttccagctcaccttcaaaggtgacgatggatttgacgcggctgctcttgcccgacggcagcaccacgacttcgtcgcccttgtgcacgatgccgctggccagggtgccggcgaaaccacggaagttcaggttcggacggttgacgtactgcaccgggaaacgcaggtcggtgtagttgcggtcgttggcgatctcgacgctttcgagaatttccatcaacgactggccggtgtaccaaggcgaacgctcgcttttgttcaccacgttgtcgcccttgagcgccgacatcggcacgaacgccatggtgctcggcttgaacgcgatgccctcggcgaacttcaggtaatcggccttgatctgctcgaagatgctttggtcgaagccattgatgtccatcttgttgacggccaccacgatgtgcttgatacccagcagcgaagcaataaagctgtggcgacgggtctgggtctgcacgccgtagcgggcgtcgatcaggataatcgccaggtcacaggtagaggcaccggtagccatgttgcgggtgtactgctcatggccgggggtgtcggcgatgatgaatttgcgcttggcggtggagaagtagcggtaggcaacatcaatggtgatgccctgctcgcgctcggcctgcaggccgtcgaccagcaacgccaggtcgatgtcgtcaccggtggtgccggacttcttcgaatcgcgggtaatggcttccaggtgatcttcgtagatcatcttggagtcgtgcagcaggcgcccgatcagggtgctcttgccgtcgtcgacgttgccgcaggtcaggaagcgcaacatttccttgcgctcgtgctggcccaggtaggcgaggatgtcctcgctgatcaaatcagatacgtgcgacatgacagccccttagaaatagccttgacgttttttatcttccatcgagcctgcaccatcgtggtcgatgacacggccctggcgctcggaagttcgcgtcaggagcatttcctgaatgatgtccgtcagcgtctcggcttcggactccaccgcgcccgtcaacgggtagcagccaagggtacggaaacgtactttctttttgacgattcgggctttgtcttcgtcagacaagtgctcgaggatgcggtcgtcgtcgatcatgatcaacgtgccgttcttttcgatcacatcgcgctcggcggcaaaatacagcggcacaatcggaatgccttcgaggtagatgtactgccagatgtccagctcggtccagttggacagcgggaacacacggatcgactcacccttgttgacgttgccgttgtagacgttccacagctccgggcgctggtttttcgggtcccagcggtgcttgctgtcgcggaacgagtacacacgctctttggcgcgggatttctcttcatcgcgacgggcaccgccaaaggctgcgtcgaaaccatgcttgtccaaggcctgcttgaggccttcggttttcatgatgtcggtgtgcttggcgctgccgtgggtgaacgggttgatgccctgcgccacgccatccgggttgacgtgggtgatcaggtccaggcccagctcttcgaccattttgtcgcggaacttgtacatctcctggaatttccagcgggtgtcgacgtgcatcaccgggaacggcagcttgcccgggaagaaagccttgcgcgccaggtgcagcatcacggcggagtctttaccgatcgagtagagcatcaccgggttgtcgaactcggcggcgacctcgcggatgatgtggatgctttccgcctccagctgtttcagatgcgtcagtttgtcgaccatggctactcacggaaaaacgatcttatggacggccagcgggccgtgttcgagcgaggcatgctagcacagcaccttcttctattcagggagctggctagatcgaaacggtatatgaatatgcctccgagtttggcgtgaaacccggccagcggtgggagaaggcttgtgtgggagctggcttgcctgcgatgcagccacctcggtcagacaggtaattgaggtgatgctatcgcaggcaagccagctcccacagtgggccagcggcgaggcttagatcgggttggggcaatcgatgaaaaggtgttccagagcaaagcgtcgggccaggtaatcgcccaacgcctggacaccgtagcgctcagtggcgtggtgcccggcggcgatgaaactgatgtcgttttcccgcgcactgtggaaggtttgttcggaggcttcgccgctcaaatacaggtcgacaccggccgcaatcgcgtcgtcgatgtagccctggccaccgcccgtgcaccagccgacacggcggatcatttcgctgccttcgatcagcagtggctcgcggcccatcacatcctgcacacggcgggcgaagtcgcgaggcgacaacggctcggcgagggatccgaccaggccgacgattttcgggttgctcgggtccagcgggccttcgacggtgatgtccagctggcgggccagttgcacgttattgcccacctcggcatgcaggtccagcggcaggtggtaggcgagcaaactgatgtcgtgtttaagcagggttttcaggcggcgctgcttcatgccggtgatgcacgggttttcgcctttccagaaataaccatggtgcaccagcaccaaatcggcctgggcctcgacggcggcgtccagcagggcttggcttgcggtcacgccgctgacgatgcgcatcacctgcgggcgaccctcgacctgcaggccattggggcaataatcggcaatttttgcactgccgaggtagcggtccgcttcctcgacgagggtggtaagggggacggccataaaagactcctaaatatcccgttccgaggcgctcgcagcctcgtataatgcgcgacattatgggcgctctcccgccccctgcaacctgtcaggacttacttgatgctcaaggcactgcgtttttttggatggccattgttggctggcgtgctgatcgcgatgctgattattcagcgttatccccagtgggtgggcttacccagcctggatgtgaacctgcaacaagccccacaaaccaactcggtagtgcaaggtccggtgacttatgccgacgccgtggtcatcgccgcgcccgccgtggtcaacctgtacaccaccaaagtcatcaacaaaccggcgcacccgttgtttgaagacccgcaatttcgccgctatttcggcgacaacggccccaagcagcgccgcatggaatccagccttggttccggggtgatcatgagcccggaaggctacatcctcaccaacaaccacgtgaccaccggcgccgaccagattgtggtggccttgcgcgacggccgcgaaaccctggcccgcgtggtcggcagcgacccggaaaccgacctcgcggtactgaaaatcgatttgaagagcctgccgtcgatcaccattggccgctccgaagggctgcgcgtcggtgatgtggcgctggccatcggcaacccgttcggcgtcggccagacggtgaccatgggcatcatcagcgccaccgggcgtaaccagttggggctcaacagctacgaagactttatccagaccgacgcagcgatcaacccgggcaactccggcggcgcgctggtggatgccaatggcaacctgaccggcatcaacaccgcgattttctccaagtccggcggctcccagggcatcggttttgcgatcccggtgaagctggcgatggaagtgatgaagtcgatcatcgagcacggccaagtgattcgtggctggctgggcattgaagtacagccgctgactaaagagttggctgagtcgttcggcctgacaggtcgcccaggcatcgtggtcgccgggatcttccgcgacggcccggcgcagaaagccggcctgcaattgggcgatgtgatcctcagcatcgacggtgaaccggccggtgatggccgcaagtcgatgaaccaggtggcgcggatcaaaccgaccgacaaggtggcgatccaggtgatgcgcaacggtaaagagatcaagctgctggcggaaatcggcttgcgcccaccaccggcaccggtgaaagaagaggaataacggttcttgggagcccgttcgcgggctcctgtaacctaatatttcaaaagaaatccattctcattggtcatgttatattgtttcaatatcgctattggaacgctctatcatgccgtctcgaagatttgcccccatggccggcctggccttgggattgctactcgaccccgcctacgctgatgacaacaccgtagaactggacaccatcagcgtcacctccgacgcctatgaatccgccaccggcccggtcaaaggctaccgcgccacccgctcggccagcgcgaccaaaactgacaccgatctgcgcgacatcccgcaatcgatcagcgtaattcccgccacagtgctcaaggacctgggcagcaccagcgtggagcgcgcgctggaatttgctggcggcgtgtccaagcaaaacaacttcggcggcctgacgctttacgaatacagcgtgcgtggcttcaccacctctgagttctaccaggatggtttcagcgccaaccgtggctacccgagcacgccggacgccgccaacatcgagcgcattgaagtgctcaaaggccccgctgccagcctgtacgggcgcggcgatccgggcggcacagtgaatatcgtcaccaagaaaccccaaccgcaagccttcaccaccgtgcaaaccagcgccggcagttgggaccgctatcgcaccgcgctggacgtaaacaccccgttggacagcgaaggccgcgtgctgtcgcgggtcaacctggcagtggaagacaaccacagctttcgcgaccacgtggatgcccggcgcgtcttcgtcgcgccatccttcagttggcagttgagcccggacacgcgcctgctggtggaaagcgaattcgtacgccacagctcaaccttcgaccgcggcattgtcgcgccgcacggtatgtcgcgctccaccttcctcggcgagcccaacgacggcaacatccgcaaccacaacaaccgcctccaggcggcccttgaacatcacctcaacgacgcctggcaactgcgcctcgccagccactacaaacagggcagcctgtggggcgacgcctcggaaagtcgcgcgctgaacgccgacggccataccgtcaaccgccgctaccgcgaacgctccagcggttggcacgacagcattacccagctggaactgcgtgggttgttcgacatcggcagttggcagcacgaactgttgatcggcaccgagtacgaggactaccgcaaaaaggaacgcgtgacggccatcggcggcagcctttaccccatcgacatctataagccggtctatggccaggccaaacccaacggcgcacgcaccggcaccgacttcttcgaacagacgaaaagccaggcgctgaacctgcaggatcagatcgtcttcaccgaccgcctgcgcggcatgcttggcgcgcgctttgaacacgttgaacaaagcaccgatgacttcgcccgcaaccacgccaaaagccggcaaacccatgacgccctcacccagcgcgccggtttgctctaccagctcaccccgcaagtcggggtgttcgctaacgcctcaacctcgttcaagcccaacaacggcctggacgccggcggcaaatccttcaagccggaagaaggcgtgggctatgaagtggggatcaagagcgagctgttcgacgaccgcttgagcaccaccctcgccgccttccatatcgacaagcaaaacgtcctggccctggacccggccaccgacactaaccgcgccatgggcaaggcacgcagccagggtttcgacctgcagctgaccgggcaattaactgacgccgtaaggatcattggcgccttcgcctacatcgatgccgaagtgaccaagggtgacaaagccatccccaccggcagccgcattcttggcgtggccaagcgcagcggcagtctgttgggtgtgtatgaatttcaggatggcctgctacgcggttcggacctgggtgcggcgttcacctacgttggcgatcgttccggcgaagccggcagccggtttgagttgcccgcctaccacaccgtcgacctgctggcgcattacaaggccagcgaaaacgtcaccgtgggcttgaacctcaacaacgtatttgacgaaaagtactacgagcgctcctacagcaattactgggttacacccggcgagccgcgcaacgtcaccgtcagcctgaccctcaacctgtaaaaggacgcccccatgcaagccctgaaatccctggccgtgctcggcctgctgtttgccagccacgtttctgcccacggcctgtggaccgaacaacggcgcggcaatatcgaagtgatctacggccacggcgccgaggacaacgccttcaaggcgcaaaaaatcagcggcgcctgggcgtatgacgccagcgccaagatgatcccggtcaccgtggagcgcctggccgaccacgcacgcctcaagccgctcaaatcacccgccgtgttagccgtggccctggataacggcatgtggtcgcaaacgccggacaagcagtggattaaccagggccgcagccacgtaccgggagccattcaatcaacgcagacgttcaagtacagcctggcgatttaccagccgggggctaagttgccgaagctggatcagatcaagctgctgatcctgccggaagtcgacccgctgaccgtggggccggggcattcactgccggtgcgggtgctgctggatggcaaaccggcggcggggatcaagttggtgggcgactatcgcaatgcgccgaacactttgagcaccgagaccgacaaggatggccgcgcccaggtgctggtgcggaatgaagggttgaatgtgattgcggcacaggtggagatcccgctcaaagacaatgccgatgtggcgacgcgcgggttgttcagctcgctgacattcctgggtgagccacaccacgaataaacaccaaaaattcaaagtgggcacagtcaatgtgggagcgggcttgctcgcgaaggcggagcgtcagtcgccaaatttattgactgatccaccgcattcgcgagcaagcccgctcccacatttaatcttcactcggcttaattacagtgtgactggcgcgcgctcgcacagcgtattcagcgccgccgcccactgcgggtcatcattaagacacggcaccagcaccaactcctcgccgcccgcttcacggaactgctccagcccgcgatcaccaatctcttccagtgtctcgatgcagtccgccacaaatgccgggcacatcaccagcagctttttcacgccttgctgggccaaggcctcaaggcgcgcctcggtgtagggttcgatccacttggcgcggcccagacgggactgaaacgccaccgaccatttaccttccggcaagcccatgcgcgcggcaaaattccgggcgacgctgaagcattgcgcgcgataacaggtagcgagcacctccggcgaggcgttcttgcagcagtccgcatctttgaaacaatgctggccggtagggtcgagcttggtcagatgacgctccggcaggccgtgaaaactcagcagtaaatgatcgtattcctgctctacatacggccgggcgctcgccaccagcgcatccaggtattccggctgatcgtagaacggctgcaggatcgagaactgcaccttgagctttttctcgcgcaccacgcgccgggcttcttcaatcacggtggtcacggtgctgtcggcaaactgtgggtacaacggcgccagggtgactttctcgatgccctgggcggcgaggcgcgtcaacgtcgtttcaagggacggttcgccgtaacgcattgccaattccaccgggccctgcgtccactgcgccgtcatttgctgttgcaggcgacggctcagcaccaccagcggcgagccttcgtcccaccagatggacgcataggcatgcgccgactgctcggggcgcttgatcaggatcagcgacaccagcaaccgtcgcaccggccacggcaggtcgatcacgtaagggtccatcaggaactgattgaggtaactgcgcacatcggccaccgaagtggacgccggtgaacccaggttgaccagtaacaacgcgtgatccgtcatgcaacatcctatggctagaggcggctggacaagtcttccagggccgcatgcaactcagtgaactgaaaagtgaaaccggccgccagcagccgttcgggaaccgccttctgaccgcccaacaacaacccggacaactcgcccagcccgaccttcaaggcaaacgccggcatcggcataaacgcagggcggtgcagcacctggcccaaggtcttggcaaaatcgcggttacgcaccgggtgtggcgcgcaggcattataaggaccgcgggcgtcttccttgtgcagaagaaaatcaatcagggcgatttgatcttttatatgcacccacggcatccactgccgaccattgccgataggcccgcccagccccagtttgaacggcagcaacagccgcgacaaaaagccgcccttcgccgccagcaccaaccccgtgcgcaccagcaccacacgaatgcccatggcctcggcgcgcagggcggtttcttcccaggcgatacacagctggctggggaagtcgtcctgcaccgggccgctggcttcggtcaattcgcgctcgccgccgtcgccgtaccagcccactgcggaaccggaaatcaacacagccggtttctgcgacaggccttccatccacgtcagcaaggtttcggtgaggctgatgcggctgctccacagcaacgccttgcgttttttggtccacgggcgatcggcgatgggcgcgccggccaggttgaccaccgcgtccacgtggccgatcacgtcctgcaagcggccgacccccaacacctcagggccgcaccattgggcgacggtgtccggctcgcggctccacacggtcaggcgatgcccttgggcaagccagcgcaggcaaagctgacgcccgatcaagcctgtaccgccggtcagcaaaatgtgcatgggacactcctcatgtaacgttcgccgccgatcactggtctattttatagagagggatcatttgtaatccggcgcggtttttgtttgaagcccaggctttaaccataggccacgccgtaagaacaggtacgccaaaacttataccaaaaaacaatattgtacagctatgggcgtcggcgtagtctgtacccaacggtaaaacgaggcctcccatgactgttcccatcgcgatcatcggcaccggcatcgccggtctctccgccgcccgagcgttacaagacgcggggcacgttgtacaactcttcgataaaagccgcggcagtggcggccgcatgtccagcaagcgcagtgatgccggcgcgctggatatgggcgcgcagtacttcaccgcccgcgaccggcgcttcgtcaacgaagtgcaacgctggcaaagcaacggctgggtcgagcagtggaagcctcagctctacaatttcaagtccgggcaactcacgccctcccccgatgaacagatccgctgggtcggcacgccgcgcatgagtgcgatcacccgtgcgttgctggatgacttgccggtggagttcggttgccgtattaccgaagtgttccagggcaaacagcactggaacctgctcgatgccgacggcggcaatcacggcccgttcagccacgtggtgatcgccacgccggcgccacaggccacggcgctgctggccgccgcacccaaactggccagtgccgccgccggggtaaaaatggacccgacctgggccatcgccctggccttcgacaaacccctggatacgcccatggaaggctgcttcgtacaagacagccctctggattggctggcgcgcaaccgcagcaaaccggggcgcgacaccaccctcgacacctgggtgctgcacgccaccagcacctggagcaaggcgcacctcgacctgcccaaggaagccgtgatcgagcacctgcacggtgccttcgccgaactgctgcacagcgccatgcccgcaccgtccttcagcctggcgcatcgctggctctacgcacgaccgtccagcgcgcacgaattcggggtgctggccgatgccgacctgggcctgtacgtgtgtggcgactggtgcctgtcagggcgggtcgaaggcgcctggctcagcggccaggaagccgcgcgacgcctgatcgagcacctgcaatgaaccgcatcaatccttccaagttgctgctgtcgaagtggacagcagccgcgcctcgcaacaaggaaaaacacttcctggtcaccgagctgtttcgtgacgaggaaggcaccgtgctcgaaatcgagctgcaagccgtgatgacgcgtcgcgctgagcgcctgacctggcaatcgctgcaaaacgccgaggcctggaaaatcggctggaagtagtgccgctgaaaatacttgtacaaaatatttgacttgtacagcatcaaatctatgatgagatttagttgtacaagctttctagcttgtataggaatttttgcagaggttcggccatgtccagcaccgtcaaaccgaagattgccatcagcgcctgcctgttgggcgaaaacgtgcgcttcaacggcggacacaaacaatccctgctgtgcagccagaccctcgccgactacttcgactttgtgccgctgtgccccgaagtcgccattggcctgggcattccccgcgaaccgattcgcttggtcggcgaccctgcccacccacaagccatcggcaccgtgaaccgcgagctgaacgtcacgcagccactggacgattacggccagcagatggctcaggaacataccgatttgtgcggctacatcttcatgcagaaatcgccatcgtgcgggctggagcgggttaaggtctatcgcgacaacggcacgcccgtcgacggtggcgggcgtggtatttacgcccaggcgttttgctcacgtcaccccaacttgccggtggaagaagacggtcggctgaatgacccggtgctgcgggagaacttcctgacccgcgttttcgtgtatgccagcaggcagcaattgcttgccgaaggcctcacccgtcaccgcctgctggccttccattcacgctacaaatacttgttgatggcccacagcccggcgcactacaaaagcctcggccagctgctcggcagcatgggcaagggcattgatctcgacgaactggccgccggctatttcagcgagttgatgatcgggctgaaaaagtgcgccacccgtggcacccacaccaacgtgctgcagcacatcagcggctatctcaagcaggccatcagcgccgatgacaaacaggaaatgcaaaccgtcattggccagtatcgccacggcatcgtgccgctggtggtgccgttgacgctgctcaaacaccactttcgccaacacccggaccgctatatcgcgcagcaggcctacctgcagccgcacccggaaaacctcagcctgcgtaatgcgatctagaccatgaaagctgccctgcaagacgaacccggcgaagacatcgcccaagccctcgaagacggttggctgccgattcgcgaagtggcgcgtcagaccggcgtcaacgccgtgaccctgcgcgcgtgggagcgtcgctacggtttgatcgtgccccagcgcacgcccaaggggcaccggctgttcagcgccgaccatgtccaacgcatccacaccatcctgacctggctcaaccgcggtgtgccggtcagccaggtaaaaggcctgattgactccgcccaggccagccccgacaccgtcgaaaacgaatggcacgccctgcgccagaacctgctgaacgcgatcagcgaactggccgaacgccgggtcgacgacgccttcaaccaggccatggcgctgtacccgccgcggaccttgtgtgagcaattgttattgccgctgctcaaggaacttgaacaaagatggcagggccaattcggcgcgcagatggagcgggtgtttttcctgtcctggctgcgcagcaagtttggcgcgcggatttaccacaacaaccgccagctccaaggcccgccattgttgctggtcaaccattccgacctgccgctggagccgcacctgtggctcagcgcctggctggccagcagcgccgactgcccggtagaagtcttcgattggccactgccggccggcgaactggcactggcggtggaacacctgcaaccgcgcgccgtgctgctgtactcgagcaaagccctccatttgtcggcactcggcaaactgttgagcggcatcagttgcccaattttgattgccggaccaacggtatgcatccatcagaccgagttggccgtatttacccgtgacatccctgaactgtgcttggccgaagacccgttgtcggcccaccagctactgatccagcgtggaattgtttaaatgcatttgatctggctgcgcaccgacctgcgcctacacgacaacaccgccctggccgccgcacgccagcgaggcccgatggcggccgtgtatttgatcagccccgagcaatggctggcccacgatgacgcgccgtgcaaagtcgacttctggctgcgtaacctgcagcaattgagccacaagctcggcgagctgaacattcccctgctgatccgcagcgccgccacctgggaccaggcgccgggcgtgctgagcgcgttgtgccaagagctgtcggttgaatcggtgcacgtcaacgaggactacggcatccacgagagccgccgcgacactgctgtggccaaggccctggaagccgacggcgtgacgttccacagctacctggaccaactgtttttccaacccggcagcgtgctgaccaaaaccggcacctacttccaggtcttcagccagttccgcaaggtctgctacacgcgtctgcacagtgccttgccgcgcttggtggcaacccccaaagcccaggccaggctggacctgaaaagcgaccccattccaacgcaggttgacggtttcgagccgcccagcgaaaccctgcgcgccctctggccggccggtgaagacgaagcccggcgccgcctcgacgccttcgccgaccagcagatcagctactacaaagatgagcgtgatttcccggccaagcccggcaccagccagctttccgcttaccttgccgccggtgtggtttcaccgcgccaatgcctgcatgccgctttgcaaagcaaccagggcgagttcgaaagcggcgatattggcgcaattacctggatcaacgaactgctgtggcgcgagttctacaagcacattctggtgggctacccacgggtttcccgccaccgtgcatttcgccccgagaccgaagcggtagcgtggcgcaatgcgcccaaggacctcgccgcgtggcaagaggcacgtaccggcctgccgatcatcgacgccgccatgcgccaattgttggaaaccggttggatgcacaaccgcctgcgcatggtggtcgcaatgttcctgaccaagaacctgctgatcgactggcgtgaaggcgagcgtttctttatgcgccacctgatcgacggcgacctggccgccaacaacggcggctggcagtggagttcatccaccggcaccgattcggcgccgtatttccggattttcagcccgttgagccagtcggaaaaattcgacagcgaaggcgtattcatcaagcactggctgccggagctggccggtctgaataaaaaggaggtgcacaatcccgatgcggtcggcggcctgtttggtgtagcggactacccgcgcgcgattgtcgacctgaaaaaatcccgcgagcgcgcattggccgccttccgcagcctgccctcacgccaggaggtggccgagcatgagtgacttcctgcgcaggttcgcccaggcctttgccacgctggacaagcataacctgcacctgctcgacagcctgtacagcaaagacatcgccttcgccgacccacttcacgaagtgcacgggctgcctgcgatgcaccgctacttcactgagctgtacagcaatgtcagccaactgcgcttcgacttccacggcttcgaccaagtggccgacggcgaaggctacctgcgctggaaaatgagtttttgccacccgcggctgaacaacggccaagtgatccgggtggaaggctgctcgcacctgttgtggcgcgacaaggtctaccggcatcgcgattatttcgacgctggcgctttgctctatgaacacctgccggtactcggccgtgttgtcagttggctgaaaaggagagtcggatgagcctttcattgccccgccgttattggctgaccggcgccagcagtggcatcggcgcctcactcgccgttgagttactcaacagcggcgctcatgttgcgctcagttcacgcaccaaaggcccgctgcaagccctcgcccaacgctacccaggccaagtgctggtggtggccggcgacctgaccaacagtcaaaccgtgcgcgaaatcggcgagcaaatcgaagcagcctggggctcactggacacggtgatcctcaacgccggcacctgtgaatacgtagacgcgcggcagtttgacgcgtctatcgtcgagcacgtggtacgcaccaacctgctcgcaagcagctattgcatcgaagcggcgctgccgctgttgcgcaaagggcaaacgccacacctggtcggcgtggccagcgccgtcacttacctgccgatgccacgcgccgaagcctatggcgcgtccaaggccgggctgcgttacctgttcgaatcgctgcgcatcagcctgtcgcccgagaacatcgacgtcacggtgatcagcccgggctttgtcgacacgccgttgaccgaacgcaatgacttcccgatgcccttgagctggtccgccgacaaagccgcgcggcatatcttcgccaagctggataaacgcccgctggaaatcgcctttcccgcgctgtttatcgccaccctgtggccgctgtcgaagctgcccaaccgtgcgcaactgatcatcggcaaacgcatgctgcgcagcccgccgccgcagaaggacgacctgtgaagatcgccattatcggcagcggcatcgccgggctcaccagcgcctacctgctcagccgccgccacgacatcaccctgttcgaagccggcgagcgcatcggtgggcacacccacacggtcaacgtgacggtcgagggtgaacgctacgcggtggacaccggttttatcgtgttcaacgactggacctaccccaacttcattcgcctgctggggcagattggcgtcagcttcaaacccaccgagatgagcttttcggtgtgcgatcaaaacgcaggcttcgaatacaacggcaataacctcaacagcctgtttgcccagcgccgcaatatattgtcgccggggttctggggcatgttgcgcgacatcttgcgcttcaaccgccaggcgccgctggacctgcaagagcagcgcatcagcgccgacatgacgctgggcgattacctcgaagccggcggttacggcgagcgttttatccggcactacatcgtgccgatgggtgcggcgatctggtcgatgtccctgaccgacatgctcggctttccgctgcagttctttgtacgcttcttcaagaaccatggcttgctctcggtgaacaaccggccgcaatggtgcgtgatcgaaggcggctccagcagttacatcgaaccgctgacgcgcagctttcgcgagcaggtgcgcctcaattgccctgtgcataaagtcgagcgcacagaggacggcgtagttatccacagcgtcgccggcagcgaggcttttgatcgggtggtattcgcctgccacagcgaccaggcactggcactgctggccgacccaagccaggccgaacaggagattctcggtgccctgccctacgccgacaacgacgtggtgctgcacaccgacacgcgcctgctgcccgaccgcaaactcgcctgggccagctggaactaccggctcaccggcgatgcgcaaacccaggccgccgtgacctacgacatgaacattctgcaaggcatcgacagcgccaccaccttttgcgtcagcctcaaccagacgccgatgatcaacccgctgaagatcctcgcgcgctacacctatgcgcatccgcaatacagcctggcggcggtcgccgcgcaagcgcgttgggaagaattggcgggcgtgcgcaacaccttttattgcggcgcctactgggccaacggcttccatgaagacggcgtggtcagcgctttgcgcgtggcccaggcctttggcgaaaccctatgaacagcgccctgtacagcggctggatcgcccatcgccggtttgcgcccaaggcccacgcctttcgctaccgcatcggcttgctgtacctggatttaagcgaagaagaacaagtgcttgggctgtcgcctttggctggcgcgggtcgcctggcacccttcggttttcgccagcaggattacctgcgtgaattcacgggccacggcatgagcttgagcgatgccgtgcgccaggaagtcggcaaggcgctggggcgtgagcctcagggcgttatctgcctactgacccaggcccgcagttggggcctggcttttaacccggtgagtttcttctactgcttcgaggccgatgggcaactggccgcgatcctgtgtgaagtgaccaacaccccgtggcgcgagcgttatcactacgtgctgccggcccaggccctcggcgcgaatgaacatcagcacttcgcggtggccaaggctttccatgtgtcgccgtttttgccgcgtgacctggaataccgcatgagcttcagcccgcccgccgccaagctcggcgtgcacatggccgattggcaaggcgaggtgaaagtcttcgacgccaccttgagcctgcacaaagaagcgctgagccgcgccagcctgcatcgctacctgtggcgcttcccgtggatgaccgccaagacctgcctggcgatttactggcaggccatgcgcctgttgctcaaacgcacaccgattttttcccatcaggccgccgatggcgcctctcgcaccgcagtcgggtataccaaggatcgccgccatgaaatcccctagcttatcggtcaagaccaaccgcctgaacgtcaacggcctgaccagcgcactgctgcgcaaggccgtgctgcgccaactcagccaactgcgccacggccagttggtggtgatcgaagacggtgagcgccaggtgttcggcgcacgcgaagcgcacctgctgggggaaatccagattgttgattcggctgtctgggggctggtggccgccaatggttcgattggcgccggcgaggcctttattcacggttactggaccaccccggacttgacggccgtggtgcgcgtgatggtcagcaacctggacgtgctcgatgccatggaaggtggcctggcgcgcctggcccgcccattcacccaaggcctgcactggctcaaccgcaatacgcgcaagggctcgcagaaaaacatcgccgcccactacgacctcggcaatgacctgttcgaagaattcctcgacccgaccatgatgtactcggcggcgcaattcctgacgcccgaggacactctggaacaggcgcagttgaacaagctggaacgcatctgccagaaacttgcgctcaagcccactgatcacctgctggaaatcggcaccggctggggcagcatggcgctgtatgcggcgcagcattacggctgcaaagtcaccaccacgaccttgtccaaagagcagtttgcctacaccgaaaaacgcatcgaggccttgggtttgcagggccaggtaaccctgctgctgcaggactatcgcgacctgaccggccagtacgacaagctggtgtccatcgagatgatcgaagcggtgggccatcgcttcctgccgacctacttcaagcagtgcgcgcacctgctcaaaagcgacgggctgatgctgctgcaagccatcaccattcgtgagcagcgttttgagcaggccaagaacagcgtcgacttcattcagcgctacattttccccggtggcgccctgccctgcgtgcagaacatgctgcacatcgtcagccgcgacaccgacatgaacctgctgcacatggaagacttcggcctgcactacgcgaaaaccctgcgcctgtggcatgagaactttcgccgcgcacatggccgtctcaccgagttgggctacgatgagtacttcctgcgcttgtgggaattctacttgtgctactgcgaaggtggctttatggaacgtacgattggtactgcgcaactgctgctggccaagccggcggcaatcaacccaccgttgctcgggcgtttcagtgcttaaacggctggcgaatgccgtgctgtttcagtgcggctggtttgcctgcgtgctgggcggtgacagccgctggctgtgggtggtcgccgccgtgctggccatccacctgttgtgggtaagttcatggtctgcggaggggcaagtcatcctcgccgtgaccttgctgggcagcgttatcgacacctcgttgcgcacctttggcgtgtttcatttcagttttccggggccgctgattccgttctggctggtgctgctgtgggcgctgctcgccaccacgctgcgccattgcctggcctggagcgcacagccctggtggcgtgccagtttgctgggcgccgtcggtgggccgctgtcgtattacgctggcagccaattggccggtgtgagtttcggctatggcacggcgcctaccctgatcggcctggcgctgctgtgggggctgctgtttcccgtgctgcactggattgcgcggcaattggggcactgacgcccgtcagagcattcacacctacctgacccgcttggcttacactgcgcgtctatgaccaacattccccacactcaaatcaccgaacccgccgtgacctgctcaacgtgcgcggcctgctgctgccagctggaagtgatgctgatcaccgacaccggcgtgccggagcgctacatcgatacggatgattggggcggcgaagtgatgctgcgcctggatgacggctggtgtgcggcgctggaccgggacacgatgatgtgcacgatctacgagcgtcggccgctgatttgccgggagttcgagatgggtgcaccggagtgcctgaccgagcgagaagggattgcgacggcgtatcgctgatcctgaggtagatgaaaatcaaaatgtgggagctggcttgcctgcgatgcagacacctcggtctatcagttacaccgaagtgatgctatcgcaggcaagccagctcccacattagtcagcaggtgccagataatttacaacggcaaggtgtagtgcaacgagtagctctctaccccatcgttgttgctgctgatgccggcgttggaataatgcgtggcgcgaatgcccacttcatgcccaccggcaaagcgcaaaccaaagcccaatcggtcttcgaactggaaggcctggccgatgttgttgtcttccagacgcgtgcgcgagaacacggccacgccgatcccggcttcgatgtagggcttgaccttctccccggcaaactcatacacaaacaccggcgaaaacgacaggctgcttgcgcccgcgcgcttgtcgccatcccagtaggtgtaagcgccactccaatagccggtcagtcgaccggtgtcgctctgccaccagcttttatcccaatccgacgtcaacccgagccgataggtcatggtcgaatcgctggtgctccccacaccgaactccaaaccggcagcttgagccgaaacagagtgccctactacgacggccgcaaacgcagccaaacagaacaagcgcttcataagaaacagtcctttgagacgaggttgtatatttttgtacaggctaactcgctatagaagccaacgcagagccagaagttcagcgtctgatcgcgttatttcacaaaattttcacgcgtcgaagcttcgcacaactccgggatatttccatagagtcggtaggatatttcttaggtgatcgacatcaccactggtccagaactgcgtaggttcagggttgccagcggccaacaggtcgcgctcactcaacaaacgcttgagctgacgcgccacggcggcaccggtgtcgatcaggatgatgctggggggaagcatctgtgccaggagtggcttgaggaaggggtagtgggtgcagccgagaataatcgtgtcgcaacccgcgctgagcagcgggtcgacataaccttgcaacagctggcgcaacgcggcgctgccaaggtcgccggtttcaatcaactcaaccaaacctgggcagggctgagtgatgacacgcacgtcggtggcaaaacggtcgagcaacgccgcaaacttggcgctttgcagggtgccggtggtggcgagcacgccgaccacgccactgcgagtggcggccgccgccggtttgacggcgggctccatgcccaccaagggccagtcggggtagtcctgacgcaaatcagcgacagcggcgacagtcgccgtgttacaggcaatcacaaacgccttggcgccctgctcgcggaaaaactcggcgacgcgccgggagcgctcaagaatgaacgccggggttttctcgccgtagggaatgttaccgccgtcagccacgtacagcagtgactcatggggcagtaactgttggatttcatccagcaccgacaggccgccgacgccggaatcgaacacaccgatgggcgcgtccttaaccacgctcaactccacacacgctgcaacccgggtcgcgcttgacgcgtaattcgcgaaagcgtgtggtcaaggcatcgatcagcaacaagcgacccaccagcggctcaccgaaaccggccagcagtttcaaggcttccagcgcttgcaggctgccgaccacgcccaccagcgggccgacgacgccggcttcgctgcaggtcagttcggtgtcgctgccgtgcccgtataaacagtggtagcacgggctgtcggcgcggcgcgggtcaaacaccgacaattgcccttcgaggcgaatcgcagcgccactgatcaatggcgtgccggctgcgacacaggcggcgttgacggcttcgcgggtggtgaagttgtcgctgcaatcgagcaccacgtccaccgctgccaccgccgctgccagagagtcggcgtccagcgcggtgcgatgggcgagcagagtgacttcggggttgatggcggtcaggcggcgcatagccgaatcgaccttggtctgcccgacgctgtcagtgtcgtggatgatctggcgttgcaggttggtcaggtcgacagtgtcgaagtcggccaaatgcaactcaccgacacccgctgcggccaggtaaagcgcgacaggcgcgcccaggccaccgaggccgacgatcaatgcacgcgcgtttttcaggcgcaactggccttcgatgtcgacatgctgcaacagaatctgtcggctatagcgcaacagctcctgatcggtcagcacggccggcgtcccagggtgatgcgctcgtggccaccgaggtcgacgcggctgtgtacgtcttcaaaaccctcgcccagcaacaggtcacgcacggccgccgcctgatcgtagccatgctcaagcaacagccaaccgctggcgttcaagtgggccggggactgggcgctgatcaagcgcaaatcgtccaggccgtcatggccggccaccaaagcgctggccggttcaaagcgcacatcgcctgcgaccagatgcgggtcgttgtcggcaatgtagggcgggttgctgatgatcaggtcgaacgtctggccttgcagggcgctgaaccaatggctgttcagcaccgtggcgtttttcaggtgcaggcgctggcggttgcgctccgccagggccacggcttccagcacgcggtcaaccgcggtgacctgccaaaccgggcgctcgctggccagggccagggcgatggcaccgctgccggtgcccaggtcgagaaccttggcaggcgtggcaggcagcagttccaacgcggcttccaccagcaattcggtttcgggacgcgggatcagcgtgtgcggcgcgacctccaggtccagcttccagaagccttgctggccgaggatatacgccaccggctcaccgccacggcggcgttgcaggtagttggcaaaggtcagcgccgcttcgctgctgacgatcttttccggccaggtgtgcaggtagctgcgcgatttgcccagggcagcggccagcaacagttccacatccaggcgcgcggtgggcgagtccggcaagtcggcggcgcgcagcaggctggcaatgatggtcatttattcacctatcgccgccaattgatcggcctggtactcggcgagcaagggctcgatcaccgcatccacgccaccggcgagaatctcgtcgagggaatacagcgtgaggttgacccggtggtcggtcacccggccctgggcaaaattgtaagtacgaatgcgttcggagcggtcgcccgaccccaccagcagcttgcgctcgctggcaatcgcgttggcggcggcgctggtctgctggtcgttgagtttggccgacagccaggacatggcccgcgcacggttcttgtgctgggaacgttcttcctggcactccaccacaatgcccgacggcaagtgcgtgatgcggatcgccgagtcggtcttgttgacgtgctggccaccggcgcccgacgaacgataggtgtcgacacgcaagtccgccgggttgatctcgatggcttcctgctcgtccggctcaggcaacacggccacggtgcacgccgaggtgtggatacggccctgggattccgtcgccggcacccgctgcacgcggtgggcgccggattcgaatttgagcttgccgtagacgttgtcgccttcaacccgggcgatgacttctttatagccgccgtgttcgccttcgttctcggacagaatctcgacacgccagccgcgacgctcggcgtagcgcgaatacatgcggaacaggtcgccggagaaaatcgccgcctcgtcgccaccggtgccggcgcggatttcgaggaacacgttacgtccgtcgttagggtctttgggcagcaacatgcgctgcagattgccttccagctcggcgagcttttccttggcttcgcggacttcttccacggccatttcgcgcatgtccgggtcgctgtccttgagcagcgcctgagcgccttcgaggtcggcctgcactttggtcaggtgcttgtaggtggccacaatcggctcaacttcggcgtattccttggaataggcgcggaatttggtctgatcggagatgacctcgccatcgccgagcaaggcggtcagttcttcgaaacggtcctggagcacgtccagtttattgagcagtgacgctttcattgcggttttttatccgaagagctatctgacgcgccctcaccgagggcaaagagttcctgggccatggccagcgcatcgaggcggccttcggcggtaagctttttcaactgaacgctgggggcgtggagcaatttgttggtcaggccacgggccagttgcatcagcacctcttcggcgccgctgccgttggccagcatccgctgggccttgatcaactcttcgtcgcgcaggcgttcgccctgctgacgatacgccttgagcacgtcgaccgccgccagttcacgcaggcgcaccataaagtcttcggcgccggtgctgaccatttcctcggcggcctgggcagcgccctggcgactcttgaggttttcggcaaccacttcgtgcagatcgtcgacgctatagaggtaaacgtcgtccaactcgccgacttcaggctcgatatctcggggaacggcgatatccaccataaagatcggcttgtgcttgcgcagcttcagcgcgctctcgaccgcgcctttgccgaggatcggcagttggctggcggtggagctgatcacgatatcgctgcgcaccagttcggccggaatgtccgacagcaacaccgcgtgggcgccgaactgctcagccaggatgctggcgcgttccagcgtacggttggcgaccacaatacgcttcacacccagctcgtgcagatggcgggcgaccagggtgatggtttcaccggcgccgatcagcagggcctggctgcgctgcaagtcgctgaaaatctgtttggccaggctgacggcggcaaatgccacggacaccgggttttcaccgatggccgtgtcggtgcgcacctgcttggcagagttgaaggtggcctggaacaagcggcccagcaacgggccgacagtgccggcctcgcgggccacggcgtaggcggacttcatctggccgaggatctgcggctcgcccagcaccagcgagtcgagccctgcggcgacgcgcatcatgtgacgaactgccgcatcctcttcgtgcacataggcactggcgcgcaggtcatcgaggctcaaatggtgataatcggccagccagcgcagcaccacatccgctgaaagatgttcctgctctatataaagctcactgcgattgcaggtcgaaaggatcgcagcttcgcggctgtcggtgatccggcagagctgctgcaaggcctcaaccaactgctctggcgtgaacgccacgcgctcgcgcacgtctacggaagcagtcttgtggttaataccgagtgcgaggaaggccattcaatatcgctgatgatgtcgggaagccgacaattgtcctacttcgaaagatccagaacaaccaccgtcgtctattgtcctagtagcttatgcctataaaggcgccaactgagactcggttatgtttggccgaaggcttgtgtcatgatgatccgaccgcaggttagtcgtcctcttcctatatgaatagatcttccgcgttgctccttgcttttgtcttcctcagcggctgccaggccttggcccccgtgtcgccggacggtacgccgccggtagaagacagcacccccgcccctgaaaagcccaaggtttattcctcgttcaatgaagaaacgatctacagcctgctgaccgcggaactcgccggccagcgcaatcgcttcgatattgccctggataactacgtgacccaggccatcaatacccaggacccgggcatttccgagcgtgcgtttcgcatcgccgaatacctgggcgccgatcaggccgcgctggacacctcgctgatctgggcgaaaaacgcgccggacgacctggaagcacagcgtgcagcggccatccaactggcgcgcgcggggcgctatgacgactccatggtctatatggagaaagtcctgcagggcaagggcgacacccatttcgatttcctcgcgctgtcggctgccgacaccgaccaggacacgcgcaatggcctgatgaagagtttcgaccgcctgctgcaaaagcatccgaagaacagccagctgattttcggcaaggcgttgctgctgcaacaggatgatgaagccgacgcggccctgaagttgctggagcagaacccgccggacgacggcgagatcgcgccgattctgctgcgcgcacgcctgctgcagaacctcaatcgcggcaaggaagcgattccgctgctggaaaaaagcatcaagaagtatccggacgacaagcgcctgcgcctgacttatgcgcgcacgctggttgagcaggaccgcatggaagacgccaaagtgcagttcgccaacctggtccagcaatacccggacgacgacgaattgcgctattccctggcgctggtgtgcctggaagccaaggcctgggacgaggccaagggttacctggaagagctgatccagcgcgaaagccacgtggactcggcgcacctgaacctgggccgtatcgctgaagagcgcaacgacccacaggctgcactgctggaatacgcccaggtcggccccggcaatgactatctgccggcccagttgcgccaggccgatatcctgatgagcaatggccgcaccgacgaggcggaaaaacgcctggccgcggcgcgcgatgccgaaccggactacgcgatccagctgtacctgatccaggccgagaccttgtcggccaacaagcagggcgagcgcgcctggaagttgctgcaacaggccttgctgcaataccccgacgatttgaacctgctgtacacccgcgccatgcaggcggaaaaacgcaatgacctggcgcagatggaaaaagacctgcgcctgatcatcaagcgcgatccggacaacgccatggcgctgaacgccttgggttacaccttgtccgaccgtacgacgcgctacgccgaagccaaggtgttgatcgagcaagcccacaagctgaacccggaagacccggccgtactcgatagcctgggttgggtgaattatcgcctgggcaatctcgacgaagccgagcgtttgctgcgccaggcactggagcgcttccccgatcaggaagtggccgctcacctgggcgaagtgctctgggccaatggcaaacagcgcgaagcgcgacaaatctgggaaaaattcctcaaggaacaacccgaaagcccaatcctgcgcggcaccatcaagcgcctgaccggatccgagaccctttaagcttatgttcttgcgccacgttattgttttcagcttcatcgccttgctcgccggttgcgcgggtttcggcgcccgcgaatccgttgaaggccagggcaacccggcgcaatggaaacagcacaaggaccagctcagcagcatcgatggctggcagatcgaaggcaaggtcggggttcgcgcgccaaaagattccggcagcggcaccttgttctggctgcaacgccaggactattacgacattcgcctctccggcccgcttggccgaggcgctgcacgcctgaccggtcgcccggggcaagtcagcctcgaagtggccaaccagggccgctacgaagcggcctcgccggaagaattgctggaacagcaaatgggctggaagctgcccgtatcgcacctggtgtggtgggtacgcggcttgcccgcgccagacagcaaaagtcgcctgagcctcaatggcgatagccgcctggccacgctggagcaggatggctggcaggtcgagtacctcagctacgtgcagcaaagtggttattggttgcccgagcgcatcaagctgcatggcaccgaccttgacgtcacgctggtgatcaaggactggcaaccgcgcaagctggggcaataaacgtgaccgcaaagctgacgttgccctccccggccaaacttaatttgatgctgcacatcctgggtcgccgtgaagacggctaccacgagctgcagacgctgtttcagtttctcgactacggcgatgaactgaccttcgccgtacgcgacgatggcgtgatccagttgcataccgaattcgaaggcgtgccccacgacagcaatctgatcgtgaaggccgcgaaaaaacttcaagagcaatccggttgcccgctcggcatcgacatctggatcgataaaatcttgcccatgggcggcggcatcggcggcggcagctcaaatgctgcgacgacgctgcttggcctgaatcacttgtggcaactgggttgggaccacgatcgcctggccacgctgggcctgacgctgggcgccgacgtcccggttttcgtgcgtgggcacgcggctttcgccgagggcgtgggggagaaactcaccccggaataccccgaagagccgtggtatgtcgtgcttgttccgcaagtatctgtaagtacagcagaaattttttcagatccactgttgacacgtaactctcctcccattaaagtgcgccccgttcccaagggaaacagtcgaaatgactgcttaccggttgtagcaaggcgttatccagaggtacgtaacgctttgaatttgttaggtaaatttaccgaagcaaaattaaccggaactggaagttgtgtgtttgggggcttcccaagcaaagctgaagctgataaagtctcggcccttcttacagagacccttacagggtttgtagcaaagggaagcaacgtttcgatgttgcatcgcaagctgcaaagtctgctctaaaaggaaccgagtactgggtactcgttgcaacagatacaggggcgtcgccaagcggtaaggcagcaggttttgatcctgccatgcgttggttcgaatccagccgcccctgccattttctaatactcatccaggttaccctcagcctctaggtactgcgcgtgtccaagatgatggtctttacggggaacgctaaccccgatctggctcgacgtgtcgtacgtcagctgcatatccctctcggtgacatctctgtcggtaaattctccgacggtgaaattacagccgagatcaatgaaaacgtccgcggtaaagatgtcttcattattcagccgacttgcgctccgaccaacgataacctgatggaactcgtcgtgatggctgatgccttccgccgctcctcagcgactcgaatcacagctgtaatcccttactttggttatgcccgtcaggatcgccgtccgcgttccgcacgtgtggctatcagcgcgaaagtcgtggctgacatgctgaccgtggtaggcatcgaccgtgttctcacggttgacctgcacgctgaccaaatccaggggttcttcgatattccagtggataacatctacggctcccccgtattggtggatgacatcgaagaccagcgctttgaaaacctgatgatcgtgtccccggacattggtggcgtcgtgcgtgcacgggctgttgccaaatccctgggcgtggacctcgggatcatcgacaaacgccgtgaaaaagccaatcactctgaagtgatgcatatcatcggtgatgttgaagggcgtacctgtattctggttgatgacatggtcgacaccgccggcaccctgtgccacgcggcgaaagccttgaaagagcacggtgcagcaaaagtcttcgcctactgcacacaccctgtgctgtcgggccgagcgatcgagaacatcgagaattccatgctggacgaactggtggtgactaacaccatcccgttgtccgctgcagctcaagcctgttcgcgtatccgtcaactggatatcgcaccggtagttgccgaagcggttcgccgcatcagcaacgaagaatcgatcagcgcgatgttccgttaagggtcaaaccttacgaagcaccccactgacgaaaagcgccccgccccaacctactgttggggcggggcttttttgcccatatcgcctttagcgctggtcgcaaacgctggggcgaatgtggttattttggagatacaacatgaacgattttactttgaatgctgaactgcgttccgacctggggaaaggtgcgagccgccgcctgcgtcgtctcgcaagcctggttccagctgtagtttacggtggcgaaaaagcccctgaatccatcagcatgctggctaaagaaatcgccaaactgctcgaaaacgatgctgcttacagccacgttatcgaactgaacgttggcggcaaaaagcaaaacgtaatcatcaaggcactgcaacgtcacccggccaaaggccacgtgctgcacgctgactttgtacgcgttgttgccggtcagaaactgaccgctatcgttccagtacacttcgtcggcgaagaagctccggtcaagaaaggcggcgaaatctcgcacgtcctgaacgaaatcgaagtgacctgcctgccgaaagacctgcctgagttcatcgaagtcgacctgtcggctctggaaatcggcgccatcatccacctgtccgacctcaaagcccctaaaggcgttgagtttgtcgcactggctcacggtgatgacaaagctgttgcaaacgttcacgctccacgcgttgcaccagaagctgaagaaggcgctgcagagtaattcactctgtattgccggagcttgaggaaacatcgcggaccgaaacgtagcgagaaagcgggcgataacgcggcgtttactcttgagtaaatgatcttttgttgtccactttcgccgcacgcaggtgtcggcgatgttatccacaactccaaaggaagggcccctgtcgtgactgccattaaactgatcgttggcctgggaaatccaggcgccgaatacgaacagacccggcataacgcgggggccctttttgttgagcgtatcgcgcacgcccaaggtgtaaaccttacggccgatcgcaaatattttggcctgaccgggcgcttctcgcatcagggtcaggatgttcgtctgctgattcccaccacctacatgaaccgcagcggccaggctgtcgcggcgctcgcgggcttctttcggatcaaacccgaagaaatcctggtggcccatgacgaactggacctgccacccggtgttgccaaactcaagttgggcggcgggcatggcgggcacaatggcctgcgcgacatcatcgcgcagttgggcaatcagaataatttttaccgtctgcggctcggcattggccacccaggcgttgccagtatggtttcaaatttcgtcctgggtcgtgcgccacgcgccgaacaggaaaaactcgatgccagcatcgactttgccctcggcgtgctgccggatatcttcgccggtgaatggaaccgcgcgatgaaaaacctgcacagccagaaggcctgactcttaccgaggggaaacaccatgggattcaattgcggcatcgtcggcctgcccaacgtcggcaaatccaccctgttcaacgccttgaccaaatccggtattgcggcggagaacttccccttctgcaccatcgaacccaacagcggcatcgtggccatgcctgacccgcgcctgcaggaattggcggcgatcgttaaccccaagcgcatcctgccgaccaccatggaattcgtcgacatcgcaggcctggtggccggcgcgtcgaaaggtgaaggcctgggcaacaagtttttggccaacatccgtgagaccgatgccatcgctcacgtggtccgctgctttgaagacgagaacgtgattcacgtctccaacagcgtcgacccgaaacgcgacatcgagatcatcgacctggagctgatcttcgccgacctcgacagctgcgaaaaacaactgcagaaagtcgcgcgtaacgccaaaggcggcgacaaggacgcagtggtccagaaaggcctgctggagcagttgatcgctcactttaccttgggcaagcccgcgcgcagcctgatgaagagcatgaatgccgacgaaaaagcggtaatcaagggcttccacctgctgaccaccaagccggtcatgtacatcgccaacgtcgctgaagacggcttcgagaacaacccgctgctcgacgtggtcaaggccatcgccgaggaagaaggcgcgatcgtggtgccggtgtgcaacaagatcgaagcagaaattgccgagctggatgacggcgaagagaaagacatgttcctcgaggccctgggcctggaagagcctggcttgaaccgtgtgatccgtgccggctatgaaatgctgcacctgcagacttacttcaccgccggtgtcgaagaagtccgtgcctggaccgtcaaagtcggtgccacagcgccacaggccgccggtgtgatccacactgacttcgaaaagggctttatccgcgccgaagtcatcgcctacaacgacttcatccagtacaagggtgaagccggcaccaaggaagccggtaaatggcgcctggaaggcaaggaatatatcgtcaaagatggcgacgtgatgcacttccgtttcaacgtgtaaataaaccctgcggcgcccaccgcaaataaaaagccgatgccctgcatcggcttttttgtgggcaacggtttcacgtgcgaagtagtcttattccgtcaagctgcccaatgctttaagacttctcctattacctttaggcacttccctggctaaacaactgagaacattagcgccctaacatctctaacttctcctacaccatctgcgtaagttcctacttcaagataagcacgtaaaacttataatccacaccctgccgaccgcctttgaataacgcatagtaataatggagcacctactcgatgtcggactccaaccttggggaagttgaaacggatcgttcaatcattgcaggatcagacattgaaaacacacttaacagcacagcgtcactgaacattgacatcctgttactcggagagacgggtaccgggaaagacaccttggcccaacgggtccatcggttgtcggggcgaaaaggcaactttgttgcagtgaactgcgcggcaatcccggaaagcctcgcagaaagccaattgttcggcgttaacagcggcgcctttaccggggcgatacagtcgcgagccggttttgtcgaagccgctcatctaggcactttgtacctcgatgaaatcgacagcatgcccctgaacctgcaagccaaattgctgcgggtgctggagtcgcgtggcgtagagcgcctgggctcgacccgtttcattccggtcgatatgcgtgttatcgcgtcagcccagcagtcgctgcaccaaatggtcgagcagggcaccttcaggagtgacctgtactttcgcctgaatgtcgtcagcctcgaacttccggccctgcggcaccagcgagaacgcatcattccgttgttcctgaagatgctccaggaagaagccgaacagttcaaatgcccggccccgaccccgccagcggagctgctgcaacaattgctgtgccacacctggctgggcaatattcgcgaattgcgctcggcggccaagcggtttgtgctaggtctgccagcgctctcgatgcccatgggcaaaccgcaggacagtgaaatgagcttgaaggcccgcctgcaacaaattgagaaagcgctgatagaagagtcgctgcaccgcaacgaccactgtgtcgataacgtgtcggttgagctagggctcgccaagcgcacactttactatcgaatgaaacaacttgagatataacgggcgcaggctgcgccagagcataacaagcggagttttccgatggtgagcccgacatactcttcagtacttagtgagtaaaacaaacaaaaagcagtacgtcgctcgcctcatccaagcattattaaaaacatttgagacggcgcagacagtcgtataaaagcctttcagcgaaacatttttaaataaataaccactctaaaaatggaacactttacctgctacccaccacgtaaaacatgagtgatttccaaatcattcaacacgcaacgatagctaacattcgctatccatctttggttagaaaacagaaggtgatctatgtctggaatcctaaacaacgcttcctcaaacttgagcgatggccagctacaacggctgcagggcatcatcgatgacaaaggagagaaggtagtcaaagaggctgcgatgactgctaaacaagaagaagttacagccgcagccggtcgtgtcaaatctttgcgcttcgcctaagccacaccgacctccccagcccttcaggtggggaggtttcactgtaacgacgggcacaacaatagatacgttcgatggagattcagatgaacatcatcaccccagggttcccggaaaacggtaatttcacgactcaggccgatgcgtctggcacgctcaaccgagcctccgacgtcaattttttcaacgctcaactcaacgccaacgaaccgtccggcaaagcagttggccctgtcatggcatcgcccgttccttcctggggctcggaagagtcggattcgttatcgcggcgcgtatccaaggggttccgggatgccagccagaacaagaggtccagggatgcgaatgaattcccccaatcgctcgccgaagcgcatatcgacgtgatgtcacgggtcaaggtgatcagcgccatcacaaaaggcgtcgataaaatttcaagcatgggctagatgcatgttccgtcgcctgaccaccctcgtgcttttgtcaacggtgttgatgctctccggctgcggtgaaagcgtagagcttcatcgcaatatttctgaacaggaagccaacgaagtcattgcggaactggcagacaagcagatccgggcgcagaagattccagggaaagacggcgtcgctgttcgcgtcaaggcaaatgacatcagtcgagctgttcgtacgctggacgccgccgggctgccccggacggcgcgctcgacgctgggggatatctttcgcaaagaaggcgtcatctccaccccgctggaagagcgcgcacgctacatctatgcgctgtcgcaggaactggaatcgaccttgtcgaacatagacggcgtgatcgtcgcgcgagtccatgtggtgctgcctgaacgggtagcgccaggcgagccggtacagccggcctctgcctcggtattcatcaagcacaatccgcgactggaccccgacaatatcaatccgcgtgtccgcaggatggttgccagcagcattccgggcatggcctcagccatcgacaacaccacaaaactgaccgtcatttttgtaccggccacggcctatacagagcagcagcaactcactcatttcgggccctttctggtgccggtacaagagcttggattttggcgcaccagccttgtggcgcctgtgatcgttattctgctgggcggcattggctggctggtctggcgtcgtcgcaaagggctcattccggcggtggcgcctgccgtggcacccgctcatgagtgaagcgctcagttgggttagatggtgggccttcccctgggaggatgctcacatcgactggctcacaaaaaccggctttgtggaaacgccagcgctttcacgcagccatcatggtcgggtgagcagcctgttcggcatcgaacctgcgcttcccccgcctacgtctgcgcccttgttacagctggtactgagcaacgcgcaacaacgggaccttgcactggcactcgtcaatgaggtgtacaacgcgccccgcgacagccggttaaatcaggatcagattctttggtgccagcgcttgagcaaggcactgccacccgacccgatcccggtaagcatcgacgacccactgcactatctgcgcgcgtgggtcggcccccttctctggcagcggctgcgtttgcgctttgctcgccaaagggtgcttgagttggagcagcatcccaggctggccgatactcacagccggctggatacgctgtggaaagccactatttggcgcgcaaccgcaaccggcatcgatgaggctcagcgcgccccccgcgagaaacccgagcatgttttgcgcccacaagattgagctgaacaccgacgaaccgtcgaccctcctgatccctcgggaacggcttgccgactactcccaggcccatcgaatcctcgaacaagccgaggcaaaagcgcaggcgctcatacttgaggcccacgctcagtgcgagaaaatcctcgaaagtgccagtgatgaattctgggagcgcgccaatacccagctgtaccgttgggactcagagcgccaagcgatgctcgaccatctggaacaggccgccacctccgtcatcaacgcggccattctcagcattctggacgagaccgtgcccgctcagcgcctcactgccctgcttaataaactgctgacggctcagttaccgacggtccaggcggaactggtgtgcaacccgcaggaccgcgaacctgtcgagcaatggctcagtctgcactgtggcgtgccatggacgcttcgagtcgaagacaggctcaccgcccagtcgctgctgctcgaaacggaggatggcgggtttcacatcaattggaccgatgccctcgataacctggtggttaccccaccgcaggccaaaaccaagtgacaacttttccagctagaaacgcttttctttttaaacaaattaagtcggttgatggaactggccatcaatccggtgccacacaggaatagaaccccatcggagataaaatgatgaacggtgacttacgcatactcaacagtctctacaggcagcaaatcagctccggaaaaagcatcgatcaaatcggcgtcgacgctgaaaacatgagagggatggacgaagcttcgcagctcttcgaacagctcattgaggaaaagtccaagctagttaacaactatgccgtgagcacgacctacctcagttacaagcacgaaacgattaagtcagcgatcaatgtcgtctagtgacagggctccagccacgggcgatctctggtgggtgcaatgccgacccagggattgcccaagaacaccggttcaaaacccttgaagtacctctcaagcaacgtgacacctggcgcagcgttactgcacgcctgacaaaggctgggcgcaccttccggcccacttcactacgtaagcgaccgcactgaaacagagaacctgtcatgtatagcaaaatcaacaagcacaccggcttgcgtttaaactcgcccgctgttctggtaaaacgcgctcactggcgttgtctgctcgccctgcccttgttgttggcgccgctgcacagcccccttgccgctattccctccgactggaaaaacaccgcctacgcctacgaggccgagcataagcccctgcgcgaggtactggaggacttcgctcagacgtttggcacacaactgcaagttgacggcctgctggacggcaccgtcaacggcaagatacgcgccaataccccgcagtcgatgctggacaggttggcggtagaacaccgcttccagtggtacttgtacaacaacaccctttatatcagcaccctggacctgcaagagtccgcgcgcctggaagtcgcctccgagaccgtcgccgacctcaagcgggccctgacggatatcggcctgctcgacagccgtttcggctggggtgaactgcctgatgatggggtcgtgctggtctccggccccaagcgctacatcgagcaaatcaagcaattcagcagccagcgtaagtcacccgacgaaaaacagagcgtgctcagctacccactgaaattcgccaacgcgggtgatcgccagatagattatcgcagcgaaaaaatcaccatcccaggcgttgccagcatgctgcgtgggttgttggaaccgaggtcaacttccgatctttccaccatgggttcacgcccctccgcctcacagccctcgcccatcacgccgaactttccccggttgagcaacccaatgctggggcaaatgttcggccaggcagcggactcgggccagttggccactggcgcgacgctcaccccgcgggcacccgtgtctgcaagcaggattcgcgtcgaagccgatgtgcgcaacaacgccgtactgatctatgacctcccggaacgtcagacgatgtaccgcgagctgatcagccagctcgacgtggcgcgtaaaatggtggagatcgacgccatcatcctcgatatagagcgcactcaattgcgcgaattcggggtcagctggggcaacagtcacttcagcagcgacgcgagaatagcgccaggcagttcctcgcagctgtcgatcaccaaccgtgaccgtttctttgccaggattcgcgcactggagcaacgtggcctggcaaccatggtgtccaacccgtcggtcctcaccctggaaaaccaaccgtcggtgattgatttcaaccgcacccaatacctgacggcaggcacagaagtcgcgaccgtcctgcccattactgtcggcaccagcctgcaggtggtgccgagggtgattaccagccgcggcactcatcaggttcacctttcggtgaatatcgaagacggcaacttcgacgagtccaaccccgatcgcttaggtcccgatgtgcgccggggcaatgtcagtacccaggcggtcatggcggaacagcgctcgctggtgatcggtgggttccatgtcaccgaaagcgctgacaggcgcaacaagattcccctgctgggcgatattccgctgctgggcaaggcgttgttttcttccagcgaacgccagaacaatcgccgtgaacgcctgtttatcctgaccccgcgcgtcatcggtgaccaagctgacccttcacgttatctgccgcaggacgatcaggtggagctgcaggccgcgctcaagccactggccaggcgctatgccgcacacgaccccgtcatcaaacgcagtgacatcaccagcgccctggcgcatctcgtcagtgggcaggtgcccgcggcattcaacgcggcccccatgcccctgggcctgggcaccttgtgcaacacccgcgatctgctggcaatgaacaccgaacgcagccagtggtatgccggccctcagttcaatgtggccgtgatagtgctgcgtaatcagttcaagcgcaccgtgcgtatcgacgaaaacgagtgcagcaattcacaaaccctggctgtcaccgtgtggccgcgtgcctggctcaaaccgggtgaagaagccgaggtgtttatcgccatgcgtccggtggtgaaggatgaacacatcggcgtaccccgtccctccttgctcactcccgttcagaagaaggtcaccccatgaaacaccgcttgttgtgcatcaccctgatcggcacagtgctgttcatcgccggctgcagccccacgtgcagaggcgattcctgctcacgcccgcaagcgaccaaggacaagatggtgatctggtggccgccgcagatgcgcgtcgagcctgggccctccggggaacgctcggactaccagacgatatcgctggagcgataagttttcggtgacttctggtgagcagcgctgctgctcaccagacctgcttgcgccaggcgcccggtactgatcagcgaacttcaagctccggcaattccagggtttcgcgcttggcttcatcatcaagctcacgcaatgtgcgatagatcagcgccacggcctgcaaggtctcgcgggggatgcttgctcccaccttgttcgtgtagagcgtgcgggccagccatacacactgaatcactggaacctcggcggccttcgcctgccgaatcaattcgcgtgcatcgtcgtccgtgcccttgttgaccaacatcggcagtggcgtattaccggggcggtaatacagggccacggcaaagtgcgtcgggttgaccaccagcatgtcggcctcctccagcttgggcagtttgaccttcggctcctcctgggccaattgctgtgccagcgatcggcgctgccccttcacatgcgggtcaccctccatgtccttgtactctttgacgacctctacctgcgtcatgcgcatgcgcttggcaaagaagtgcttttgcatcgccaggtcaatcagcgccaacaccagcaaaagccccaggcaggcatgcaacaagtgccggaacagggtgatcagcgccaggatgtaggttggcaggtcactgttggccaggttgatcaatgcgcccaacgagggcttgatgaccacgtaaagaatcaccccaagcagcaccgccttggtgatgctcatcaacagattcatgaccgattgagcggagaacatctgcttgagctgcttgagggggttgagacgattgaaatcgagcttcaaggtctccggcgcaaacaggaacccgaactgcatccagctgctgatcagcttggcggcaatggccagcccagccatcaacagggcaaacgagaagaacattatcagcccttcaaacatcacttcttccaacgcccgcacaaagggctgccccatactcgacatcggcaacaccatcagttgctgaaagcgttgcatactcgtttcggcggtgaacaatgccacctcgctgatggccgtcagcgccagcagcttgctgacatcctggctttgggaaacctgacctttcttgcgctgatcgcgcagtttcttggcggaggccgggtgcttcttttcgcctgagtcactcatggcgccgagacctggaacatcagcccgagtgagtgcttgagatcacccaacaagttcaagcgccctacgatcaggtcctgcagcaacggaaagtacaacaacagaatcccgatacccgccaggcatttgaccggtggtgccagcgtgctcacctgcaattgctgactgtagacccccagcaacgcgatcccgaactccaggaacaacagcacggcaataaagggcgcaacgtagagcatcatgtgggtaaaggtgtcgccgagcaggccaatgaacgtactgaagccattgactgccggcagcggcacccaggccgtggccggccagatcagataactgtcccagatcacctgggtaaggacgctcaagcccaggacaacgatcagcaggtaaatcaccacctgtttgaacaggtgcccgataggcgtcgcgtccggcccgagtgaagggttgagttggccgcccgccagggcaccacgctggttatccaacagcgcgccgactgactcgaacatccagaaaggcatggccaacaggacgcccagcaaaatgcccagggcggcctccttgcacatcagtccgacgatcatcagcgcggagtagtcctggcccaccagtaccgcatggatacctggcgccggaatgaaggccatgaccatcacgatgacgtgcctgggcaagccgcgtatatgctggaaacagaacgcaggcacgagaatggcacaggggtagatccgcgccatgcccaccaacaggctgggtagatattcaagataaagcagcacgtgcatgccctcagttcagtgccgagcgggcgatcatgtcgaacatcaggttggtcagttgaatcagctccacgccgatccagcgtcccgtcaatatcaatgtgatacccaccgcaaccagcttgatgccaaagggcagcgtctggtcctgtatctgcatcagggcttggaccagggacgtcagcacgccgacgatcactgccacgatcagcggcggtgccgacaacaccaccaccagcagcatgccctgcttgaacagcacgatcggttccatagggcactcaaaggtaagaaaggaaaagactgtccagcaaccgcgaccatccggagaccatcacgaacaacagcagtttgagcggcagggaaatggtcatgggcgagaccatttgcatacccagcgccaagagcaggttggacacaatcaaatcgatgacgatgaacggaatgtagatcagaaatccgatctcgaaccccgcctgcaactgcgacagcacgaaggaggggattaacaggatcaggtcttcgcgctcggtgctttgcgccatttcagggggccacatgcgcgcgctgttttcgtgcatgtgggtcaacacatccggatcgatgttgcgtttcataaacgcacgcagcggctctatggccacaaggcctgtctgttgaagcgtctgaacattgctcatgtccaagggcgcattcttgaggttttcggcgacctggtaccccacgggggccatgataaacagcgtagcggccagcgctattccattgatcgccatgctcggaggcacctgctgaacgccgatggcgttgcgggtgatcatcagcacaatgacgatcttcaggaacgccgtgcagatgatcaacagcatcggcagtaatgacaacgcgccgaaaaataacgccagaacaacggggtcaacgctctggaatatcatcgggaaaacaccacacgcgacaattgcaagccgagtcgcccatccacttccaccaactgcccctggccaatgggccgctctccgtaatacaggccggccatgcccggggcatacccggtaatgcccaacaccgcaccgggagcaagattgcgcagttcgcccagggtcaggctcaggacaccacagcgcaccgtcaacgccatactcaattcatcaaagggctcccggccgaagacatcctccaccggttcatcaagttcaggccccgggtattcttctattacaaattcttcgtccatcgacgcttcctctatcgcaataaggttcaggcacaacggaccggactcatcgtcaatacgcccttgcagacgatgacgtcctatattcaagtggccgtggccctgtacatcgaaaaaggcctgttcaagcatcagcacgtcaccggcacgtacatcgcgcaattgcgcacaggccaagttcaagcggcccacggttacggcgactgccaatggaaacgatgcgggtaatgggccggccgttgaccgccaagggccggccgcacacaccgccaggaagctctctggagtcagccaccagtaacctgcgactttggagggccccagcatcacggtgaaacggcaaccaaatcccaacttttcagggcctggcagcaagcgcagataaccgaacaacgccgacacctgcgggctgaggtgatgctggaacaattcccagaaccaggacttcgggtcgttacccgtctctgccagggtgaccgggcattcgcccatcaggctgaacattgcctcaggttccgagaacgccagtacaccgagggcactctcgaaaaacaaaggctttccccgtccgggcgcacggccaggctcgagcacaaaagcgccctgctggtcgccaacctgaaacggcatgcgtaacccacgccccaatcgatgcaacgccgcaacccttccccccttaaccaatggcggtgcaaaaatggaggtaatcatgcggggcccacgtttttgacatggatatccacgggctgccccaacacctcagccagcttgtcctgatagcgtttttgcaccgtgccgagccattgcgccgcgccctgctcttcagcgtgcagctcgatgttccaagcgcccggctggcgctcgacactggcgttgattcgccccagccgcggcaggtaaagcaccgccagcaacggccattgcgggacgccttgaacgcgcagtgccaactgcgtcgtcaatgcctcgatcattaatttatcggccgccgcactctgcgccggcatgcgggaagcgtaaccgccatgaccatcatctttggcaaacagttgggcgaacatgtgcacatggagccagggcaccacgccctcaacccttttctcacggtcttcgctcggctcgcgtacacggggccggttagacctgctcagaggtaatcgtttcatggctctcctgtaccaataactggtttaactccacgagtttttcgacctcgcgcaagcatcgggtcgcctgcttctgcatactgtcgatgtgcaccacttgctgctcctgctgcccgtgtaactcacgtaactgcgcctcttcgcggtgcgtactggcggataacgagcgctcctggttactccacgacttgagttcctgaaacgacagcacttgcccttgatgtttgctcaataattgcgcggcctcctgggcctcctgctggcgtgtttgctcaaggacctgctgcgcctgctcgacttgcaactgcagcgcccgttgatgccttttagcctcacccaaggcgcgctcggcacggtctgcccgatgtttgcgcaggcgcctgagggtttccaactcagaaaggaacatcgccagtcagctccgtcagttgatccagggtcgcctcaatgggggaaggctcacgcaggtcctggcgcaaaaagtcatccaccgccgaccggctctctactgccaagtccgtcagggcgtcgttgcccgcctggtactcgcccagcttgagcatcagttcgatctgctggtacgccgacaacaggcggcgcagcccggtacccgcctggatatgctcaggcgtggcgacgttgctcaaaatccgcgaaaggctggccagcacatcaaccgccgggtagtgaccgcgctccgccagcttgcgggacaaaacaatatggccatcgagcaacgagcgaacctcgtccgccaccggatcgctcatggaatcctgctcgatcagtaccgtgtagatcgcggtgataacgccgtcgcgggtcaacccggcgcgctccaccagacgcggcaacaagctgtacaccgagggcggtaaaccaccgcggcccaagggctcaccggccgccaggccgatttcccgctgggcgcgggcaaaacgcgtcaaggagtcaatcagcagcagcacacgtttgcccttacgtcgatagccttcagccaacgcggtggcggtgaacgctgcacgggcacgctccatgcttgaacggtcggacgtggcgcacaccagcacggctttggcccgcaactgatcgtccagttcatgatcgagaaactcccgcagctcccgaccacgctcgccgatcaggccaaacacgatcacatcgcactcgacgttacgggcaatctccgccagcaaggtggtcttgccacagccggcaccggcaaacaggcccacacgctggccttcgccgagcgtgagcaaaccatcgatcgagcgcacgccggtggccaaggctcgattgatcctcggccgctcggtcggcaacggcgcctcacacaacaccatgcttgcatccgggccgtcggcctcaacgaacgcactggggccaacgccggtaatcggccgaccgaaaccatccagcacctggcccaacagctcatcactgacccgtacctgatgcgacacacccaggcgctccacgctggcacccacgcgtatgccttcaaggttgccaagggcactgagtacggcatcctgctgatcgaaaccgataatctcggcgagcatgtactcgtcggcagacttttcaacctggcataagtcaccgatacgcgcgccgggcaatcggcactgcaacagcatgccgttgacgcgctggacccggccgcgcatggtcaccggcatcaggttggccagcgactgggtctgacgttctcgccaggcatccagacgcgtttgcagttcctcgctcaccagcgcacctcaaaacgctgtgcgccgtcgaagaccaccttggtattgtcgatcagtaccaggcgcaaaccgtccacttcatcaccgacaaacaagcggctgccctcttccagcacaacatggccgttcggcccgccaacaatctgcacaatcttgaacggcagtgtcccgtcgcgtacacgcacgcggctgatcaccgggaccgcgctgtcaaacagctcaccaaaacggttgagcatgcgcgataccaactccacatcatcctgggaaacctcgccgctgagcgcgacttggccattgatcacttgcaagctgacgcgtttgctcaactcacgctcactgagcatcttcaacagctgctggcgcacttcaaacggtgaggccagttcgtgttttaccaccgtgggaggcatcaacgaggcctgggcctgacgctcccccgtggacgccaaccccaccactacgaggacaatcgcaaccaccagcactgcgctgatcagacgtttttgctgcgtttgcgagatggatgacaattgcagtactcgcggcgcttcagcgggccgcgacggtgacgcaggggcgggcgtttcaggccatggctgatccgccaaggtgacacacagccggatagcccccactgaaaacggcaggttcagcaccagactcgcgatctgtgccagcacttgcccctcatggtcgtgcagcagcccggcctcggcctgcaccgaccagtttgagccgatcagtcgcaaccgcgcgtgctgctcggcgatgcccggatcattgagcatcaggtcagcgtcggggtgcgcgccaatgctccactgctcaccaaaaagcggcaacgcggcgccctggcgcaggccattgagtacccgcaactcaaacattatcgagccctcccgtgcgttgcagccagctgcagattcatgccaccgcaccgcgcatcagctcatcctgagccaggtcaaaacgcccaagcactttcaccttcgaagcgcttcccaactcggcaaaggacagcaccggcacatggttgaactcttccaggagcagggtgcgcagtgggctacgcaggtcttgcgccaccaacatcacacttttgctcttggggcgtgcggtaaaggcctggttaaggaggttgatcaacgcggcgctgttttcattgtcgagcgcaaaaaacaccccggtctgagtctggcgcagcgcctcgcgcaaaatgttctcggtacgcggcgagagcagccaggcatgcaggccgtcctcctcgctgtactgatggaagatctgtgccttgagggcaatgcgcgcatagtcagctaacgcatcaggctcacgctcatgctggccgtactcgatcagcgactcgacaatcagccgcacggcacgcaacggcacgccttcactggccaggcgttgcaataccgccgaaaaccgcgagagcggcatgatgcgttgcaactcctgcaccaattccggctggttgtgttcaagccaactgaggatcgacttactctcctggatgccgaggaactgcggcccactgagcatcatcgcctgcctcatgcgttcgatgatcaaactcgtcgcggtgaagcgctccaactgcgggtcatccagcagcggatcatcaggagccaaccacacccaatcctgctcatcacgctcggcaatccccggtatagcgtgctcaggtacgactgtcagtgacttgcgatccacggccacatggttaacgaccgaggccttgaccatcggcacttcatgtacgcaaaaacgcatttcatcatcggccagcgagtcatcgagttcgacttcaaacggcggcagtgtcagaccaatattggcaaccagcgtgtttcgagccaggcgaatcccgtgaataagatccgtcacctcaggggtgcctcgcaggctcgggggaaactgcagcaagtaaggccgcgacggatcgaacccgcgcaagtcttcatcaccgttctgttcggggcgtacggcgtcgacggcttcatcggcgggcgcctctgcgcgttgacgctggcgcatcaagtaataacccaggccgccagttgccatggagatcaggataaacaccagggtgggcatgccgggcactatcgcaaacgcgagcatccccaccgacgcgatcatccaactcttgggttcgctggtcatttgccgggcgatttcggcgcccatgttactgacgcccttgcgcccgtccggcgccacacgggtgataatcatgcccgccgtcagggagatcagcagcgcaggaatctgtgcaatcaggccatcgccgatggtcagtaccgaatacagctggatcgactcgccagcgctcaagttatgttgaaacatgcccgtggtgaaaccacccaacaggttgaccacgacgataatcaaaccggcgacggcgtcgcctttgacgaacttcatggccccgtccatggcgccgaacaattggctctcgcgggataactgctcacgcttgtcccgcgcttgtgtgccgtcgatcaggccggcacgcaggtcactgtcgatggacatctgtttacccggcatcgcgtccaggctgaaccgcgccgcaacctcggcgacccgttccgagcccttggtgatgaccaggaagttgacgagggtcaggatcagaaagatcaccatgcccaccgccaggttgccacccaccacgaaattgccgaaagcctcaacgatgtcgccagcgtcctgctccaacagaatcaggcgtgtggtggcgatcgacagcgccagacgaaacatggtggtcagcagcagaatcgaaggaaacgatgaaaacgccaaaggccccggcaaatacaacgccagcacaatcaacaggcaggagatgcaaatgttgatcgcaatcaggatgtccacgagccaggtcggcagcggcacgataaagataaacacaatgcccaggaccaccaccgcgcccagcacttcggcacgctgtgccactttgagcaagacgcggttgatggccgagagtgcattcacgcagacgcccccaagtcaccgggaaactttaccgggccacgctcgtcgcggcccagttcgtccaacaccgccaaaaagctgtccaaagccttgtcgcgtacccggctgtcaggccacaagtccagaggcatatcgcgagccagagggtaaagcgcgttaaggagtaccacttgccgggtactcgtgccatttcccagatcctgcccgaaccgcaggatttcaggcgcatcgataccgctgtcggcataccccagcaggcgttgcaaaaggctcacggcgtcatggtttgggctcagactcaggcggtcgatcaacgcctggccagcggccaacactgtgcccagcttcccgcagctttgcagagccagcaacaaggtgcgcaaccgcggcgtggacgttgacgacaccagcatcgcgatgtcgtcagccaaggctttgcgcatgctgccgagcctggcggaaaacgtatcgccaccatatacacccagcagagcctgcatcatcgtagccagagactggcgcgtggccacactggagtaataaagcgcacgcagcgcttggcgctcctgcgcatcacctccggcctgcgtcaacgccgtggcgaacttaaggcccgcctggatttcccctttgaagccgaccgtcagcgcggcgatggcatcccgcgccaaggccgcgtcagaggggcgtgcgtcattggacgcctggttctccaaatgcttgagcaccacgaacgcacgtgcggggtcgccctcggcaagctccagcagcttgtcgacactggagtgctgctgcaattgctgcctgaaccgcagagaaatagctgccaacgactcctgagccggatggcccaattggtcataaagttgtgcaagctgctcgacggggggaacgcgtatcggcgccaaccgcaaattccggttattggcgatcaagtcctggtcgaatagcggggcaagctcatcgaccttccctgacgcgggtgtggagacaggcgcagtggattgttgatccaggcgctgggtagagggcgcatctttgggggattcgactttcataagcatgccaagaagggaagtgtgtgtccctatgtggcgaggcctgccgatacggttccatcaaaactcgactttagacacacttgcaaagacccgcacaaaccatcggcgccttttgcaaattacggcgtaaaaaataatagattcaatatatatctctatataaatcaataggttgagaagatttttccgttggcatagccagtgcaaaggggttcgcatcgaaaacatttcgatagcgtctaccctgaggaaaaaatcatgaatatccctattgaagctttagcgcacctggttggcagctcgcctcaattcatgcatcacctgacggacgatcaacaaaaaaaacttcggcgcttcattcacaagcgcgtactcaaccccgaagatgccgacgacattctgcaactgacgtacctggaggcgtggcgcaacagggagcgtttcagcggccaggcaagcctcagtacctggatgtgcggcattgcgcagaacttggtgcgcaaccattttcgacgcctgtacgccaagccggtgcattgcgaattcgatgaatcgctgtggcatggccaagaggaaaacaacaatctggattgggagttcgagatcaaccgccgactggaaaaaaccctgacggcgatcgaccacctgccagtagaaatgcgcaagacgctgtacgcttcgctggagactgacggtagttaccaggacacggccgacgtattggacatcccgatcggcaccgttcgctcacgcttgtcacgtgcgcgcgaacacctgaagcgtgtcacgcacaccccatcgcaaccgtaaggccctcgaaagggtaatcgttgggcggcagggatatctgcccaaccgaattacgctttcatacgcgtcagttgaatcgccggccactcgctcgatactcttctaacgactaacaccaatcctttgtgggagctggcttgcctgcgattgcagtggatcagccgatgatgaggttgaatatgccgccgtcatcgcagccaagccagctcccacagggatttgcgtggcgtcctgagcaggagaaatccccacgccactcgtcgcccgaagctgcattttcggttaaacggttgaaagcgtagataaaaatttaaaataaacgcttgacgcattcccgttctacgcgaataatgcgcgccacttggctacatagctcagttggttagagcatagcattcataatgctggggtccggggttcaagtccctgtgtagccaccaagtactaaaaacggcttaccgaaaggtaggccgtttttttatgcctgccgaaaagtgctcaggcatactcgcagcggcccacacaccacaacgcggctttgagtgcccttcatgagcttcgacgtattcgccatcatcctgctcggcgcggctctgcacgccacctggaatgccgtggtcaaaggcggcgccgacaagctgttgaccacttgcatgatcgccgccgtcgcctcgttgatcgcgttggccgccatcccgtttctggcgttgccggcgaaagagagctggccgttcatcggcgcgtcggtgattctccaagtactgtatttcgtgctggtggcctcgacttaccgtatcgccgacatgagccagacctacccgatcatgcgcggtactgcgccgctgctggtggcgacggtgagtgtgcttgtgttgtcagaatcattgtcggcattcgcctggctcggcattgcggtgatctctctgggcatcttgagcatggccatagccccctcaacagggccgcgcaaaggcttggccctggcattgatcaacgcgggagtgatcgcgggctatacccttatcgatggcctgggcgtgcgcaagtccggcgcgccggtggcttacacgctgtggatcttcctgctgaccggcattccactcgcagcgtgggcgttagcagcccggcgcagggtgttcgttgattatgtagccggtaactggcacctgggcatcgtcggcggcgtgggcacgatagcctcttatggcctggcgctttgggccatgaccgccgcccccatcgccaccgtttcagccttgcgcgaaacctcgattctgttcggcgtagtgatctcggcatgggtgctgaaagaacacctcacgcgcgtgcgcatcattgccgcctgtgtcattgctgccggggcgatgttgctgcgcctgggctgagcaggccttggtgtttgcgcgcaaaaaaactgcgtatctgtattttgacgcctccccgagccactgttagtgtccagcctcccctacacggagtgccccggatgaaattggatatctaccaagtcgacgctttcagccaacagcctttcggcggcaacccggcagccgtctgcccgctcaccgagtggctgccagacgaacaactgcaaaatatcgccgcggaaaacaacctctccgaaaccgcctacttcgtaccccgtggcgatttttatgagttgcgctggttcacccccgaagtcgaagtggacctgtgcggccatgccacgctggccgcggcgtgggtgttgattcaccagctggcggatgcgcctgaagtgttgcgttttgccacccgcagcggcgaacttcgcgtgacgcgcaatggcgacgaactggcgatggattttccggccaaacagccccagccctgcgagccgccaagcggcctgttgaacgcattggggattgaacacgccgaggtgtttgccgctgatgactacatcgtattggtagacgacgcagcgcaaatcgccgccctgacgccggacttcgcacgcctcaagggtttgcccaaacgcgggattgcggtgacggccaaaagcacccggtttgattttgtttcgcgctggttcggccccaacgtgggcgtcaatgaagacccggtcaccggctccgcccacacctcgctggcaccgttctgggccgagcgtttgggcaagtcaatattgaccgccgaacagggcggcaagcgccgtgggcaactgcgttgtgaactcaagggtgatcgcgtgatcatttcgggccatgcagtgctctacctgcaaggcgtgatttacctgtaaaaagcagtacatcaaggacaacagatcattctcaaaatgaacggagttcagcgcgtgttttcgatttcccgccgtcaactgtcagtgattgccgcagccctcgccctggccgcctgtcacgcccccgtcacggaacaaccgccagcgccggagttggggtcgggttatcgcaccgacctcagcacccgccacgccgagcgccatatggccgccgccgccaacccgctggccgccgaagccgggcgcgaaatgctgcgccagggcggctcggccattgacgcggcgattgccatgcaggccgtgctgaccctggtggagccgcagtcttccggcatcggcggcggcgcgttcatcatgctgtgggatggcaaaaacgtgcacgcgtatgacggccgcgaaaccgcaccggccggggcgactgagcgcctgttccttaaagccgacggcacgccgatggcgtttcccgaagcgcagattggcgggcgttcggtgggcacgccgggcgtcttgcgggcgctggaaatggcacacaagaagaccggccacctgcaatgggccaagttgtttgaaccggcgattcgtttgtcggagcaaggctttgcgatttccccgcgcctgcacgcgctgattgctgccgaccggtacatcgcgcagtcacccgacatggccgcctattttctgaatgccgacggcacgcctaaagccaccggcaccctgctgaaaaacccggcgctggccgccgtgttcaaacgcatcgccaaggaagggccggacgcgttgtaccaagggccgattgccgatgagatcgcgcgcaaggtccagggcaaccgcaatgcgggcagcctgtcccaggccgacctcaagggctacaccgccaaggaacgcacgccgctgtgcactgactacaagcaataccaactatgtggcatgccaccgccgtcgtcgggtgggattgccgtcgcacagatcctgggcacgttgcaggccctggaaacccgcgacccgcgcctggccatcgcgccaatgaaaccggtaaaaagcacctcacccgctggccttgaacccacaccgcaagccgtgcacctgctcgctgaagccggtcggctggcgttcgccgaccgcgcgctgtacgttgccgacgccgacttcgtgccggtgccgactgccggccttgtcgccccggactacctggccaagcgcgccgcgctgatcggtgagcgcagcatgggcattgccaaaccgggcacacctgcggggatccaggtagcgtacgccccggaccgctcgccattgcgcatttccacctcgcaagtggtggcggtggatgacctgggcggcgcggtgtcgatgacgaccacggtggaagcggcgttcggttcgcacctgatggttcagggctttttgctgaacaaccagatgaccgacttctcgttcatccctgaagaaaacggccagccggtggccaaccgcgtcgagcccggcaaacgcccacgctcggccatggcgccgacgctggtgttcgaccgcaagagcggcgagttgctggcaaccgtgggttcaccgggcggttcgcagatcatcgaatacgtgagcaaatccttggtggcaatgcttgactggaacctcgacccgcaagcggccatcagcctgcccaactttggtagccgcaacggtgctaccgagctggaagccggcctgttcagccccgcagtgaagcaagcgctgagggacaagggccacgcgttgagcgagattgatatgaccagcgggatccaggccatcgttcgcacgcaagatgcccaaggcaaggtgtcactgagcggcggcgccgaccctcggcgtgaaggcgaagcggtcggcgattgagtttattgagcggagagcgtcccttgcagcaggcaaacaatctcggcgccctgcccggcgtcgaccatggtttttgttcgatcaatgacccgttgcgaccggacgaggtgttcatctgcaagcaggtgcacagtgccacggtgatcaagtggcaggcggatcaggtgaccaataccgttgaggcggatggcgtgtttacgggcgagcatcagcccatcgcggtgattaccgccgattgcctgcccattcttatcgccgcaaaaaacggcggaatggttgccgcagtgcacggcggctggaaggggctgcaagccgggattatcgccaatgccgtgcagcaatttgccgcccagggcatcgccgtggaccagttgcacgtcgctatcgggccgtcgatcaaaccctgttgttacgaggtcagcgagagctttattgcgcagtttcaagcggaccaggggcacttgtggcacttcgaacaaccggcccctcaactgtcaccgcagattgcgccgccccatgcaagacagacgggaagcgcatggtttgatttgagtggttatggggtgatgctgctgcaagcggcggggcttggccgtgagcagatcgaagtcagtgaggtgtgcacgtattgcacctcaccgacctttgccagctaccgcaggcggacacataaccctgcggagccgaagacgctgatctattcgtggattgctcgaaaaacctaaagaagcccctccactctttgacgagcgggcttgttgtggcgagcgggcttgccccgcgctgggctgcgaagcagccccaaaacaatcaccgcgtccttcctgacagcccccgtcaaaccgactgggggcgcttcgcgccccaacgggagcaagctccctcgccacagggttccccctcacacctgctaacttcagcgactgatcttcaagcccttgcgccccgcatgccgctccagcgccagctcaatcaaccggctgaccaactcgctgtaactcattcccgccgcctgccacagcttggggtacatgctgatgcgagtgaagccaggcagtgagttgatttcgttgatcagcacttcaccgtcgtcggtgaggaacacgtcgacgcgcgccagcccggcacagcccaacacctcgaacgcttggatggcgaggtggcgaatgcgctcgctggcctcgacgctgatatccgccggcaccaccacttgggcggcctggtcatcgatgtatttgctgtcgtaggaatagaagccgctgccgacgacgatctcgccacagccactggcgatggggttgtcgttgcccaacacggcacattcaatttcgcgcccttgcacggcggattccaccagcaccttttcatcaaaacccaaggccagttcgacggcggcgtggtactcggcctcgttgccgactttactcacgcccaccgaggagccctggttggcgggtttgacgaacatcggcaagcccagcgtgttcactgccgtagcaaaagaggtgcgcgccgcattgcgacggttcagggtgatgaacggggtgacggcaataccggcatcgcgcagcaggcgtttgctgatgtccttgtccatgcacacggccgagccgagtacgtcggagccgacgaaaggcaagtcagccatacgcagcagcccctgcaggcagccgtcttcaccgagcgtgccgtggacaatagggaagatcacatcgatgtgttgcagcaggccctgacccgaggtttccaccacttgctggctggccttgcccggcaccaccgccaattcgcggttggattggttgagggcgatcagggccgggttttcctggttaatcaggaagttcgaggtgtcgttgaggtgccagtggccggccttatcgatgccgatcagcacgggctcgaaacgcgaacggtcgagtgcgtcgacgatattgcgcgccgattgcagcgagacttcgtgctcggccgaacggccaccaaaaataatacctacccgcaccttgctcatgactcggcctcactgttgaaagtaaggcttcttaccatgagcggtcagcgattcgccaccagatgtgcaccgaacaacaggtagcaaccaccggcaaaccggtcgagccacttgcgtgaacggctgtaaaggttggccatgcgctcgctggaaaacaccagggctacgctggtgtaccagctgaatgacaaggtggccatggtgatgaccgccagggccaacaacgttggcgacggcgaaggcggcatggtcgaggcgaaggccgtggcgacgaacagcgcggccttggggttggacaggttgcccagcaaaccgaagcgccaggcggagaacagcgagcgccggggttcgtctggcaacatcgcctggttgctggcaggggccgaacgcttgaacagtttcagccccaaatagatcaggtagcagccgccgatgatcttgaatgccaggtagagcatgggcgcagcggtgaacagcgacttgatgcccagaccacccgccagcccccaaataatcgtgccgcaggacacgccggccgaggccaccacgccatgtcggcgcgaacaactcgccgccagctgcgccgtgttgaaaaagttggggcccggtgtcaccaccgcgacggtccaaagcagccccagcgacaacaacggcgcgacatacggcaggtcggagaagagcatggggcgatccctcttggtaaatgtttaaacctatttggtcgcaggctcaggcgtgtgcaccaacaagtcgccaggctggcagtccaggtaggtgcaaatcgcatccaacgtgcccagccgtatgcccttgaccttgccttgtttgagcaacgacaggttctgttcggtaatcccgatggcggccgccaggtctttggatttgaccttgcgccgggcaagcataacgtcgagttcaatcacaatgggcatttcgatctcaaacaaaagtgcggttttcagaatccacttcactggcctgccacaggatacgcgcgattaccgcgatacaggcagcgagaaacagcgcgacaaaacttggcggggtcaggctcaacgtgatcaatcgctggccgatcggctcgttcattgtgacccagacactgagcagcggctcgcataaaaagtccagcaagacccacaacgccaccgctcgccccaccttgcccaagtgctgcgccgccgcactggagaaatactcaccacgggcgtaattgcggaacagttgacgcagatggttcaagccgaaagccaacgccatcagagggatactggaaagcacaatgccacccaaaatctgccaccagggaaacagcgccacttgcgcggtacgctcttggatcaggcggtcactcaaggcaaaaccaaagcccaggccttcggtggaagaactcaataccgggtacagccatacagcggtgttgagcaccagcataacgacaatcagcaagagcgtaagcagcgacatgcgctggctgagttgagccaaacgttgggtgttcataagcaacctcagtaattgaatgaggacgcaaaataatagataaattatcgtaaaacaatcattttttaatgcttaggggtatttatcttgaagccagccccccctccaacgcgtgcacaatcgtacaagaccccggcagacaaaccgcgccagactgggttaacgtgtttccaccactacatgtgacaagtcaccatgggccaacccacttccaccctcgattggctgcaccgcgccccgcacgccagcggcctggaccgtatcgaagcgtactttgcgggctttgcgttcgacccgcatcgccacgacacctacgccatcgggcgcacgctgtttggcgtgcagagttaccactaccgcggctgcatgacccacagcctgcccggcacgaccatggtgattcacccggacgaatcccacgacggccgcgccagcagtgttgagggcttcaagtaccgcatgatttacgtggagccggcgctgatccagcagattctcggcggcaggccgttgccgtttatccacaacggcctgtcgacagacccacgtctgtttcgcgccagcgaagtgttgctgcaaaacctggactgcccggtggacccgatgcaggagcaggacgcgctgtacgacctggcgcaggcgttgagcgctgcgtcgggggtgatcatcagccgtaaatccttcgattatgtcgccgccgaacgcgcccgtgaatttatccacagcgccttgggccgcagcatcaccctggatgaaatggccgaccattgcggtcgtgaccgctgggcgttgtcgcgggatttccgcttgttgtttggcaccagcccctatcgttacctgaccatgcgacggctggatttggtgcgcagtttgctcgcccaaggccaatcgctggtcgatgcggcgctgactgcaggtttcaccgaccaaagccatatgacccggcaatttcgcagcacctacggcatgccgccgtcgcgttgggtgaagatgcttgggcgctgagcctctggtttgaaatacagtcaatgtgggagctggcttgcctgcgatgacggtctgtcagacacccctaaacagactgatccggtactatcgcaggcaagccagctcccacattagaactatgttgtttccaatatcacgctcgacgctggagcctgttgtttgagccgcaacgccaacaccgcgcccaccaaggcaatcgccgcactccaccacaacgccagttcaatcccgccggcattcgccaccgacaccagcaccgccaggcccaatgcgccgccgatctgctggctggtcgacgccatgcccgccgccacgccctgctcgcccggccgaatccccagccccgccgccacccacatcgccgtccaggtcatgccctgaccaatgctcaagatgaagatgcccggcagcaacgaccagaaccccacacccgtcggcagcgcccagcacaccagcgcgatccccaccgcgcccgccaactggccgctgaccaaggtgttacgcaaccccaacttgagcagcgagcgttccgccagccagatgccgaaggtgcacaccagggtcgccggcaaaaatgccagcccggcctgcaacacgctgtagccatagacctgttggtaatacagcgccaggaagtagtactgcacgccaaagctgctcatgaacaccgccgtcagcaccatggccatgcgcagttcgcgataggcaaacagtcgcagcggcatcagcggatcgcggccgcgatgttcgatccaggcgaacaagccgagcaacaacagcgccagggcgatgcaacccagggtcgacggcgccgcccaaccccactccgggccttgcaccagcgagaacaccagcaacgtgccaccgaccgtcacggtcaaggcgccgctgatatcgaatttgcgcccgcgcactcgttcgctatcagccggaatccagtaacgcgccgcccaggcgcaaccgcccgccagcggcacgttcaccaggaacaccgcctcccagccccacacctgcgtcagcacgccgccgagcaatgcgcccagcgccaagcccgctgccgacgccgcgctccacaccgcaaacgcccggttacgcgctggcccttcggcatagtgggtgttgatcaacgccaacgtggccgggaacaacatcgctccacccacgccttgtacggctcgcgccagcaccagcaacatcgcgctgccgccgagcaccgcggccagggacgccaacgcatacagcgactggcccacccgatacaaccggcgcttgccgagcaaatccgtggcccgcccacccagcaacaggaagccgccaaaggccacactgtaggcgctgaccacccactgtaactgctgggcggaaaaatccagatgcgtgccgatttgcggcaacgcaacaaacacaatggttgcatcgagggcgatgatcagttgcgcggtggccagcagtaagagcatccagccggaaggtcgagagggagacatcacagcgtcctgcctgaaaaaatgagaggcggccagtgtctttcatgcgcaacagatgataaatagcgctatcactctttcagtaatgactttaatcatggatctgaacgctgttcgactgctggtccgcgtggccgaaacacgcagcttcactcgcgccgccggtgacttggggctgacgcagtccgggctgtcacgcgccatctcgcgtctggaaaacgagctgggcgtgcgcctgctgcaacgcaatacccgcagcgtcagcctcacgcccgacgggcagatgctctatgagcgcagtgcgccgttgttggcggaattggccgaaaccgaaaaactgatgctcgaccgccgcagcactccgtccggcctgttgaagatcagcacgccgtcgctgttcgggcgcaaggtggtgatgccggtgatcggcgaattgaccttgcgctaccccgacttgcgcatcgaagcagtgatgaccgaccgcctggtggatatcgtcgacgaaggcttcgacgcgctgctgcgcaccggcgaaatccaggaccaacgcttgatcgcccgcgccctgccgccgctgcgctgggtcacggtggcttccccggcctacctggcgcgtttcggcacgccgcaaagcgtcgatgaactcaaggaccacaactgcctcaccgtgcgcaatttgcgcagcgggcgcatggtggattggcagttcatgattgatggcaacgtgcaggacgtcagcgtcgaagggcggctggtttttgatattggcgatgcgctggtagacggcgcagtcgggggattcggcatcgcccaggtgatggattttgccgtgcgcgatgacctgactgcgggccgattggtgacgctgctggaggacgttgccgggcgcagtcgggcgatttcgctggtctatccgccgtcccggcagtattcaccgaagctgatggcgtttgccgaagcactggcaaacgcacgctggtaaaacctacagctgacgcccgaccaccggctcgccgatggtgaggaaattcccaccggcgatatggtgcaaggtacgcaatggatcatggccttcgaagtgccagtgcccgtcactgaatacacgctcgtcggcataggccgcgaccacttcgccgaggaataaatcgtaggtctgctggttatgaggctcgggcaacagacggcattccagccacgccacgcacccttccagcaacggcgcttcggtgtgttcaccgttaaatgtctgcaggccgtaggcggcgaacttgtcggtgtctgcgccgctggtgttgccaaccgtctgcaccaggtcggcctgggccacgcaaggcacttgcagcacgaaggtgccggcgccttccagcagttgccgggtccaggtggccttgtccagcaccacggcgactttcggcggctcgaaatccagcggcatggcccaggcggcggccatgatattgcgcttgccgtcgtgggccgcgctcaccagcacggtcggcccgtggttaagcaagcggtaggccttggacagcggaacggggcgacggtgggttgggctcatggaggggcggctcttcaagcaagaaaaaacctacgatacctcaagcacaagcccgatgggtcagctcgacaactgattggcgaactgcccgaccgcgctgaccactttttgcgcaccgtcctggatctccacaatcaccgtgcccgcctcggcggccagcgccaaaccatgctcggcttgcaggcggccctcggtcatcaagctcaccgcatcacgggccatgtcctggttctgacgcaccacaccgacaatttcctcggtggccttgctggtacgcgatgccaactggcgcacctcatcggccaccacggcaaagccacgaccttgctcacccgcacgcgcggcttcaatggccgcgttaagcgccagcaagttggtctgctcggcgatgccgctgatggtcttgacgatggttccaatcacttgagactgggcgttcagcgcctcgatgccgtcgccggcctgctgcatgtgcttggccaggtcacgcatgacatccaccgcctgcgtcaccacagtggtgccgcgctgggcactgttgtcggtgtgcagcgaggtgctgtaggcgatgttggcggcttcggccacggcctgttcctgattgacctggtcggtgatcacggtggcgaacttgaccactttgtacagccgatcgttggcgtccagcaccgggttgtaggtcgcctcaagccacaccacacggccatggctgtcgacgcgtttgaagcgcgccgcaacaaattcaccggcgttcaaacgcttccagaactgctggtactcggcgctgttgtattcctccggctcgcagaacatgcggtgatgtttgccctgaatctgcgccaggctgtaacccatgccgccgaggaaacggtcattggcggtcaacacatgcccgccaaggtcgaactcgatgaccgccgtggaacgcaccagcgcggtgatcaggttttcatgctcgcgcgacgcctcgatagtgcgagtgaggtcgctggagtagatcgaaaaatgcttgatgcgcccgttcgaagtgcgcaccggttgcaggatcgagcgcagccacgcctccttgccgttgccgcgcatcagccgcaccgtgccggcgaagtgttcgccgcgcaccagggcattcttgaagcgcagttgaaactcgtcctggcgcaggtgtgccggcaccaggtcatcaatgtgacgccccagaatgttgctggcctggtacgacagttcttgcaggaagttggcgttcgcccactccacccggccatcggcgtccagcgtcaggcacagcatttcgctttccaggctctccttgacctgttgcaagctggacaactcttcgcgaagagcagacagctcctgcttcaaacgggtgttgaacattgggcaccgatggtcatttggggaggtggatctgacctgcatcggcgctgccggcgttttctgaagcgttttttcacgccgggccaactgttttttcggatccattaaccaccgttatttttgcacacgcccatcacttgatactcaagggtgttgagcttgccgctggagtcttcataggtcatgcgcgacggcaccgggttgcacgaacggatcggcggcgtcacgttgacgactttggcaatgtccagcttcatgccgtagcggtaggcctgaacctcaggcatcggtttgccctttctttcggcgtaggccgccatggctttttcatttcgctccatcatcagggcaaaggtgcgatccccgccgccttctgccaacgcaccgaatgacaagactgccgctaatacacccaagccgattttaaaagcgttcataacagtttcctcgattgaaaagttcagtaacgagactaatcaaccgaccctgtcgcaatgttcactaaaacattacttatctgttaggtgggcgtgagtttccagaattgtaatgttgacgccacctaaccgttatccgccgtttgcaactatcagcccgggccagatcaataagaacgcccaccctataagaagctgaaaactgccaatacccaggagcgaaacatgaacattgcttactacacccttcccttttcactgattgccgcactgccagtggcagccgtcgccgtggaagacaaacctgaaggctttatcgaaggcagcagcgtgaacgtgctggcgcgcaacttttacttcaaccgcgacgaccgcaagggccagtccagccctaccggcaatggctattcggaagcctgggcgcagggtttgatcggtaaattcgaatccgggtttactcaaggcaccgtggggtttggcctggatgcgtttgccatgtacggcctcaaactcgactcgggcaccggccgcagcggcggcaagagctcgtttggcgtattgccggtagacagcgacaatcaccctgaaagtggctacagcaagttcggcggcgcggcgaaattgcgcgtgctggacacggtgatcaaggccggcgacgtgttcccggccacgccggtggtggccgccggtgactcgcgtttattgccggaaagttttcgcggcgtcaccgcacagaacaccagccttgagggcttgcgccttcagggcggacgcctgagcggcatgagccagcccagcgaaagcggcatgaacaaaggctttgcgaccttctatgcgggcaaggtcgattcgccctgggtcggctatttcggcggtgaatacagcgtcaataaacacctcagtgtcagcctgtacagcagccgcctgaaggacgcctgggaccagtactatttcggcagcgccgccagttacccgctgaatgacgacgtgtcgttgttcggcgacttcaactattacaaggccgtggacgaaggcaaaaagctgttggggcaattcgacaacaccatctggagcgcgcggcttggggtcaaggtcggcgcccacagcctggccgtgtcgcaccagcgtaacaacggcgatgacgacttcgattacctgcgccaatcggactcgattttcctcaacaactcgatccagtacagcgacttcaactcgcccagggaacgctcgtggatggcacgctatgacttggatatgcaagccttcggtgttcccggcctgtcattcatgacccgttacgcaaaaggcaccggcgccgactacagcaacgcgaacgctgtgtacatgcgccgcgattcggcgggtaacccgctgacggatcaacgccgctgggagcgaaacttcgaggccaagtacgtggtgcaaagtggcaacctgaaagatttgtcgttgcggttgcgccaggcaaccgttcgctcgagtgctttcgaatcggacctggaggaagttcgcctgattgccgaatatccactggtggcactctgaatagtcattggcgggaacgtttacattcgttcgcccttaactaacatttgctcacaaagtgataactatcaaaactgtaatattagccccagcttcccgttaagttgagcttcctatactcgctcaaacttttttacaccgagcaacattcatctctgaagctttttcggagctcctttggaaagagatgattttttaacgcccctctggggcgttttttttgcgcgccggcttaatcgcgaccaatggtcgcagttgaccctgaagctacttcacacttcagacttttcctactcccaagacaccctattccataaggaaatggcgcccttctctcacccgaaaaaggtaaatccccatgcgtatccttgtagttgaggacgagcaaaaaaccgccgactacctgcagcaaggcctgaatgaaagtggttatgtggtcgactgtgcgtccaacggtatcgacggcctgcacctggccgggcagcacgcctatgagttggtcatcctcgacgtcaacctgccaggcaaggatggctgggaagtgctggagcaattgcgccgcaatggcagccaacgcgtgatgatgctgactgcccgcggccggctggccgacaagatcaagggcctggacatgggcgccgatgattacctggtcaaacccttcgaatttcccgagctgctcgcgcgggtgcgcacgctgttgcgccgcagcgaacatatcccacagccggacgtattccgcgtgcaggacctggagctggacccacgccgccatcgcgcgtaccgcggtacccggcgtatcgacctgaccaccaaggaattcgcgctgctgcaggtgctgatgcgccagaccggtgaagtgctgacccgtacgcaaattatttcgctggtgtgggacatgaatttcgactgcgacaccaacgtggtggaagtgtccatcagccgcctgcgcgctaaggtggatgaccagagcgaggtcaagctgatccacaccattcgcggtgtgggatatgtgctggaggcgcgtcaatgaaagccagcagtctgtcgatgcgcctggggctgacggtcagcatgatgggcgcaggcctggtgctgttgctggccaccctggcctacctggcgctgacccacgagctggaaaaactcgcgcgcaagggcctggagagcaagatggaacagatccagcacagcctgtcacagggcctggatgccagcgctatccgagctcgaccgcacgcgctgatggacctggtgatcggccatgacaacttttacctcaccatcgtcggcacagcccccgatgacagcgtgttactcagcgccggggccaaaccgcaggaaccgttgctgacagacttcacaccgcgcgaaaccctcggttacctcaactgggccgacagcaatggtaaccaagtactcagcgcttccagcctgatgcgcctggccagcggcgaacgcgtacgcgtgctgctgtccctggaccggagggacgatcaggcactgctcagtgcctatcttcgcgccacagtcatcgcgttgcccatgctcttgatattgattggcatgggcgcctggtggctggtgcagcgcgggctggcgccgttgaaacagttcagcggtgtggcggccaaagtgaccacccaggacttgacccatcgcttgtccgtcgacaacctgcccaaggaactgggcgagttggcgcacggcttcaacgtgatgctcgaccgcctggatgcgggcgtacagcagctgtcgcaattttccgacgacctcgcccacgaactgcgcgcgccgctgaccaacctgatgggcaaggctcaagtaacgctgtcgcgccagcgcccgccagaagcatacaaagcggtgctggaatccaacaccgaagagctggagcgcctggcgcgcatcgtctcagacatgctgtttctggcccaggtcagccacccggcagcacgggcgtcgttcgtcgccgtgtcgttaatggaggaagctaaccgggtgatggacctgttcgccctgagcgccgaagacaaacaactgaccctgaccctcagcggtgatgcccaggtgcacggtgatcgcctgatgatccaacgtgccttgtcgaacctgctgtccaacgcgatccgccatagccccgcgggttcgcatatttcgctgttggtagaggcctacggcaaccacgtgtcgttgtccgtcagcaacccaggcccgggaattgaagcgcaacacctgccgcacctgttcgaacgtttctaccgcgtagacagcagccgcgcccgcaccgagggcggcaccgggctgggcctggccatcgtgcggtcgatcatgaccctgcaccaggggcaggccgatgtgcgcagcctgccaggtggtttcaccttgtttcgcctggtgtttcctcaagtcgctgcctaggtacttcaaactcaaccagatccatgtggtagccgtcgagcttcagcgaggccgcgaagacggcggcacagccaatagaagtgtcgactgagccaccgctttcgcagcctcgctaaagctcgacagctcccacagttgatctccgggatttcagtaccgcgcccgcctcattcctccttgcgatgcgcccactgtgtgatgtgtgcagcctgccaggtacttcaaactcaaccagatcaatgtgggagccgtcgagcttcagcgaggccgcgaaggcggcggcacagccaatagaagtgtcgcctgaaccaccgct

SEQ ID NO: 52 - DNA, 88074 bp, Pseudomonas poae FL10F
ttgatgaaaggacaaaccgaataccaaccgaagattggttgagggttgcccctcaaccatagaatctcccacatttggaatgcactctcctgtgggagcgggcttgcccgcgattgccatcactcggtatgaggcctcactcaggaatacgcaatgtctgccctgggtaaattttattcacatctttaagcagcggcttattggcctcaaagattttgttgtactggttggcgttgccatacaccgccagcgaaatcgcactgagggtgtcgccttttttcacgactacaaaacgtgcggcagccactgctgggccagacacagtaatctggtcttctacactgccaacacccgcgatgttgcctgcagccaggatgattttctctttctcttcctgagtggcgacttcacccttcacggtgaccttgtcgccatcaacggtggcggtgatattcgggtttccaagcccgacagcgctgatgtgcttcttcaactcatcactcgcgttggcattacccggcgtcaacaggtcaatcagcttctcgcccgcttccttaacaaagctaaaaatactcatggtgcgctctccttgggatttaagttccagatgcccaagactagaccagtcctacagattcgggttccgaaccgaccaaagactcaaacgcgctagaatccctcgccattggaataagcccggagcgaagatggacatcaaacagctgaaattcctcatcgccctcgacgagacccgccacttcggccaggcggcagcgcgttgtcacatcacccagccgaccctgtcgatgcgcctgcgcaacctggaagaagagctggacttgccgctggtcaatcgcggccagcgcttcgaaggcttcaccgcgccgggcgaacgagtattggcgtgggcgcgcaccgtgctggcggcttatgacggtttgctggccgaagcggcagcctgtcgcggcaacctggtcggtacgttgcgcctgggtgtggtgccgctgtcgagcttcgatcccttggcgctgatgcaacaactgcataaagagcacccgagcctgcgattcgagctctcggcattaagctccgagcaaattcttgaacagctggcgagcaatcgcctcgacctgggcgtgtcctacctggagcgcctggacaacgagcgcttcgactcgctggccctgagcgagacgcgcatgggcctgctctacgaccaacgttttttcagcttcggcgacaaaccgttgagctgggaagcactgatcgaactgcccctgggcatgctcaccagcggcatgcactttcgccagtccatcgaccacaacttccacagccgtgggctcaacccgcagcccttgctgcaaaccgatgcggtgcatcaattgttacaagccgtgcacggcggcctgtgctgcgccgtaatgccactggacggcggccttgacgccctcaccgagcacctgcgcctgcaacccattgaagacgctcacacgctggcgcgcctggggctgatcatgcgccgcagcgcaccccgctcggcgctggcggaagcctgttttgcgttgtttcaaaaatcgcagcaagaggcttgatcgacgccatctatcggtagatcagtaatggcaattagacgcgaccctttgtcgcgcctagtctaaacactgatcaatccgccggtggtactgccccatgaacgccaagcgcccagtctgcgcggcgcccgctctcgaaacgcccgcgcccgccgccagccagagctaccagttttgcaatcttgaacacacggaagtcgccagcactgcgttggcggaagaagtggcgttggcgattgcctacaacgacatcagccaggccgtgatgctggtgacgccgacggacctcgaagacttcattgtgggtttcagtatcggcagcggcattatcgccgacgttagcgacatttatgatctgaaactcagcggttcaggctcaactcagtacgcccaggtgcagatatcgagccgcgcgttctggaacctcaagcagcaacgccgccaactggccggcaccagcggttgcgggttgtgcggtgttgaagcggtagaacaagcgctaccgaaccttgaagtgctgcccggcgcgccattgccgcccgccgaatggctcgatggcctgcgtcagcgcatcagtgctttccagcccctgggccaatacagcggcgcggtgcacgcggcggtgtttatgaacaaccagggcgaattgctgatgggccgcgaagacatcggccggcataacgctctggataaactgatcggtgcgctgattcgccaaaagattccgaccgacggcggcctggcgattgtcaccagtcgctgcagcctcgaattgatccaaaaagttctgcgcgcgggcatccagaccttggtcagcctgtcgtcgcccaccggcctggcgctgcaatgggctcgccggcacaacctcaatctcatccacctgccgcagaaaagtgcgccgcgggtctacagccctgcgatggagaaccagccatgagccagcatcatcaagccgaccaaaccccgaccccgcgctataagccctacaaaggcccggcgggcggctggggtgcattgatcagcgtggcgcaggcctggctgaccagcgacaacgcgctgaaaaacctgcgcatgatgctcaagaccaaccagaacggcggcttcgactgcccgggctgcgcttggggcgactcgccggaaagcggcatggtcaagttctgcgaaaacggcgccaaggctgtcaactgggaagccaccaaacgtcgtgtggacgcggcattttttgccaagcacagcgtcaccgcgctgctggagcaaagcgactattggctggaataccagggccgcctgaccgagccgatgcggtatgacgccgagaccgaccgctacaagcccatcagttgggaagcggcattcgatctggtcggcaagcacctcaacgcattgcctagcccggacatggccgagttctacacctcgggccgcgccagcaacgaagcggcgtacctgtatcagttgttcgtgcgcgcttacggcaccaacaacttcccggactgctcgaacatgtgccacgaagccagcggcgtagccctggcgcaaagcgtgggtgtgggcaaaggcaccgtgacctttgatgacttcgaacacgctgatgcaattttcgtgtggggccagaaccctggcaccaaccacccgcgcatgctcgaaccgctgcgtgaagcggttaagcgcggcgcccaagtggtgtgcatcaacccgctgaaagagcgtggtttggaacgcttccagcacccgcaacacccgctggaaatgctcaccaacggcgacaaaccgaccaacaccgcctacttccgcccggcgctgggtggcgacatggccatcctgcgcggcatggctaaattcctgttgctgtgggagcgccaggcccaggccgaaggcaaagaagccgtgttcgaccacgacttcctcaacgaacacacggctaatgtgctggattacctcggccagatcgacgacacctcgtgggatgaaattgtctcgcaatccggcctgaccctggtggagatcgagcaagcggcgcgcatgtacgccaaaggcaaaaacgtgatcatgtgctgggcgatgggcatcacccagcatcgccactcggtgccgaccatccaggaaatcgccaacctgatgctgctgcgcggcaacatcggccgcccaggcgccggcctgtgcccggtgcgtggccacagtaacgtgcagggcgaccgcaccatgggcatcaacgaacgcccaccggtggcgtttctcgattccctggaacgccgcttccagttccaggtgccgcgccacaatggccacaacgtggttgaagcgatccacgcgatgctcgaaggccgctccaaagtgtttatcggcctgggcggcaacttcgcccaagccacgcccgacagcccgcgcacctttgaagcattgcgcagctgcgacctcaccgtgcagatcagcaccaagctcaaccgcagccatttgatgcacggtaaagacgcgctgatcctgccgtgcctgggccgtaccgacatcgatatccaggccgacggcccgcaagccgttaccgtggaagactcgttcagcatggtgcacggctccaacggccagttgcagccgctgtcgaagctgatgaaatccgagccggccatcctggcaggcattgccgccgcgaccctgggcagcaaaccggtggattggaactggctggtggccgactacgggcgcatccgcgacctgatcgccgacaccattccaggcttcaaagacttcaacgagaagatcaaaaacccgggcggcttctacctgggcaactctgctggcgcacgccgctggaatacaccgtcgggccgcgcaaatttccgcccgaacgtgctgcccaaagacctgattcacgaacgcacccacgccacgggccgcgtgccagatttgatcatgcagtcgatgcgctcccacgatcagtacaacaccaccatttacggcctggacgaccgctaccgtggcgtgaaaggtcagcgtgatgtgctgttcgtcaacgaagccgacatcatccgcctgggcttcaagccggggcagaaggccgacatcgtatcgctgtgggaagacggtcgtgagcgccgcgtcaaaggcttcaccttgctggcatttgatattccagcggggcaggcggcggcgtattacccggaagtgaacccgttggtgccattggaaagcaccggggatggcagccatacgccgacgtcgaagtttgtggcgattcgtttggaagcggcgagcgcgaccggcttgattatggcgcgttcggcctgaccgagacccgttgtggcgagcgggcttgccccgcgttgggctgcatagcagcccctgatccaggcactgcgttctgactgaaagaatgcggtgacattcttaggggctgcttcgcagcccaacgcggggcaagcccgctcgccacaacaagccgctcgccatgactaataaaaatccaaggcacaaaaaaggccgcttttgcataaaagcggcccttccgaagtagttaaagactcacaaaaaccacttaagttccccatacaaaacagcaacttagcaaattgtatacaactcataccactggtcggttttcgattgtcagcgtatcgatacaacctcaggatcgcgccgtcatcctcttgaggtctctctatgaagttctcctcgattctcttgttgtcccttggtctggtcagtggcgcagccatggccggtggcaccaccgaagccggtgtgggcggcgcattgggcggggttttaggttcggtagtgggccagcaaatcggtggtaacaccggttcggccatcggtgcagccctgggcggcgcaggcggcagtgccgttggcgccgacaaacgcagccgtggcgaagccgctattggcggcgccctcggcgcagccggtggcaacgtggtgggccgcagcatgggcggcaacaccggcagcctgatcggcgcagccgccggcggtggcgcaggcggtgcgctgggcaactacatgggcaacaagagtgatgacgatgaccgccgttatcgcggccgggataaccgtcgctatgaccgtgatgaccatcgtggccgcgggcatgcgtatgggcatcgcaagaacaagcaccactaccgtcatcggtaaggtctagagcacactgctggaccaatgtgggagcgggcttgcccgcgatagcgtagtgtcaggaagcacatccaaccctgacccgccgttatcgcaggcaagccagctcccaccgttattttcgccgatcacaaaagttgtgttacaccaccaaccgctgcagcgcctcacgcaatctccccggaatcgtcaccggctggttcgacgcccggtccacgaacacatgcacaaagcgccccgccgcgcaggcgtcctcctcgccagacttgaacaccgccaactcatactgcaccgagctattgcccagcttgcccacccgcaggccaatttccaggcgatcaggaaacgcgatcgacgcgaagtaatcgcacgccgaactcaccacaaagcccaccacttctccgtcatgaatatccaacccaccttcttcaatcaggtaggtattcaccgccgtgtcgaagaagctgtagtaggtgacgttattcacatggccatacacatcgttgtcgtgccaacgcgtgatgatcggctggaagtgacggtaatcggcgcgcaacggcattgagtcaggcatgtgcaggtctcgtcaaagtgggtttacagatcattcaattgggcttcagcccactcacgcacctcggcgtaggggtagtcctccagcgcggcaaaacccggaatgccgcgcgctttgagcttggtaaacaacggcacgctgataccgcccagaaaccgcgccagccgttccgcaccgggcaggctcccggtgtgttcatgatgcctgtggataaaatcaccgcacagccccataaagtttttatccacaagtggcggcaggctcggcggcggcggtaagtgtgcaacctggccatggcacaccgaacaatgcccgcaacgctggggtgcctgctcatcaccaaagtacttggccagacgctgcccaaggcaatgttcggtggcgaaaaggtcgagcatggcgtgaatccgcgccacctcaccgacctcgtgctgcttgaagcctgtgtataactcggcgctcaatgcctgcgggtcaaaatcggcgttcaacacgctgtagacctcggtcatctgcttgctttccagttcgatcaagccttgttcctggaagtaatccagcgctttcaccacccggccacgctcggcattgtgttgctggtacaacgcgtcgaagtccacggtcgcccaagtcctggcgcgactgcacacctggataatggccgcaacgaactgctgccgttcaccggaaaagcgcgccagcaaggcctcgggttcaatcaggtacttgaagcggtattcagcataaaacgcgtagcgcggcgcgatcacacccttgagttccaactgcaccagcagggtcttcagcggcagttcgcggatgttgctgtggtctgacagcgacctcagcaagaactcccactgcccatcgccccgcgccgcctgcaactcagtcagcacacgcagaatgccgtcctgctcgggcgtgtcaccgtacacaaagttttccagcacattgaggctgtcgcggttggccagcaccaggcaatcggacggctgcccgtcacgcccggcgcggccaatttcctggctgtagttctcgatggatttaggcaagtcgaagtgcaccacattgcggatgtcacttttatcgatgcccataccgaatgcgatggtggcgacgatgcaattggagcgcccgcccataaagcgctgctggatgccctcgcgtttttcatggggcaaaccggcgtgataggcctcggcctggatgccgttacggttcaagtgttcggcaatctgctcggcggttttctgcagggtgacgtagacgatgctcggctggttagcgcgctcgctcatccattcgaccaggcgccgacgtttgtcgtggccgctcaccggctctaccaacaggttgagattgggccggtagaagcccgtggtgatcacatctgccggtgcaatggcgaacttcgcctgcatgtcggcaatcaccttgggcgtggcggtagccgttagcagcaaggcttgtgggatattgaactggcgctggtagtccggcagcttcaaataatccggacggaagttgtggccccactcggaaatacagtgcgcctcatccaccaccagcagcgagatctgcacgctttgcaggaagttacggaagcgctcgttcttcaaacgctccacggaaatcatcaggattttcaactcgcccgaacgcgcacgggccatgacgtcattggcgtcttcgcggctctgcgccgaatcgatactgcccgccgaaataccgtggcgctgcaggaaacccaactggtcctgcatcaacgccaacaacggcgacaccaccaatgtcaggtgcggcagcagcactgccgacagctgataacacaacgacttgcccgagccggtaggaaagatagcggcggccgaacgaccggccagcacggcgctgaccgcttcttcctggcccaaacgaaactgtggataaccaaagacctgttggagggtgttgtgcataagctgtcactccattgaccgctgaacgagcccaaaacatagaccagcacgctcagcgaatcgagaaaggtcgcaaggaaaaaagagacaggatgatacacaggctgggggatggccttgggccgaagtaggattgttcactcgattttgtgagaagaatacaaaccaaatgtgggagctggcttgcctgcgatggcggtgtatcagtcgacctaagtatcaactgaaccaccgccatcgcgggcaagcccgctcccacatttttagtgctgtgttaaaccggaatcagcggttttgcacgcgctcaatcgccgtgtcatacaccgggttggccttctgctctttcgccaactggtaatgacgcaaggcatccgagaactgccccgccgcttcgtaaatccgcgcaatgttgtagtaggcgcctgcgcgcacggtcgctgcattcgcgccggtggccagggcgatggccttacggttggcccagatcgactcggcagtgttgccggctttctgataggccaaaccgaggttgccgtaggccttaccgaagccattgtccaggtcgatggcctggcggaacaggtcaatcgcctggtcgagcttgccagcctggtaggccgcttcaccttgcaggttcagacgcttcgcatcagcctgtgcggaagagctgacagccacagccgtgaccgccacgctgtcatccagcaacggtttgacttcgttgagcacgttaggcgcgtcaaccgtcacgccactgaaattgttaatgtcctggaagtcgccgccgccggtcatgcggaacacggtccacaggttaccgctgcggtttttcggcacgtaataggtgcgcaccagggactggcccatgtacacaaacaccttggcctcgctgttggacaactgccgcgagcctggattgccgctgttggtgaagtcatgcacggcgtacacgtagctttcgccatagtgctttttctgcagggtgatggtttccgggccgtagctatcggtgtcatccacatccagctcggcgtcggtgcctttctggttgccgaagaagatgttgttgccggggaaaatcatgtgggagtcgaggtcttcaggggttttgccccacgtcagcaccacacgcaagccgtcgaggttttccatcaccgggctgatggcataagtcatgcccgcacacgggcacttcaccaccaggttggagtagccaggcttcttgatgatcaacaggttgctggcgtcatcggccgcttcgctggtgagggtcacctggccttgggcgttggtgcggcccaccacgttttgtgcgccgttacgctgcagcagcacctcggcgtcggcgattttctggtccttgaccaccgcactcaacacctcaatcggcaactgctcggcctggaccgaaaacgccatcgcacacaatgacaccgctgaggcgacacgaagcaaacccatgcttaactccctttaagtagtgggcggaatcgccctacaagattttgcggtgaaacatacgctgaattcagcgggttggcggaatttttgtgcggaatgtgacgtggtttttatcccaaccggtcagtcgggccttgcttaaccaacccacctattgccacacgcatcacctacttctaaccgctcgttgattggctggaaaccttcaccaaccactgagataaaactgcgggggctggcacccacatttgatgggtattgctcaaaaaagctctgtcaaaccgcaaaatccggaaagccctgtgagaaacccttaaatacgtcgtagtcctcttcctaaactgcttaaaacacctgctcaaccctctacataactcccctttttatgacggaaactagcgctctcacaattgcgctggcaaaaatctgtgaacatcgaaaggactcaatacatcggccattatggcgtcaccttcacggtgattcgtttcaccgtgaaaccaaacaaccggaatgagctcgccgaaaaaatcatttctggcgcagtcgcgcccccgattggagtcatttccagccaagcagaatcgatggtcgaaaatgctttcagcgatttgatcttcaacaggctccgcaactttcatagcgcagagatgaatatcggcctggaggcacaggtcagcgggggcattggcccccagcgctcgggcctctcaatgcatgtgtactcagatgacgcatagtgaatggttctacctgcagctgggcgcattttgggccgcctctatagtgtttcactacaaaatcaccgactgcaggctcagaaaacgcttcgggattgcgttcatgctaagcgggctgatcctattattttggctaccctacgtcgccatcatcctcggcattcagctacttcctctgtttctattcttgctaggcttagaacttttcatcacccgaaacaaattccgccgacaacgcaaccatccccctcacccactcctgcgtgcccccaccatgaacctcgcccccaacttccccgaagacccggtcatgcagcagcttctgcaattgctgcacgaagaaatcggcctgccgaagcacaagacccttcgtcttgaaacctcgctcaacttcgatctcggctgcgaccgcgccgaggccaagcaattcatggaagcgctggagcaggactttgccgtcgacctgggcgactacgacgcctatcgttacttccagccgccggtgttcgatgtgttcctcaaacgccgcgccaagggccggggcgacaagatcccgctgaccatcggcatgctctacctggctatcaaaacccatagctgggacacgcaaaccctggaaaacctcagctgatccccaagaacactgaggttcaaatgtgggagcgggcttgctcgcgaaggcggtgtgtcaggcagagtatttctcactgatacaccgcattcgcgagcaagcccgctcccacatgggttctgcgttaatctggccaattgctgacataacaaggaccgtacatggacgtattaatgggcctgctggccgccctgctctggggtggcacggatttcctcgtgggcctcaacgcccgcgccgtcggcgttaaacgcgcggtgtacttcggccaagcccttggctttttgatcatgacgttgctgctggtcatcttcccgatgttcctgttcaaatccctgaatgccccgttgagcgtctggctcctgggtgtcacggccgcgctgctcaccgtctccggcgctctcgcgctgtccaaggccttcgccctgggcaaagccgctatcgtcgcgccgctggtgacgtcctacggcgtcgtcaccacgctgctgtcctgggccagcggcgaacatatcagcctgactcaactcggctgcatcggcctgtgcgtcatcggcgttatcctctccagcctccacaaggacgacggagttccccacaacaacccacgcctgtccatcgcctacgccatgctcgcagcatttctctacggcaccagcttctggctgcagggccgctacaccttgcccgcgttggggccgatcaccatgttgtggctggggtacctcgtaggcctgtgcgtgctggtggtgatggtgctgaagatcaaagacggcctgaagattccgccgctgaaaaactgcgcgacgttgaccggcgcgagcctgatgaacctcggcgggttctcggcgttttcgtggggggcgatggcggggtcggtttcggtggtgacggtgatcagtacgttgtcgggtgggattgcggcgattcttgggtttgtgtttttcaaggagcgattgtcggcggtgcaggtgctgggggtggtgttggtattggttggcgccgtggttttgcacatcgccgactaacctttcgcgcataaaaaagccgcccctagaggcggctttttcataacaaccgaaccttacaacttaggcccggccgccttgatcgcatcgctcacttcaaacttcttgaagttctcgatgaacagaccggccagcgctttcgccgcttcgtcgtaggcagctttgtcagcccaggtgttacgtgggttcaacaggccagtttcaacgcccggtacggccagtggcacgtcgaggttgatggtgtcgaggtgttcggtttcagcaccgatcaacgcgccactctggattgctgcgataacgccgcgagtggtcgggatgttgaagcgtttgccgacaccgtagccgccgccggtccagccggtgttgaccaggtaaaccttggagccgaagccgcgtacgcgcttgatcagcagctctgcgtattcaccggccgggcgtgggaagaatggcgcgccgaagcaggtggagaaggtcgacttgatgccgctgccggaacccatttcagtcgagcccaccagagcggtgtagccagacaggaagtggtaggccgcttgttcttcgctgaggatggacactggcggcagtacgccggtcaggtcgcaagtcaggaagatcacagcgttaggttcgccgcccaggttcttctcggaacgcttggcaacgtgttccagcgggtacgcggcgcggctgttctgggtcagactgacgtcggtgtaatcggcgtgcttggcgtcgtcgatcaccacgttctcgagcacggtgccgtgcttgatggctttccagataaccggctcgttcttctcggagaggtcgatgcacttggcatagcaaccgccttcgatgttgaacaccacgccttcgccccagccgtgttcgtcgtcaccgatcaggtaacggctttcgtcggccgacagcgtggttttaccagtgcccgacagaccgaagaacagggtcacgtcgcctgcttcgccgatgttggcggcgcagtgcattggcagcacgtcagcagccggcagcaggaagttctgcaccgagaacatggcttttttcatttcaccggcgtagcgcatgccggcgatcaggacttttttctgtgcgaagttgaggatcacgcaaccgtcggagttggtgccgtcacgctctggcacgcactcgaaattggccacgttaagcacttgccattcatcacggccggccgggttgtactgggccgggttgatgaacaggcaacgaccgaacaggttctgccaggcagtctgggtggtcatttttacggccaggtagtggtcttcggcagcccctacgtgaacgtgggaaacgaaatgctcttgcgcgttgttgaaggcctcgacgcgagcccacagcgcatcgaacttgtcggccgggaacttgcggttgatcgggccccaggcaattgcgtcctgggtggaaggctcttcaacgatgaagcggtcgaccggcgaacgaccggtacggtgaccggtttctacgaccagcgcgccagtatcggcaagcacgccttcaccgcgctgcagggcttctttgaccagatcgtcaacactcagatcggtgtatacggcgttattggcttgcgtcatgaggttccccgtcggcctatggccgagtgctccaaacgttttgtagtagaaagttgcgcactactaccgcgaaaaaagtgggccggattatgccagaaaagcccaaaaagagtagggccctcccgtcagaactgcgctaatccggcgtttgtcaggtgatttacctgtgcttaaacgttttagtggcgggtgtcggaaggggtgtcgatgcctgcgccggcgaataattgggctacatcggccgcatcgaacaggtaacgctggttgcagaactggcagtcgatctcgatatttccaccgtgctccaccaccagattctgcgcatcttccaggcccaggctgaccagggcattcgccgagcgctcgcgcgagcagctgcaacgaaagcgcaggccctgtgcgtcgaacaggcgcacggcctcttcgtggtacaggcgatgcaggatggtttcattgtccaggcccagcagctcttccgcggtcagggtgccggccagggcggtcagtttgcgccagctgtcggtgcgctcatcgtcatccttgatgcgatcggccggcagttgctgcagcagcaggccacgggcgcgtttgccgtcggcattcagccagaacttggtgccgacctgctgggacattacgaaatagttggtgaagcagtcagacaaggtttcgccgtcgaggtcgacgatgccctggtagcgctggccttcagtcgggtcgacagtaatcgccagcacaccattggccatcaggtcggacagggtcgcgtccggcgcaatacggtcggcgtcgtaacgggccaggccacggatctcgcgctcgctggagcactcgatcatcagcatcggcaccgggccttcggaacgcgcctgcagaatcagcaaaccgtcgaacttcatggtgcccaccagcagcgaagccgccgccatcagctcaccgagcagctgcgcgaccggctccggatagggatgcttggcgaggacttcggcatagctgcgctccagcgagaccagttcgccgcgggcgtcgttctcgtcgaagatgaagcgttgggtgaagtcggtatccggtagatcagtcataggtctgggtatctgaattgatgacaaattgattacaaggtttataaaattaaacgctttagcaccatattggtgcgaatttctcctgaaaatggagagttaaatagagcgaagaggaacagtttatgaacaatccgggtttgttccaagccaagtggaacctccggcgatgggctctatgcaatctactcgctatcggcctgctgtgtttttggctgtggcccacgggccagatgctgtgtgtgattttcgacgaatggctgttccatctgcttaatgatccattggcaagcaattcggcatggctgcatgtgtgggccgtggccagcttgcggccatttgacgcggtggtcggggtgattctgctggcgctgttgattcgcggtgactgggtgttcaaggcggtgcaggtgcgccaggcattctttggctttttgggcattctgctgttgttgctgttcatccgcatgctgttttccaaactcgcggcgcagatgggctggcagcacagcagcccgtcgatggtgatcagtggagccattcatatgagtgactacttccctgggcttgagaaaacctgggaactgaaggaccgttcaagccagagcttccccggcgatcatgcttcagtcctgctgatttggggcatgttcatgacggtgtttgccaagcgcattggccaggtgctggtgatctggggtttggcgctgctgttcatgatgccgcggctggtagcgggcgcgcattgggggcaggacgattacatcggcggcgtgttgctggcgctgttggcactgggctggggttattacacgccgtttgcggcgaaggtgtccggtgcgttgttgcgagtgacggcgccgatcttcgggttgctgggcaagctgccggtgatcgggcggttgagcgtgatgcgcgccgctgcgtaacgcagtagattcctgtgggagctggcttgcctgcgatagcggtgtatcagcgaatgagagactggcagacctgacgctatcgcaggcaagccagctcccacatttgaaactccttcgtactggaaatgtgcgcaatcaatcgtcattgccgctgccgcgaaacttgaacaaatcgcggcgctgtttcttgctcggcttgccatcggtggtcatgccggtggcaccggccttgcgcatggccgctgcgttttcgcgcttggcaatgctggcttcagtctcggtgtacagcgcctgcgcctcgggtgcaccacggcgcacaacggaaagcgcctgcaccaccacggtcttttcatcaaaccctgcacgaatctgcagttcatcaccgacgcgcggttccttgcccggcttgcagcgctcgccgcgatgatgcaccttgccgctctcgatggcggccttggccaaggcacgggttttaaagaaacgcgccgcccacagccacttgtccaaacggactttttcttcctcttcctgcttttgagccacttgaattcctcgctctgaaaaatgtcgcaactttaccgttgaagcgcttcgacgcataaaccccaacgctcacctaagatacgccaggcaccaccctgttttcgcgaggatacgccgtgaccgacttccctacttcactcacctcgcccaatcagcgctgcgtgggttgccagcaaagcgaacccctgggtttcgattttgcgttcgcctatcagcctatcgtagaccttcgcgatcattcgatcttcgcccatgaagcgttggtgcgcggccctcacggcgaaggcgcgttgtcggtgctggatcaagtcaacgaaaccaaccgttaccgcttcgaccagcgctgtcgcacccaggcgattgccgaggccgcagccttggggatgcaaacccatctgtcgatcaacttcatgcccaatgccgtgtaccgaccggaactgtgcattcgaagcaccctggaggcagcccgggcgcacaactttccgctgaaccagctgattttcgagacgcttgaaagcgagcacgtagataactatcgccatttgaccaatattctgcgtgaataccgcgaattcggcttcaagaccgccatcgacgatttcggcgcgggctattcggggctgaacctgctggccgatttccaacctgacttgatcaaactcgacatggcgctgattcgcgatgtcgacaaggatcgtgtccgccaggtcatcgtccaggggattgtcacaatctgtgagcagttgggcgttactgtcattgccgaaggcatcgaaagtgccggtgagcgcgacttcctgtccgactgcggaatatttctgatgcagggttattggttcgccaagcctgcattcaaagccctggccgaggttccacctcacgcctgggcgaactgatcggttacccatattgaagacatttgaccatttgaccgttgtgggtctgcgtgagtgggtggcacttcccgatttgggagtggcaggcctgcgcgccaagatcgacaccggcgccagcacctcaagcctgcacgccaccgatatcgagccgtttgagcgcgatggtgagaagtgggtgcgctttaccgcgcacctgggcagcgtggtgcaactgcgtcaccgtcgctgcgaagcgcccttggtgacgatgaaaaccatcaagagctccaacggtcatgcgcaggtgcgctatgtgatcagcaccaccctggcattgggtgatcgggtgtggcgggtggagttcaccctcgcctgccgcaaagccatgcgttaccgcctgttgctgggctccaaggcgttgattgacggcaacttggtagtcaatccaggcgtcaaatacgttcaagacaagccggtgttcccggtctctactatttctgccccaggtgctgcatgaagattgctgtgctgtcgcgaaacccgcgtctgtattccacccgccgcctggttgaggccggcaccgaacgtggccacgaaatggtggtgatcgacacgttgcgtgcctacatgaacattgccagccacaagccgcagatccattaccggggcaagccgctggaaggcttcgatgcggtaatcccgcgtatcggcgcctcagtgacgttttacggctgcgcggtgttacgccagtttgaaatgatgggcgtatttcccctgaatgaatcggtggccatcgctcgctcgcgggacaagctgcgttcgctgcaactgctgtcgcgtcgcggcatcggcctgccggtgacgggctttgcccactcccccgacgacatccccgacctgatcgacatggtcaacggcgcgccgctggtgatcaaagtgctcgaaggcacccaaggcatcggcgtggtgctgtgtgaaaccgcaaccgcggcggaatcggtgatcgaggcgttcatgggtctcaagcagaacatcatggtgcaggaatacatcaaggaagccggcggtgcggatatccgctgcttcgtggtaggtgacaaggtgattgcggcgatgaaacgccaggccaagccgggggagttccgttccaacctgcaccgtggcggcagcgccagcctgatcaagatcaccccggaagaacgcatgaccgcgctgcgggcggccaaggtaatggggctggccgtagcgggtgtggatatcttgcgctccaaccacgggccgttggtgatggaggtgaactcatcgccagggcttgaagggattgagaccaccaccggcaaggatgtggcggggatcatcattcagcatctggagaagaatggtgggccgaatatgacgcggacgaagggtaagggctgatacacactcaacctgcccggcaacacgaaataattgtcggagctggcttgcctgcgatagcggtggcccaatcaacagcgatgttgaatgggccaccgctatcgcaggcaagccagctcccacatttgatttcagttattggttagaccgcgtctctcggcagcatcaagccaagcggcaaccgcacgcgcgcttccaggccgccctcttcgcggttgcgcagttcaacattgccgccatgcatcgaggcaatccgccgcacaatcgccaggcccaagcccgtgcccttgccaccgcgagctcgatcgccacgggtgaacgggttgaaaatcccttccagttccgccgggtcgatgcccgtgccacggtccatcacactcagcaccacatacggcgcagcactgtcgccggacacatacgccgccacttccacatcggaaccggcatggtgcaaggcattgccgatcaagttgttcaacaggcgcttcatcgacacccggcgcaacgcgaacggctggatcggctccaggcgcatacgcacctgttcgccgttctggttgtagggcgccacgacctcacgcaccaggtccgtgagatcgacttcttccacgacctcatcgcggccatcacggatgaacgccaggaactgatcgagaatcgcgtccatgtcctcgatgtcacgcaccatgtcatcggtcaggtcgttatggttgcccatcaattccagggacagccgcaaacgcgtcaacggcgtgcgcaggtcgtgagacacgcccgccagcatcagctcgcgctcgcggccagcctgttcgacatcttcggccatctggttgaaggcgccgtacacttcggtcatctcactgggcgtgtcgctgaccggcaggcgcacactgcggccctgccccagttggcgagctgcgaataccaggcgtttgagcggttggttaagctgacgcacgaaaatccacgcagacgccgttgaaagcagcccgatggcgaggaaccagcccagcacgttccagatcttctggccccgcaacgggtgcgggtacagcggcactttcagccaatcctggcccaggctcggtgcccgcacccataacgccggtgacacatgcatacgtagccgcacctcggtgtcttcacccagttcggcctgcatctggcgctggtaaatctcgctgtaaggccaatgctgctcgccttccggcacccctgcgccggccacacgcaccagggtagcggccttggcgatcttttcgcggttctcaggatcggccgcccaataggcgcgcagcgtcagggcgacaccgtggctgtactgcctgtccaccagcacgtcttcgttcatcaacagataaaccagcgtgagcgccttggaaaacagaacgacgatcagcaccagccaaagggtgcgtgagaagaaactttgcgggaaccacaacggggttttcataggagactgccagacagcttgcagaaacgagcggcgctcgcagaaatgcagacgccgggcagcccgttgacccttatggagtcaaacgccgggctgcccgcgcctgcaaatcatcgattacttggttgcagtgccatccggcacaaacacataacccacgccccacaccgtctggatataacgcggcttggacgggtccggctcgatcatgcggcgcagacgggaaatctgcacgtcgatggagcgctccagggcgtcccattcccgaccacgggccaggttcatcagcttatcgcgcgtcagcggttggcgagcgttcatcaccagagccttgagaacggcgaattcgccggtggtcagcatgtgcacttcttcgccacgcttgagctcacgggttgccagcgacagttcgtagtcgccaaaggtgacgctttcatcttcgctgcctggcgcgcccgggaccggggcagcctggcggcgcaatacggctttgacccgtgccatcagctcgtccggattgaacggcttggccaggtagtcatcagcgcccagctcgaggcccttgatgcggctcagctcatcgcccttggcggtgagcatgatgattggaatctggttgttcgcaccgcgcaggcgtttgcaggcggtgaggccgtcttcgccgggcagcatcaggtcgagcacgaccagattgaacacttcacgccccaacaggcggtccatctgctcggtgttcggcaccgcgcgggcacggtagcccttggagttgaaaaaacgctccagcaggctgctcagccccggatcgtcatcaacgatgagaattttttcgccttcagcagtttgtgcagtgctgctcattagatgctcctcttatctcggcgcgcattatggcgtagctgccgttatacgcaccgtgtgcattgttagcagatttttcctctaccgccagcgaacccttaccctgcaacctgcggcgcattccccacccgaggcggaacgctggttataatgcgccgcctttgtgcagggtaatgtcagactttactgcttactgccttattcgtttttttcagcggcgggcagcaaatttccgatttcgagggtcaataggcagcctcttgacccaggcagcggcgccagacgggccgctcaaccagcctcgcaaggccttgttttccgggcctgcgagctgctttcagaatttcaggtggttttatggacagcatcaacagccgcatcgccgaggaactcggtgtacgcccacaacaggtcgaagcggccgtcgctctactggatgagggctccacggtgcctttcatcgcccgttaccgtaaagaagtgaccggcagcctcgacgacacccagttgcgtcacctggaagagcgcctgcgctacctgcgagaactcgacgaacggcgtatcagcatcctcgccagcatcgaggaacaaggcaagctgaccccgcaactggaacgcgacatcaagctcgccgacaccaaaacgcgcctcgaagacctttacctgccgtacaaacagaagcgccgcaccaagggccagatcgccctggaagccggcctgggcgatctggccgacggcctgttcaacgacccgtcgctgaccccggaaaccgaagccgcgcgcttcatcgacgcagagaaaggcgtcgccgacgtcaaggctgccctcgaaggcgccaagtacatcctgatggagcgcttcgccgagaacgccggcctgctggaaaaactgcgcacctacctcaagcaggaagccaccctcagcgcccgcgtcatcgccggcaaagaggaagaaggcgccaagttccgcgactatttcgaacacgacgaaccgctcaagagcatgccgtcccaccgtgcgctggcgattttccgcggccgcaacgaaggcattctcagctccgcactgaaagttggtgacgagctgccgggcaccatgcacccgtgcgaaggcatgatcggtcaacaattcggcatccagaatcagaaccgtcctgcggacaaatggctcggtgaagtcgtgcgctggacctggaaggtcaagctctacacccacctcgaaaccgacctgctcggcgaactgcgcgacggcgccgaaaccgaggcgatcaacgttttcgcccacaacctgcatgacctgctgttggccgccccggccggcccgcgcgcaaccctgggcctcgaccctggcctgcgcaccggctgcaaggtcgcggtggtcgactccaccggcaaattgctcgaccacgccaccgtgtacccacacgtgccgcacaacaagtgggatcagaccctggccatcctggctgccctgtgcgccaagcactcggtggacctgatcgccatcggcaacggcaccgccagccgtgaaaccgacaagttggccgccgagctgatcaaaaaatacccagccatgaagatgaccaaggtgatggtctccgaggccggcgcgtcggtgtactccgcctcggaactggcttccaaggaattcccggacctcgacgtgtcgatccgtggcgccgtctccattgcccgtcgcctgcaggatccgctggccgagctggtgaagatcgaccctaaatccatcggcgtcggccagtaccagcacgacgtgtcgcagctgaaactggcgcgcggcctggacgcggtggtggaagactgcgtgaacaaggtcggcgtggacgttaacaccgcctcggtggcactgctggcccgtatctccggcctgaacaccacactggcgcagaacatcgtcactcaccgtgacgaaaacggcgcgttcaaaacccgcgcggcgctgaaaaaagtcgctcgtctgggtgaaaaaacctttgaacaggccgccggcttcctgcgtgtgatgaacggcgacaacccgctggacgcctcggcggttcacccggaagcctacccactggtgcaacgcattgccgccgagaccgaccgcgatatccgctcgctgatcggcgacgccgcgttcctcaagcgcctggaccctaagaagtacaccgacgaaaccttcggtgtgccgaccatcaccgacatcctgcaagagctggaaaaacctggccgcgacccgcgtcccgagttcaagaccgccgagttccaggacggcgtcgaagacctcaaggacctgcagctgggcatgatcctcgaaggcgtggtcaccaacgtgaccaacttcggcgcctttgtggacatcggcgtgcatcaggacggtttggtgcatatctctgcgctttcggagaagttcatcaaagacccacgcgaagcggtgaaagccggtgatgtggtcaaggtcaaggtgatggaagtcgatatcccgcgcaaacgcgttggcctgtcgatgcgcatgagcgacacccccggcgagaaaatcgacggtgtccgtggcgcacgcccaggttcggcgccgcgtcagtcgcaaaacaacgcgccacgcaaagaaaccgccaccgcagcgccgagcaacaacgccatggcgtcgctgttcgccaatgccaaacagttgaagaaacgttgatggaaatcccggccggtttgacccagagcgcgttcagcgaactgatcggctgccgcctgcaacgtcttgaagaaggcgttgccgaggtggccctgaccctggagccgcacttgcgcaaccgcgcgggcaagctccacggcggggcgattttcagcctggtggacatcaccatggggctggcctgttccagcgcccatggtttcgaccagcagagcgcgactattgagtgcaaaatcaactatatccgcgccgtgtcggatggcgatgtgttgtgcaccagccgcgtgattcacgctggccgacgtacgttggtggtggaggcagacgtgtttcaggacgaaaaactggtcgcaaaagcacaaggcaccttcgctgtcctatagctccccgccctcgatttgagttaatttcggcgctgcgacaacagcgtcggaattttcttgctgcgctatagcccaattcatggagtgaagtaggcttttccaaagcgggtcaaatcgactcaaaaccaggcgataacgccagtttcaacttcacccttgtagaccgtcctgcccacccccatattggggcgactgacgcgtgaaggaatccaacttgagcgaacttctcaaccgccgcctggccttgctcggcaagcgcgaacacctctccctgctagagcagtgcttgcacggcatcgagcgcgaatgcctacgcgtcaccggtgagggtcgcctggcacaaacgccgcaccccgaagccctgggcgccgcgctgaccaacgaattgatcaccaccgactactcggaatcgctgctggagttcatcactcccgccctgcccaacccggccgataccctgagcagcctggacaagatccatcgctttgcctacagcaagctcggcaacgagtacctgtggagcccttcgatgccgtgcccgttgccggccgaagaagatattccgattgcctactacggcacctccaatatcggccagctcaagtacgtgtaccgcaagggcctggccctgcgctacggcaagaccatgcagtgcattgccggcatccactacaatttttcgctgccagaagcgttgtggccgctgctcaaggagactgaaggttttgtcggcaccgatcgcgactaccagtccacagcctatatcgcgctgatccgtaacttccgccgctacagctggcttttgatgtacctgttcggtgcctcaccagccctggacgccggcttcctgcgcggtcgttcgcaccagttggaagtgctcgacgccgacacgctgtacctgccgtacgccaccagcctgcgcatgagcgacctcggttaccagagcaacgcccaggccggcctgacgccgtgctacaacgatttgagcagctacaccgatagcctgcgcgaagcggtggcaacgccctacgcgccatacgtcgaagtcggcacgcacaaggacggtgagtgggttcagctcaacaccaacatcctgcagatcgaaaacgagtactactccaacatccgccccaagcgtgtgacttataccggcgagcggccgatccaggcgctgatggcgcgtggcatccagtacatcgaagtgcgttgcctggacatcaacccgttcctgccgatgggcatcgacctgccggagtcgcgtttcctcgatgcgttcctgctgtattgcgcgctgaacgacagcccgctgttcgcaaacaacgaatgcggcaacgccacctccaacttcctcagcgtggtcaaggaaggccgtcgcccaggcctgcaattgcagcgtcagggccagcctgtggacatgaaggaatgggccaccgagttgctggagcagattgcgccgttggcggcgttgctggatgagagccacggcatcaccgagcacagccaggcgctggacgcccaactggcgaaggtcaaggatccgtccctgacgccgtcggcccaggtgttggcggcaatggccgagcgcaaggagagttttgcgcagttctccctgcaccagagcgaggtgcatgccgagtacttccgtaaagagccgttggcggctgaagagcaggcgcgttttgaaacgttggcgcgcacttcgctggcgcagcaggcggagctggaacagaacgaagtcggcgattttgatgtgtttgtcgggtcgtatcaggcgagcattctggcgatcagcaactaagcaccaccccgccttctgtggtgcctggtttgtgtgggagctggcttgcctgcgatgcaaacacctcggtgtatcagtgatacccaggtgatgctatcgcaggcaagccagctcccacatttaccctctttgattcgaacatctgcgttcactcttcttctaataagctaattcgaaaatgttatttattttcggattcttagatcatttagtctcatcacacgccgaccctcggccgcctgattgaggagcttccccttgaaactgttaacccctctgcgcctcttggccgcattgtccctggccggtgccagcctgtttgcccaggcggcggatgtaactatcgcttaccaaaccaccgtggacccggcgaaagttgcccaggccgacggcgcgtacgaaaaagccacccacgccaaaatcgactggcgcaaattcgacaatggcgccgacatcatcgccgccatcgcctccggtgatgtgcagatcggctacctcggttccagcccactgaccgccgccgtgacccgcaaagttccggtggaaaccttccttgtcgccacccagatcggcggcgccgaagccctggtggcgcgcaacggttcggggatcaacagcccgcaggacctgatcggcaaaaagatcgccgtgccgttcgtatccaccggccactacagcctgttggccgcgctgaagcactggaacatcgacccgtcgaaagtgaccatcctcaacctcgcgccgccggccatcatcgccgcctggaaacgcggtgatatcgacgccacctacgtatgggacccagctctgggcgtggccaaggaaaacggcaaggtgctgatcacctccggcgagctggccaagttcggcgcgccgaccttcgacgcctggatcgtgcgcaaagacttcgccgagaaacacccggaaatcgtcaccgccttcgccaaggtcacgctggatgcctacgccgcgtaccgcaaagacccacaagcctggctcgccgacaaaggcaacgtcgacaaactggtgaaactctccggcgccaaggccagtgacatcccattgctgctgcaaggcaacgtctacccgctggccgctgaccaagtgaccctgctgggcgcaccgaccaccaaggccgttaccgacaccgccgcgttcctcaaggaacaaggcaaggtcgacgccgtgctgccggactacgccccttacgtcagcgccaagttcatcactaactgattcaggagttcattgcgatggccttgctacaactggagcgcatcagcgcacagtacccaggcgccacagaaccggtactgtctgacatttcactcgaccttgggccccagcaattgctggtggccctcggcccgtccggcagtggcaagacctcgctgttgaacctgattgccggtttcgtcgagccttctgccgggcacatcaccctcgatggcgtgccggtcaaaggccccagcgccgagcgtggcgtggtgttccaggacgacgccctgttgccctggcaggacgtgctcgccaacgttggcttcggcctggagctggctggcgtgcccaaggcccaacgagaagtgcgcgccaaggaaatgctcgccctggtcgacctggcgggttttgacaatcgccgcatctggcaactgtccggtggacagaaacaacgtgtgggcctggcccgcgccctggcagccgacccgcgtgtattgctgatggacgaacccttcggcgccctcgatgccttcacccgcgaacagatgcaggagctgctgctgcaagtctggcggcgcacagccaagccggtgttcctgattacccacgacattgaagaggcggtgttcctcgccaccgatttgatcctgctggcgcccaacccgggccaaatcgtcgagcgtctgcacctggacttcggccagcgctacgccgccggtgagtcggcccgcgcgatcaagtccgacccgcgctttatcgaaacccgcgaacacgtgctgggcaaagtgttctcgcaacggcaggtgtccgcatgagcagctacgaactccccgtcaccgccgccaagccggtgacccatgcagtgattccggtacgccgaagcttgagcacgcgctggatcagcgtgctcacgttggtcgccttgctcgccatctggtgggcggtgaccgccacgggcttgatcgaaccgttgttcctgccgccaccatccgccgtgctgcaaaaaggctggctgctggcgaccacgggctacatggattccaccttgtggcagcacttgggcgcgagcctgcaacgcattggtctgggcctgggctttgcggtgctgacggccgtgccggtgggcattgccatcggtgccaaccgcatcgcacgcggcattctcgacccgctgattgagttttaccggccgattccaccactggcctatctgccgctgatcgtgatctggtgcggcatcggtgagctgtccaaggtactgctgatttacctggcgatcttcgcacccattgccatcgccaccgcgaccggcgtgcgcaccgtcgacccggccaaattgcgtgctgcgcagtcgttgggcgccacccgtgcccagctgattcgccatgtaatcctgccgagcgccctgcccgatattctgaccggcgtgcgcatcggcctcggtgtgggctggtcgacactggtcgcggccgagttgatcgcggccaccagcggcttgggtttcatggtgcagtcggcggcacagttcctcgtcaccgacgttgtagtgctggggattttggtgatcgccctgatcgccttcgccatggaaatgggcctgcgcgccctgcagcgcaaattagtgccttggcatggccaggcacactgagtgagaacagcatgagcagcctgaccgttaccccgataagcaccgccctgggcgccctgatcagcggtgtcgatatcacccggccgctgaaccccgaagaacgtgacgccatcgagcacgcgctgctcgagcactcggtgctgttcttcagaggccaagccatcaccccgcagcaacaggcgcgcttcgcggcgaactttggtgacctgcacattcacccgatttaccccaacgtaccggaacagcctgaagtgctgatcctcgacaccgccgtgaccgacgtgcgcgacaacgcggtctggcacaccgacgtgaccttcctgcccaccccagccctcggcgcggtgctcagtgccaagctgctgccggcgtttggtggcgacacgttatgggccagtggcattgcggcgtacgaggcgctatcggagccgctcaagcgcctgcttgatggtttgacggcgactcacgacttcaccaaatccttcccgctggagcgctttggcaacactgccgaagacctggcgcgttgggaagaaacccgcaagaaaaacccgccgctgtcgcacccggtggtgcgcacgcatccggtgagcgggcgcaaatcgctgtttgtcagtgatgggtttacgacgaaaatcaatgagctggaaccggccgaaagtgaagccatcctcaagctgttgtttgctcacgcgacacggccggaattcaccatccgctggcgctggcaggagcatgacgtagcgttctgggataaccgcgtgacgcagcattacgcggtggatgactaccgaccgcaacgccgcgtgatgcatcgcgccacgatcctgggcgacgtgcctttttagggccaggccactaacaaatgtgggagctggcttgcctgcgatagcggtaaaccagccactacttcaccaactgacccaccgccatcgcgggcaagcccggctcccacattgaccgagtagatcgttcccacgctctgcgtgggaatgcagcccaggacgctctgcgtctgcttctagagccgtgacgcggagcgtcacaggaggcattcccacgcagagcgtgggaacgaacgggtgggttactcagcggtagatggcttttcccacaagttaatcccaccttcctgcgcaaaccgatcaatctccgccagttcttcggcactgaagctcaggttcttcaacgcgccgacgttctcgatgatttgctccggccggctcgcgccgatgagtgcactggtcacccgtgggtcacgcagggtccaggccagcgccagttgcgccaggctctggccgcgacgcttggcgatttcattcagcgcgcgcacatgggcgatgttggcgtcggacaggtgcttggcttgcagcgaaccaccccctgggcgattgacccgtgcatcggccggtacgccgttgaggtacttgtcggtcagcaaaccctgggccagcggcgtgaatgcaatcaccccggcaccgagttcttcggtggtgtccagcaggtctttttccacccagcggttgagcaggttgtaagccggttggtggatcagcagcggcactttccactcttgaagcagcgccgccatctcacgggttttcacgccggaatacgacgagataccgatgtacaacgccttgccctgttgcacagcggtggcaagggcgctggcggtttcttccagcggggtgtcggcgtcgaaacggtgggaatagaaaatatccacatagtcgacgcccaggcgttgcaggctctggtccaggctcgccaatacgtatttgcgcgaaccgccgccctggccgtacgggccgggccacatgtcccagccggctttgctggagatgatcaattcatcgcgatagtgcttgaagtcttcgcgcagcaaacggccgaagttgatctcggcgctgccgtagggcgggccgtagttgttggccaggtcgaagtggttgatccccaggtcgaacgcggtgcgcagcaaggcgcgctgggtgtcgatcggagtgctgtcgccaaagttgtgccacagccccagggacagtgcaggcagcaccaatccactgcggcctacgcggcgataagggatagattcatagcggttttcggcagcaatgtacgtcatcgaatcctctctgggcttagggcaaataaggcctgggaataaggttattcccaggccttttaaccagctgaatcgcttaactatgcccttctcttttacagcaattccctaccaaagtggaacgacgtagctcacatagaagcggttttcatcttgcacggtggcaccggtaatgtccgggctggcgtgggcatttttccaggtcacgcccaggcctttgagggtgccggtgggcacttgataggccacggcaatgttgcgttcccattcgctggtggtgccttgcgccgtgcggatgtcatcgccgtgtgcgtaggccgcagagaacgtcaggccggtgaggccgagcttgccgaaatcatatttgtactgcgccagccaggtgcgttcgccggcatgctggaatttgttcaactgcatgttggtcagcgccggggtgtcggcgcccgagcctgggccctggtgcgcgtcgccgctgttcaggccggaatccaggtacgggaagtcgctgtcgccgctgtttttctggataccgaggcccacggtatgaccgtccaggctgtagctctcaagcaaactggcggtggtctggttgatgcgccctttgctggtgccgtcaccgtagaggccggcgctggcaaagtccttgtcaccatcggcgttggcgccgacacccaggctgcggaacacgcgcacgtcagtgtcgaatgcacccacagccacggcgtcatgacgcttggcgccgaggaaaaactgctggtagtaatcctcaaggttggaataccacaggctcacggtggtgttctggatgccggtgtagtccgcaccgccgaacaggaagcgatcgctctctttggtgccgccggcggtgatcatgccctggtcgccggtttcgttgcggatcttggtcttgaagatatcgccgccggtgaaggtgaagtcggtgaggtccttggacaccagttgcacaccggtattggtctgctggtacaggcggccgtcggtgttggccaataccgggttgttgccgtaaagcgtaccgacgcgcaactcatccttggcgaaacgcatcttgaatgtggggctgagtacaccgaactggtcggcggatttgccgtcgtccagcgggaacatgctgccggggtagcggccctggtggtccttgtcgttaaggtcgccaccggagtcgagtttcaagccgtagaacgcctgcagatcgaggccgaaaccgaccggcccctcggtgtagccggacttgaagttaaactcgaaaccctggccccaatcacgcacgctgtgggccttggcattgctgttgaccacatcacgcccctgctggttgaggtagcgattgagcagggtcacatcggcgtggctgtcatcgataaaatcggcgtgggcggacagcataaagctcgccatggcggcacccaccatggggcttattaacgtcttcattgttaccggtctccgtcactgttctgaaatgaaagcgtcaaacgcttcacacaattacgcagtggccagatgacagttcggagtcaaaccgcggcttaaacgaatgaaattaaatttaaaaaaagccccgtagaacggggctttgcgggcttttttgtgggagctggcttgcccgcgatgcaggcaactcggtgtctctcaaacaccgagcatgatcgttcccacgctctgcgcgggaacgcatcccgtgacgctccgcgtcacccgcgcgcagggcttgaaccttgcgccaacagaggggcgcggagcgcctcgggcggcattcccacgcggagcgtaggaacgatcatttaaaaaagccccgtagaacggggctttgcgggcttttttgtgggagctggcttgcccgcgatgcaggcaactcggtgtctctcaaacaccgagcatgatcgttcccacgctctgcgtgggaacgcatcccgtgacgctccgcgtcacccgcgcgcagggcttgaaccttgcgcctcgggcggcattcccacgcggggcgtaggaacgatcatttaagagcgaactagcgcaccaggtgcaggaactgcaggtgccgctcgtactggtcaaggatgtcgttgatgatctgctccttggtgtagcccaccaggtcgtagtcctggctgccctcgctcaaatgcacttccgcccgatagtagcggcggttgttgagctgcttggagcccatgccaccgcgcgcaaaggacggcgtgaagtaaccgcgcatctgcacctggtaaacgaacggatgctcttcaccgtggccgatttccaggctgacgctgtcgttggacgggtccggctgagtgacgacgctgaggcctttttcgacaaacaccgccgtcacttcttcaatggccgggcgcaccgtggtctcaaggaaccggtacacctcatcgcgcgacgggaaatgcactgcctggctcaaacgctggcgccaaccgccggtgcccttgcgtgagcccgacaccggtgccagcgaatgcaactgcgcgatctgcttttgcgactcgaggtagaaggctttgtgcagcccccacatcatcagcagcaaaatcagcgagaacggcaacgacgtcagcaccaccgcggatttcagcgagtcgatactgccggcaaacagcaacgcactggtgaccagcgcggtcatcgcgccccagaacacccgcagccacttcggcccgtcttcatcggcattgccgcctttggacgacaaggtcgacagcaccacggtgccggaatctgccgaggtgacgaagaacacgaagctgataaacaccgtgaccgcgatgacggtcttgctccacgggtaggtttccagcagcaggtacagactcatcgacgggtcgtcgatggccgactggccgagggcggtcaaaccgtggttgagcacttggtcgatagcgctgttgccgaagatcgacatccacgccagggtgaagcccagtgggatcagcagcacgccaaacacgaattcgcggatggtacggccgcgggaaatccgcgcgataaacagacctacaaagggcgaccatgcgatccaccaggcccaatagaacactgtccaaccgcccagccagtcgctgggtttgtcgtaggcgtacacatcgaagctcttggtcggcaaggcgcccaggtaatcaccgatgttctggatcagggtgttgagcaagtgctgggtgggacctgcgaacaacacaaacaggagcagcgcgcaggccaacagcatgttgatgtcggacatcacccgcacgcccttgtcgacaccggcgacggcgacgaggatcgcggcgcccatcattagcgtgatcaggccaacctggatccactgggtgtgggcaatgccgaacaggtaatccaacccggagttgaggtgcaacacgccaaagcccatgtcggcgccgaggccaaacactgtggcgatgatgccgaagccatccactgcgtagccaatggggccgttgatgcgtttgccgatcagcgggtacagcgccgaacgcagcgccagcggcaggttatgccggtaggcgaaatacgccagggccatgccgacaaaggcaaacacgccccagccgtgcaggccccagtgcagaaacaggatctgcatggcctggcgcgcggcatcggcgttcatcggcgcgccctggggcggttgcaccaggtgcgtcagcggctcggacacgcaaaagaagaacagcgtgatgctgatcccggcggcgaacaacatgccggcccaggacaggtaactgaactcgggctcgtcgtggtcggcaccgagttttatcttgccgtagcccgatagcgcggtgaccaccacgaagaccaggtacagcgtcatcgcgagcatgtagtaccagccgaccgtgttggccgcccagttttgcgcggccagcagccaggcaccggcctgttgcggaatcgcgatgacagtgatgccaaagagcaggatgaagctggcggcaaagtagaaaacgggcgcattcatgcgcaccaagccgctggatggggtggacgatgcactcatgaacgatgcaccccgaaggtgtgggatgtggctgtaaataacggactcagcaaaggtaagcctcctgttgtgagcgggcagcgaaccaccggtttaacttgaacgaacattcaagttaaacatggataggcggtctgggactaatcgcagggctgagtggtagacaattcctacactagctcaaggattggtatgacgggtgcgcgaggcaaaacgttcagcgatttccgagtgaaaacctaccccaatatgaaatgcggtccactgtgggagctggcttgcctgcgatagcggtgggtcagcaacacatttgttgactgatactccgccatcgcaggcaagccagctcccacagttgattggtggttggctcaacgactacttctgcgccccatcctcatgctgcagattcgcctgggtaatattcgcccccgccggcacgctgcgggtcagccacacattgccgccaatcgtcgaacctttgccgatggtgatccgccccagaatcgtcgccccggcgtagatcaccacatcgtcttccacaatcggatggcgcggatggcccttctgcaactgcccatcttcatccgccgggaagcgcttggcgcccaaagttacggcctgatagatacgcacccgttcgccaatgatcgcggtttcgccaatcaccacgcccgtgccgtggtcgataaagaaactcgggccgatctgcgcgccagggtgaatgtcgatgccggtggccgagtgcgcaatttccgcgctgatccgcgccagcaatggcaacccggcgcgatacaggtggtgcgccaggcgatggtgaatcaccgccagaatccccggatagcacagcagcacctcatccacactgcgcgcggcggggtcgccgtggtaggcggccagcacatcggtgtccagcaggctgcgcagggaaggcaaggccagggcgaagtcctggatcaggcggatggccagggcgtcgacctcgcggtcatcctggccgccctggcgtgcggcgtaacgcagctccaggcgcgcttggccgagcaaggcattcaacgcgacgtcgagggtgtggccgacgtagaaatcttcactttcctcacgcaagtccaccggccccaggcgcatcggaaacaacgcgccgcacagcgactcgagaatctgcgccaccgcctcgcgcgacggcaactcacgcccgccgtgctcgccactcaagcggccattgcgcgtgcgccactggtctcgggcgctgcgcagttggctgacgatggtttgcaactgccaatggctggaacgctcactcacggtattcactcctgacgtaatggccatcactttacggtatgcaccctggccgcccttaagaaccaatggtgtgatgtacagaaccatacggaataagcgattggcggttgcccgatgaaaagtgcctgcctatagtcgcccaatcacttagccaccgtgcctcgccatgatcaaacaacagctcgaccgttttaaccgcctggaactgctgggcggcgccaccgccctggaaaaactcgagcggctgtcggcctggctgggcagggatatctacgtcaagcgcgatgacaccacgccgctggccatgggcggcaacaagctgcgcaaactcgaatacctggcggccgacgccatcgcccaaggcgccgacaccctggtcaccgctggcgctatccagtccaaccacgtgcgccagaccgctgcgctggccgccaagctgggcttgggctgtgtggcgctgctggaaaaccccacgggcaccgaagaccctaactatctgggcaacggcaaccgcctgctgctggagctgttcgacgccaaagtggaattggtcgagaacctcgacaacgtcgacgcgcaactcaacgccctcgccgaccgcctgcgcagcaacggcaaaaagccgtacctggtgcctatcggcggctcgaatgcactgggcgcgctgggttacgtgcgcgccgggctggagctggccgggcagattaaagacagcggtatcgaatttgccgccgtggttttggcctcaggcagcgcgggcacccacagcggtctcgcattggcgttgagtgaggtgctgccgaatttgccggtgatcggcgttaccgtgtcgcgtaccgatgaagcccaacgaccgaaagtgcagggcctggccgaacgcaccgccgagttgctcggtgtggacattcccgaagcgttcaacgtgattttatgggacggatatttcggcccgcgctacggcgaaccgaacgcaggcaccctcgctgcggtcaagctattggcgagccaggaaggcctgctgctggacccggtctacacgggcaaagccatggccggcttgctggatggcctcgggcgtcagcggtttgaggacgggccgatcattttcctgcacaccggcggagcgccggcgttgtttgcctatgactcggtcctaacggactgaacacggatcacatgtgggagctggcttgcctgcgatagcggtctgtcagcaaccaatatgctgactgacacaccgctatcgcaggcaagccagctcccacagtagatcaacgatatattctaaaatcgaataacaaattaattttatattattttcaagtcttaaaaactggctttatagtcgcgccgaaggcgaagacgcgcttcgcgctttaaggcaggatacgactactgcgtcacctgcttcgctcaacataaaaacacaggggctgttcatgactatttctgtattccgccgcacgttgttggttggcacattgggcctggcactcggggctggctggttgggccaggcggttgctggcgagcagttggataacatcaagaaagccggcgttatcaacgtcggcctcgaaggcacctacccgccgttcagctttgtcggtgaagatgggaagctcgcaggctttgaagtcgaattttccgaagccctggcgaaagaactgggcgtcaaggtcaatctgcaggccaccaagtgggacggcattctcgcggcactggaatccaagcgtctggacgcagtgatcaaccaggtcaccatctccgaggagcgcaagaagaagtatgacttctctgagccctacaccgtttccgggattcaggcgctggttctgaagaagaacgaagacaaactcaatatcaaatccgccgccgacttggccggtaaaaaggtgggtgtgggcctgggcaccaactacgaagaatgggtaaaagccaatgtaaaaggtgctgatgtgcgcacctacgaggatgaccccaccaagttccaggacctgcgcatcggccgtatcgatgccatcctgatcgaccgcctggctgctctggaatacgccaagaaagccccggacaccgccgctgcaggggacgcgttttcccgtcaggaagctggagtagccttgcgtaaaggcgagcctgaactgctggctgcggtcaacaaggccatcgacaaactgcgcgcagacggcacgttgaaaaagctgtccgagaagtacttcaacgctgacgtcacccaataatggaagcaaagtttcaattgatcctgaattccacgcccttcttgatgcagggcgtgtacttcaccgtcatcttgagtttgggggggatgtttttcggctttctgctgggtttcggcctggccttgatgcgcttgtcacgtttcaagctgctgagctggatcgcccgagtctacgtatcgttctttcgtggtacgccgttgctggtgcaactgttcatgatgtattacggcttgccacaagtcggtatcgagctggatccgattcccgccgcactgatcggcctctcgctgaacatggccgcgtacatctgtgaaaccttgcgcgccgccatcagttcaatcgagcgtggccagtgggaagctgctgccagtatcggcatgacgcgtgtgcagacactgcgtcgggcgattctgccgcaggcaatgcgtacggcgttgccaccgctgggcaacagcttcacgtcactggtcaaggacacctcgctggcagcaaccatccaagtacccgagctactgcgtcaggcgcagttggtttccgcgcgaaccttcgaaattttcgccatgtacctctcggccgctctgatctactgggttctggtcagcatccttgctcatgtgcaaaacattcttgaagaccgggtcaaccggcatgacctggagtcttgaagcatgatcgtggttgaaaaactgaccaaacaattcaagggtcaggtggtgctcaacggcatcgaccttgaggtcaaggaaggcgaagtcgtcgccatcattggccccagtggttcgggtaaaaccaccttcctgcgctgcctgaatttcctcgaagaacccaccagcggccgcatcaaggtgggtgacatcgagatcgacagcagcaagccgctcaaccagcaacaaggcctggtgcggcgcttgcgccagcacgtgggttttgtgttccagaacttcaacctgttcccccaccgcaccgcgctggaaaacgtcatcgaaggcccgatcgtggtcaagaagatgccacgcgaagcggcaaccgagctgggccgcaagttgctggccagggtgggtctggcgggcaaggaagcagcctacccgcggcgtttgtccggcggccagcagcagcgtgtggcgattgcccgtgcattggccatggagccggaggtgattctgttcgacgaacccacctcggccctcgacccggaactggtcggtgaagtactggcgaccatccgcagcctggccgaagagaaccgcaccatggtcatcgtcacccacgaaatgagctttgcccgcgatgtcgccaatcgggtgatcttcttcgacaagggcgtgatcgtggaacaaggcgaagccaaggcgctgttcgccaacccgaaggaagaacgcaccaagcagttcctgagcaaattcctcgcccactgacaccccggaaaacctgtgtgggagctggctcgcctgcgctgcaggcacctcggtgtgtcagccacaccacagcgatgctatcgcaggcaagccagctcccacacaagcgcgttcctacatgaaatcctcgcgctaacgcataaaacgcaccgccgcccccaccttaaaatcccctgcctcgtcagctctttctgaatctgctccagcccgccgtttagccttctgccgccattgacgccccccgagcaaccctcttatctagcacccagaggattggatcctatcccggctattcactgaatcgttcctttcggcacctgtgcgcaaacgcgtaccggcgccggaacgattgctgctggctgcatcaaggagattacttatgacgcgcactgcaaccctggccatgctcaccgccccaaccctgccccaggcccatcgacacggcatcaacgccctcgccgccacccaattgcaggtggatatcgccccgtaccccggcatggaggaaggcgacctgatcgagctgttctggaacaactgctttgccgactcccggcgcgtaacggcgtgcaaaatcggcacagccactcacctgcgagtaccggaaagctttgtgctggacggccccgcgcaggttcactaccaagtcatgcagatcggccacggcccagcacgctcggccttgacgcgggtgcaggtgaaaaccaattatccgggtggccaaccggtgttcccgcccaaccacgaaaacaacgacgaaaaccagaacctcgcccccgtcgacctgcctgaaaccatccgccgccacggcgtcaacggccgccaggtattgcgcggtattccgttgagcatcgaaccctacctgaacatggccagcggtgacgcgatcacgttgcgttggggtgacgtgcgcctggacctgccgaaaatagaggcgcaagacgtcggcctggcggtgcacgtgtgggtgccttcgacggtcattatcgaggccggcgacgacagccgcctggacgtgacgtactgcattctcgaccgcgtcggcaataattcgcgctgggcaccggcgcgcaccctgaacatttccgcctgttcgccacagaccccgccccgcccggccagggccgcatcggcctaccaaccgcgccaacccggttcgccttgcgaaccagggtgacggcccttctatgcatattcctagaagttagtttatttaaagatttaacacgcttagggtatatgcaccggaccaccggacatctctgatttttctgtttttatttcattgaatgcgaggtcggtatggtcagaattaccccggtgcataacgccagggcattacgtgcagccaaggagcggcgctgatgtctaacttggctctaacacccccccagagtgatctggatgtagccccactgctgttgccggccgctgtgctgcgcgacgacgcccaagcgttgagcgcagcccgcgaactggcccaggccgcgcgcctgcaggccgccaagcgcgaccagcagcgcaagctgccatgggcgcagatcgaacagttcacccgcagcgggctcggcagtatttccattcccagtgaatacggcggcccacaggtttcattcgtgaccctggccgaggtgttcgcgatcatcagtgcggcagacccggcccttgggcagatcccgcagaaccacttcggcatcctgcacgtgctgcagggcgccgccaccgagcgccagaaaaagcagctgttccagagcgtcctcgacggctggcgcatcggcaatggcggcccggaacgcggcaccaaaaacacgctggagctcaaggcgcgcatcaccgccgagggcgacggctatgtcatcagcggccagaagttctactccaccggcgcgctgtttgcccattgggtggcggtgaaggcactgaacgatgacggcaaacaagtcatggcgtttgtgcgccgtggcaccgaagggctgcgcatcgtcgacgattggtcgggctttggccaacgcaccacggccagcggcacggtgctgctcgaccgcgtgccggtggacgccgagctggtggtcgacaactggcgcatcggcgaaagcccgaacatccagggcgctgtctcgcaattgatccaggctgccatcgacgccggcatcgcccgtggcgccctggacgacaccctcgccttcgtgcgcgaacgctcacgaccgtggatcgacgccaaggtcgaacgcgccagtgatgacctgtatgtgatcgccgatatcggcaagctgaaaatcgagctgcatgccgccgaagcgctgctgcgcaaggccggcaaggtgctggacgaggtcagcgccgcgccgatcactgcgcaatccgccgcccgcgcctcgattgccgtggccgaagcgaaagtgctgaccaccgaagtgtcgctgctggtcagcgaaaagctcttcgaactggccggcagccgcgccactctcgccgaattcaacctcgaccgccattggcgcaacgcccgcgtgcacaccctgcacgacccggtgcgctggaagtatcacgccatcggcgcctatcggctgaacggcacgttgccggctcgccattcctggatctgaccgaccagacatctggagaacatcatgactttctctaccaacgtcgcggttatcaccagcgatgaacaagcccttattgtcgccagcgacctggccgaagacttccgccgcgacagtgcccagcgcgaccgcgaacgccgcctgcccctgcccgagctcgacgtgttttcgcgctccggcctgtggggcatcagcgtgccgaaggaacacggcggcgccggggtctccaacgtcaccctggccaaggtcattgccctgatcgcccaggccgacgcctcgctgggccagatcccgcaaaaccatttttatgccctggaagtgctgcgcgtgaatggcagcccggcgcagcaacaacgcctgtacgccgaagtgctcgccggccagcgcttcggcaacgccctggcggagctgggcaccaaaaccgctcacgaccgcgtgaccgccatcacccgcgatggcgatggctttcggatcagcggccgcaagttctattccaccggcgccatctacgctcaacgcattccgacctcggtggtggatgaacacggcgtgcagcaactggcgtttgtgccccgcgacagtgaaggcctgagcgtgatcgacgactggagcggcttcggccaacgcaccaccggcagcggctccgtggtgttcgataacgtgtgggtcgccgcccaagacgtaattccgttccagagcgccttcgagcgcccgaccaccgtcggcccgctggcgcagatccttcacgccgccatcgacaccggcatcgcccgcgccgccttcgaagatgcgctgcactttgtacgtaccaagacccgcccttggatcgattccggcaacgacaaggccaccgaagacccgctgacgctcaagagcttcggccacctgagcattcgcctgcatgccaccgaagccttgctggaacgcgcaggcgaatacctcgactgcgcccaggccgacagcaccgccgaaaccgtggcggcagcctccatcgccgttgccgaagtgcgcgccttgagcactgaaatttccctggccgccggcagcaccttgttcgaactggccggcagccaggcgaccctggccgaacacagcctggatcgccactggcgcaacgcccgcgtgcacaccctgcacgacccggtgcgctggaagtaccatgcggtgggcaattactacctcaacgatgaaaacccgccgctgcgggggaccatctgatggcgaagaaaaagatcctgctcaatgccttcaacatgaactgcatcgggcacatcaatcacggcctgtggacacacccgcgggacacctcgacgcagtacaaaaccgtcgagtattggaccgaactggcacaaaccctggaacgcgggctgttcgatggtttgttcatcgctgacattgtcggcgtgtacgacgtctaccagaacagcatcgacgtgccgctcaaagagtcgatccagctgccggtcaatgaccccttgctgctggtctcggccatggcggccgtcaccaaaaacctcggcttcgggcttaccgccaacctcacttacgagccgccgtatctgttcgcccggcgcatgtccacgctcgaccacctgagccgtggccgggtcggctggaatatcgtcaccggctatctcgacagcgccgccaaggccatgggcctgaccgaacaggtcgagcacgaccgacgctacgaccaggccgatgagtacctggaggtgctgtacaaactctgggaaggcagctgggaagacgacgcggtcatcaacgacccacaggcgcgggtctatgcccagccgggcaaggtgcacaaggttgaacaccacggcgagttctatcaggtcgagggttatcacctctgcgagccgtcgccgcagcgcacgccggtgctgttccaggccggcagctcggaccgtggcttgctgttcgccggacggcatgccgagtgcgtgttcatcagcgggcaaaacaaggccgcgaccaaggcccaggtcgacaaggtgcgcgccagcgcggtcgaggccgggcgcaacccggatgacatcaaggtgttcatgggcctcaacgtgatcgttggcgccaccgaagaacaggcctgggccaagcacgccgagtacctgagctacgccagcccggaagccggcgttgcgcacttctcggcgtccacggcgattgattttgcccagtacgaactggacgaaccgatccagtacgtgaagagcaacgcgatccagtcggccaccaagaacctgcaaaacaacgactggacccggcgcaaattgcttgagcagcacgccttgggcggccgctacatcaccttggtcggctcgcccgagcaggtcgcggatgagctggaatcgtggatcagcgaaaccgggctggatggcttcaacctgacgcgcattgtcacgccggaaagctacgtggacttcattgatctggtggtgccggagttgcagaagcgtgggtcgtacaagacggcttatgagcagggaacgctgcgcgaaaaagtcttccaaagcggcgcccgcttacccgaacaacacaccggatccacctaccgacactgaatcaaaaaatgtgggagctggcttgcctgcgatggcggtgggtcagctaaaaatttggggctgacagaccgctatcgcaggcaagccagctcccacagttgaccgagttgttggcactcacaccttatgactggaaatcgattatgaaaaaaacactgctcacccacccagtcaaagcactggccctggcccttggtttattcagcgcggcggtattcgccgccgatgcaccgctgaaagtcggcaccaccgccgccttcgcgattcccctggaagccgccgtcgccgaagccggcaaacaaggcctgaaggtcgagctggtggagttcaccgactggatcgcacccaacgtcagcctggctgccggcgatatcgacgtgaactacttccagcacatcccgtttctggaaaacgccaaggccgccgccggttttgacttggtgccgtatgcgccgggcatcatcaataacgtcgggctgtattcgaagaagtacaaaagcttcgacgacctgccccaaggcgccagcgtggcgattgccaacgacccgatcaacagcgggcgcggcctgcaactgctggccaaggcgggcttgattaccctcaagccgggcgtgggctacaaggccactgaagaagacatcatcgccaacccgaagaagatcaagatcctgcaagtggaagccgtgcaactggtgcgcgcctatgacgacgccgacctggtgcagggctacccggcgtatatccgcctgtccaagaccttcgatgccgagtcggcgctgctgttcgacggcctcgaccacccggaatacgtgattcagttcgtggtccagcccaaaagcaaaaccgacccgcgcgtgatcaagttcgtcgacatttaccagcactcgccagtggtgcgcgccgccctggataaatccctcggcaagctctaccaagtcggctgggaagataaaaaatgaccgccgcccactctcaactgcgcgacctgggcttgccgcccagggacgccgagcagaccgaactgcacccggatttgaaccgcgcccatgtgcgttttatcaacctgggaaaaacctatgacggcagcgtgcatgccttgcaaggcatcgacctggcgatccagcgcggtgaagtgttcggcatcatcggccgcagcggcgccggtaaatcctcgctgatccgcaccatcaaccgcctggagcaaccgagcagcgggcgtgtgttgattgatcaggtggacatcggcgaatacgacgaagaccgcctggtggccctgcgtcggcgcatcggcatgatcttccagcacttcaacctgatgtcggccaagaccgtgtggcagaacgtcgagttaccgctgaaagtcgccggcgtacccaagccacagcgcgagcaaaaggtgcgtgagctgctggagctggtgggcttgcaggacaagcacaaggcttatccggcgcagctctccggtgggcaaaaacagcgcgtggggatcgcccgttcgctggtgcacgacccgcagattctgttgtgcgacgaggccacctcggccctcgacccggaaaccactcaatcgatcctcggcctgctgcgcgaaatcaaccagcgcctgggcctgaccatcgtgctgatcacccatgaaatggcggtgattcgcgaaatctgcgaccgcgtggtggtgctcgaacacgggcgcatcgttgagcaaggcccggtgtggcaagtgttcggcaacccgcagcatgaagtcagcaaaaccctgttggcgccgctgcaacacggcttgccggaagaactgcaaagccgcctgcaactcacccaaacccgcgccgacgccgcgttggtgttgcgtttgcaattcaccggcagcgacaccgatgagcccgacctggccgcgctgttcagcgccctcggcgggcgcgtgcgcttgctgcagggcggtgtggaacggatccaggggcatgccctggggcaattactgctggcggtgaatggctcaccgcacacggccgaagagctgcgcaatcgcgccgcgcggtgggcacaacaggtggaggtgctgggctatgtggtttgatcgcttattgcagggcgccatcgacaccttgttgatggtcggcgtgtcgtcactgatcgcattgctggtgggcattccactggcggtattcctggtcaccagcgacaagggcggcatctaccaggctcccgcgctgaatcgcgtgctgggcgcgttcgtcaatctgttccgctcgattccgtttttgatcctgatggtggcgttgatcccgtttacgcggctgatcgtcggcaccacctatggcgtgtgggccgccgtggtcccgctgaccatcgccgccacaccgttctttgcgcggatcgccgaggtgagcctgcgtgaagtcgaccacggcttgattgaagccgcccaggccatgggctgccgccgctggcacatcatctggcacgtgctgttgccggaagcactgccggggatcgtcggcgggtttacgattaccttggtgaccatggtcaattcatcggccatggccggcgccattggcgcgggcggcttgggcgacattgcctaccgttatggctaccagcgttttgatacacagatcatgctgaccgtgatcgtgctgctggtgattctggtggcggtgattcagttgggtggggaccggttggcgcgggtgctgaacaagcggtgaggtatagtcgaggcatcttcgatgcccggtatttcccgtcatgaccctcaagcccgatgacctcaaccagattacatccaccacccttggccattacaacaaggtcgccgaggacttccgtgaaggcacccgcgatcatgatgtgagccagaacatcgacgcgttgctgcggcatatccagggcccggcgccgtttaccgtgctggacttcggctgcgggccggggcgggatttgcacacgttcacgcgcaagggccacgtcgccgtcgggctggacggttccgagcgctttgcgcagatggcgcgcgaggacagcggctgcgaggtgttgcagcaggatttcctcaagctggatttgcccgctgagcgcttcgacgggatctttgccaatgcggtgttgtttcatattcccaagcaggagttgccacgggtgctcaagcaactgcacggggcgttaaaggctgggggcgtgctgttcagctccaacccacgcggtgacaaccaggaaggctggaatgggcccaggtatgggtcttatcacgacctggcggcgtggcaggggttgctgacggcggccgggtttgtggagttggaacattactaccgaccggccgggttgccgagggaacagcagccctggttggcgagtgtgtggcgcaaacgctagagcagtgttgaatgctatggcctcatcgcaggcaagccagctcccactattggaatgcgttccgactgtgggagctggcttgcctgcgatagggccttaccggcaacgctaatcgacctgatacacccgcggtttttcgcccaccaccagcgccgtcacactgcgcccggcatagccttgtttttcctgcgcagcaaagttcgccaccaaccgcgtgccatcggcaaacgtggtctgctgcacctgccggtctgccgtcagccaacgaaaatcggtcattgcctgcgtcgccaagcgctcatgcaacggccggaaaaaccggtcctggcgctgtatcaacggtatccgctgcttgagggtggcggcgctcaagtgatacagcggcggtacgttgtacagcagctgggccagctcgttttcagcccgcacattgcttaatttcaggctgtcgaacagccaatggtgagtggtgatcaccgagccgtggaacactgcctgatacagcggcagacgcatcgtcgggtcgaaatacaccgtgcgaaacggctcgttcagcggcaccggtttgaagaacaccgccggttgctccggtggataccagttgcccacgtaatagggcgactgcttgtccttggtcatctcgcgatcaccccaaccgatcaccggtgtctgcatgccgtgggcgaacagaatgccctgggccgtcaccgcgttgccgtcttcggaaccggcgggcagcttgagcgccgtgttcagccaacgcgacgcgtcgatattgccgtcggcgttttgcgcctgggtcatttcggcgccatttcgatagctgtcgaagaccatgctggtcgcataggcatccaggaaccaggcgttgaaaccggccttggcttgcacggccttcacgcgggcctccagcagcggccttacgcagcgcgggtcggtgtaatggccagattgttgaaagccggtcttgagcttgccgtccttcaacacaatggcgcagtcgcgataggccttgctgcccaggtgggcggtggaccagtccgggttttcgctgctggataacgcagtttcataggagtcatacggcgccatcaggtagccggcgttcacgcccgcctgaatcgcttcggggtgccagaggccgccttcccagccttcgcccagggtcagcagcaggcgctttagcccagcgtcttgcagcgccttcacggttttgcccgacagcgtactgccccaggtgccggggctgtcgctcaaggcgccggcaaacgctgtcgccagttcacggcgcagtacgccataaccgtcagcaagtttgagcatgtccggctcgtcggtggcctgccaggtttgccgggccttttggttgatcgctgcgttgagaccacgcagcagtacactcttttgatagcggtccaatgggcgcgactgagtcagtacctgcgtggtctctttgtccagcaagcccttgagtgcgtggccgcgcagcaccttcaccaacagcggccagtcacgcacatcgtccggccccaacaggtcattgccccatagatagacatggctggcgcccagcagtttttcagcctccggtgtctggcgcagcttgtccgtcagcggctcatagcgcccttgctccaccagccattcgcggtagcgttttgcacccgccaaagggtcggcagcgcccaagtgcaggcgcaacgtcatcggcgccccaggctcaagcgcggtaaactggtgcgccactgtcagcgccagcccgccaccgtctgcctgccattgcaggcggttgtgatagggattggtgagcaaccagttaagcgtgaagcggccatgatccacgccccataacggcaggctgagatcctgcgtggtgttgacctcgccctgatcctgcaaaaacgcgttccacacggcgttgccggcgggcacgtaatgcccttcggccaagggccagatcaagcctttaccgatggcctcggcaggttggcgcagcaggtgcagctcaccgggttctcgcgcgctgatactcagggccaggtcgcgctgctcaaggcgggcgctcaggtggtaggcgccgttatcccactgccaagtgacgtgttcagcatcggcttgcagttcagtgactgcatgtgcggtgacaccgctggaggcctgcaccggcgcctcgcccgccggcgtgactcgcagcgccagcgtggcggggtcgatttcgacatgccactgggcgttttccagcacggtgccagccaaggccagcggagacagcaacaagcaaaaagccaacatcagagcgcgcatcacacgggccttccaaataggaacaggcccggagggtaaaacacttatcgccagccaaatgtagggaaagtgtttccaggaaccttcccacatcgttgcaggaaggtcccaagcgtcagccctgttgttttttcggctcgcgaatcttgtaccaggccacgtaaagcgccggcaggaacagcagcgtcagcaaggtggcgatgatgatcccgccgatcatcgcgtaagccatcggcccccagaacacttcccgcgcaatcgggatcatgcccaggctggccgctgctgcggtcagcaggatcggccggcgccggtgctcggtggcttccaccactgcgtcccacggcgtgtagccatcgcgctcatacgcatcgatctgcgtcaccaaaattaccgagttacgaatgatgatgccgatcaacgcgaggatgccgaggatcgccacaaagcccatgggcgtgcccgtgggaatcaacgccagcaccacaccgatcagccccaatggcgcgacactcgccaccaggaacatcttctgcacgctgtgcagctggatcatcaggaaggtcgccatcaagaacagcatcagcggcactactttggcgatggggccttgggccttgccgctttcttcgacggtgccgccggtggcaaccttgtaacccaccggcagctcggcgctgaacttgtcgatctcgggtttgagttgcttgaccaggtcggtcggctgtatctcatcacgcaccgaagccttcacggtgatggtcggcttgcggtcgcggcgccacaccagcggctgctccagctcataacgcaccgtggcgaacgccagcagcggaatcgaggtgccgttgggcgtgacaatctgcaggttctgcagggtttccggcgtgccgcgttcggcgtcctcggcgcggccgaccacgttgatcaggtagatatcgtcgtgcacctgggtcaccgacgcaccactgaccacgctgttcatcaactgcgccacgtcttccgacgacagccccagttgccgcgccttgtcctgggcgatgtccacgcgcagcactttacccggctcgttccagtcgtagatgatctcgcccaggtgggtgtttttatccagcaaggtcgccagctcaatggcgtgtttgcgtacctgatcggtatctttaccggacacacgatattgaatcgggcgccccaccggcgggcccatttccagtggctgcacatagctgccaatgccgacaaagtcatcacgcaggcgtttttgcaggcgcgcaatcaacgcgccgcgctcttcgaggcctttgctgacgatcaccagctgcgcgtaataggggttttccaactgctggtcgaggggcaggtagaaacgaatcgcgccctggccgatgtaggtgctccaacgggcaatgtccgggtcatccttgatgatcgcttcgaggcggtcgacggccttgcgggtttcgttgatcgaggcgttttgcggcaggttaaggtcgacgaggatttccgggcggtccgacgacgggaaaaactggttctgcacaaactgcatggaaaacaccgacgccacaaacaagcccacggtgataccaatcgcccaccagcggttacgcatggcccagagcatgccgccattgaacgcgcggccgatgcgccccggctctttgttttcgggtttaacgttggcactgaggatatgcacgccgattaccggcgcaaacagcaccgccaccacccacgacaccagcatcgccacggcaatcaccgcgaacagggtgaaggtgtactcgcccgccgagctggcgttgaggccgatgggcacaaaaccggccacggtcaccaacgtgccggtgagcatcgggaacgcggtcgaggtataggcgtaggtcgccgcctgctccttggtttcacctttttccaggcgcgtgatcatcatctccacggtgatcatcgcgtcgtccaccagcaggccgagggcgatgatcaacgcgcccagcgacacccgctgcatggtgatgccgctgtattccataaacacgaacaccagcgccagcaccaagggaatcgagcacgccaccaccaacccggcgcgcatgccgaggctgataaagctcaccaccagcacgatgatgacggcttcgaagagcgcgctggtaaagccgccgacggcctcttccaccacttccgcctgatcagagactttgtgcacgccgacgcccaccggcaggtcggcagtcagctcatccatacgctggtgcaacgccttgccgaacgactggatattgccgcccttctgcatggcgatggccaagccaattgccggctggccgttgaaccggaacatcggccgcgccgggtcgacatagccacggctgatgtcggcgatgtccgccaaacgatagaaccggtcattgagccgcagattgacgttggccaggtctttctccgaggcgaactgccccgaggtgcgcaccgaaatccgctccggcccggcctcgatcaccccggcgggcgttacggcgttctgcgattgcaggctctgcacgacctggcgctgatcaatccccaatgccgcgagtttgcgcgtggagaaattcaggtaaatcacttcgtcctgctggccgatcatctcgaccttgcccaggccaggcaccgagcggatttcggcgcgcacctgctccacatagtcacgcagctggcgcatcgacaaaccgtcgccggtaaacgcgtagaccgaaccgaacacgtcaccgaactcatcgttgaacgacggcccctgcaagccttgggggaaggtgccgcgaatgtcatcgatcttcttgcgcacctgataccagatatccgggatggccttggcactggtggtgtctttgaggaacacgaacaccgtggactcgcccggccgcgtgtagcttttcacgtagtcgagggagtcgagttcttcgagttttttctcgatgcggtcagtgacctgcttgagggtttcttcctgggtcgcgcccggccaacgggtctggatcaccatggttttgatggtgaacgaggggtcttcctcgcggcccaggttcatgtaggagaacacgcccatcaacagcgcgacgaacatcaagtaccagacgaaggactgatgcttgagggcccagtcggataagttgaagctccctttcatcgcgggctgtcctcgtcgattttgactttttgcccaggcttcaggctgttcacgccagcggtgacgatgcgttcgccgggtttgacgccgccgttgagcagcgcgctgttggcgtcacggctgaccaccgtgatgtcgcgcggctgcacggtctggctttgggtgtcgagcagccagatacgggtcttgccgtcgacttcttgcagcgcgctcagcggcagctcgatacgcggtgcgatggcgctgctcaaggtcacgctgatcgccgtgccgagacgaaacgcgggcggcgtgtcggtcagggtcaagcgtgcgcgacgggtgcgcgtggcgctttgagcctggggttcgatttcgcgcacgatggcggtggtgttgacgctcgggtcgagttgcccggcgaccagaaacacgacgtccggcggtagccgctcggcgagcccggccggcaggtcgatcaccgcttccttgatgtccgggcgcgccagggtcaccacttgctggccggcgctgaccacttggccggcctcggcattccaggcggtgacgatgccggcgtggtcggtgcgcagttcggcgtagttgagctggtctttggcctggttgaccgaggccttggcctggtcgagggtggcctgggtggttttcaggtcggtctgggccacgtccagctgggcttgggcgcccaccccacggttgaacaattcctgctggcggcgggcgttggcctgggcattgataaattgcgcctgcacgcgggcgaggtcgccttgggccgagcgcaactggttttgctggtcggtggggtcgagtacggcgagcaaggcgcccttctcgacttcggcgcccacgtccactgcgcgcctggcgatgcggccgggtacacggaaacccaggttgctttcgtagcgcgcctgaatcgtaccggcgaagcggccgaggttttcctggtcttcggccttcacttccatggacagcaccgggcgcaccggttcgggcgcaggttcttccttggagcaggcggccaacaacaggctggcggcgagcactgccgtcaggcgcttcatggctgggctccttgctgggcgatctcgacgaccatgccggggtgcagtaattgcccaccggccaccacaactttttcgccgcccttgaggccgtcaccgataatcactttgccggtgaggtaacgcgccacgctgaccttgtgcagctgcgctttgccgtcaccgtcgatcaaccacacggcgggttcgttgaggtctttggtcagcgccgaccagggcagctcgatactggctttggccgggccattggcagtcgcactcaccaccgagcccagttgcatgcctttgggcagcgattgcagggcgattttgacctgcacggtgccggtattggccgccactgccggcgtgacttcgcggactttacccacggccttgatgctcgggttatccagcaggctcacggtgatcggcgcatccggcggcggctctaccagcagtgattcatagacattgaacaccgcatcacgctcgccgtcggtggccaggctgaaaatcggcacggtggcttgcacaacctggccgacttcagcctggcgcgcggtaatcacgccgggcgcatcagcgaccagcgcggtgtaaccgagttgttcgcgggcattggccagttgcgcctgggcggcggccagggcgctttggctgctgcgcagcgcggcctgggcggcgtcgtattcgctgcggctggtgtagcccttgggcagcagtttttcctggcgcacaaaggcggcggcggtctgtttgacgcgcgcctgttcggccacgacctgggcctgggcggaatcgacgttggtctgcaaatccttggggtcgagcttggccagcacttgcttggcggtgacgcggtcgcccacgtcgaccatgcgctggatgatcttgccgcccacgcggaaggacaaatcggtttgcacacgggcctggatatcaccggtaagggtcaccgctgcggcgaaatccgccggctgcacggtctgcacaaacacccgcgaatgctccttgggcgcggccttttcctggccacagccgctcagcagcgccaacacgccaagactgagtaaaactatcgaagtgcgaccgcccatgcaggctccttttgcgtgatgccgacttgccagtgtgtatgcgactgtgagcttagatcagggttccttatctgcatggaggatcccatactccaatggttcccatgtcgactgattacttatgctgaaaaccctggcggtggccaattaccgctcgatcaataaattggtggtgcccctggaccggctgaacctggtcaccggccccaacggcagcggcaagtccaacctgtaccgcgccctgcgcctgctggcggaaaccgctcagggcggcgtgatcaatgcgctggcgcgtgaaggtgggctggattcaaccttctgggccgggccggaaaccatcagccggcgcatgcgtgagggcgaggtcgccgtacaagccaccacccgccaggacgtgaagcgtctgcgcctgggatttgccggggaagatttcagctacgccatctccatggggctgccgtcgcccggcatcagttatttctccctggaccccgagataaaaaaagaatgcatctgggccggccacctctatcgccccgccagcctgctggtgcagcgctccgggccgatggttcgggcgcgcgcggggcgcaactgggacgtactggcccagcacacgcccaactatcaaagcctgttcgaccaggtcggcagcctgcgcggctcgccggaagtgttactgctgcgcgaaagcattcgcggctggcgcttttatgatcactttcgcagcgacgtggacgcgcccgttcgccaaccgcaattgggcacgcgcacgccggtgctgcatcacgatgggcgagacttggcggcagcgttgcagaccatccgcgaaatcggcgaccccgaggcgttgcagcaggccgtcagtgacgcattccccggagcgcggctgaatatcgagccgttgcagggtgggcgctttacgattgagttttatcaggaaggcttgctgcggcccttgtcggcggcagagttgtcggacgggacgttgcgttatttgctgctgatcgcggcgctgctcacgccacggccgccgaccatgatggtactgaacgagccggaaaccagcctgcacccggatttgctgccggcgttggcacgcttgattatccaggcttcccagcattgccaagtgtgggtggtgtcgcatgccagccgcttgattgcggcgttgcagcaggatgaggggtgtaattcgattgtgctggaaaaggtgatgggcgagacgcggattgtcgggcaggggattttggatgcaccggcgtggcattggccggaatagtggtgattgcaccggcctcttcgcgggcaagcccgctcccacatttggaatgcatttccctgtgggagctggcttgcctgcgatagcggtgtgacagtcagcgcaggatcaaccctgccacttgccgccttcaacaatcacactctcaggcttggtgtcatcgctcagctctttacgcacatattggtcatacagcttgagcaggaacttctcttcacccaacttcgccaactcggcattcacccagtcacgcagttcgatgttgcccttcttcaccgcgggcgcaatcggcgcttcatcaccgagtttttcttccagcacgcggtagccagggttctgcttggcccagctgaacagcaccaggttgtcctgcgcatacgcatcaccacggccagccgacagcgcttgcagcgactcggagtttttctcgaacttgagcagtttccaatccgggtggtttttggtcagccagatgtcggccgttgtaccggtggtgacgatagtggtgcgggtggccaggtcatccaggcttttcaccgcgctgtctttcggcaccagggcctgcaccgccactttcaggttggggttggtgaagtccaccgcttccttgcgctccggcgtcacggtcatgttggcgaggatcaggtcgactttgtcgctttgcaggaatggaatccggctggccggctcgaccgcgacgaactcgaccttgttttcatcgcccagcaaatccttggcaaattgacggccgatgtcggtatcgaagccgacatagcgaccggcttcgttcacaaagccgaacggcggcttgtcggtgaatacgccgacgatcagcttgtcgcgcgccttgatcttgtcgatgtagctcgccgcggcagccgcaggcttggcaggctcttcggcctttttatcgcagccggcgagtaaggcgacggcaaatagtggcagcagtaactttttcatatcagctccagttccttggctttcttgggcagtgttgaaacaaaggagaacttctccaggaactgctgcgcgcgtgcggtttgcgggttcgtaaagaattcttcgggggtgttgtgttcgaggatgcgaccggcctccataaacaccacgcggtcggcgacggcgcgggcgaaggccatttcatgggtgacgatcaacaaggtcatgccatcgcgggccaggccctgaatcacctccagcacttccttgaccatttccgggtcgagggcggcggtgacttcgtcaaacagcatcacttgcgggttcatgcacagcgaacggacgatggcgatgcgttgctgctgaccgccagacagctgacgcgggaaggcgtcgcgcttgtcgcccaggcccacacgttcgaggagtctttccgcttgggcgcgggcttcgcggggctcgcgtttttgcactttcagcgggccgagcaggatgttgtcgagcacactcatgtgcgggaacaggtgataactctggaacaccatgcccacgtcctgacgcacctggcgccagtcggtgtttttgtccagcagctctttgccggcaaagcgcaggctgccgctgtgcgccacttccaggccgttgaggcagcgcagcaaggtgcttttgccacagccgctggggccgaggatcaccaccacttcgccactttgcacgctcaggtcgatgcccttgagcacctgctgctcgccaaagaatttgttgaaaccctggaactcgatcaatgcgctcatgcttgggcccagcgccgttccagcaccttggaggcggccgacaacgggtagcagataaagaagaaaaacaggaacagcacgccatagatcaataccgactcataggtgcgttcgatgatttgctggccgaccttgatcacgtccaccacgccgatcagcaccgccagcgagctggtcttgatgatccgcgtgtagacgttgatggtcggcggcgtcatgcgcttgagggcctggggcagcagcacgtagccgtacagctgcgggtcggacaagccgatcgacaaaccggcctcgcgctggccacgtggcagcgaatgcaacgcgccgcgtaccacttcgccgacctcgctggcaccccacagcgacagcaccagcaccgcgcaccagaagctcggaatgctcaggccgaagaaaatcggcaaaccgaaaaacagcaggtacaaccacaccagcaccgggatcgcgcggaacagttccaggtacacccgcaacaccgcgttgatcagcgtgttattgagcgtgcgcagcacgccgtacaacacgccgccgacggtgctgaaggcgatgctcaaaaatgaaatcgacagggtttgcgcagcgcccttgcccaattgcggcaacgacacccacaacagctcaagacccgaactggccatgctggagcctcctttccagacggctgagcagcagcgacagcggcaagaacaacagcacgcagatcagcgtcagcacggcgagcatttcgtaagttttgtagtagagcgcgatgtagcttttggtggtgtagagaatctccggcaccgccaccgcggagaccacggtggtctccttgagcaggaagatgaaattggcgaacagcgccggcaggctgaggatgccggcctggggcaggatcacgtggcgcagcagttgccagtcggacaggccgatggacttgcccgactcgatctgcgccagcggcaccgcttccacaccggcgcgcagcacttcggtgaggtaggcgccgccaaggaaggtcatggtgatgatcgccgcccagaacccggagatattgaaccccagggccggcaaggcgaagtacacgaagaacagttggatcagcagcggcgtgttgcgcgccaactccacatacagcgccaccaggcgcgacaggtacggcgtgcgaaacaccagcagcgccgcgttgatcagcgccaccagcagcgaggtggcaatggcgatcaagcccacttgcagcgtcacccccacggcgttgagaaacgccggcaaggtgctgaggataaaagcgaaatcgaaagtcatcttgggtccatgacgccgcaggggtaatgcagcgagcgcagtacgagccgacgtgggtaacgccgggtagcgcgaactttaaaggtataaaaagcaaaatttaaatacccaaatagcatattgatatcacgcaaaaagataaccgcagggttcgcgggtttggccgctggcggctatggtcttggggtcgcagaaaagctgttttttcgaaggaatgagaaaatgaacgaagcgaaaccgattgatccgcaggagctggtgaagtggttggtggcgttgcgtcgggcgattaatagccgtcctatctgacacaccgctgttcaatgtgggagctggcttgcctgcgatagcgatacatcggccagcacatccgtagctgacaaaccgctatcgcaggcaagccagctcccacagtttaaaagcgtgacgcagagcgtcacaggaagcattcccacgcggagcgagggaacgatcaaaaaaaacgccgacgctgtagtagccgtcggcgttcaaaccttgaagggggttttggttacatcagaacgcaggcacgaccgcgccgttgtacttcttctcgatgaaagctttgacttccgggctggtcagcgccttggcgagtttctggatcgcgtcgctgtccttgttgtccgggcgggccaccaggaagttcacgtacggcgacttcgcgtcttcgatgatcagcgcgtctctggccgggttcaggccagcttccagcgcgtagttggtgttgatcacatccaggtcaacctgatccagcacacgcggcagcagcgccgattccagctctttgaatttcaggtttttcgggttgctggcgatgtcttttggcgtggccaatgcattggtcgggtctttcagcgtaatcagaccgttcttttgcagcagcaacagggcacggccggcgttggagccttcgttcgggatagctacggtagcgccatctttgagttcagaaatattcttgatctttttcgagtaaccgccgattggctcaacgtgcacaccgatcacagtgaccaggttggtgcccttgcccttgttgaagttttccaggtacggcagggtctggaagtagttggcgtccaggcgcttctcggcaacctgcgtgttgggttgtacatagtcagtgaagactttgatctccaggtccacgccttctttggccagggtcggtttcaccagctcaaggatctcggcgtgcgggatcggggtggcggcaaccaccagtttctcgttggcctgggcgaagcttgcagtcagggcagccgccagtgcggtaaacaacagaacctttttcatgcagtgtccttatcgaaattccggggcgtctctgacgaccgttttttatggtgtgccagcgaagtgctatcgcggcgtgggatggacaatacctagattttttattcccgaacaatatcttttattcacgttgatattccattttgttcatgcagccgctgttcatttagaaagctgagcaaggcttgccgctcggcggggctggcgctggcgaaaatccgctgcacttgcgccagcggcgagcccgccgacggcaggttgaggtgctcgggcaaaatttcatcgccactgctcaccagcagcgcaaagtgaataacgttctccagctcgcgggtattgcccggccagctgtggtgttccagcacgtgctgggcggcgtcgctgatcagcggcaccggcaggtccaggcgctggctgtagatgccgaggaagtattcggccagggacaggatgtcgccgacccgctcgcgcaacgccggcaggtcgagctggccttcgctcaggtaatggaacagccgctcatgaaacttgcccgcggccacggcctgggccaggtcgatgctggtggcggcgaccaggcgcacgtctaccgggctgggctgatgggcgccaacgcgggtgacttcatggttctccagggcggcgagcaatttcacctggatcggcagcggtaagtcgccgatctcatccaggtacaaggtgccgccgttggccgaaccaaaccaccccgcccggctgctcgccgcgccgctgtggctgccggccgcgtagccgaacagttcggcatcggcgtaagtggggctgatcgcaccgcagttgaccgagacaaataacccggtgcggtcgctgccacggtggatatgccgcgccagcagctctttaccgctaccggtctcaccgcgaatcaacacgggcaaggcacgcggcgccaggttttccagctgttcacgcagttggcgcgagcgcgggtcgacaaacaccagtgccttggcgcggatgctcagcgggcttttttcggcgtcggggaaggtcagcagtggctggccgaaggtttcatgactcatggcaggctcccgccccaaatccactcagggacggggcgttgaaaagaatttaggcgctgcgccgggcgtgatgctcaaggcggttttgcaggcgatagaggtaagcgaaaccctgctcccaacgctggtggccggacttcacattgatatgcccggctcccgacagaatgccggcttcggcaccccaattgcgcgccagctccagcgctcgagaggcgctgacggcgctgtcgttgtcggaactgaccacctggctgggaaacggcagcaggtcggtcgggatcggcgcgaagttgcgcagggccggtgaacaggccgggcgttcgacatccgccggggccaccagcaaggcgccacgtacctgacgcaaaaattgcacgggcgcggtggccgcccaatgggcgacggtgatgcagcccaggctatgggcgatgagaatgacaggcgtgctgtcggcggcgatggcctcggccagtgcggccacccagtcttcgcgacgtggcgtcagccaatcggcctgctccacgcgggcgctgttgggcaggctgttctgccaatgactttgccaatgatcttctggcgatccttgccagcccggcacgatcagataacgaatcgactcgctgtgcatgggtgtgccctcctgcagcgtttaacgttgctgaccagtataaggacgggggttatattcgttaaggaataagaagctatttattaataaccaaaaactcaatctcaacaatgaccaaactgtgggagctggcttgcctgcgatagcggtgtgtcagccaatacatctgtagccgagagatcgctatcgcaggcaagccagctcccacagtgaccgggttacacagtggaacttgaggcgttgggcaaatttcaggcaaaaaaaaaggccgcaccctgccaaggaaacggccaaaaaattgtcgaggcatttgaaactaacgtgcggtaatcaccgacaacttggtaatgcccgcgcgctcaatcgacgccatggctcgcgccacttcgccatagttcactccatcgtcagcctgcagttgcacccgcacatcggggtccttggccttggccgactgcaggttgaattccagcaagtccggctggatttcgtccttgttgataaacagtttgccggcgccgtcgatgcttaccaccagcgggtctttctgttccaccggggccacggcctgggtcttgggcaggttgatcgggatcgaattggtcagcagcggcgcggtcacgataaacaccaccagcagcaccagcatcacgtccaccagcggcgtgacgttgatctcgctcagcacctcatcactgtcttgcgtggagaaggccatctcaggacgcctccttcactttttgcggggtgccggccgcgcttttggtcagcgcagggtgcagcagcacccggaaggaattcttctgcgccaggctgtagaagtcgtgggcaaagtcatccaggtcggcagccgtcagcttcaggcggcgcaggaagtagttgtagaccagcaccgccggcaccgcgacggcgataccgacgcccgtggccaccagcgccgcaccaatcgggccggccacggtttccaggctggcggaaccggcggcgctgatccccttcagcgcttccatgatcccccacacggtgccgaacaggccgataaacggcgaggtgctgccgatactggcaaccacggccaagccggtttccagcgagcgtcgttcccgcacgatctgctggcgcagggcgcgttcaaggcggtcctgatggttgatggcctggctcaagtccgctgcgtgcggcgcatcaccgacctggattgcggcataaccggcctgggccacacgggcggcagcgccgggttgggtttcggccagttcggcggccgagtcgagactcgacgccgcccagaactgtttgtggaatttgcgatcctgggccttgaggcgaccgaactgcaggcccttgagcaaggcgaagccccaggtcgcgaccgaaaagaccaccagcagccagatcaccgcgctttcgatggattcaagtggagatgctaatgccatgatgttttccctctgtacaagtcgcggcgtgtgcaacacaccgcagcgcaatagttagtgaatcttgaaatcgatcggtacgctgacccagccgtcctgggccacatcgccctgcttggccggcacgaagctccaacgcttcacggcggccagtgcggcgtcatcgagttgctggcgcccgctgcttttctggatctggatctcacccggtttgccgctggccaacacatgcaccctgagcaacaccgtgccttcccaaccccggcgctgggccagtgacgggtactccggcgccgggttcttcaggtacgcagcgttcgccgacgcgggtgtaaccggtgcaggcgacggcggtgcggccggcgcgggcggagcaggtggcgcaggcttcggtggcgcgggcggctgctcgaccggtttcgatacgggcttgggctcgggcttcggaactggcttgggtttaggctttggaacaggtttcggcggcgctggcttggcggctaactcatccaccaccggcggcggtggctcaaccacaggcggcggcggtggtggcggtgcaggcggtggcggttcaaccaccggcggcgccggctgggaaaattcgatggtcatcggcgggatttccggcggcacaatcggcagcaccggcgtcggcttctggctcacccaatagatcaccgcaccgtgcaacgccaacaccagcaagcccagcagaaggccttcgcgacgactcgaaaagcgcttcggggtttgctgcaagcgcaattgccccaacggcgcgcggtgcggccggccaaggtcgaccaactcaccactcggtgcctggcgccactgcgcctcgggtgcactggcggcggtctggacattgcccattgattcactccctacggttttcacactaaaaaccgacaggcctgcaatagcggccgtcgagggctgaatcatcgagtccagacgcttatctcataaagtaatatttgacgttatacatagatctaattcgaataaaagaaacatcctgaaacgccaaacccacggcctgcaagggctggcgacaaagtgcagaatttgaatgcctttcaggcatgcaaaatattcactaaaggcatgaatttgaagccgattggccacttgaacagctgtggcgatgccaggcgtcttcccctggtcgtaccgtccggcgagacgggtttatgcgcatagccccttggaacccaaccccatcctcaaccaccaagagtccaagttggcgcgcctgatcgtgcgcgtcagcacaacacgtacgacaacgcgcccatgtgctgccgaaaccgggagacgggccattattggaggcccaatgaacatccattcccaactgaaaaatttatttgccggtgactcgtcccagactgatgcgcagccttctgccccgcgcgcgccccacgcccaacaaggaggtcaggtcaactttggcaacgcgggtaaaaagagcatgacccccaccagagccaaggacactcatcagccgtcgctgggtgcctcggcctcactgagtgctcagctcaaggccctcttgaaaatattggatggtttgttgcagagcataagacagccatacacgcagccctcaaacaccaacaatccgagctttaaccctaatgcctttaacgaccattcgacgaatcacgtgaatcggccacggcgcaatacgccaacgacacacacgcacgcacccaacagcagcaaggcggtgaccgagcccaaaaacgctagcccctatagcgataaagaccttgtcgatggatttgcgcaacagagaggcacgatgaattgcgtcaccgtcggagggataaaggcagccatgaaacaatacggcggccccaaggagatttactcatcggtacaaaaaactgccgacgggtatgacgtcaaaatgcgagataaccccagcaaaacttaccatgtgaccaatcaggagattcaacaggccacgcagcaatcggggttttccggcaacaacccgcagatgctcaacgatgccaacttcatgtatgcggtcagcgccaagcgggcacaagaggaaaacaataatggcaccgcgtcccgcagtttcagcgatgcattggctaccctgaacggctgggaacacaccgcagaagggctgcaacgtctgggcctgcaaaaccatatccagcaagccacaccacaggaattggccaacggcgcagccggtgtcatgacccacgccaaccacgtttttacagtactcaatggcagagtagaggaccacggccgcttggggcgcgcacctggcgcatgggttgaggcctataaattggtttaaacacgcagcggcacacgccggctgggttagatttaaattcaaaatatgtcgccggctatccatactccatgcctcttttgcgcttccgagaggtcatgcatgccgcttaacccgtcattcctgagcaaactcgcgggctggggcctgctggtcgtgctcggcctcaacctacgtcccatcctcagctccatcagcccgttgctcggcgagattcgccaggccaccgggctgagctttcagagcagcgccctgctcaccagcctgcccgtggtgtgcatgggcctggtggcgctggtcggcgtgcgcgtggaagcacgcctgggcgaacggcgcggcattgcgttgggcttgatgatgattctgctggcgtgcctggcgcgctggctgatgggccaggcgtcggcgctgctggtcacggcgttgctcggcggtgccggtgtggcactgatccaggcgctggtgccggcgatgatcaagcgtgagtttcatcaccgcgtgccggtggcaatgggcgtgtactcggcgtcgttgatggccggtggtggcttggccgcgctgctcagcccgctggtggccacgtatttccagcaatggcaggcggggctcggcgtatggctgttgccggcgctggccgcgttgctgctgtgggcttttttacccctcggtgcagcccgaagcgaccgcgtgatgccgacgttcaaaggcctgcgcaatcggcgcgcctggctgttggcgctgtattttggcttggtgaattgcggctacatgagcctggtggcgtggctgcctgcgtactaccagcaactgggctggggcgtgctgccaagcggttcgttgctggcgttcatgaccatcttccaggtaatcgccgcgctgttgatgccggtgctggcgcaacgcggtatcgaccgacgcccactgcttggcatcagcctgctggcgcaaaccatcggctacctcggcctgatcatcgcgccgctggactatccgcacctgtgggtagcgttgtgcggcttcggcctgggcgcctgttttgccttgagcctgttgctgaccctcgaccaccaccgcgacccacgccaagccgggcaactggcggccttcgtgcagggcgtgggctttttgatcaacgcggtttcgccatggctgaccggctggctgcgtgaactcaccggcaactttgtcagcgcctgggtggtgctgacagtgacggcggtggcgatgctggtggtgacgcgggtgttcagcccggccacctatcgcactgggtcagaagtcgtagcgcccagtcacgcctaaggtgcgcggcgtgcccaagaggccttcatagccgccattgccaccggtccacagcgtggtgtagtaggttttgtcgaaggcgtttttcagccacaacgacacgtcccactgcccttgctggtagttgccacgcaggccggtggacaggttgaccacggcataggcgggaatctgcccatagtcggaatcctcgaccgtgccgaccgctttggagcggaacgcgtagctggcagtcacgtaaggttcgaagccgttagccaggttccacttgtattcgccgttggcgttggcgatccacttcgaggcgccgaccacctggtggccggtcaagtcgcaggacgccggcgcgcctgggcgcaggctgacttccggtgggcacggcgcatctttgtacgacaggtaactcacgtcgttgaacgagccgttgaggttcagcgtcaggcccttgatcggcaccagtgtgctttccacttcaacaccccgcgagcgcaccgagccggcgttggtcaggtactgcacgcggttgtcctggtcgtaggcgttggtctggtagccgttgacctgggtccagaacaggttggcgttgagctgcaggcggcgatcccacagcgtgctcttgaagcccagctcggcgttgttggcgcgctcggtgccgatcagcaacgagtcggcaccggcagtcggcgcggaacccaccgccaggttgaccccaccggatttttcgccgtgagacagcgtggcgtagccgagcaggttttcgttgaagtgataactgaggttcagcagccccgagggtgttgcgctgtattggctgaggtcgcccgagtcatacaccccggcacgcccacgccgcgcggtggcagcggcgccggtcactgccgcgccacccagcggcgcattgcgcgtgacccaggcgcttttctcttcataggtgccgcgcagcccggcggtgaaatccaggcgctcggtgaggtgccaggtgccttgggcgaacagggcaaaactgtcggtgcgaatgtgcccgttgccgacgctgctcacattgttcaacgcacccgtcggcgtgccgttccagatatccgccttaggcccgtaataggcaaaggatttgttatccagcgaattgccaaagtaatacgcacccagcacatagtcgaagaagccaccggtaggcgaggccagacggaattcctgggaccactgtttatcttccaccgacacaccggcgttgtatgacgcgggcacgttgagcccgtcgtcattgcgcggggtgaaattccaccagcggtaggaactgaccgaggtcagggtgaagtcgctcggcagcgtccagttggcctccagcgatgtgccgccctggaacacggtgacgtgctggtcgctgtccaggttgaccttgcgatgggtgccgtccgccagcgtcgcacccgccgccgtcgcccgggcctggtagaggttggtgccattgatggtcggcccggtgctgtagagcacgcgagtgccggcgctggaatcttcctcgttgtagtcgccgatccagcgcaggttgaaggactcgttgggcttgtacagcagctgccctcgaaagccctggcgtgagccgccattgagatcgtgaccgttgtattcatttttgatatcgccgtcactgcgcgtgcgataagccgaaagacgcccggccaaatcatcggtgagcgggccggaaatcgtgcccttggtctggaaataaccgtcctcgcccaacgaggtttcaatgctgcgttccggggtaaaactcggcgcgcgggtgctgatgttgatcaccccagcggtggtgtttttgccgaacagcgtgccttgcgggccacgcaacacttcaagctgttcgatgtccatcaagtcgaacaccgccatgcccggtcgcccgaggtacacgttgtcgatgtacagccccacgctgccttccaggccgtcgctggccgggttgttgcccagcccgcgaatcgacacgctggactggcgcgcatgcatataggcgacgttgacgctgggcaccaactgctgcaaatcctgaatccgataaacccgctgactctccagcgcctggccgccgatgacgctcatgggcgtgggcacttcctgggcgctttcggtacgccgccgagcggtcacagtgacggtctcaagctggccgctggcgttttcacccttgccggcaggcgcaggtgtttcggcggcctgggtcggcgaccaactggtgctgccggccaccaacatggccaggggcaaggacttcaacagactcataagcggctccgaaacccggaaatatctgggcttagatattccataaggttatttatttatgtttttacgaacatttactgcataagagatagcctttataaggagtcgacctaatgcatagccaatgcatttcccggatatttttgatgtgaaaaatgcatatcgatttgcgccagcttcgccacttcatcgccctcgctgaacaacgcagttttgtcgcggcggcgttggccgtgaacctgtcgcaatcggcgttcagccgcagtattcaggcgctggaacacagcgccggctgccagctggtggaccgtggccgcaaggacctggcgccgaccaagcaaggccaggtgttgctggaacatgcgcggcggctggtcagcggcgcgcagcaattggccaacgagatcagccagttcaatgggctggaggccggtgagttgcgcttcggctgcggcccggcaccggccgccgggctaatcccgcgtgccatcggcagttttatcggccgttaccccaaggcgcgcgtgcagttccaagtggatgactggcaaagcctgagcaaacgcctgctcagcgaagagttcgaatttttcgtcgccgacacccgccatttcgaagcccacccggactaccacacccaccgcctgcgcgcgcggcgctggtatttctgctgccgcgccgggcacccgctggccaaccgcgacagcgtgagcgccgccgagctgatgagttatccgctggccgtgaccattcgcccgccaaacttgcgcaaagtgattgtcgacttaagcggccggcccgattacctacccaatgtggagtgcgaaaacggctacagcctgatgggcgtggtgctgcgttcggacgccatcggcatcgtcagcgccaacagcgatgtgctgcacatggcgcggggcgagttgatgtgtttgaagattgacgggctggccgaggacttggaggaacgctacacccgctacggcattgtcagccgcgcggggtatcggctgtcgccattggcagaggcgatgattgagcagataaagcagatcgacgaggcggatgaggatgtgtgtgcgctggagaatgtggctgtttgaactggcgctatcgcaggcaagccagctcccacaggggaatgcattctctgcatgaaatccagtcttcaaatgcacttgccagtgcacctgcgaacagcgaaaaccgtggtctttcttctgttcggtgaagccccatgtctcaaccaaaacctgtgcgcaatgtgctctacatcatgtgcgaccaactgcgtcgcgattacctgtcgtgctacggccacgcgcatttgcacacgcccaatatcgaccgcctggccgccgccggcgtgcgcttcagccgtgcctacacccagggcaccatttgcgggccgtcgcggatgtcggcgtataccgggcgttatgtcagcagccaccaggtggcgtggaacgcggtgccgctgccgctggaagagctgacgattggcgactacctgcgcccccatggcattcgtaccgcgctggtcggcaagacccacgccacgccaaacgtggaagccttgcagcgcctgcatatcgaccccgacagcgcgcaagccgaaccgctgaatgaagtcggcttcgacgcctatttgcgccacgacggcatctaccccgacagcccgctcttcgacgacaaacgcgagtccgcgccctacacccattacctgcgtgagaaaggttacgacggcagcaacccgtggcatgaatgggccaatgccgcagccggagaaaacggcgaagtgctcagcggctggcacatgcgcaacgccgggctgcccgcgcgggtggccgaggaacattcagaaaccgtctacaccaccgaccgtgccatcgactttatccgcgagcaggccgagcagccgtggtgtttgcacctttcgtacatcaagccgcactggccctatatcgccccggcgccgtatcacgcgctgtatcgcgccgagcatatccaggcgccgattcagcctcagcaggccagcgatcacccggtgtaccaggccttccgccaacaccaggagagcctgaatttctcccgagatgaagtgcggctgacggtgattccaacctacatgggccttatcaaacagatcgacgatcaactcgggcggctgttcgattttctgcaaagcaatggccgttgggatgacacgctgattgtgttcaccagtgaccacggcgacttccttggcgaccatttcctcggcgaaaaagaatttttgctggagcctgccgtgggtgttccgctgatcctgcgcgacccgcgcgccagtgccgacgtcagccgaggttcggtggacgaacgcctggtggaaaccatcgacgccctgcccacctttctcgacgccctgggcctgccgagcgccgaccatcgcctggaaggccgctcgctgatcccgctgctgcacggccagcccatcacttggcgcaactacgccatcgccgaatacgactacgccttccaggccccggcccgtgagcgtctggagcagcccatcgaccgctgccgcatgaccatggtgcgcagcgagcgctggaaatacctggcgtatgacggctttcgcccgcagctgtttgatttggaaaatgatccgcaggagttgaatgacctgggtgaagatctggcgtatgcggcggtgcgcgagacgcacgcggggtatttgttcgaatggctgcgcgggttgaagcggcgcaccactatcagccacgcagagattgatcagcgtgggcaatggtttcggtatggtgagccggaggcagagaaggtcgtgcagataggcgtctggtaaacaccacaaaaccaatgtgggagctggcttgccagctcccacacaaacttgcttccacatttgaaactgtattcgcttagagacctttggtggtctggctccgctgcccttgcacacccaccggcacatcacccttgagcgttacccggcgcacgatgcgttcctgggtgccgtagtcgtccaccgcgtaatgctgggtggcgcggttgtcccagatcgccacgtcgccggtgttccagcgccagcgcacggtgttttccaggcgggtgacgtggctttgcagcaggttgaacagttgcgtcgagtccgcctgggagtagcccttcaggcgcttgacgaagtgcccgagcaacaaggttttttcgccgctgaccgggtgcacacgcaccaccgggtgttcggtttcgtacaccgtggaggtgaaaatcttgcggtattcctcaagcttttccgccgatacgtccggcttgcgcccggcgtagtcgtattcgttgctgtgcactgcccacaggtggtcggcaagtgcgcgcaactcgacgctgaggtcgttgtaggcgctggcggtgttggcccataccgtgtcgccaccggacttgggcgccagcaccgaacgcaggatcgaggctttcgggtaggcgtcgacgaaggtcacgtcggtgtgccaggaattggcgcgctggccgcgcgtgccgtccagctccagcaggaaccgcgtgccgtcacgcaccggcacggtcgggtgggcaatcggctcgcccagcaggtgcgcaaaggcttcctggctttggtcgtcgaggtgggtctgctcgcggaagaagatcactttgtactgcaccagcgcctgctggatggcctcgacggtggcggcatccaggtcaccggacagtttgatgccacggatctcggcgccaatgcggccggcgaccgggtggatgtcgagtgcctgggcgacgggttgaacggctaatgcggcgttgctcatggtgttgcccctcatgtgcctgctgatggtgggatgctttccagcaacgctctattcatatgcaatttaggtctagcagatgaatgaatgcttcgttgacggaataagagcttgcatttaaaacctcagctcctcgggtcgcaaatgccttcgacctatttttcaaatgccgggaaagcatatggatcttcgccaactgcgctacttcatcgccctcaacgaacaccgcagtttcgtgcgcgcagcggacgccatgggcatcacccaaccggcgttcagccgcagcatccaggggctggagcaagagttcggctgcgtgctggtcgaccgtggcaacaaggatttgcgccccacgccggaaggccaggtggtgctgcaacacgcgttgagcctggtgcacggcgccgccctgctgagcagtgaagtcacgcgcatgaccaagctcgacgccggcgacctgcgcttcggcaccggcccggcgccggcggtcaaattggtgccggatgcagtggcgcgctttatcagcgcccacccgaaaatccgcaccagtttccaggtggataactgggaaaaactcagccgcgccttgagccgcgaagagatcgaattctttatcgccgacattcgccagttcgaagccgacccgaacttccagacgcgcgcgctgacgcccaagcgcggggtgtttttctgccggccggggcacccgctgctggccaaggacagcttgtcgaccaacgacatgttcgactacccgctggcctcgccgctgatctcgcaaggcattcgcaaactgctggcgaacctgagtgggcgcatggacttttcaccgagcatccagaccgaacacttcccggcattggtgaagattgtgctgcagtccaacgccatcggcgtgggcaccgaggaagcctttgccgaagacatcgcccaaggcacgctggtgctgctgcactggcgcaacctgccgcagaacctggagaccatgagcgcgcggtgcgggattgtcagccgcaccgggtcgcggttgtcaccggcggcgaaggcgatgattgagacgttggtggaggtggacaggcaggaggtgagtgtggcggtttgacgggcctcatcgccggcaagccagctcccacattttgactgtgttcacagatcaaatgtgggagctggcttgcctgcgatagcgatagcccagacaccaccagactcagagccccgccgccgccaggttcggcgccacccaatcactcacctgaaacgacttgcggatcagccgctccttggacgccagatccaccgcgtcctgcaatttgccgaggaacaccgggtccagggtcgaggggaaaatctcgctgagtttctggtctttcaaatcattggccaggatcaccggcgggtaactggcccgcgtcgacaccaagtcaatgtaggcctgcttgttgctgtcatcggtcagccactgcacggcttgctgttgggccttgagcaacttggccacgacctgcgggtgttcgtcgacaaacttggcgctgcccaccagcacggcctgcacgctgccggcgccaccgatgtccttggtagtcagcggtatctcggccaggcccttggcttgcagccctgtaaggcctgaaccgccccaggtggcgtcaatctgtttggcggccagggcggcaatggcggcgctgaagtccaggttgatgactttcaggtctttttcactcaaaccctggctggccagcgcgctgtcgaacgacaactggctggccgtgccacgaaacaccgcgacgcgcttgcctttgaggtcttgcaaggtcttgatgccggagcccggcaccacgccgaggtagtgcttcacaccgcgtgccgaggcgctgagcaggcgggtgtcgagcccattggaacgaccgatgatcgcggccaggtcgccgaggtacgccaggtctacctggccgttggcgaaggcctcattgatcaccgggccggcgcccttgaagtaattccattggatcttgatgccctggtcggcgaaggctttttcgaagatctgctggctttgcagcacgtcggtcaccccgccgccgctgtgctggctgcccgcactgaggtcgggcacggcgatgcggatttgcgtgaggtcggccgcgtgcaccagcccggccagggcggtgcccgcgaacaggctgatcagacgtttgaagggcagtttcataagcgcagctcctggtgggcgacggtcgcctggggagcagaaagtaggcacaggccgatcaaaactttaaatactataaattcacaatttaatagcttttagacctatgcaggctaaaacgcgggctacagagggttatgcataaacagcatcgaaaatattcttcgaatgcattggatgcgtgccgggcagaggctttaaatgatttttcttatcccacaatcatcttgattgcgtttttgtaagatcgaaatcacataacgccctcggcgacaacggaggtcctccatggcccgaatttcacttttgagcctacctctcgcggcccccggcaatagcgccgcaccgcgctggccgaggctgagcgaacgtttattgccgtggttgctgccactggggctgtttgcactctggtggctggccagccgtaatcattggatgagtgagcagattctgccgccgccgtcgctggtgtggagcagcgccgtggaactggctggcggcgagctgtggagccatttggcgatcagcttgcagcgcctgttctgggggctgctggcgggtgtcggcgcaggcgccctattgggtgcgctgctggggttcagcgcccgcgccgagcgcctgatctttccaaccttcagcgcgctgtcgcaagtgccaaccctggcctggatcccgctgttcatggtgtttttcggcatcggcgaaaccctgaaactggtggtattggtgaaggccatcgtggtgcccgtcaccctgcataccttggtcggcgtgcgcgacgcccagcccaatttgcgtgaagcggcgcgtgtgctgcgcctgccgactcatctgttgatccgccgcctgatcctgcccgccgcgctgccggcgttcatggccggcgtacgcctggccctggcggctgggtggacgtcgctgttggccgttgagttgctggcctccagcgaaggcatcggctacctgatcgtctgggcacgccagttgttcatgctcgatatcgtctttgtgtgcattgtggttattggcgtgctgggcgtggtgatggaccgcggcatcggttggctggatcgcaaatgggtgcactggccgcacccggccaccgcgcagattcgtcgcgggccgcgctatgaaggctggcagcgcctgcaaccgtggctgttaccgctgctgttgctggcgctgtggcaactggcgacgcaacgtggctgggtcgacccgaacattctggtcagcccgtgggcggtgctgcaaaccactggcgccggcgtgctggatggcagcctgtccggcgccttgggcaaaagcctggggcgcacgttgagtggcttgctgctgggcggcggcctgggctttgccatgggcctgtggctgggcctgtcgcggcgcagtgagcgggtgctcggcccgaccttggccgcgctgcgccagatcgcgattttcgcctgggtgccgttgctcacggcgtggttcggtttgggtgaattggccaagtcggtgtttatcgccctggcggcgtttttcccgctgtttatcgccacccaacgcagcgtcttgaacctctcgccacagctgcgcgaggcggcgcaggtgttgcgcctgaacctgttgcaacgcttgcgccgcctggtgttgcccggcgcagcggcggggattttcgccggcctgcgcctgagcctgatctacgcctggctgggcaccatcggcgcggaatatttcatgccgtccaacggcggtatcggcagcctgatgatcggcgcccaacagctattgcgcatggacgtgatcatgagcggcatgctgctggtcggccttaccggcgcgaccctcaattttatcggccaacgcatcgaaacccgcgcaacccgctggagacacgcatgaacgcacctatcgtcagcttcaaccatgtgggcaaaaccttcgacgtcgacggcttcgaactggaggctattcgcgaattcaacctggagattgccgagggtgaattcgtcgcgattgtcggttccagtggctgcggcaaatccacgctgttgcgcctgttggtggggctcgatacgcagtttcgtggcgagattcaggtcgacggcaaagcggtaagcggcatcggtggcgagcgcggcatcgtgttccaggaacaccgcctgttcccgtggctgaccgtggcggaaaacatcggcctgggcctggtcaacgagccgctgagcgaggccgagcgcaaccggcgcatcagcgattttatcgagctggtgggccttagcgatttcacccgcgcctaccctcatcaactctccggcggcatggcgcaacgggtggcgattgcccgtgggctggtggcgagcccgcgcatcctgttgctcgacgaacccttcggcgccctcgatgcgctgacgcgccagcagatgcaggacgagctcctggcgattcgcgctcgcgccaaaatcaccacggtgctggtgacccacgatgtggaagaagcgattttccttgccgaccgcgtggtggtgatggagccgcgtccggggcggatcaagcaggtcgtggatattgacctgccccatcctcgccagcgcagcagctttgaattccatcaactgcgcgaagaactgctgcacgaactgatcagcgacggccactaccagccgcccgtgcgcgaacagattcgtgacctgcccttggcctttattgcttgctgaacgcgagttcggcgtccggttgcgcctggcgttcaagccgattggcgcgggcgaaggtgccgaaatcattgaagcgcacgcccatctcgcgcatcacgctgtgcgccaccttggccgtcatctggcggatgtaaaacggctctttcaccacaaaatggtggatgccatgggtgctgccgaagttgaagcagaacgcctgcagcggccacatccaccacgggttgagcacttgggtttgctggatcacattgcccagctccacatcgccgtagtagtgcatgttggagctgacaaagtgcaggcaaaaagtgcgcaatacgttggggccgatgatcaccacggcggcgatgtcgatcacgtgcatcatctgcaatgtgccggctgaccactcgatcggcgtgcccatcaggctggcaatgccattggcggcatggaagccgaggaatacataccacgcgccccaatgcagtagcgccagcggtgcgtaaaccagcagggagcgcttgagaatcttgagtttgtgctgccaggtcttggcgcgcagcatgcggataaaggccgacatgacgttgtcacccaccatcagcaaccgcgcaaggccccacggctcgccattggtgatggcgcgttcttccatgtcagtctcggtgcctgacaccttgtggtgattgaggtgcaggtggcggcggatccacgggttgatggtgctcggccgcgccagccacaccaggcccatcatcaggttgtgcgcaacgcgctgcttgcgaaagtacatgctgtggatcaggtcgtgttccagctcgtgggtcagcgaggcgaagaaggcgttgagcagcaggcacacccaccaggccatatgcccggtgatgtacagcgccgcagagccgagcatgccgagcaaggcaaacgccagaatgcccgcgcccagcgcgtcctggtggcgcagccaggggtgctgctggcgcaacctgaggccttcggcgagcaccacttcacggatatgtgctgaacgctgttgcgcgttcatctgttggggacttgcagaagtaccgtccatgctcccatcctcttgtttactgatgcgtccatcctgccccaagcgatctggcaggacgctagccccggacgccaacttgttgaccgcaagcgccaatcgtcatgaccgaagccacttccctcgccagttggacccgcgccctgcgcaaacagctcgatgccctggacctcgacagcgccgcgctgtgcgcccaggccgggcttgacccgcagcagatggacgacccgaatgcgcgctacccgttgtcggccaccacacgcttgtgggcgctggcagtgcaggccagcggcgacccggccattggcctgcgggtgtcgcggtttgtcagccccaccacctttcatgcgctggggtatgcgctggtggccagcggcagtctgcgtgaggtgttcgagcggatcgtgcgttaccaccaagtggtcagcgatgccctgacactggagcttagccgagagggcgaacgctatcgctttcgcctgctgcaaccgcccggcagcccggcgccggcgctggaagcgattgatgcgtttgcggcgatctatgtgcgcacctgccgtaatcgtctgggccgtgaatacgcgccgctggcggtgtacctgcggcggccggaaccggctgatcccaagccatggcacacggtatttcgcgcgccggtgttttttggcgccgaggaagaccgcctggagtttgccgcgcgggatttcgacagccacttggacgacgccaaccccgagttggccgaacacaatgaaaccgtgctcaaacgcaccctcgcccagctgcaaccgctgacctgggagcgcaaggtgcgcgcggttatcgaggcgcagttgcccgaaggtgagcccagcgccgagcgggttgcccaggcgctgcacttgagtttgcgcagcttgcagcggcatttggcggatgaaggctgccggtttgatgcgctgctcaatgagtgccgggagaacctggcgctgctgcacctgcgcgacccgcagtgctcattggctgagatcagccatttgcttgggtttgccgataccagcagttttaaccgggcgttcaagcgctggacggggctgacgccggggcagtttcgggatgggttgcggtaggtagatgtggggtgagtttgagggcctcatcgcgggcaagcccggctcccacattttgatttgtgaacacggtcaaatgtgggagctggcttgcctgcgatgacggtggttcaggcactgcacatcctggatcagtcagcgccctcgatcccggcgcaataatttccttacccgcgccaccagtgctttggcatcaaacggcttgagcaaataatcatcctcatgcaattccaatccccgcaaccggtcttcaatcccgcccggcgtggtcaggaacaacatcggcgtctcacccttgagccgaatcgcctgctgcaacttccaggcattcaagcccggcagcatcacatccaggataaccagctcgtattcagtgctctcaacccagcgcaacgccgccatgccattggccgcgacttcgacgctgtaaccggcctcgttcaaaccctgggccatccgccgtgcctcttcggcttcatgttccactaacagcacacgcataacgcacctcgattgatcaggcttgcaggctaacaccctcaggtgtgcgccgcctcacgcagtcgcggcgcatcaaggatttcgatctcgccatagcccaggcgcacgatgccttgggcctgcaagtccttgagcaacgcgttggtggtttggcgtgacaggctcagcatcgccgccaggtcttcctggggcagttgcagcacgctttttgaacgctcggtatcgccataaccttccacaatcatcaacaaacgatgggccaggcgaaccgaagccggcatcaggctcagctgttcgatgttgataaagctcaggcgcagtttctggctcatcagcagcgccaggtcgcgccagtactggggcgactcgtcgaggactttcagcagcgcgtgctgcggcacctgcaacagcgtgcacggcccgacggcgcaggcatcatgggtgcgtggcaggccgtcgaacaggcagatttcgccaaaccagtacggcagctccaccaggctcaacagcgcttccttgccgtgctcgttcaccgcgctgatgcgcaaggtgccgtcgagtacggcatacaggccacacggcgggtcgccgcgcttgaacaggtactgccccgccgccagctggcgcggccgggcgtgggccagcaggctatgctgaaaagcagcaggcaagtggctgaaccactgaccggtggccagctgcgcgtgccatttctgtgtgtccatgagcactccgaagattgtcgcccagctgacagtcagtggcaggccgacagggcatgatcaaacatcctacaggaggaacaacaatgaaaagcctcgtcgaccacctcagtcaatacgccgcctaccaccgcgacccgcgcaatatcgccagccactttatcggcatcccgctgattgtcgtcgccgtggcggtgctgctgtcacgccccgaatgggcaatcggcagcctgtggatatctccagcggtgctgctcgcgctgttttcggcgtggttttacctgcgcctggaatgggcgctgggcgtgctgatgacgctgttgatgggcttgtcggtgtgggccgggcatgtgttggccgcgcagagcacagcggtatggctgggcagcgggatcgggatgtttgtggtgggctgggtgattcagtttgtcggccactattacgaaggcaggaagccagcgtttgtggacgacgtgtcggggctgattgtggggccgttgtttgtggtggcggagttggcgtttctagtggggttgcggggtgatctgaaaagcaagatcgagcagcgctcggggccggtagaacgccgcgatctaaagccaagcaaggtgtaaatgtgggaacccggtttgtgtgggagctggcttgcctgcgatgccagcgcctcggtatttcaggtagaccgaggtgatgctatcgcaggcaagccagctcccacataagccagcttccgctttgatgatcgttcccacgctctgcgtgggaatgcagcccaggacgctccgcgtcccaaagcgtgacgcagagcgtcacaagcggcgttcccacgcagagcgtgggaacgatctgaggatcaggctttttgccagaccttgggtttgaagaacaaggtctcgccacgggccaaaccggtcaggctgtcgtggtctttcaccacttcagcctcgatcagctcgctttggccttcgaccttcaaggtcacccgagtcgttgcaccaagcggccgaatatcacgtacttcagccgcatggtgatcttccagctcatgccgcgacagcgacacttcgtgcgggcgaaacagcacgtgtttgtcctcgcccaaatgcaggcggttggaatcacccaggaagtggtagacaaaatcgctggccgggttttcgtagacgtcgcccggtgagccaatctgctcgatcacgcccttgttcatcaccacaatacggtcggcgacttccatggcctcttcctggtcgtgagtcacgaacaccgaggtcaggttgatgtcttcgtgcaggcgcgccagccagcggcgcagttctttacgcaccttggcgtcgagggcgccgaagggttcgtccagcagcagcactttgggctctaccgccagggcacgggccagggcgatacgctggcgctggccgccggagagctgttccgggtagcgatccgacagccaatcgagctgcaccatgttcagcagctcgtggacttttaccgcaatctggctttcattcgggcgctggtttttcggcttcatgcgcaggccgaaggcgacgttgtcgaacacggtcatgtggcggaacagcgcgtagtgctggaacacaaaaccgacgttgcgatcacgcacatcgtggccggacacgtcctcgccgtggaacacgatgctgccgtcatccggggtttccaggccggcaatgatgcgcagcaaggtggtcttgccgcagccggacgggcccagcaacgccaccagctcgccactctggatgtccagattgatgctgttcagggccttgaaggcgttgaagttcttgctgacattacggacttcgatcgacatgacttattcctcaccggcgcttttgcgcaggcggttgatacggttctcgctccactgcttgagcagcaggatgaagagcgccaggatcagcaacaggctcgcgacggcaaacgcggcaacgtggttgtattcgttgtagaggatctcgacatgcagcggcagggtgttggtcacgccgcgaatgtggccggacaccaccgaaaccgcgccgaactcgcccatcgcgcgtgccgtacacagcaccacgccgtagatcaggccccatttgatgttcggcacggtcacgtgccagaacatctgccagccattggcgccgagcaggcgcgcggcctcttcttcctgcgtgccctgctcctgcatcagcgggatcagttcacgcgccacaaacggcaccgtcacgaagatggtcgccagcacgatgcccggcaaagcgaatacgatctggatgtcgtggtcttgcagccacgggccgaagaagccctgggcgccgaacatcaacacgtagaccagacctgcgatcaccggcgacaccgagaacggcaggtcgatcagtgtgaccaggatgctcttgccacggaacgagtacttgctcacgcaccacgccgcgctgacgccgaacaccaggttgagcggcaccgaaatcgccacggcgatcactgtgagtttcagcgccgacagcgcgtcgggctccaggatggcggtgaagaacgcaccgaggccattcttcaaaccctgggacaccacgataaacagcggcagcagcaggaacaggaagaacaccagccaaccgaggctgatcaggatgcgccgcgacaccgcgctgccacggcgggcagcattggccgaagacgcggcggaaatagacgattgggacatgttccgcgcctccttatgggtgttcgatgcgccgctgcagcaagttgatcagcagcagcaggacaaaggaaaccaccagcatcatcacgccgatggcggtggcgccggtgtagtcgtattggtcgagtttgaccatgatcagcaacggcagaatctcggttttcatcggcatgttgccggcgatgaagatcaccgaaccgtactcacccacgccacgcgcgaaggccagcgcgaagccggtcaaccaggcgggcagcaaggcgggtacgaggatgtagcgaaacacctgcaagggcttggcgcccaggcaggcggcggcttcttcgatttcccgcgggatgtcggcgagtaccggctgcaccgtgcgcaccacgaacggcagcgtgacgaaggtcagcgccagggtaatgcccagcggggtgtaggcgatcttgaagcccaggtcggcggcgaactggccgaccagcccggtgggcgtgtacagcgcggtcagcgcgataccggcgacggcggtgggcagggcgaatggcaggtcgatcatcgcatcgatgatcttgcgaccggggaaggtgtagcgcaccagcacccaggccagcagcgttccgatcacgccattgatcagcgcggcgtagagcgcggtgctgaagctcagtttcaatgccgccagcacacgcggtgcggaaataatggcccagaactgatcccaagtgagttgagcggcgtgtacgaacatcgccgcgagcgggatgagtacgatcaggctgaggtacaccacggtgtagcccagcgtcagcccgaagccgggtatgacgggggaaatacgacgcgacataagagtccttggttaaaaggtagaaaccactgtaggagcgcactctctgcaggacctggctcttctgtaggagctggctcttctgtaggagctggcttgcctgcgatgcaggcaccacggtgtgtcaggcacactgcggtgatgctatcgcaggcaagccagctcccacacaagccagctcccacacaaaccagttcctacagaaaggttcgctcctacaggtactttggcttactgcgccgagtagatctggtcgaacacgccaccgtcgttgaagaatttcggttgggcagttttccagccgccgaagtctttgtcgatagtcaccaggtccagtttcgggaactgctgggcgtatttggcggcgactttctcatcgcgtgggcggtagaagttcttcgccgcaatctcctggccagccgggctgtacaggtgcttgaggtattcggtggcgatttcggtgttgccctttttctcggcgttcttgtcgaccacggccactggcggctcggcgaggatcgacagcgaaggtacaacgatgtcgaacttgtcggcgccgccgtcttctttcagggccaggaaggcttcgttttcccaggccagcaacacgtcaccctgaccgttgttgacgaaggtgatggtcgaaccgcgagcaccggtgtcgaggatcggcacgtgcttgaacagctccttcacgtattcctgggccttggcttcgctgccaccggctttcaggccgtaggcccaggcggcgaggaagttccagcgggcgccgccggaggttttcgggttcggggtgatcacggacacgtctttcttgatcaggtcgccccaatccttgatgcctttagggttgcccttgcgcaccaggaacacgatggtcgaggtgtacggggtgctggcgtccggcaggcgggtttgccagttctccggcagggtcttgcccaatttggcgatttcgtcgatgtcaccggccagggccagggtcaccacgtcggcgcgcaggccgtcgatcactgctcggccttgcttgcccgagccaccgtgggattgctggatcttgacgttgtcgccggggtgggactgtttccagtagttggtgaactcagcgttgtagtcctggtacagctcacgggtcggatcatacgagacgttaagcaactcgtagtccttggcaacagcggaaccggcaaacacagcgctggccagtgcggccagggcgtaacggcgaatcgacgacatagaaggctcctgaaattcttgggtgttggcttttcttatagttgcgggtctatcgccggtggtgcttaagccggtttgttgcccgggttctgcaaacggaatttttccttgcgttcgatctgtaccacttgggcgttgtgcacagtgatttccaccgcgccaaaccgcaggtcgcgcaaggcgctctggatctcacgcaaaatggctgcttcgtcctggccgtcgacgctacgtagagatgcgctcatggtctcgctcctgaaatgaatagtgcctggcagtggcggcactgcttgcggcgtgagggcgatagtagataagcgcggatattcttaaaaatactatttaagaatgtttatataaccagaaagaattttctggcaggacgtggggttgcgcgggttttagcgacgtcaacactgtaaataagccgtgccgagatcaaaatgtgggagcgggcttgctcgcgaatgcggtgggtcagccacagatttattgactgacactccgcattcgcgagcaagcccgcttgtgtcttgagccaggtttaaactgaggttgagagcggtgagtggcaagctgaatgccc

SEQ ID NO: 53 - DNA, 87950 bp, Pseudomonas poae FL10F
ccgctcttacagcgggtcactttttgagggaccaaaaagtaaccaaaaagtcctcgccccaccactcggcacctcgctcacgcttcggtgtgccctcactccggcttgaatccgtgggccgccgcaatgggccatccctggcccagtgcggctaacccggcgtcctgccgggttacccccgctccaaagcctgcgttcggccagcgtggttgatggggcgcctcagatcaaaatcaagatcaaaatctacagcacggcggcctagtagccgacctgagtggttgaagcaaaagcagggcaaaagcacatctacctgattgactgagatccaaaatgtgggagcgggcttgctcgcgaaggcggtggggcagtgacacatgagctggctgatacaccgctttcgccagcaagcccgctcccacagttttgaccaagttcgaccgtcagtcctctgtgctctgcttttctgtgggagctggcttgcctgcgatgcaggcacctcggtgtatcaggcagaaccagttgatgccatcgcaggcaagccagctcccacatgtgattgagttcagcttcaatgaaaaggtcggctgtcaggccgcctcggccttgcttttgatctaaccactcaggtcggctactaggccgccgtgctcttgcttttgatcttgatcttaggcgccccgttaaaccacgctggccgaacgcaggctttggagcgggggtaaaccggcaggacgccggtttagccgcgctgggccaaggatggcccatcgcggcggcccccgctccaaagccggagtgagggcacaccgaagcgtgagcgaggtgccgagtggtggggcaagagcccttttggttacttttggctgggccggcattccgggctcttttccaaaagtgacccgccgtaagggcggaacccatatacgccatcacccaaataacggatatgtactcaaccctctaaaaaaccagcccccagctaaaccttgaactggcgcagtaacccacccagctgctcactcaacccacgcaaatgcgcactcgccacgctcgattgctccgccgccaacgcagtgctgtgagacagcccggccgcctgggtgacgttctggttaatgtcctccaccacatgcgcctgttgcaacgtcgcgctggcaatcgacgcattcagcccgttgaggttacgcagcgcctgcccaatggcggtgaggctcgcaccggcctggccggcctgttcaatcgtcaattgcgaggcgctgtggctgtcgctgatcactttgaccgccgcctccgagtgcccttgcagacgctcaatcatcacctggatctcagcggtagatttttgcgtacgctgagccagcaaccgcacctcatcggcaaccacagcaaaaccacgcccctgttccccggcgcgcgcagcttcaatcgcggcgttaagcgccagcaggttagtctggtcggcaatcgagcgaatcacctccagcacgccaccaatctgcgtgctttcgctggacaaggtgcggatcacttccacggcctggctgatggtgctcgaaagctggtcgatctgctgcaagctgccgtcgatattcacctggccctgctgcgcctgagcctgtgcatcgcgcatttcgctggcggcgtgttcggcgtttttcgccacgtcctgcacgccgtaggtcacttcattgatcgccgtcgccaccagctccatctgctgcgactgttgctggctgcggtcatgggcctggctggcgttggtgcccagctccgtcgacgactggcccaaggcgttggcgcacacttgcagttggccgaccacctgacgcagcttggcggtaaaactgttgaagtgctgggacagctgggtgacttcgtcacgcccgtgggtgtcgaggctgcgggtcaggtcgctttcgccactggcgatattggccatggcattcaccgccgcctgcaacgggtgcacgatgctgcgggcgatcaacaggaccagcacggccatcaccagcgcgatgcccaggccgatcagcgaggcgttccagacttggcccttgaactcggcctgcacgtcatccacgtacacgccggagccgatgatccagccccagggttcgaacagttggatgtaggaggttttctccaccggcgcttcggcacccggcttgggccagcggtagttgacgataccggcgcccttggccttggccaggatcacgaactcgttgaataccgcaaaaccgtccgggtcacgaatcgccgagaggttctggccatcgagcttggggttggccgcgtgcatgatcatcacgggcgtcaggtcgttgatccagaaataatcgtcgtggtcgtagcgcaggccacgcacggcgctcagggcctgcttttgcgcgacctcgcgggtcagcacgccggttttctcgaggttctggtaataggccagcacgccactggcggtctgcaccacgtgttgggtctgcaggcgcttggcctggtagaggtcgccatggatctgcttgagcatcaacagccccaaggtcagcagcatcaacacggcgactatcaggatcagccacagacggcggctgatcgacatgttgcgcaaactgttcatcgtcctgtcactccctgctttttataattgtgtgccgcatcgacaattccagcgtgtctgataggctttcggcctgtaatcgaaaaacctgagtactccctgatttttcacgaaatttttgcaggccgatggtgaaaatcagccgcggaaattgagtgcgcttgcgtcagtgaacattaaaaagacagtcaaggcatgccacagcgcatgacctttgggggaagcatggatttttggaccgccatacaggcattgattcttggcgttgtggaggggctgaccgagttcctgccgatttccagcacgggccaccagatcatcgtcgccgacttgatcggcttcggcggcgaacgttttgaagcgtttaacatcatcattcaattgggcgcgatcctggccgtggtctgggagtttcggcgcaagatcctcgacgtggtcatcggcttgccgacccagcgcaatgcccagcgtttcaccgtcaacctgatgatcgcggtgctgccagccatcgtgcttggggtgatttttgctgacctgatcaaacattacctgttcaacccgatcaccgtggccaccgcgctggtggtgggcggggtcatcatgttgtgggccgagcgtcgccaacatgaagtgcacgccgaaaccgtcgaccagattacctggaaggacgccgtcaaagtcggcttcgcccagtgcctggcgatgatcccgggcacctcgcgctccggcgccaccatcattggcggcctgctgttcggcctgtcacgcaagaccgccaccgagttctcgttcttcctggcgatgccgaccatggtcggtgcggcggtgtattcgggctacaagtaccgtcacctgttccagccggatgacctgccggtgtttgccatcggctttgtcacctcgtttatcttcgcgatgattgcggtcaaggccttgctcaagttcatcgccagccacagctatgcggcgtttgcgtggtatcgcatcgccttcggcctggtgatcctggcgacctggcagttcggctggatcgactggtcggcggtcaagccatgaatattcagcacccgcgcctgaaggcgctgatctttgtgttgctgtgcgccgcgccgttgctgggggcggcactggtgtggcagcgcggtgagacggtgattccgctggcggcctatggcgtggtcagcgtggtggcgtttttcctgtactggggcgacaagcgcaaggcgcaatcagacggcccgcgcgtgcgcgaaaacatcctccacgccgtcgagctggcgggcggctggccgggggcgttgatcgcccagcaagtgttccggcacaagacgcgcaaagtgtcgtaccaagtgctgttctgggtgattgtgttgctgcacgaggtgttctggctggatcagttgttcctcggcggcacgctcgtttcaatcctctagccgcaagccgatctgcgtgcgcttgggcagcttgctcaccaccaattggtgtgagcgttgcaacaggccacgcagttcctcggcgcccagcgggtagggcgtgttcatgatgacccactgggcccgcgccaggtacggcgccgggtgaatgccggggcggtccacatggccgaggaacaactccttgtcgaccttgaacgccaatgaatcgccccgcaggttctgcagggcgaacatcttgttgccggcaatcgaaaagacgcgcacgccgccccatttatagtcttcccgcgcgccgggcaggctcaggcagaaggcggcgacttgggcttcagtcatgttcatagcaggcgatctccgcagcccttgaaggcttcttccaggtagtcgatccaggctcgaatggccggcagcacgccacgtcggtgtgggtagactgcctgcagccagccacccggcgatgaccattgcggcagcagttgcaccaactggccgctggccaattctgcttcgcaatacatcatcggcagcacggtaaagcccaggcctttcatggcgcaggccttgcgcacgatgaagtcgtcgatgcccaggcgggcttccagtgccaggtcttcgctcttgccttgtgggtcgatcaggcgcaggtgcaccaggcggtcggcttccagggcgccgagcaccggcagttgcttgaggtcgtcgagggtgttgatgtgccgctcgcggatgaattccgggctggccaccaggagggtctgcgcctggcgcaggcgcttggtcaccagcaacgggtcttcatcgcccgattcgcgcacgcgcaaggccacgtcgatgccctcggcgaccaggtcgacacggcggttgaccaaggtcatctccagctgcaccagtgggtgagcggcgagaaaccccgcgaccatgtccggcagcatgtgctgggccatgcccaccgggcagctgacccgcagccgcccgcgcggttcgctggacatgctggccacggcctcgtcggccatttccgcttccagcagcatggcctggcaatggcgcaggtagcgctcgccgacggcggtcagggtcaactggcgtgtggtgcgttgcaacaggcgtgcgccgaggcgttcttccagctcggcaatgcgccgcgacagccgcgacttgggaatccccagcagccggcccgccgccgcaaagccgccggcttcgacgactttggcgaaatagtagaggtcattgaggtcttgcatgggcaacctattgtcctgtcagtgggacgaatcatccgcgtctggcgagggcaaatccactaaaaatagtggcggcctttgtggcgagggagcttgctcccgctggggtgcgtagcgcccccaaaaaaagcgggagcgctgcgcactccagcgcaagcaagcttgctcgccaccagaggccagtttctaaaggtgcgcgccggccatcagcacatacttcacatgcacgtactcttcgatcccgtaatagctgccttcgcggccataaccggactgcttgatgccgccaaacggaatcgacgcagtgcccaccgaacccgagttgagaatcaccatgccggcttccagctggcgcgacagccgcaacgaacgccccagtgcgctggtgtaggcataggcaaccaggccgaactcggtctggttggcgcgggcaatcacttcctgttcatccttgaacgaataaatggcgaacaccgggccgaaaatttcttcggtggccagcggtgagtcgtcctgcaaaccggtcaatacggtcggctcgtagaacagcccacctttggcgtggggcttgccgcccatcagcaccttggcgccggcggccctggcgtcttcgaccaggcgcacgactttgtcgaagcccagttgattgaccagcggcccgaccacaaagtcttcgcgcaggccttgatccacgtcgatcttggcgacggcggccttcacgcgtttgatgaagtcttcgaggatgctgtgctgcacaaagatgcggttcggcgagatgcacacttggccggaattacgcagcttggcgctgaccaaacccttgaccgcttcatcgaggttggcgtcctggaacacgataaacggcgcgttgccgcccagctccagggtcattttctttagggtggccgcgcattgcgccgcgagcaatttgccgacgccggtggagccggtaaaggtgattttgcgaatgcgtgggtcaccggtgaagatcaggccgatctccttggggtcgccgaccaccacttccagcacgccgggttcgataccggccttgcgtgcgtattccagcagcttgaaggcggtcagcggcgtgtcttcggcaggcttgatcaccatggtgcagccggccgccagggccgtagcgactttgcgcgtgatcatcatgaaggggaagttccacggcgtgatcgctgcgaccgggccgacggcttccttggtcaccaccacgttggcgttgcggtcgtgggtgggaatggtgtcgccatacacgcgcttggcttcttcggcgtaccactcgataaagcccaggccgtagtcgatttcgccgcgggcttcggtcaggcacttgccgttttcgcggcacagcagttcggcgaaggcttccttgtcggtcttcaccgcgtcgtgccagcggcgcaggatctcgctgcgctccttggccagcctggaggaccatgcagggaaggccgcgcaggtgcggtcgaccgccgccttgacctcggctgaggtgttcttggcaacgcggccgatttcttcgccggtggcggggttgtagacaatgagcatgaggcaatctccgggggctgaatgggctgtttcaggctacggaaacgggcgtcgcgagcgaatatccattccaatgtgctgattgcctattcctatgagcgcgtagccacggcgacgtttgcgcagtaacgtgcggtttttcccaggagccttgcagcatgggccgcacgcaacgaatcatcgagttgatgggcagcttggcgcctgtcgaaggctataacctgaccgcgctggacgacgtgcgcttcctgcgttccaatcggcctttgcaccgggtgccggttctctacgacccaggcattgtgattgtctgccaggggcgcaagcgcggttacctgggcgacgagatttacctgtatgacgcccggcactacctggtggtgtcggtgccggtgccattcaccatggagaccgaggccaccgaagaagaacccatgctggcggtgtacctgcgactggatttcaccctggccgccgagttgatgctggcattggaggactttccggcgtctgtcgaggccaagccccgcggcatgtattcatcgccgatggatgacaagctcggtgagtcgctgctgcgttttctggaggccatgaatacgccgatggaggcgctcatcctcggcccgtcgctggtgcgcgagatttactaccggatcatcacgggcgagcagggcggttcgatgcgcgccgcgctcaaccgccagggccagttcggcaaggtggcgcgggcgatccgcaagattcatgggtgttaccaccagcacctggacgtagaggcgctggcggcggaagcgatgatgagcgtgccgagttttcacgcgcactttcgcacggttaccgacacttcaccgatgcaatacctcaagtccacgcgcctgcatcaggcgcgcttgttgatgctgcgcaacgacatcacagctgccacggcgtgtgctcaggtgggctatgaaagcgcctcgcagttcagccgagagttcaagcgcctgttcgggcgcacgccgcagcaagagattcagtggatgaaacgcacctacgcgctaccggcacctgcgtcggcgtctatttatgtgtcgtcgcattgattgcgaggagcgggttggtgtcgtggcgagcgggcttggtgtggcgagcgggcttgccccgcgttgggctgcgcagcggccccaatacagaccccgcgcagtgtcaggcagaacgcggtcgcctggtttcagggccgcttcgcgccccaacgcggggcaagcccgctcgccacaccaagcccgctcgccacaccaagcccgctagacacaccaagcccgccagccacaacaggcccgctgccacaaggttactctcgtgctttgaacagggtcagcagcaatgccagcccggcaaacgccgcaccggtcagcgcctggccctgccagccgtaatgctgcgaagcgaacgccccggcggccgaacccaaggcgccgccgataaagtagaccaccatgaacaccgtgttcaggcggctggtggctgacggttccagcgccaatacgcgggtctggttggccaactggttggtgcggttgccgaggtcgagaaaggtcgccgcgatcaggatcggccaccaccagccgctgaggcccagggtgtagatcagcacaaacgcgaccagcaccgtggcgatgccggcgcgctccagcaaacgcccatggcgtcgggtttgttggccgatggtcgatgcgcagaggatgccgacgatggccgacaggcccagcagccccgcctgggcgctggaaaacccatacggcggcaacgccaacaaggccgccatcgagccccagaacacattcaacgcgccgaacaccaacgcgcctttaatggccgattggcgcaaggtcgggtactggcgggccaggccccacagggatttgagcaaggcgccatacgccagtttgctggtcgagatcgacaccggcatgcgcgtcaggatcgccataaacagcagcacatccagcgccgccgccacggcaaacatgccgcgccagcccagccagccgctgaccacgccgctgacggtgcgggccagcaaaccaccggccgacaaaccgctgaccatcaagccgagcaccgcgcctttctgttcaacggtactcaggtccgaagcggcggggatgatcacctgcgcactgatgcccgacagccccagcagcacgctcgccaccagcagccaggcatacgacggcgccgtggccgaggccaacagagcaaagaagttgatgcacagcacggccaggatcagcgtgcgccggctgatgcggtcgcccagcggcacgaacagcagcaggccactggcgtagcccaattgcgtgagcatcgcgatttgcccgacatgcgcggtggacacctcgaaggtgttggcaatcagcggcagcatggcttggttgtagtaaatcgtggcgaccgaaaacccgcagcagatggcgaggataagggtcaggcccttggtgagggcgggcgtgtgtgggtgcatggcgtggccgctggctgtagaaactgcggcgagaatgaagtgaagcgtgggggaaatccagtgccgcagaggattgggcaacacgcgtgttggattgggttttcgcccctttatagattgtcctgctggcaggacgaacaatcacatccgagctgtctaatcggctattggcttcatgtgtaggattaacctcactcggtcgcctcatcgcgatcctcacttggagattccgcatgaaactgttgcatatcgattccagcatcctcggcgacaactcggcttcgcgtcagctcagcgctggtgtggtcaaggcctggcaagcggcggagccgggtgtggaagtgacttaccgtgacctggcaagcgaaggcatcagccacttttccggcctgaccctgggcgccctgggcactgctgccgaattgcgcgacgccgtgcaacagcacgaggctgaactgagcgcttcgtcgctggccgaattcatcgcggctgacgccgtagtcattggcgcgccgatgtacaacttctcggtgccttcgcagctcaaggcctggatcgaccgcatcgccgtggccggccagacgttccgttacaccgaagccggccctgaaggcctgtgcggtggcaagaagctgatcatcgtgtccaccgccggcggcctgcacgccggccaggcaagcaacgtcggccacgaagactatttgaagctggtgtttggcttcctgggcatcaccgacatcgagttcgtccgcgcccaaggcctggcctacggtgaagaagtgcgcagcaaagccctcagcgacgccaacgtggtcatcaacgaacaattgttcgccgccgcgtaaggcttgtgtaaatttcgcctttgcccggttccaatctgaaaccgggcgcctaaactctgtattgtggtcgcctgaaaacgaccggagtacggagttttttcgtttgcccgctgtcactaccttggcccaggttatgcacgtatgggtttatcaaccggtgcgagcgccttgaaccatggacttttcatatagacatgccgctggtgttaaacgtggccgcgcagcaaaggtggacatccccatgatgcgtctttgtgctgttttggttctctccctgctcggcggcctgatttcagtgcacgccgccccagcgccgcacccgcattggagtgtgggcttccatcgcatgacctttctcgacccgctggattcgcagccgatgaaggccatcgcgttttatccgtcgaccgacgatgaacacagtacccaactgggcccctatcacgtcgccgccagcgaagattccaaggtcgccattggccgctttccgatgctgatgctgtcccacggcaacaccggcacaccgctggccctgcacgatttggcgacgtccctggcgcgcaaggggtttgtggtggtggcggtcctgcaccctggcgacaactacaaggatcacagccgcctgggtacggtgagtaacctgtatgggcggccgatccagatctccgaagcgattaccgccaccctcggcgacccgatgctgtcgccgttcgtcaacgttgatcaggtgggcgtgatcggctactcggccggtggcgaaaccgcgttgatcctggccggcgccaagccggactttgaccgcctgcgtcgctattgccaggagcgtccggaagaccgcgatgcctgcaccaccaaaggtgagctggtggtcgaccgtgacgacctgcaaccccaggccgacccgcgtattcattcattgatgctgatggcgccgttaagcctgatgttcggccgccacaccctggctgatgtgcatgtgccggtgctgctctacagcggcgatggcgacaaactggtcgccgtggacaagaatgccgccgccctggcgcgcaaactgccggagccaccggacttcaaactgttggcgggggcagggcacttcgtgttcatggcgccgtgtgacagcgaccaattggtggcgatgcccgctatttgcaccgacgccgacggtgttgaccgtgaaggtattcaccgcgacctgatttcagaggcgggacgtttcttctcccacaccctgggccaatcgacccgagccggtttacagaccgccgatcagtaagcgcggcgcttgagcagcacggtcagggccagcgccgtgaccgacagcagcgcggcgcaaaagaagatccagccgtagcccaggttcagcgctacggcgcccatcaatggcccggcgatcgccagggccagatcaaaaaacactgcatacgcactcaagccggcgccacggctactgttgggtacctgtttgatggcctcgacgcccagcgccgggtacaccagcgacaagccgaacccggtcagcccggcgccaatcaaggccacgcctgttgagggcgccagccacagcagcgtcaggcccagggtttcgatggtcatgcaggcaatcgccgcagtgaacccgccaaaacggctgatggccgagataaacaccaggcgcgacaggataaaacacaggccaaacaccgtgaggcagtacgccgcgccggcccagccgcgattgaggtaatacagggtgatgaaggtggtcagcgtgccgtagccaatcgacgccaggcacaggctggtgccaaacggcgcgatacgcccgaacaccgcccaaaacggcagccgctcgccgcgtaccaccggcaccgagggcttattgcggatcagcaccaggcccaacgccgccaacacggtgagggcgatgccgaggctggtgtagccatagtcggcgaccatcaccacccccagcggcgcgccgatggcgatggcgccgtaggaggcgatgccgttccacgaaatcgagcgcgccgtgtgctcggcgccgaccgcgcccatgcaccaactgatggtgcccacaccgatcaagccttgggccacgcccagcagcagccggccgacgatcaggatgcccaggctcaaggcgggcaggctttcgaacaaggtggcgaaaaacgtcagcacgccactgaccagaataccggccaggcccagcacgatggcgcgcttggtgccgacgttgtcggacatacgcccggccatcggacggctgagcagggtggccaggtactgcgaaccaatggtgaccccggcgaccacggcgctgaagcccaactgctcatgcacatagcctggaatgaccgcaatcggcaggccgatgcagatgaaagcaatgaaggtgtagaagacgatggagacgatctgcagggtgatcgacagggaactgggggcggcggcaggcatggtcactcgttcgcgggcgggcggtgacggcatgatggcaagggcgtgggggaaaagaaagcaggctaactagtttgtttgatcagcgagcgggcctgttgtggcgagcgggcttgccccgcgttgggctgcgcagtagccccaataaaaaacaccgcgttctgccaggcaaaacgcggtgtctgatttcagggccgcttcgcagcccaacgcagggcaagcctgctcgccacaacaagcctgctcgccacaacaagcctgcctgccacaacaatccagctcacagggcaagcctgcccgctacagtggcgttatttagaacaccacgccttggctgcgcaggtagtcgtcataggtgccgctgaagtcgatcacgccgttggcgctcaactcgatgatgcgggtggccagggacgatacgaactcgcggtcgtggctgacgaagatcagcgtgcccgggtagttttccagcgccaggttcagtgcttcgatggattccatgtccaagtggttggtcggttcgtccatgatcagcacgttgggcttttgcaggatcagcttgccgaacagcatgcggccttgctcaccgccggagataaccttgaccgacttgaggatctcgtcgttggagaacagcatgcggcccaatgtgccgcgaatcatttgttcgccctgagtccactgacccatccagtcgaacagcgtgacgtcgtcttcgaagtcgtgcgcgtggtcctgagcgtagtagcccagttcggcggcgtcggtccacttgatgctgccggcgtccggggtcaactcattgaccagggtgcgcagcagggtggtcttgccgataccgttcgggccgatgatcgcaacacgctcgccggcttcaacctggaagctgaagtctttgaacagtggcttgccgtcgaaacccttggccattttttcgaccatcactgcctggcggtgcagcttcttgttctgatcgaaacggatgaacgggctcacgcggctcgaaggcttgacctcggccagctggattttgtcgatcgccttggcgcgggaggtggcctgcttggctttcgaggcgttggccgagaagcggctgacgaacgattgcaattcggagatctgcgccttcttcttggcgttgtccgacagcagttgctcgcgggactgggtcgccacggtcatgtactcgtcgtagttgcccgggaacaggcgcagctcgccgtagtccaggtcagccatgtgggtgcacacgctgttcaggaagtgacggtcgtgagagatgatgatcatcaggctggaacgctgggtcaggatgttttccagccagcgaatggtgttgatgtccaagtggttggtcggttcgtcgagcaacagcacttcagggtcggagaacagcgcctgggccagcaatacgcgcagtttccagcctggggagacttcgctcatcgggccgaagtgctgttccaggggaatgcccaggcccagcagcagctcgccggcacgggattcggcggtgtagccgtccatttcggcgaactcggtttccagctcggccacggccatgccgtcgtcttcgctcatttccggcagcgagtagatgcggtcgcgttcagccttgaccttccacagctcttcgtggcccatgatcacggtgtcgagcacggtgaattcttcgtaggcgaactggtcctggcgcagcttacccaggcgtacgttcggctccagcatgacctggccgccggacggatcgaggtcgccgccgaggattttcatgaaggtcgacttgccgcaaccgttggcaccgatcaaaccataacggttgccggcgccgaatttgaccgagacattctcgaagagcggcttggcgccgaactgcatggtgatgttagctgtggagatcaattactttacctatcaatgggttgcgagcgtggcggcaggagccttcaggcatgcgtcaacagcgacatcaaggcgcgaaacccggtcgctgagcagaaaattttggatgtgtgttggaatttggcgcgcattgtcgcatatgtcaggtgacagttgtaatgcgtgcgaacgatggttttgccaatgtctccggcatggccagccataacagcgccaaagccagcgccgcaacggcggccagggtcaggaaggccgcgttgtaaccggactgttgcaccacgaaaccggccaggctggtgctcagcgccgcgcccaggccaaacaccgtggacagcgcgcccaggctgacattgaagcggcccgtgccttgggtcaggtccttgacgatcaccgggaacagcgcgccgaaaatccccgcgccgataccgtcaagcatctgcacggccaccagccaataagggtcgctggacaaggtgtacaacacgccgcgcagcggcagaatcatgaagccggccagcaacagtggtttgcgcccccatacgtcggctttgctacccaccagccaggccattggcaccatgaccaattgcgccgcgacaatgcacgccgaggtcagcggcgtggccatttgcagattgatctgcgacagcttctggctgaccagcggcagcatcgcggcattcgccaggtggaacagcgcgcagcaaatggcgaacagcaacagcgggcggttggccagcaacactttcacgccggaaggttgttcatgctcactgctgtgagccgggtcgaagccgcgcgcgacttcgtggtcaatcgccgacgccgacacacaactgaccgcgacgatactggccagcgccataaacgccatcaggtaaaacaccaccaccgggccgaacaggtaggccaggccgcccgccagcagcgcggccacggcgttgccggcgtgattgaaggtttcattgcgcccggtgcggcgggtgaaggcgcgcggcccggttatcccaagggagatcgccgaaatcgccggggcaaacaccgacgcggcgacagcactggccgcctgggtcacggccacccaactgaacgagctgacaaacggcagcaccaggcaactgagggtcaccaggatggcggccaccgcgatcaccgcacgcttgctgcgcgtgcggtcgatcaatgcgcccgccgggccttgggtgagcaacgcggcgatgccggccagggtcatgaccacgccgatgctggccgggtcccatttgtgcacggccagcaggtagatcgccaaataggggccgaggccgtcacgcacatccgccaggaagaaattcaggctgtccagggacaaggtattgcgcaggtcggagtgattggccacggcggtatcttcggcaagggtgtccaggggctgaacactcattggcttagtgacctgcgggcctggctggaagtttcgcgccctggaaggtttcatccgagcggtacttggattattttgcgtagcccgctgtactgactctctggagacgcaatggacatgccctcagcccaacaggccatcgccagcaacaaacacgcctgggatgcatccgccgaactgcacaaagacaccgctaactggaaagcactgctgaaatcggtggcgctcgccgacttttcacgcctggaccccaccattaccgcactgctgcaagaggtcggcgtggccggcaaggacgtggtgcaactgggctgcaacaacgggcgtgaaagcctgtcgctgttcagcctgggcgcgcgctccgtggtgggcgtggatcaatcccgcgccttccttcagcaagcgcaggaactggctgaggtttcgccccacagtccggaatttattgaggccgatatttatcaactgcccgagcgtgtgcacgggcgctttgatatcgctttggtgaccatcggcgtactgggctggatgccggatgtggcggcgtttatgcagcatgcggcgagcacgctcaagcccggcggcacgctggtgatttacgaaactcacccgttcctggaggtgttcgacccgctggccgccaacccgcttttgcccgccacgtcgtacttccagcgcgaccccttggtgttgcaggagtcaattgtctacgaagggctggatgaaattcccggacctacgtcctattggtatgtgcataccctgggcagtgtggtgagtggggcgattgcggcgcacttacagattgaacatctgcaggaatacccgcattgcaaccgtgaggaactgtacgagcagtatgagcatcaacctgcgcaactgccgctgtgttttaccctgacggctaccaagcgcctcgcctgagggcgctgcggcgacgtcacaagcatctaggcctacgtctgcggtctacctgtccgacactgcgtgctgataacgctgataaattcctggcttgattcgtggaaggctgttcctcccttccacaatctctgcggaatcacaggagtatccagtcatggcgcaaatcaaaccgggcctaccttccacgggatacgaggtggtccaacgtgttctcgacgataataagcgcagcggtgggaaaacatcgcaatacggtgatccttctctgaacagcgcagaggttgctcaacggcttaaccgatttggcaaacactggcccgacagcaatcacaatggcaagacagagctgacttttgagttttccacgtcgaggccacgggcatcagaggaaaaccagcaggacatcctcgaatacaaggtcgagcgaatcgtacccttaaccctggggcagaaagcgtttgtcaggaaggtgcaccaggagtatgccgatgtcgccaatgttacgttcactgaaaaagccgcaggcgccagtgaggggcatctgacctacagaggctacagtactggcgatcaagctactgaggttgctgggtttgctcatatgccggacccgaaggatcctgcgcagggtacggtttggatgcgtcatctggatcagacgaccaaattcggcaactgggcggatgatgacaaacgccaaatcagtcacgaaaagtggcgttcgacactgattcatgaggtggggcatggccttggcctggggcattcgcacgcagagggcgaggaagagcttgaaccttattattatgcggaagattcgaatagctacacggtcatgagctacaacgtaccctttctgagtgaggctgaagagactgtctatccagccagtctgatgatggacgatatggcggcaattcaatcagtctacggcgccaattacgccactcgtaacggtgatacgacctacggtttcaactccaacaccgagcgtgatcaatacagcctgaagtcggccgaagacaagccgctatttgcagtgtgggacggcggcggttgggactcgctcgacttttccgaattcagccaaaaccagacgataaatcttaatccgggttcctcttctgacgtaggggggttaacaggaaacgtcagcatcgcccagggtgtgaccatcgaagaggccaaaggcggcaaaggcaagaatattctgatcggcaataacgccttcaatgttctgcggggcggcccgaacagcgatatcctgtttggcggcagcggcggggcacagatgtggggcggcaagggtgcaaacacctttgtctttgataccagctccagcggtaaagcgaactgggtgatggattttaccagcggcaaagacaaactcgacttctctggcttgcgccagcagttgggccctctgaactttgtgtccacgctgccgcatgaccacagtaaagcgcaagacccgctcagcccgacgtttatcacccgcccgggtgatgtgttggtgacctacgatgcagcctttcagcgaacgcacttcaggatcgataccacggggaatggcaaaatggacatgcacattgatgtgcaaggaagcgttgctcgcgaggatgtcgttgtataaaaaaagcccgcgaggagaggcgggccaagtgattcactggagtaggtaagcctcaccctataggccgagaagtgaaggccgtgtgaaaagcgtgtcgcaagttcggatgcgctcggatcagcctctgcgtacaaacgtgcgcatggtttgcccaggcccggtgctgaacaccgtcgggcggggcatacccgcatcggcggcaataaacacaaaatcatcgccttcaaggcggtagctggcgggcaagggcttgccggcgtcttcgcccatcgcgtcaacccaggtaatgctcttgggcgtggtggtgctgtcgagggtaaatcggccggccagcagcacctcgccgtctgtcgtgcgcacttcgaagcagtcgccggtgatggtggtcagagcgcctggagctgtgtgggcatcaaccgggttgagtacgccgctgtcttcgagcgcggtttgctcccaactgccttgaagtgcctggtaatcgctgtttgaaagggctgacatacaaaatccattttgttgaaggaaagttcttgcagtgcagcatggcgcgcatcgcaagacaagcgcaggtgttgatccagcacaatgagtggacagcttttcacaattcttagttaacctttggttacaaactgtggctaaataactgccaatggtcatgaaccggtgctcccatcgccggtcgtgccgcgtatttgtgaattgtgatttcagacgctgcttattcaatcctcggccgttgtgggcatgcaggagcagcctgttctctctactgacgtgtgacgaatcccttgaaactcatcattgttgctctctacgttgcctccatcgcgtatgttcacctgcgtggtcgggtgcgacacaagctgggtcgccagcttagcgaccactcgacgttcctggcgccgatcaattgcttcctctatttgttctccaggcagccaagccgcccgttcctgtcgcctgccgactttccggacctgagcccactgcaggaacactgggaggaaatccgccaggaaggccagaacctgatgcgcatgggcgagatcaagcgctcggagcagtacaacgatgtgggtttcaactcgttcttcaagtctggctggaagcgtttctacctcaagtggtacggcgacagccacccatcggcgatgaagctctgcccgcgtaccaccgagttggtgcaaagcatcggctcgatcaaggcggcgatgttcgccgagttgccaccgggctccaagctggtacgccaccgcgacccgtacgcgggttcctaccgttatcacttgggcctggacacgcctaacgatcctggctgctatatcaatgtggatggcgaaagttactactggcgcgacggcgagccggtgatgtttgatgagacttacattcactacgcggaaaacaccacgcagcagaaccgcatcatcctgttctgcgatatcgaacggccgatgaagtaccgctgggcggcggcgttcaaccgctggttcagccgtaacgtgatggcggcggcggggtcgccgaacgatgagggcgacaagaccggcggcctgaaccgtgcgtttacccgcctgtacaagatccgcctgcgcggcaaagagctgaaaaagcgcaatcgtgcacgttactacctggaaaagtgggcgatttttgcagggttggcgctgatcttcatcctcatctaaagtcctcttgggcgcgacttacagcggtggtgtcgcgcccagcttgtcccacatcttcttgctgatcttctgccggttggcataaccggcccacgggtcgcctttcaacgtgtccaaacgctcgtgcaagttggcgactgtccactgctgtgcgccgcgcaagccttttaattcttcccgactgaccggcactgacaccggcaggcctggccgcgcccgtaccgagtaggccgccaccgtgctcgcgccacgggcgttacgcaggtagtcgataaagatcttgcccacgcgattcttggggccggaagtggcggtaaaacgttcgggcaactgcacggccatgaattgcgcgatggctttggcgaacgctttcaccgtgtcccagccatcccggcgccctaatggcacgaccaggtgcagacctttgccgccgctggtcttcacgaacgcctccagacccaattcgtcgagcaccgacaacgtcagttgcgccgcctccagcatggctttccacggcagcgccgggtccgggtcgaggtcgagcacaaacaggtcgggcgtttcgatcttgtccgaggtcgcgccccaggtgtgcagctcgacggtgcccatctgcacggcgccgatcagcgctttgctggtgtcgatctccagcaggcgcgcatggcccgggtccagtgcctggtcgagctgcttgatatagggaatggccaggtgctcggaatgtttttggaagaactgttcgccttcaatgccttccggcgcgcgcagcaacgacacggggcggtggcgcaggaacggcagaagccacgcgctgatgctggcgtagaagtcggccagttgctgtttttgcgtgccgctttgtgcgtcgatcacgcggtccgggtgggtgatggtcacgccgctgccggcctttttcgcgggcgccggctttgtgacggatttggctttgcgcggcagctcatgaatgatctgcgccaccggtttgtcggtgcgcagcgcaataaatgaggcctggcgcaccacgccttcacgggtccattcggcgaaattcacttcacccaccagcttcggttcaacccagtgcacgccgcgcgcctgggtgctggtcagtggtttttgcagcggcgaggtcttgcgttccaggggcgtgagttgcgcgtagatgttcttcagcgccgcctgatcaaagccggtgccgacgcgcccggcatacaccagcccggaatcgtcattcaccgccagcaacagcgcgccaaagccactgcgcgaaccttgcgggcgtgtgtagccgacaataacgaattcctggcgcaagcgacatttgagcttgatccagtcggcattgcgactggacacatagtggctgcccacgcgtttgccgatcacgccttccagcgccaggtcgcaggcactttcgaagatgtcacgctggttggcggcgaaggcttcggagaaacgcagtaatttactgcggctaccggacaacgccgctttgagcgcggcgcggcgttcctccacgggggttttgcgttgatcctggccgtcgagaaacggcgcatcgaacaggtaatacacgatgtcgaggctgcggccgatatcgaaggcattttgcagcgcctgaaagtccggcaagccatcgccgttaaggctgaccacttcgccgtcgagccagctgtctttgagcttgagcgcttgcagggccttaacctggcgcggcaggcggtcggtccagtcatgcccgttgcgcgtgaacaggcgcacttcaccgtcgcgaatacgcgcgagcatgcggtagccgtcgaatttgatttcgtactgccagtcgccgtcgggggcgcggtcgaccagggtcgccagttgcggcgtgagctggtcggggagagcggttggggttttctggcgtttcgcgggctttttcggtttgccgaccgaagcgtcgctgagcacgcttttgggctggttctggacaatgtcgtaatcgctcgcgggccgggcttgctgatccttttccttgatcagtagccactgttccttatcgccgctgcccttcaggcgcgtgcgcaccaaggcccagtcgccggaaagtttttcgccgaccaaggtgaatttgagtttgccggccgcataggccttatgcgggtcgtcatggggttgccagacgccacggtcccacacgatcacatcgccggcgccgtattgcccggcaggaatgctgccctcgaagttgccataactgagcgggtgatcttccacgtgcacggccaggcgtttctgggccgggtccaggctcgggcctttgggcacggcccagcttttgagtacgccgtcgagttccaggcgaaagtcatagtgcaggttgcgcgcgtcgtgcttttgaatcacgaaggacaatgccgaggctttgcgtttgccggcaggcgcgctgccggcgggttcggcggtgatctcgaaatcgcgtttgcggttgtattcgctcaggggctttgccatgtcgatctccagcaaatggcaggctcaagaggcctttttggtggactttttcgccgcaggctttttcgtcgtgcttttagttgcgggcttgccggccaggctgcgtttgagcagctcggtgaggtcgataacgtccgccgatttgcgctcctcgctgccttcctggctttcgacatcttcgattttgccggccttggcctttttcgccaccagcgccatgatcttctcctggaagctgtcgcggtactcgtcgggctgccagtctgcgctcatgtcttcgaccaggcgcttggccatgtccagctcgcctttggccaggctgggtttggtcacgtcagcgcccagttcaagctcgtcgaggctgcgcacttcggcgggccagcgcagcatcaccaataccagggctgaatcaagcggcattaacgcggccaagtgctgcttggtgtgcagcaccacattggccagcgcgaccttggcggtttttttcagggtttcgcgcagcagcgcgtagaccttgccgccgcgtttgtccggcgccaggaagtagggcgtgtcgatattttgcagcgggatctggtcggcggcgacaaaggcgatgatttcgatggtctgggtcgacttggggtgagcagagcgaatttcgtcttcgctcagcaccacgtaacggcctttctcgaaggccacgcccttgacgatgttctctttggtgacttccttgccggtggtcttattgatgcgcttgtagcccactgggtccatgctgcgtttgtccagccagtcaaaatcaacgccttgagaggacgtggccgacaccagcgataccgggatatggaccaatccgaaactgatggcgcctttccagattgcccttggcatagctgcgattccttgagaagagactgtgtgctggtgactcgcaggcgtgcgcaaaagtttcgatgggcagatgcgcggacagatcgtgttacacctgatgagaaagtatttagtgtcgaaagccgaacccaaggcgtagcgtgttatcgaaagctcgtacaactcgccccagagaggctttgtgatgaacagctgtgtgcgttacatgaccgtactcgcgttgggcctggcacttgcgccattggcccaggcgcagaacctgcccggcacctacgacaccaacaacagccctattcatcgggccaaccccaacagcatgcagggcacacagcccaacgcgccggctgttcgcggtattcaaaccgggccgaccagccccgcgccgaccgtcgaaaacggcggcatcggcaatcgctatcccacgcgcaacgccacgccgagccgtcccgcgaccgacaccaaagcacccacttacgatgccaacggcaatcgccggtaaggattctgtcttatgtttctacgcaaaaccctgctagccgctatttgcgcaaccacgctactgccactcgttgcggtgcacgccgccgatgcccagcaattccccagtgaacaaggcagcatcaccgccaccccgatcgccaaaggtctggatcacccttgggcggtggcgtttctgccggacaaacaaggcttcctggtgaccgaacgcccaggccacctgcgttttgtcagcccggacggcaagctctccgcaccactgaccggcgtgccgcaagtgtgggccaaagggcagggcggtttgctcgatgtggtgctgtcgccagatttcaaggaggaccgcatggtctacctgtcgtacgccgaaggtggcggcgagggtggcaaagccggcaccgccgtcgggcgtgggcgcttggccgatgacttgagtggtttgaaggacttcaaggtgatcctgcgccaggagcccaagctttccaccggcaatcactttggctcgcgcctggccttcgaccgtgatggctacctgttcgtgaccctgggtgaaaacaacgaccgcccgacggcccaggacctggacaagctgcaaggcaaagtggtgcgcatcttcccggacggccgtgtgccggatgacaaccccttcgtcggccagcagggcgtacgccccgagatctggtcctacggccagcgcaacccgcaggggctggcgctgaacccgtggagcggcacgatttgggagaacgaacatgggccgcgtggcggcgatgaaatcaatatcatcgagcgcggcaagaactacggctggccgctggcgacccatggcatcaattattcactgacgccgattcccgaggccaagggcaagaccgtggaaggcaccgtaccgccgcatcacgtgtgggagaaatccccgggcatcagcggcatggcattttatgacgccgaccgtttcaaggcgtggcagcacaacctgtttatcggtgcgttggccagccaggagttgattcgcctgcagttcgacggcgataaggtgattcatgaagagcgcttgctgggagccttgaaagcgcggattcgcgatgtgcggcaggggccggatggctttttgtatgtgctgaccgatgaggataacggcgtgttgtatcgggtggggttgaatcaggactgaaggtcgctatgacctgcttgtgtgggagctggcttgcctgcgatgcagacgactcggtccatcaggttcaccgaggcgatgctatcgcaggcaagccagctcccacagaggtcttagagacccagttcagacagccccggatgatcatccgggcgccgccccagcggccagtggaacttgcgctcgctttcctggatcggcaggtcgttgatgcaggcaaaacggttggccatcaagccattctcatcgaactcccagttctcattgccgtaggaacggaaccagttgccggagtcgtcatgccattcataggcataacgcacggcgatgcggttaccggtgaacgcccacaactccttgatcaaccgatagtccagttccttggcccatttacgggtcagaaaacccttggcctcttcacggttatgcgcaaactcggcgcggttgcgccactgcgtgtccagcgtatacgccagggacacccgttgcgggtcgcgggagttccagccgtcttcggccagacgaactttctcgatggccgactcgcgagtaaacggtggcaggggcgggcgtacttctgcgttagatgacatggagcaactcctgaaagaatcaaggcttatctaaggttgcgtggcctgtgcgttcaaagcgccaataacgttcgcgccatgcattgcgcattatccgcagcggttgaatcgcccatcaccagggcaacggtaatggcgccatcgatcaggatcagcaggtgcgcggcctgccgttcggggtcgggggtgccatgtgctttacacagttcgagcgcgtactcgaacagtttctgtttatgcgccttggccaacagccgcaccgggttgtgcgggtcgccggtttcgccgctggtgttgataaacgcgcagccgcgaaagtccgccgagccaaaccaggccttgagggcgctgaacagcgcgagcagacgctcaccactgccttcgctgcgttccacttcgctgcgcagccactgcatccaacgcgcgtcgcggcgttgcagggcggcaatcaccaattcatctttattggcgaagtaacggtaaatacttttgcgcgacacgccggcggttttcaccagtaagtccatgccggtggcggcgataccatggcggtagatcaacttttcggtgacgtcgaggataatgtcgcgggtgtcattgctggtcatgtcgttcatgttgcgtacagtagaatgatcgttctccttggtcaattaacttttttccatccagggcgacgagacctgagcagccccatggtgtaagctcggggcctcttcggattcgacccattgcgagccttatgccgtcgttcttcaaacgctccctgttacccaaactgcgcggttttccactgtctcccgaggccatcgaggtgctctgcggcgccgctgagtttcgtcgttgcctgctggagaaaatcccccaggcgacgcggcgtatctacatcgttgcgctgtacctgcagcaggacgaagccggccaggagatttacgacgccttgcacgccgccaaggcggcgcggccggagctggatatcgtggtggtggtcgactcgttgcgcgcgcagcgcggtttgatcggtgccggcaagcagcccggcaacagcgcctggtatcaggccatgacccaagcccacgccagcgaagtgccggtgtacggcgtgccggtacaaacccgcgagctgttcggcgtgttgcacctcaagggctttgtgatcgacgacagcgtgctgtacagcggcgccagcctgaataacgtgtacctgcacaagttcgacaagtaccgctacgaccgttatcaccttatccatagccaagcgctggcggattcaatgcagcacctggtggagcacggcctgatcacctccaaggcggtgcatcgcctggacctgccgaacccgcccaccacgcgcagcttgcgcaatgacattggcgacctgcgcagccgcctcaagcacgccgcctacgacaccaccaccgggctgttgcccaatgggcacatgtcggtgagcccattgctcggcgtcggcaagaacaacccgctgaaccgggtgatcctggagctgattgccagcgcccagcatcaactgaccatctgcacgccgtacttcaacctgccgctgccggtgacccgggaaatcaaccgcgccctggcacgcggcgtgaaggtcgacatcgtcgttggcgacaagaccgccaacgacttctacatcccgcccagcgagccgttcaaggtgatcgcggcgttgccctacttgtatgaaatcagcctgcgccgtttcgccaagcgccatcagccgatgatcgaaagcggccagctgaacctgcacctgtggcgcgacggcgacaacacctatcacctcaaaggcatgtgggtcgaccagcgctacaccttgctcaccggcaacaacctcaacccgcgtgcgttccgactcgacctggaaaacgccttgctgatcgatgatccgcaaggccagtggctggtaccacggcgcaccgagctggcgcagattttcgagcacaccacgcgcatcgagcgttaccagcaattgcagacattggtggattacccggcggcagtcggcaagttcctgcgacgggtcagtcgggtgcgcattgagcggttgctttaccgaattctgtaaagcacagatttcgtacgaataagcgtccgacagccttcacagattagcgagtttgccgggtttcatggcgggctcaggttcgtacagttcctctcgacagttcttagggacaagaactcttaccactcattggtacagaggaactagaaatgtcgaatatctcgccaagccatcaggcccctaggctcgcgccagcgttactggcgttctcacccatccccgtcgccaaccctgcacccgatacggttgtgcgcagcaagcgcagcctggcagttcaggcatccgacgagcagacctttaactggacgctccaacccttggccacgcccacggctgaggcgtcgtcaagcgccgaccgcttgctgcagactgcgctggctggctcgcctttgcgcagcgcggcagacagaaaagtgcaggtcccacccgacgccactgttttcgcgcttttcgacgcctaccggagcgcgatcaatacgcctgaaattcaagcctggttgcgcagcaaaggcattgcgccgtcgacgctggtggtcaagcacggctcagtcagtggcagcgtaacccgtgacggtgtgtccagcattcaaacatttaccaccggcgatgcctccggttggtggcaagtcagtgccaggctgcgtgccgctgcgcaggggcttgaccctgatgaccacggcctgccgtacgtcaacgatgacagcgatagtttttcgcgcgacaccctactgcgctggtatggcgtgaaaccacctgccgacgcgagtgacgtaatccgggcccagcatgagttatcgacgctcgactggtccacgctggcgcccctcaaaaaggctgaacttgagggccgggcgcaaacggcccggcgcgccatcggggctttggatgagcgtgctcacctggctgatatcctcaaacaacatctcgcaggcaagccagacgacgagccggtggcgctggacggcctggaagtgcaggtcagcagcacctcgacgctggcccgcaacgtcaacggcaaggttgcgctcgacgccgccctgcagtcccatgggcagccgctgcccaaaaccgtgggtgaattgcgtaacgcgatccgttggctcacggcggcattgccgccgccgccggcccagggcaactattcccatctgttagcgtacacctgggcccccggaaaactgtctgccgccgataaggctgctgtggcccatctgagccatgacgacgatgacaatgatgaaggcgagtcgagcgggctcaacctcctgcgtttgctcgatgttgatggcatcctgggtagaaacacccctgaagcattgcgcagtcaagcggatggctttctcgagcgaatacttggaaaccctgaggcattgttttggggcgatcttcttgcccaggatcgggattatcttggcgagaacggtacgtcacacttgtcggacgctgagcgtgcgcaatggataatcgccgccatcaagctgcagtttgatcctgacgcccctgggcgcaagggttctatcgccggctatggcctttatcagcctggcaacagcgggcgaaccctggccgaggtgcgtagggatgtcgaaaaccacctcaagcaaaaaaactcactgctcgatcccagggctgcgccattggtggcccatctgtttctggcgagcgcggcgcctgagtttctggtgcccggcacgccagcgaccctgcgcataggctccaccgagtgggcggatttgcgccttgccgtcacattggccgagcgccagggcggcgcgggctgttcgcgctccatgagttatcaggaaatcatcgccctcagtcggttggatccgcgcaccccggaagaagcggcggtgctggacaactatggggtcgacgtcttgctcgattggggcctgatgcgcgggctctacgccaagccggcggacgaccgatacacacccgagcactatcagcaagccactgcagccttcaacgccgaacgcacgcaaatgctgcaagccctcgagctattgagcgcagcgatgccgacccgagaggacttggcgatcgcgaacctgcaaaaagagtttccaggctttagcgctcagcagataaaagccttgagggtgtacatcgccgacccgcaaacacgtcgcaaaatgagtcatttggagccgaagatgcgttctttggtcgagacgtacatgaccggcgacctgaccaaggatagctggatgctgttgggccccggggagaacgcgccgcaacctgcccgcaagaaaaccccgtatgccgctgagcccgtgctgagcccggcgcaacaagcggctgttgatgcaaacgttcaggcgttgaatgccaagatcgccaacttgccggatgtgcaggccctggtacccgttgaagtcgaccgctacctggccaatctcgcgcaggggttgagtatcactacgcgacgaatgatggcgaacctgccattgcctgtgcgtcaggccctggagtacggcgaggtcaaactgttcgccctgcgcgagcaaaccgatgaagtcctcgtactggacgaaacgcccggtcacgtcgaagcgcggcgaggacgcaaagggacgttgatagagtgcacattccagggagtgacgcgttttcttgaagtgtttgcggacaagtttctgatcgttgaacgtgacgacttggtcgcgccgctaacgctggggggcacgcttgaggaacataagaaaagctatggaatttgggggctatcggacgtacagaagctgattggcagggaacagccctatgatttcaacgcctacagttccgacgccaagcctgcgccgggggtgaaatccaagggcatcattatcgacccattgggcgacgcactgcccgccgattcatctgtggcgcaaggtgacagcgctgttccagtccccaacagtttttcctcggaccgaacgcaggcgatcgtcagacgcatcatgtacggcaacttcgttcatcaccgtgacacggtagtaaagctcgcccagggcgagttgaagctggagcaacagcgcgaaatgttgcggcaaaacgaccgcatattgctcggcatgatccccttcgttggggcaatcatggagctggccaagggcaacatcgttgagggtacgcgagggctgatcctcgatactgtcggcgcttttgtaggcggcgcggggtcagccacgggggctttgatcaaatccacaaaagtcgttgcgcctttcggtgccaaggcttttcgtgttctggaaaagggcatcgtcgtcgtcagtggttttttgaatccgctggatggcgcggcggacctgctgcacggcgctgctagaggtgtcatcgcggtgcccaaactgctgaacaaggcaccgaagcccttgttgttgagcacgctgggagtcgtggaggaaaagttgcgcctgtgccttggcgtgcacagcgggttgttgaatcgtgcgccggccgctcatggcggtagcaggccgcccccgactcaggcggtgaacaaccattcggtagcggttgacgcagtgccggtcgatgacaagttgtatgcggccaacccccgcaacggcttgcccctcggtacgcccctggacggggttcaactgctgggcgcaaaggcggcgtaggaacatgccccgcgcctcctttggggcgcggggtgccggctgccttagcttggataatttccctcgatactttgagtaaacccctacgccttaacttggcgtttcttaatattttcataattgactgtttttacggacaaaaactctcatcactccaaccggtagagagacatttgcaatgttgccaatccctgcgaacggtaatgtcacgttttttggtcagcctttaagtcctcgagtaccactaccgcccctgcatcgccctgatgaacccaccgcgtccacggctcccgaggcaaccccgcgttccgatcgctcccaaccctttaaccccccatccctgcgtcagttgcggctccaggagcaggccggccggcctaaacgcgataccgccgctcaaggcacagaagtgcccgccacccgtcaaaaagaaaggcgccgataccccgccagggccgacgctgaaaaggccgataccaagctgcagaaaaacctggtccagtggctcaaaaccggcaagcccaacgaaaacgttattcctgaaaaatcatccgttgcgccttttatcgctatgtacaaccaggcgctgaatgagccctctgtacaagcctggttcagcgctcaagggttgatacccgcaaccatacgggtattcagtgattgcgtggtaggcacggtgatgcgcgagggtaaagcagtcatccagcgtttttctaccaccgatggctccggctgggggcaagtcagccacaccatcaatgcgctgcaaaaagtgctgtcgccgagtgatctggggcttcccggcaccccggatttcgtttcaatcgggcgcgatgtgttattggatttttacggcgtaaaaccacccctgaatgaaaaggccgcgccgaaattggccaagcatcttagacaggagggctggcccacgattgcccaaacggcacgcgacggttgggagggccagttcaacgcgctgctccagcaccgtcacgacagcgccgtacgtacgcgtctggtcgaacagtttcaatcgcagttcacgaccgaacccaatgaaaacgtgattgagctggataatcaggctgtcgccgttgagcctggggccagccttgatcggcgcagtcataaagcacgtcagttgtttctcgagttcctggcatctgcgacattccaggcctttctgaagaaagccggttttgagcttcccggcagcgagttcaggatgagtgaattcaggctgtcggagggcgaactgcagatgcgcaatctcgccggtgaatgggtttccctgcagaacgcgttcgacgatgaggtcgagcgcgcgtccagggtcgacgacccccaagggcatgccgcccgcaagatgaatgcggatttcgaccagttagtgaaaatgagcgaaaaaaccggcaatgcgctgtacaacacgcgcacttatgacgcgcgtcagaccctggcgttttatacacctgacacaccgaaaaccgtcggccagttacgcgcaaccctgggatggctctgcaatcaattgccgcccccaccgctggcaggtgactacgccagcatgacgccttacggggaagatcagggaggcttgtccgagcaggcccttgaagcgctgaaaggtcagtcggcgcaggtcatgactgccttcaaggacttttccagggcgcccttagggttccagtccaacccggacccggaccgtcaactcgctgagttttttgattcgccgcaggccgtcgcgctcgccgaacagatcgccaagtccctcaagctgtttgccgtggccgatggtcaggcgctgccaagggccgagcgccatcaactgttagccacagcactcaagctcaatgtggatgcgcctgtgccaggccttctcgggaacgtggccggttacgcgttgtatcagccggaaaatatgggccgtacgcttaaagaggtgcgacagagtgtcgagcagcatttggagagcaaaggcgtcgacgctaaggtctcggccctgatggcccacctgtttatggctcagtcggcacccgagatgctggtcaagagagacccggccttggccgccgatgctgcgcaggcgttcaatcaggacccggaaaacatcaaggtcggttccaccggctggatgaacctgcgcctggggtgtgcaatcgcgggcgattcacgcgtgaacttcacgcaagcgctggcgctggcacgccaggacattaccgggcctgaacaggaagcgttgctcaaggagctgggcgtgcagtcactgttggactggggggtgatgtcggggatttttcccgcgagttcagatggcaaatactcgccgggtgactacgaggccgcggcgacagcctttaccgcgcgtgaaaaccagacgcgtgaggcctttgccacgttaatgagcgagccgcccacccaggcaagcctgctggtcgaccaactggcgatactgttcccggaaatgaccaaggaggaaattcgcaacatcaaactggatgggtaccccccgacaagccttgctgcggctgctttcgagaaaaggtcatataacctcaagtcgaaaatgttgatcgacgtgattctgatgaatcaaagcgaaaataagccggcgctgggcaccgttgagcaatggacggacggcgcgtttatacaccccaaagtgtctcttgccgagttcagagagcgcatcaagcaattacccaggatcgagccattggtggcgccagcggtcgacacgtacatcgccaccacccgtgcagcccaggccacagcattgaagctgatgttcacgctattgaccctggagcagcgcatggcgttggagcgatcgccgcaaatcgagtgctttaccttgcgggctccgacgggagacgatttgaagcaggataacgggccggaatcgaacgttgcaaaaagcgaaggcaggcatggcgtcctgatacgttacgaaaccggtcaggccaagcctaaatatggttactgggggatttaccccaactcaatgacgatggtcgagataaaagacttgcccgatgatttgaaactgggtggcgagatacgcgatggcactaaaccccatgtcaaaattccgggaataaacctgaccattaatgaggtcgctacccaattccaccgaggcaccgtactgcccattgatttcgaggcttttcacaagggagtggccccgcgccccggcgtatcgtcggaggtgatcgttgaaaagcttggggaaccgttgaaacggcctgcggcgcatacgcaccatcgcatccccaacaccttttcgtcttccataacatcccagttagtggaccggttgctggagcatagttttgatgacagtcgcgcgggtcggattgcattcgccaacgagccgtcagacctgcacaaacggacttatccctttaagccgggcaaatattttaccgccgaaaatgcccgcacgttactcaaccttatcccgtttgtgggggcgattgccgacttggtggagggtaagacgctggcgggcgtcaagggcttgctgatagacattgggtcttttctcatcaccggtgggctggctggcgcaaagacgtttgccaagggcctgacaatgctggtgcctttcagcagcaagccattcaccctggctgggctcaagggtggggcatcctttattcgcgggctgttcaaccctttggaaaacatccccgacttgttgcgcacagtgccgcgtggccttaagggggcgagtaaagtcgccaacaacgttcgggttcgcctcggttcaaatatttacgtgccgccgaaaattttcgagcagtggcgctggactgcgggcgcgtgggatacatcgttttcaggaggcgcacgcacaattaaccagttcccgggcgcccgcaaaggttttagcgggaccaaggaggtcgtggcggtgcagaaacatggctcgtggtacgcgatcaacccggtaagccatcgaccggatcgcacgccgttggaacacttcaaaccccaacccgctgcttgaaccccggcattcggccgcttagtgcggccgaatgccagggcgttgcatcagttcaagcccaacttgccacgcagggtcgacaggtcttcagccaaggtgttgaccggacctaccagggccttacggtcgttttccttcactttgtcgtaagtctcaaagccgccatccttggtcttgtacttggccaggattttgtccacggcggcgaagttcttgtcgactttagccaggaaggccttgtcttgtttctcgatctggccacggaacaggtcgacgattttcttcgcaccgtcgatgttgccctggaagtcatacaggtcagtgtggctgtagcggtcttcttcaccggagatcttggtggcggcaacttcttccagcagcgcggcggcaccgccgacgactttctctggcgggaaggtcaggccgtcaacccgggttttcaggtcgttgacatcggtgttgagcttggcggtcagggtttccaggcctttggtggtgttctgcgagaacagcacgtactcgatgcggtggaagccggtgaagtcttcggcggtcacgcctttttcgtggtcgtcgacgcgcgagtcgatggaggcgtcgaggtcgctgaacagctcggcgatcggctcgatggactcatagtgcacgcgggtcggcgcgtagagcttcttggcggtggccaggtcgcctttgttgatcgcatcggtgaacgcctgggtctgggtgaccagctcaccgatttcttcggtgacgtagatcttgtagtccgacaccgggcctaccaggtccagcggcgcggtagcggcgaacgctgccagcggcgaaagggtcattaacaacgacaacgcgatagtcgacttcttcatgggacgttttccgctctggtttgttttaagtgttggcagtggtttgagggtgcgttgcagcgagcagcgcgcgcccaatgaaatccttgggcccggtgacccctggcaaggtgaagaagtacccgccgccgaccggcttgaggtattcctccaggggctcgccgttgagccgggtttgcacgctgataaagcctttctccaggtcagcctggtagcagatgaacaacagccccatgtccagctgaccgtttttgttgacgccgttggagtagttgaacggccgacgcaggatcaggttggcctgagtctgcggggtacgcgggttggccaggcggatgtgcgcatcgagcttggtcaacttgccttccgggtccttgctgtaatcaggcacctgggtttctttgtcgccatccatcggtgcgccagtgggtttgacgcggccgatgatgctttcctgctcttgcagcggggtacggtcccaacgctcgacgaagttgcgaatgatgcgcacggcctggtagctgccattggcggcccacgccggttcgtcgctgcccggttgtacccacacaatctggtccatggccttgtcgtcgttggagttcgggttggccgaaccgtcacgaaaaccgaggaagttacgcgcgctctgcgccggctcgccaggtttggcgggtgcttgcggcggcacgctgccttcctgtttccaacgcaccagcagcaggtccggcaggtttttcacgatgtcgcgcagggcgtggatattggtgtccggggtgttcgagctgaactgcaggctcaggtcgccgtggcactgcgccggctccaacgcgtcgttggggaaaccgaccatgcggctcaggcgcttgggcttgacggcggtgaggccgaagcgctcatcgaacagcgactcgccgacggagacggtgatggtcaggttatccggggtgaccaccgggccgagaatcccggaatcggtgggcggcagcttcgggtcgacctgcggcacggtgccgccggtcatcaggaacgcgatgcgctcgttcagtgtgcggaacaggcgctccaggtcctcacggtcgctggcgagtacgtcaaatgcgacgaccatgccgcaggccgggcgcggggtgacgatgccagtctggtgtttgccgaaaaagtcgtgatggtcctgggtcttgtcactgcgcggtgcggtagtgacttgctcggcagacgcggccatggccgggcaggtcagggtgctgccggcaatcgcggcgccggtggccgccatgcccaacaggacgcggcggcgggttgcggaaaactgttctgaatcactcatgtagtaggtcgtcttcactgcaggccggaaaggccaagggcggggtcgattccatcgagtgcaacggccagagccttggccttgtcggcgatctgcttgcgctgatcggccgtgacgctgtcgtagcggctgtactggccgtcgactttcaaaccattgagctgggcatcgaaggcggcgagggcgctgtcgatttttggcagcaggtccgctgcggatttggtcagcagcggacgcatcagctcgacaactttgtgggcggcttccaggttggcggcaaagccattcaagtcgatatggctgtagcgttcctcttcaccgctggcggcgcgaacatccgccaggctgttgaggttgcgtaccacaatgctcaccagttgctccggtggcagcgactgcgcgagcagctgttgcttgagcgtggtgacatcggtgaccaggcgctgggcaatcgggttcaggccatcgaggctgcgttgctggaacaggctgtattcgaggcggtggaagccgctgaaggctgggtcctgctcgcgtttttcgaagtaatcggcgcgggcgttgattgcgttatccagctcggccaggcgttgcgacgccggcgccagacgctggtaggcctcacgggccggcacatacagcgcctgcgcctgggccaggtcgcccgcttcaatggcttgctgcagggccgtcacggccttgaccagtgcactgccttggccgctcaggtacacgcgaaactccgacagcgggccgataaacgccaccatcgacggcttggccttggcctgggcgtcggactcagccgtcggcgtgacatgtaacgtgccgcgcgggttgctcagcagcccgcaggtgattgcatagtcgccgggcaacaggttggcgttgatcacctggctcaaacccggcgcgatattttcgcgttcttcgatcaccagcacgccgtcgaggatttcccactccaccgcgcggtcggagcggttgatgatgcgaaaactcgcgcgcccggcaggtaccgttatttcgttgggctcacaggcgtgaccatggatcgtcacggcgatttcattgtggttggtctggcgtttggcggcggccaattgcgaggcgtaatagaacagcgcaccggcgccgatcatcacgaccaccgagcccgccaccgcccagcgcaaggcgcgggaaggcggagccggttgagggtttgggttggacaagggacggtccttactggctggaaacggaagaggtgttggcgacaggcttgggtggggccgacggcaggaagaacatcaccagcgccaccaccaggtaaatcaggtaagcgcccagggtgctgacggtcggcgcatcctgatagccgaacatcccggccagcaccgagcccaacgggccatccatcggcagcgtcgcgctgaaatcgaacaacacggtttgcaggtggttccacaccccggcttcgtgcagggcttggaccgagttggcgagaatgccggcggccaccaccaggatgaacaagccggtccagcggaaaaacgcgcccaggttcaggcgcatgctgccggtgtagatcaggaaaccgacgatgatcgccaggatcaggccgagcagggcgccaatcggcgcgccggggccttcgctctgctggaacaccgcgagcaggaagaacacggtctccaggccttcgcgggcgacggcgaaaaacaccatggcgatcaacgcgatcacctggtgcctggagccggccaacgcgtggtcgagggattcgtgcagggcatgcttgatggaacgcgcgactttgcgcatccagaacaccatggaactgagaataccgacggccaccaggccgaccacgccttcgaacagctcctgttgtttttgcgggaattcggcgctgaccagctccaggccgccgcccaccagcaaggccagggcggcggcgaggaacacgccgatccatacggcgggcatccactggccgcggccggtctgttgcaggtaactggcgatgatgccaacgatcaatgctgcttcaatgccttcgcgcagcatgattagaaagggaacgagcattcggcaccgcatcaagactggataggatgctaatttgtaacataatgatactcattactaaacaggcaatgttgaccttagctgaactgcggctgaacggtggtggcgaatcgcaaccgcccttatgatgcaccccatcttttgcagcattgaatagcccgattcccatggcggaaaaagacaccatctctatccatctcgtgcgcgaagccttgctgcaaagctgcgcgcccggtgcggccacggtggaggcattgagcaaggtcgggatagacccggcgttgctcgagcagcccgacgcccgcgtgcccgccacggcctacgcacgcctgtggcgcttgctggcgcggcgcatggacgacgaattttttggcatggacccgcgcgcactcaagtccggcagcctggcgttcctgtgccgcaccgcgatggcgcagccgagcctgggcgccagcctggaaaccggcctggggtttttatcgctgatgcttgagcagatgcccgctcaactggtgcgccaacagagcctgtcggaaatcgtcttgctcgaacccgaacctaaacgcgcgtttacctatttcacctattggatgatcgtccacggcgttgcctgctggctggcagggcggcgtatcccgatcctggcgattgagctgcgctgcgcgcagccggatttctgcgatgactaccgagtgatgttttccgacaacctgcgctttgaccggccgcgcacccgcatgattttttccgccgactgcctggacctgccgatcaagcgcagccctgaagaactcaagcgctttcttgcgcatgcgccggccaacatcctggtcaagtaccgcgaccctgacagcctcgccacgcgcatcaaacacgacctgcgccaaatgtcgcccgacctgtggccggaaaccgacggcctggcggccagcctgtgtatttccgcctcgaccctgcgccgccgcctggcagatgaaggccagacctatcaagggctcaaggacagcgtgcgcaaggaactggcaatcgtctggctggccgaagcgaatatcagctttgccgaaattgccgcgcggctggggtttgccgatgccagttcgttctacaaggcatttcgcaagtggtccgggtccaatcccgggcattaccgtagtttgatcctgaatgaggcgagttgaagcgtaggtttccgtgggagctggcttgcctgcgatggcatcggcggggtgcctgatagtgcaaggtgcgtgcatcgcaggcccgccagcgcccccatcaacccgtggcgggcagcaaaaaaaagccccgcgaccgaatggggcgcggggctaaaaattggctggatgcgaccaaccaaaggagctctttacatcacttgctgctggcgacgaccgtgtccggctgccagccgccaccgagggctttgtagatcgcgacaatcccgcgatacaggtccacttcggcctgggcctgggagtcttcagcggccagacgctcacgttgcgcgtcgagcagcacgaggaaatccaccgtgccttcgcgataacggatcgccgccaggtcggcagccgcgcgactggactcactttgacggatcagcgagaccaggcgctgctggcgtttgccgtaatcactgaaagcattttccgattcttccagcgccagcagcacttgctgctcgtaggttgccagggcgccatcggcctcggcattcgccccacgcaagcgtgcacgcacactgcccaggtcaaatgcagcccaggtaatgcttgggcccagggaccaggcattggctgcagccgaaccgatttgcgaaccgcgcccggcggtaaagccgaggaagccgctgaggctgacccgcgggaacaggtcggccttggccacgccgatccgcgcggtggcggcggccagcttgcgttcggcgctgaggatgtccgggcgacgttgcagcagttgccctgggtcgccgattggcaactccttggcaatcgccggcaggtctttggggctcaggtccacgctcagcttgtcggggcgctggccgaggagggtggcgatgcggttgcgctcgcgcacttgctcggcttgcagttgtggcacgctggcttcaacggcggccaggcgcgcatccgcgcgttccacatcgagctgatcgccgacgccggcatcgcgcaggctgacggtgatggtgcgcgattcctgctggttcttcaggttgtccagggcgatgcgttcacgcaattgcgcgccgcgcagttgaccgtaggcgtccaccagttcggcaatcatggtgacttgcagttggtacaggtcggcttcggcgacctgttggtcagcgtcgctggcttccaggttgcggcggatacgcccgaacaaatccacttcccaggccatgtccaggcccaggtcgtagcgttcgctgttgacgcgcttggtggtctggccgggaatctggcctttgcccacgtcgctgctggcccggctggtcaccaccggcatgatgtcgttggcggcgtcatcgcgaatcgcacgcgccgcgcgcagacgggcaaaggcgacgcgcaagtcacggttaccgctcaacgactgggtcaccagttggttgagggtcgggtcctcgaactgctgccaccagatgccttcgtatttggcatggtcataacttttggtgtcggcggcggccgtgatattggccgcctcaagcttctcggttttatagtccgggcccacggcgcaggcgctcagcgccagtaccagcaagctcggcaggaatactttcatgctcattgctgtgtctccagcttcaaggccttggccgctttgcgcgcttcgccgcgctccacatggcgacggatcagtacgtagaacactggcgtcagcaacagaccgaagaaggtcacgccgatcatcccggagaacaccgccacgcccatcgcatggcgcatctcggcaccggcaccgctggacagcaccagtggcaccacacccatgatgaacgcgaacgaggtcatcaggatcggccgcagacgcagacggcaggcttccagcaccgcagccagcggatcgaggccttcctgctgtttgtccttggcgaactcgacgatcagaatcgcgttcttgcacgccaggcccaccagtacgatcaagccaatctgagtgaagatgttgttgtcgccgcccgagataatcaccccggtaatggccgacagcagcgtcatcggtacgatcagaatcaccgccagtggcaggctccagctttcgtattgggcggccagtaccaggaacgccagcagtacgcagagcgggaacacgaacagcgcagtgttgccggagaggatttgctgataggtcaggtcggtccactcgtaggtcatgccgttgggcagttcttctttcaacagtttttcaatcgccgcctgcgcctggccggagctgtagcccggtgcggcgttgccgttgatttcagcggtgataaagccgttgtagtgcatcacgcggtccgggcccgaggtgtcgctgaccttgataaaggtcgccagcgggatcatctcgcctttgttgttacgcactttcagctggccgatctggtcttcatcctggcggaactgttgctcagcctgcacgttgacctgataggtacgcccgaagcggttgaagtcgttggcatacaacgaacccaggtagatctgcagggtgtcgaagatgtcgctgacggccacgccgtgggtcttggccttttcgcggtcgatggcagcatcaacctgcggcacgttgacggtgtagctggtgaacaggccaaacagctccggggtggtgcggctcttggtgatgatgttctgcacttctttgtacagctcgtcatagcccaggttgccacggtcttcgatctgcaggcggaacccgccaattgtgcccaggccctgtaccggcggcggtgggaagatcgccatgtaggcttcttcgatgctgctgtacttgccgttcagtgcaccggcaatcgcaccggcggacatgcttgggtctttacgctcgtcaaagggtttcaaggtcacgaacacgatgccgctgttcgggctgttggtgaaaccgttgatcgacaggccggggaacgctacggcactttccacgcctggctgtttcagcgcgatgtcggacatgcgcttgatcacatcttcggtgcggtccaggcttgcggcgtcgggcaattgcgcgaaggccaccaggtattgcttgtcctgggccggtacgaaaccggttggcgtgtgggcaaagcccagccaggtcaggaccatcaagccggcgtagaggaacagcgcgataccgctgccgcgaatcacccggcgtacggtgccgacatagccatggctggctttctcgaagaagcggttgaatggacggaacaaccagccacccaagagtttgtcgagcaccttggagaagcgatccttcggcgcgtcatggctgcgcagcaacacggcggccagggcaggcgacaaggtcagcgagttgaaggccgagatcaccgtggaaatcgcaatcgtcaaggcgaactgcttatagaactgcccggtcaagccactgataaaggccgctgggatgaacaccgcacacagtaccaacgcggtggcgatgatcgggccggtcacttcgctcatggctttttcagtggccgggaacggttccagtcccaactcgatgttccgctcgacgttctccaccaccacgatggcgtcgtccaccacgataccgatggccagtaccaaaccgaacagcgacaaggcgttgagtgagaagccaaacaggtgcatcaccgcaaacgtaccgatcaacgataccggcaccgccaccaacggaatgatcgaggcgcgccaggtttgcaggaacaggatcaccaccagcaccacgaggatcagtgcttcgaacagggtgtgaaccaccgcttcgatggagccacgcacgaagatagtcgggtcatagacgatgctgtagtccatgccttgcgggaagctctgtttcagctcttccatcttggcgcgcacttcgttggaaatctcgatggcattggagcctgggcgctggaagatcgggatcgccacggccggctggttgttcagcaacgagcgcagggcgtattggctggagcccagctcaacccgtgcgatgtctttgaggcgcgtgatttcaccgttttcgccggagcgaatgatgatgttctcgaactcttcttcagtgaccagacggccctgagtgttcaccgacagctggaagctggtggcattcggtgcaggttgcgcacccaaggcaccggcggccacttggcggttctgctcacggatcgcattgaccacatcggtcgcagtcaggttgcgcgaagcggttttgttcgggtccagccacacacgcagggagtagtcgcccatgccgaacaactgcacgtcacccacaccgcccaaacgtgccaactcatccttcacattgagcaaggcgtagttggacaggtagagcatgtcgtaacgctgatccggggaggtcaagtgcaccaccatggtcaggtcgggagaggccttgtccacggtgataccgatgcgcgtcacttcctcaggcagttttggctgagtccgggtcacacggttttgcacctgcacctgcgcgttgtccaggtcggtgcccagggcgaaggtgatggtcagggtcagcttgccgtcggcggtcgactgcgaggacatgtacagcatgttctcgacgccggtgatcgcttgctccagcggcgcggccacggtttcaccgatgactttagggttggcgcccgggaagttggcgcgtaccactacggtgggcggcacgacttccgggtattcgctgatcggcaattggaacagcgagatcgcgccggcgatcaggatcaacagcgacagcaccgctgcgaagatcggccgtgaaatgaagaacttggaaaaattcatcttgagttgtatcccttaaccgcgtggagtcgcgacgctggcaactttgggcgcggctttatccggcgccacttgctccaggttgctggcttcaagcgcttgtcgttgttgtgccaaggcggcgagggtttccttgctggccatcgggatggtttccggtgcaaccggcgagcctgggcgaatgcgctgcaagcccttcacgacgatggtgtcgtccttgttcaaaccgctgcgcacaatgcgcaagccttcgatctttggcccaagctccaccgagcgatacgccggcttgtcgccgtccatcaccagcacgaacttcttgcccaggtcagtgccgacggcttcatcgttgatcagcacggcggagtaggtgccgctgccgaccagcttcaagcgcgcatacaggccaggggtgtattcgcccttgctgttatcgaacacggcgcgaccacggatggtgccggtggccgggttgacctggttgtcgacaaagttcatctggcccaggtgcgggttgccggtttcgttggacaggcccaggtacaccggggtggttgcaccgcgacggccttcgcgcgccagttgggtgtacttgaggtacacgcgctcatcggcgtcgaagtaggcgtagaccttgtcggtggagaccacgctggtcagcgcggtgacgtcggcggtgaccaggttgccggcggtgatttcggcacggctgacgcggccgctgatcggcgaggtcacgcgggtaaagctcaggttcaacttggccaggtccagctgcgcttgaatgccggcaacagcggcgcgggcttcctgggcggcggtggtgcgcgagtcggccagttcggcggagatcgcgttgctctggcgcaggcggtcgccacgttgcgcttcgttatcgctacgggtggcggcggctttggtttgggccagctgggcttcgaggcggcgcacttcagcctggaacgggcgggggtcgatctggaacagcacgtcgcctttcttcaccaaggcgccttcggtgaacgccacctggtcgatctggccggacacgcgcggacgaatctgcacggtttccggggcttccaggcggccggtgaattcatcccactcgttgaccggttgctcaagcaccttggccacgctgattttcgcagggggcatggcggccgcttgttccggggtcttgccgcatgcgctcatcaccaccacggccaaaatcgccaaggggaagcgcaaatgtttgagtgactgttccatgaggtgcatccgccaatgtatttgagatgggcggatcatgcgcggcgaggtgctatgtcacgaatcgaatgaaacaaaggtaactatcattcggaatgatataagcgcgggattagccctctaggatgcgggtttcgttaggtagctatcaataggagtgatgacaaaagactgttgcgcgggctgcaaggaacgcccgcgcggtttttcagtccagcaggcggctgacctcgcgcaagcgcacgtcattcaaattgccggtggaggccagcaggttaagttgcgccagcaggatcgcatagcgctgctgcgccacacgctgctgagtgtcggtgactttctgctgggcatccagcacatcattattaatccgcgagccggcttcaaacccgtgcgtcaccgacgccaggttgacctggctggatttgagcgcctgcttgagcgcctgatactggctcatgccactggtgacttgcaggtacgcctggcgtgccatcagcccggcgttgcggcgtgcgtcttcgacctcatcctgagccttgctctgcagcgcgtgggcttcacgcacgcggctgctggtgcggccaccgccatacagcggcacgctgagtttgaccccgaccacggtctggttatagcggttttccggcagcgtgacgtcgtacacatcgccgcccaccgaggcgaagcggccgtgggcggcgatcaggtcgagggtcggcaagtggccggcctgttccttgtcaatgtccatttcggccaggcgctgggcgatctgcgcgcgctgcacggcgaggttgccttgctgcgcggtattggcccaatcgccgatggcggcgggcaccggggcgctgaactgcggctccttgcccgaccacgggcgcgcctgggcggcggtcaattgggtgagggcttcggtggcgatatccagcgcgccgcgcgcggcaatctgctcggcaaatgcctggtcgtacttggcctgtacctgttcgagcgcgttggcagtggtggcgccgtcagcgagcaagcgccggctgcggtcctggctttccagcagggtttgcagttgctgagtgcgggtgttcaacagctcctggttgagcaacacatcaaagtaggcgcgggccacgcgcagcatcaagtcctggcgcgcttgttcggtctgcacctcgctggcactgatcagcagtttgctctggtcatgggcgatcacgttctgccagcgcaacagcggctgagtgagcaccacggcgtaggcgttggtgttgttgcggttgcggtggtaatcgttggaatcctcggcatcgacccaggccgcgccgccggtgacggacaggtccggcaacaggttggcgcggctttgcggttctttctccgccgtggccaactgctgggcctgggcggcggcgaacttcatgtcgtggctcagtgctttctggtacagctggtacaagtcctctgccgacgcgagggccgggcagcaggcgagggcgagcccacacagtgaggtgagcaaaggggtgtgtgtcagatgcagccctggaatacgcaagggtaggtctccacaaaaaaattatcggctgagggtgcttctgcgcatcatcagcaccatgggtatgccgatggccatgaccgcgcccaaggtgccgaacagcatgctgaaggcgagcatttgcgcctgttcgcgcgcttgcagataaggcatcaaggccaacgcttgttgatggctggccaggcccagggacaggaacagcgggttggattccacgccgccccagccattggcgatcaggctggattcggtcacgtgctcggagagcaagcgatagcgttcccacgagaaccgcgtgagcaaggtggcagcgatggcgatgccgacgctgccgcccagctggcgcatcaggttgagcacgcccgaggcgccggagatcaacgtcagcggcaaccggcgcatggccaggttggtcagcggtacgaagatcatgcccaggcccaggccgcgaatcaccagtggccagtacagcgtgtccgggttgctgtcgagggtgaattgggtgtgcaggaacatcgcgtagcagtacatgacgatgcccaaggtcacgaacacgcgctcgtcgatcttgttttcctgggacagcttgccgatcactaaggtgctgatggcgctggccaccgcgccggggaaaatcaccagcccgctctggtaggcgctttgcgccaacaacgtctgcaagaacagcggcaccatgaataaggtgctgtacagcccgaaccccacgcaaaacgcgcagatgcagcccatcaggaactcgcggttgtgaaacagcgcaacgttgacgattgggttggccgcacgccgttcccgccagaaaaaccccaccaggctgaagctgctgagcaacaggcaagccaccgtccagttggattccatccagtcccaatgttcgccgcgttccagcaggatctgcaggctgccaacccccagggccaacaggcagaagccgctgtagtcgacactgctgggtttttgctcattgaccgaatcgccgatgcacaaccagcacagcaacagcgccacggccccgatcggcacgttgatcaaaaagatccagtgccatgacaaggtgtcgatcaggtaaccaccgacggtgggccccaaggtcggccccatcatcacgccgacgccgtacagcgccatgccgctgctgaccttttccttggggaacacgtcgtagatgatcgcctgggagattcccagcaacccgccgcccgccaagccttgcagcacacggaaggccaccagttgccacagttcggcggaaaacgcgcagcccaccgacgccagcacaaacaccgctgtggacaccaggtagtagcggcgccgcccaaaccaggcggacaaccagccgctgaccggcaggatcaccacgttggccaccacgtaaccggtggagacccacgagatctcatccaccgacgccccataagtgcccatcaggctgggaatggcgacgttgacgatggtcacgtcgagcaactccatcatcgacaccagcgtcaccgtgaacgcaatcaggtacggcgacctcataacgtctggctgccgctgcgtggcgtggcgacttcgacgaaggcgctcatgccggggctcaacaagggcttgtagtcagccggcacgtcggtgagggcgatccgcacctggacgcgctgcactaccttggtgaagttgcccgtggcgttttcctgcggcagcaacgaaaacttcgccccggtggccggtgccaggctttcgaccacgccgtcgaaggcctggccggggaacgcgtccacggtgaccttggcgtgctggccgacgcgcacgcggccgacttgggtttccttgaagttggcggtaatccacagtggctcggtggcgatcaggctcaagagcttctggccggcgaccacgaactggccgggttccacctcttttttcgacacgatgctgcgcaccggcgcggtctggcgggcgtcgtgcagcttgatccgcgcctgctccaactcggcttgcgccgccgcgatgcggtagtcctgcaccttgagttcggccttgttggccagggtgctttgcgccgctgcctgggcgttactgcgcgcggcttcctgggcgtggctcagcgcgtcgaaacgcgccttggccagttccaggtcctgggtgctcaacacaccttgggcgccgaggcgacgggcacgctggtagtcattgcgcgcctgctcaaggttggcgctcgattgtgccagggccgcctgcgcggcctggcgcatggcgaccgcgccgaggatctggctgtccagcgcccccgagctgccgctgcgcccggcggcggcgagcagggcttgccattgtgcttcgcgctgctgcacctggtattggtattcgctgtcgcgtatctgaaacagcaagtcgccgctttccacggtgacgttgtccatcaccggcacgctcatcaccacgcctgacagcttggcccgcaccggaataatcaccccatccagctccgcgttgtcggtgctgacgtacgcgctggagtactgccagcgctgccagccgagcagcagcaaacccccgaccacgacagtgcacagtgtgagtttgattagcttgcctttggtcatgtcttgctccctgtgttcatgcgcggctcagaaactgtgtgcaacccggcgcacagggcgttccgtggtgtgttgggctttctcctggaggaaatggtgcacgccgtcccacaggtcgatgcgggagttgatcgcggtcttggcgctgtcgatcatgtgttggtgttgctcgggcgtggtgacgatttcgccgatgatgcgtttggcggccgggccatgctcgtcgccgtccatttcgatgtggcgcttgaggtaataggtgagcatcggcacttcggtctcactcaccgaccactgcgagagcaggcgcccgaacatgtcagggatgatgtcttcacggccaaaaaagaagtacgccagcaccgcttcggtagagccgtgttgggcgacatcgagggtctggcacatgaacactttggccgccagcgggatctcgcgatcgttgagcgccttggccagcggcaccttggcctggatggcggcgaggaagcggcggaataccgagctgtcggcgccgatttcatccatggcggtgaggtacaggtccaggtggctgataaacccgccgcccgggtgttcgtcggtttcttcacccaccacgatttcgttgatcaagcgcgcagcggtgatatgcaccggcggcacccacggcagctcgacgcaggtgaggtcgcgctggatgcgcttgagcaaggtcatgaagtcccacacggcgaacacgtggaattccatcaaggtgcgcacgtcttcaaccgtgcggatgttggcaaacagcgggtggccgaataactgcgcgcgttcggcttcaatgtggctatcaatttcaaacggcatacatgctcctgcagcctgagggttcaggcggtcaatccattggggaattaaaggtgtgtgttcagtcgttcaccgtgtctccacggtaagggtggcggcgggtggcgtacttgaaggacgcaacgaagtttttttccagcaggtgctgccggtcggcgtaccagccggcgtcgagcagttgccggtgcaccttgggcaggcgccagcacggcacggcagggtaaaagtgatgctccaggtgaaagttcgcgccggcatgcatgaaggtgcacaggcgcgacgtgcgcgaacgcgcgggcggctggtcatcgtctgcgctgaaggcatgttcctggtaggcattaaaggccgacaccagaaacgccaccgccaggctcaggccgaaccccagcagcaacccgtcgacctgccacaaggccagcgcgtacacacacagccaacccagctggcaggcaatattgcagcgcgccaagtgttgaacctgcgccgcgctcaagggcagcggcgaggggctgaccagcggcccgaacgccaggcgcaaggtggcttgcaggtagttcgaggtggcgagcaaacgtgacagcgcgatgcggctcagcaaggtgcgatagcgcgagaagtgccggtaatccgggtcgtttgcgctgttgctgaagcggtggtgctgccagtggtcgacgaagtaaccggtcacgcagaaccccggcagcatcgaactggtgaagatgcccaggtaacagctgtgcatcgggttacggctcaggttgaagtgaaagccttcatgcccaaggatcgcttgcagaaacatcccgtatccggccatcacccagagtggcgcgcacagcagcaccacccacaggctggacgtcgcgttcgccacccacacaaacagcgcgagtggcagcaggtacaggcacagggcgtaaccgatgatcaacaaggactcgcccgtgtgcgctttgaacaacgcgcggtcgaggcgaacctggggcttggcgtgcagttgtctggccattggtagcgcgttactcgatcagttcaggtttgagcgccaggtgcccaccgcgtgtcagcgtgcgcaggcgcaaggcgataaaggcgtcgaccacactcggcgcaatgcgcgcggtgtacatggccagggtgcccatgaacgtcaggccacggttgcgcaggccgtctttgcggcaggcgcgcaccaggccgtcggcggcggcatcgagtttttcttccagggacagcaaggtcttgtcgccccacatgaaggtcaccaggcgcttgaccgacaggcccacgcgctgggccggcaaatggatcgcggtgtcgatgaaccccgggtacaccgtgaccacatcgagctgcccgcgatactgcatgcgcagaacgtcggaatacgcactcagcgcgcgtttgctggcggcatacgcggccacatacggcgcattgaccagggcgaacagcgacgaaacattcaccaccttgccgcgtttgcgcagcagccccggcaagaagccggcgaccagttgccacggcgcgaacaggtttacgtccaccgcgcgggtgacttcgtccgtcacgccggtttcgccacgctccagggtcagggtgccggcgttattcaccagaatgtcgatgtcaccgaagtcagtgctgatggcagtgatcacctgggccaacgccctgcggtcacacaggtcgacttgataaaacccgtcgagcagccccagttcctgcggttccaggatgtccaggccgatcaccgtggcgccttgccccttgagcttgtgcgcggcggcatggcccaggccacgtgcacagccgctgatgacaatggtttttccgagcaggttcatggtttcactccggcgatgctgaaggtggattgggacaagtagcagtcgaggttggtcgccatcgagatcttcgccggcgggtgaaattgcaggccacggcaggccatcaaccaattcgaactctggttgttggtgataaacgccatgcccccgagcatcgcgtgagcttcgtccgacagctggttgagcagttgttcgatgccataacgcaccagcaacaggcgggcgagcacggtgtgcaggtcgtgcgggttgcgttccacatccagcgctgcgccttccagggcggtgatcgccaattgcaggtgggcggccaggtcgacgcggtgatgggcggtccagcgcgcagcgtcggtcacggtttcgatcaacccggcgcaggtccccacgtaggatgcgcaaatcaacagctcgaaccagatgaaacccacggtttgcacatcgcccagcaggtgcttgtaaccggcggaaaacaccatgcgctccggcacgaacacttcattgaggcgcacttcgatgctttcggcggcggccagcgcgctgttttgccagaacggtgcccggctgatgcccggcgcatttgcgggaatcaacgccaccatcaactcttcgccgtccacgccctggcgggagtagctggcggtgagcaagtccatcgactggccgaggcagcaaggctttttgctgccgctgagcagcacgccttccggggtttggacggcctgcatgttcgagtcgagaatgccggcgcccgagttgccctcggcaaagcccgaggacagcaacaagcggttctgcgccacggcggccagcaacaggccttcggcgccgccgccgttttgggtcagcgccaacaggctggcgacggagaattggtgcatggtgctggccacggccagcgacggcgagcgcgcgcccagggcgatctgcacatgcaccgcatcgaggatgcccgcgcccaggccgccaccggcgcggttgaccaacagcccgaccgggccgtgttgcttgaacagggcgacgacgtcgctgtgcgatgcttcacgttcggcgaaggcaatgtccgccaggcgcgcgtcaaaacctggggcgtagttgtgcagcaccgcacgtgagcggttcaacagtgacagggtcatggctggggcctcacatagcttgtgggaaacaacccggtgatgatcgagttaatgttgtcgcgaatggcggtcttggccacggggtcgagcatgtcggcgagcatcggcaggcccaggtcaaagcgtgacttgaaggtgatgatcgagtccttgccgtccggcagcacttgccaggtgcccgagaaatggtcgacatcgccggccagttgttcgaagtggatctctcgggtctcggcgttgaacgtgtcgcgctcttgccacttgagaatgccgctgtggaaattgacttcccaggaggtgaacgacacctggtcgctgaccttgttgatggtgatattgcgcaccgattcgcacagctcgacgtagttgctgaagtcgctgatcacggcaaagacttcatcagcgcaggcgtgtggaatgtgcgcctggatattgacttcctgcatggggtaactccaaaaatcaaagggtggaaactgaagtggtgagcgcctgggcgaacccctcgatcaaccaattgcagtcctgggcgttcagcagcggcgacggcgtcagccgcacgacccggtgatcattgagcgagtggcaaacgatgatttgctgctcgatcagcgccatgaccatgtttgcggcaatcgaggcgtcgcgaaattcaaagcccagcagcaagcccgcgctgcgcagcttcacgcactcggccaggcccatctgttgcagcaaggcactgaagcgcgcgtgcaggtcctggcccatcagccgggcgcgctgcaccaggtcttcctgctccatcacttgcaacgtggcctgcacggccgccatggccagcgggttggcgccaaaggtcgaggtgtgcaccgtggggttgcggttgaacggcgcatagaccgccgcgctggcaaccatggcactcaccggtacgcagccaccggacaggcttttgcccaccagcatgatgtcgggcaccacctgctcctggtcgcaggcccaccaatggccggtacggcccaggccggactggatttcatcgatgatcaacagcgcgccgtattggtcgcacagctcgcggacacgcgtcaggtaaccgggcggtggcaggatcacgccggcttcggcctggatcggctcgagaatcacgcaggctttgtccggcgacgccagcagttgctgttccagcgcatcactgtcgccgaagggcacgaacgcgctttcactgagcaggccactgaacggctcgcggtagctttcgcggccggtcacggccaaggcgccgagggtcttgccgtggaaaccgccaagcgtcgacagcgtgcgacggcagccgttaaggcgcgccagtttcaacccggcttcggtggcttcggcgcccgagttgcaaaagaacacatagtccaggttgccggggcagcgggcagccagggcgtgcgcggccaaggcctgttgtgggttgagcaacaacttgctggccagcgcgttctgctgcagctgccgggtcacggcttccaccacgaccgggtggccgtggccgaggaagaacaccccatagccgccggcatccaggtactggcgccctctgttgtcatagatgtagacgccctggctggactgctcgatgggcaggttcatcagcgaggccaggcgggcgtagcccgaattcacatgctggcggaaatactggtcaatctgttcggcgtcgcttgcgggttcgataagaagcgggttcatgccacggaggcctcagcgaagggcggcgccggctgtttgagcatccgcgtcagggcacccagcttgggcgccaggtgattgagcgacagcagcaattcgcggctgacatcccgtgcgttgaacgccgcttcaccgagcaactcgggcaacgaggtaggcagcggcgtgcgcaggcacgcatagcggcacagttgattggcgcggcccagcgcggcctggatattgccggtcagcgccggcagaaacaccgggcggatcaggcgttcataaatgtccggcgccatgcagcgtggtcgcgtaaacgctttgccctgggcgtccatggattggcacatcaggtcgagcaggccggtcaggtccagggcctgcgggccgctggtgaggaagtagtcctcgccgatcaaacgctggcgcaaggcattggcaatcgcccgtgcggcgacgtcgcgagcgatcaagtcgatatagccggcaggcgggcagggcacaatcggcagcacgccggacatcatcaggcccatggtcatgtgaaaaccctggaagttgggcatatgcccgctgcccgaatcgccaatgatgatcgaggggcgaaagatcgacacgtcgatcccggccgagcgcaccagggtttcggcctgacgcttggccacttcataaggggtttgtgcctgcacgccttcgtagtagtcgcaggggtgagtgaaggcggtgctgatgtggtaaagcgggactttggcctgctggacaaagctcacgacgttctcggtgccgaggtaattcaccgagaaaatctggtcgacatcgccatccatacgggtgacggccgcagcgtgaatcacccagtcgacgcgcttgagcagcgcttcataatcggcggcgtccaagcctagccgagggcggcagatatcgcctgtgagcacttcgacctgcgggtggcgaatgcgacttttacgcgccaggcagaccaggtgaaagtcctgcgccaggcactcgatcagggactcaccgagcacacctgatcctcccgtgagaaggacggttaatttttgcggttctgacatgtaggacgcttcctgcggactcatcgaaagaattaacgttgcgtttcgccgaatcccaggcacggatgcccctggcgaacactctgtattcacgtgcggtggcgttgaagtgctttgggggaagacaatcagcgcttaacgtttcagcgaataagatccaatcgatattggcgttttgatatcactgcgtcttgaacgaaacgcttgtcttgcgcaaaaccttggcagcggtgcggggcgtcatgccaaacatgcggcgcatcatgcgcgccaggtgggcctggtcggagaagccgccatcggcggcggcgtccgacaggctggcgccagccgccagggacttggaggcgcgctcgagtttgttccagatgatccattgcgacagcgaaacgcccatctggtgcgtggccacgcagcgcaagcgcgggctcgacaggccgaccgcgttggcggcgcggctgacggaaccaggaccgtcgcggtcctggcgcaggaggttcaaggccttgtacaggcgctgatcgatgggcggcgtgattgccagcagccgcgcgagcgcctcgacaaactgcgccagggaggtggtgcggcggaaacactcgagcatctcctcactggccagggcgatgccattgtgatgaagcaaggctttgaggtcgcggcccagtggcgtgtcggggttgatgtagacaaaggccaccgggtgaatgtcggccaccgcgcggtgctcgacattgggaccgatgatcaccccggccgcgcggatcagctggccgggcaattccagcttcacgggttggtgcacgccgatgcacagctgaatggcgacatgggagtgggcagtattttgatccgcgcggccaatgtagcccgcccatgaatcaccaaaggtaacgctgccgtcccacatgtaaggtcttcctgactcagagggtgagtgttgcgtgtgcagggtaggcctgcacaggtctggattcaagcaccgggcgtgccgtcaccgctgtagcgccgcgcgcatccccgccagcttgatgcaggtttcgtcgtattcgctggcagggtcggagtgttcgacgatgccgcagccggcgaacatccgtgcctgattagcgtttaacagcgcactgcgcaggccgacgataaattcgccattgccatgggcgtccagccaacccagcggcgccgcgtaccagccacgatcaaaaccttcgaactggcgaatatgcgccaatgcctgctggcgttcgtggccgcccacggcgggcgttgggtgcagaatcgagaccatcttgagcaaactgcagcctggctgcagcgggccttcgatcagcgtcgccaggtgctgcacgcggctcaggcgcttgatgtgcggcgtgggcggcatgtgcagcgcctgcacccagggcgcgaggtcgcgttgaatgatctgcaccaccaccgcgtgttcgtgccggttcttttcgcagtcgagcagggcctgcgccagttgcgcatcctgttcagggttggggtcgcgacgcgcagtgccggccagcgccagggtttgcaggcggccgttgtgcagcttggccaggcgttcgggcgaggcaccgataaagcacgcctgatcacgtcggaaggcaaacaggtaggcgctggggtcgttgctggccagcgcgctcaacgtgcgcccggcacttacgggctgggtgtattcgctgagcacttcgcgcgccagcaccacctttttcaacggggtgtcgcgcagcacgtccagggcgtgggcgattttgctttcccagcaggcacgcggcaggccttggtcacggatgtgttgcagtgccacgctcgggcgcgggccggacacgtagcggtccatcagcgcgttccattggttcaacacgtgctcgcagcattgttgcgcattatcgccgggcgcgatccgttgctggcacagcagccagcaactgtcggcattgcgcaccagcagcagcgtcatcaacagcagtgacgcgtcgccaaaaccttgccaggcgccgctggccttgacctcatgatcaaaccggaagccgccgcagaccgtcggcgccaatgggccgtggctgaccgcgtgttccagccaacgctgccattgcgcgtccacagcggcaaaacgctgcgcgccaacgccgctgagttcggcggccacgccccagccgaacaggcttttgtggtcttccggcgcgcgccagaacaggcactcggcgcccggttggtcgacgctgcaaaacagctccagcaggtccagcggggcgagttcaatcgagtagctggccaacaccgcttcgccgtgttcgacggcccgctcgcgcgcctgttcaaacaccgccgccaggccttgggcatgggcctgcaacgaaggaaaggccctcatgctggcgttctcgttgcacgccaatgcagcacttgctggccgatgtaccaatggatgatctgggcgaacagggtttccataaagtgcgggtccaggccggcgtgttcggcccattcgcggcgttgcggcagcatctgcgccacgcgctcgggcgcggcgatgctgctttcggtcggtttgaagcgcgcagcggctttgacgtaagccatgcgttgacgcatgagttcgatgatctggtggtccagtgaatcgatggcgtgacggatgtccggcaggccatcacaggcgtcgggtgttttcatcaacaggtttccttgggggcgggcgagagggtcagcagcgtggcggcgatggcgtcgagcagcgcctggcgctgctcgatcaggtaaaagtgttcgccgtgccagcgctgcaggtgcagtggctggtggctggcggcttgccaggcctgggcttcatccagttcgatttccgggtcgtgttcggggtagaacacctcgatgcggctgttcaggagccgcggttgtgggcaggcgtaggtttcaacgatgcggtagtcattgcgcaggccaggcaggaacagctcgcacagcgccgggtcgtccagcagcgggttgggccggtcggacaaacgtcgcacgtcgtcgagcaaggccgcgtccggccccagatgcaactgcccgccgcgctggcgatgcggcgccgggtgggcggacacgaacaggtggtcgacggcaatagcgcgctgctccaggcgcgcggccacttcataggccaccaccgcgccgaggctatggccgaacagcgccagtggccggtcggcgtaatccgccagcgcgtgggcggcgccgtcggcgaggcgctgcatgtcggtcaggcacggctcgctgaagcggtcttcgcggcctgggtactggatggccaacaggtcgatatcgtcgggcagggcattgacccagtcgcgaaagaaacttgcactgccgccggcatgcgcgaaacacaccaggcgccagcgcggcatgggcgtcagccggtaagcgcgtacccagcggttcacgaggcggcccgctgcagccaggcctggcgcaagcgttcgcgcaagtccttgcggctgactttgcccacaccggtgtgcgggaagtgcgcaacaaactcgatgcggtccggcaccttgaacgccgccaaaccctggccacgcaaatgctgcttgagcgcaaacgccgacggcgccggctcgcgggcgacgataaacgcgcaggtggattcgccaagcaccgcgtccggcatcgccaccagcgcggcgtcgtgcacctggggatggctgatcagcaggttttcaacttcttcggcggcgaccttttcaccgccccggttgatctggtccttgtcgcggccttcgaccaccaggtaaccgtcggcggtgcgtcgcacccggtcaccgctgcaataaaagccgtcggcagtgaacgccttggcattgtgttcgggcaggcggtagtagccgcgaatggtgtacggcccgcgcacttgcagctcgccgacttcgccgtcaggcaccggctggccgtgctcatcgacaatgcgtagctcatcgtcggcactcagcgggcggccctgggtatgcagcagcacatccgcgtggtcgtccaggcgggtaaaacacagcaagccctcggccatgcccagcacttgttgcaaggtgcagcccagtgtcggcgtgacgcgcgcggctgcggtgctgagcaattttgcgccgcccacctgcagcaggcgcaggctcgacaggtcggcctggcgctgggcctgggcgtccagccacagcatcgccagcggcggcaccagcgcggtgacggtgacgcgttgttcgctgatcagtgcaaagcaggtttcagggtcagagcggcgcgtacacaccacgcgcccaccggccaacaaggtgccgattacacctgggcagcacagcgtgaagttatgcgccatgggcagcgcggtgaggtacaccgtgtgtgcatccaggccgcacaccgcgctgctggcgcgcacgttatagaggtattcggcatggcgccgcgggatcagcttgggcgtgccggtggtgccgcccgacagttggaaacacgccactgtgtcagcgtgaccggcgtcctgctccaatggctcgctgttgtataacgccttcagcgcggtgaattcctcggcatcgccgtcgatcaccacctggcgcaggtgtggattggcttcggccaactggcgcgccatctggcggcaatcgaaaccgtccaactgatcgcagccgatgtaggtcgaggcctgggcaaagctgcaaaagccgccgatctcgtgttgacggtgggcgggcagggcgaggatcggccgcgcaccgagccggaacaacgcaaagcacacctcgataaacgcgctgccgttgggcaaatgcaccaccacgttatcgcccgctgcaacacccagggcacgcaggccaccggccagatgccggcaacgctgcaccaggttgcggtagttgaggtgcaatgggccgtcggtaatggcgatcgccgatgggctgcgtgcggccaccgcatccagcgcctgggcgaaggtctggtcttgccagtaaccggcctggcggtagcgttccgcgaacgcggcgggccagtcgggctcgtcgccaaaggtgtctgaatcgcgtgcgcaggtgtgcaatgacatggaatcccctatttgtagaaataattggctacaaatgcccaaatgagatctattatcattgtccttcgccgagcgcttctcaacgccaaggctttcggacctgtgactttttcattagatgaaatacacagcggctttaaacagggaggtttacggtttaaaagcctcctcctcattcaggtcaggccccgcgtaatggccttaggatcaagggaaaacccaatgactattacgatcatcgcccccagccaccaagagacgcaggccgagcccaagggcaaccaacccggcacggtttacctggaaccgcacatgacgctggtcaccggcacgctgtggtcagagagtgagaattgggtcgaagacccgctggagcgcggcctcaagctgatcctggtgcagagtggcgagctttcgtgccgcattcccgggcacagcgagcaatcgatcaagggccccagcctgtgcaccatcgtcaatgacggcgagttcacctcgtcgcagatctacggcacctccacgccgctgcgttacaccatcgtgcaactggacctcgaatccctcgaccgccacctgggcatggccccgcgcaaactgttggccagcagcggcggcgacccgtacatgatggtgcgcccggcgccgcgcgcgatgcaggcgctggccacacagattgcgacctgcccgatgcagggcccgagccgctcgttgtatttgggcggcaaggcgttggaattgaccgcgttgagcgcgcagttcctgctcggtgagcgcgggcagccggagcaaaagctgcgcatcacctcttcggatgtggagcgtgtacacgccgcgcgcgaccgcctggtgcgctcgttgttggagccgccaagcctgaatgcgctggccagccacgtcggcatgagcccgcgcaaactcacggcggggtttcgcaaggtgttcggcaccagcgtgttcggctacttgcacgagcatcgcctcaacgaggcgcaccgcatgctcagcgacgaggaaagcaacgtttccaccgttgcttatggcgtgggcttcagcccggcgcatttctccatcgccttccgtaaacgctacggcgtatcgcccagcgaaatccgctgagggcatgggtgtgtctctgaatcgaatgaaaaggcccgtgcatctaaagccctgagcgctttctgaaaacctgcttgcgatagagttccaattgagaatggcttccatcttggtgagccagggactttatctagacgggtcacaggaagcttttcatgagcgagctgacaacagcagacacctccttactgcgcacatggctgatcgaacacctcgcccagttgctgggcgccaccgtggcggaaatcgacagcctgggcgatgaggaaaacctcctcggttgcgggttggattccatccgcctgatgtacctgcaggagcgtttgcgcagccacggcttgcacatcgactttgctcaactcagtgcgcagccgtgcctggcagcctggcttggcttactgcacggccaggtcccgcaaagcgtggtcagcgcggcagcgccgttgctggcgccggatgacagctttgaactcagcgctgtgcagcaggcgtactggctggggcgcgggccggcggaagtgctgggcaatatcagttgccatgcgtggctggaattcgactgccagggcatcgacccgcaacgcctggaagcggcggtgaagtgtgtgcaggcgcgccacccgatgttgcgcgccagtttcaacgaaggccgccagcggattcttgccgccaccgacctgccggtgttcgatcaccaggattggcgccagcactcgcaagccgccgcgcaagaggcctggcgcgcattgcgtgactggcgctcgcatgaatgcctggcggtcgaagccgggctagtcatgctggtcggcctggtgcaattgcccgctggccgtgaccgcgtgtggctgagtgtcgacctgctggcggttgatgtggaaagcctgcgcttgttgatggcgcaactcggccaggcctatcaggcaccggccacgcttgcgccgccgcctgctgtgcattttgccgactacctgagccgccgtcgccagcgccgcgccgacgcgtatgagcgtgaccgtcagcactggtgccagcgcctggcgcagttgccggacggcccggcgctgccgctggcccgcgcaccggagtcgataaaagcgccacgcttcagccgccaggccttcgtgctcagcccagccgaagccgaacgcctgcaacgccaggcgaccgcccacgggctgaccttgcccagcgtgttcgccacggctttcaacgcagtcttggcgcgttggagcgagcagccgaatttcctccttaacgtgccgctgttcgaccgccacgatgaccagcaagccattgaccaggtgatcgccgacttcaccaccttgctgctggtggcctgcgaagacgcgccgcagttgccctttgccgaaggcgcccggcgcttccagcgcgacctgcacgcgaccatcgaccacgccgcgtttcccgcgctggaagtgctgcgcgaagcccgtcgccagggccatccgcgctcggcgccggtggtgttttcctgcaacctgagtgacgcaagttttgtacccgcgagttttcgcgaagtgttcggcgacctgcacgacatgctctcgcaaaccccgcaagtgtggctcgatcaccagctgtaccgcgtcgaagacggcgtgctgctggcctgggacagcatcgccgagctgttcccgcagggcgtgctggaggccatgttcagcgcctatatcgaactggtgcaacgcctcgccgacagtgactggaaccagccacagccggtgttgctgccgctggcccagcaagcgctgcgcgaccgccagaacagcgtgccgtcgctggctgcggggcgtggtttgctcgacgactttttccgccaaagcacccaacagcccgacgcggtggcgttgatctgtggcacccgacggtggacgtatgcggcactcgccaaccaggccctgcgtgtggctgctggcttgctggacgccggaatgcgccccggcgaagccgtggaagtctgcctgccgcgcgggcctgggcaggttgccgcggtgttcggcgtgctcgcggccggtggctgctacgtgccagtggacaccgcccaaccgcccgcacggcgcagcctgatcgagtcggcggcgggcatcacccgcgtgatcgccgagcagccgccggcggatcctgcgttgcaatggcttgacccgactcaactggaacactgcgcgccattggcggcagcgaaaaaaagctcgccacacgccagtgcgtacgtgatctacacctccggctccacgggcattcccaaaggcgtggaggtcagccacgcggcggcgatcaataccatcgacgcgctgcaagccgagctgcaggtcacgccggatgattgcctgctggcggtttcggcgctggatttcgacctgtcggtctatgacctgttcggcgtactggggcagggcgcgcgcctggtgttgttgcagcctgaagaaacccgcgacgccatgcgctgggcgcaactgatccgccagcaccgcgtgagcctgtggaactcggccccggcattgctggaaatggccttgggcatcggcgctgaacagtgtcagtaccaaagcttgcgagcggtgttgctgtcgggcgactggatcgccctggacctcgccgcgcgcctgcgtcgccacgccacgtcagcctgccgcgtgtatggcctgggcggcgcgaccgaggcgggcatctggtcgaacctgcaacccatcgatgaggtgcccgagcattggccgtcgattccctatggcaagccgttggccggccaggcctatcgagtagtcgacgccagcgggcgggatgtaccggaccaggtgatcgggcaactgctgatcggcggcgcgagcctggcccggggttatcgcaatgatcccgtgctcaccgcccagcgttttcgcagtgatgagcgcgggcgctggtatcacaccggcgatcgcgggcgcttctggcaggacggcacgctggagttcctcgggcgcatggaccagcaggtcaaggtgcgcgggcagcgtatcgaactcggcgaaatcgaggcggcgctgacggcgcatccgctgatcgacaacgcctgtgcagccgtactgaatggcagcctgggcgcggcggtggtgttcaagtcgttggaggctccggtgccggttttgccagccgcgtcgatgctcgatgacagcctggcagccgaaagccgcgtcaccgccgagctgctgcaacgcctgctgcaagacccgccgcccacgccgttgcttggcacctggcgcgaatggctggccagttatgtcgagtccatcagccttcatgatgcattggcgcaattgggctggcgcgaagccgatctgcacagcatggtcggtgccttgcaggtgctgctgcgcacggaaggcggcacctctcaagtgttgtttgacccgttgctggcgccacaggccatggcgctcaacctgcccgcaggccgccaagtgctggacgccatgaaccgcgcgctgcaacacagcggtacagcgctgaacgtcgccgtgctggatgtgcgcggcgggcagttgcttgaccagtggctgaaccatctgagttcacgcgacctgcagctgaccctgttcgagaccagccccggcctgctcgccgccagcgtgggcaagcgtcagcgcgtggcgagccaattgctgctggacggggtgttgcccgctgagcactggtcccggtacgacgtagtgatcagcttcgcggccctgcacagctacgcgcagccgtctgacggcctgagcctggcccacgcgctgctcaaaccccagggccgtttgatagtggctgacgtgctgcgtgactcgccgttgcggctggtcagtgcggcgctgctggacgggcgcacaccgctgctgccgggtgccgacgcggttgtgcgcttgctcggtgaaagcggcttcagccacctggaatgcctgtggcaaaaccctgcgatgctgttggtgagtgcccaggctgccgacgaagtcttgagcagtgaacgcctcaaccactggctgcaacaacgcctgccgcaggcgatgcgccccgaacacctgtggtgcgtgccgcgctttgccttgaacgccaacggcaaaatcgaccgcacgcgcctgcaagccagcctcggcgacgcgttgcaacgcagccaaccctgctgcgacgaagacgccgagctgagccccgaactgcaggcgctggcgacctgttgggaaaccgtactgggccgctcggtgcacagcgcccaagcgagtttcttcagcctcggcggcgacagcctgttggccacgcgcttgctggccactgtacgtgaacagctgggcgtgagcctgcgcatgggcgacttctacctgcaaccgactctcgccggcatggccgcgctgctggtgcgcaacaccgatgtggcgatcgaggagggcgtgctatgagcctggatgatttgctgcacatctgccgtgaacgccagattgaactctgggccaccgaaggcaagctgcattttcgtgcccccgaaggcgcgttggactcagccctggccgagcgcattcgtgcccagcgcgaagcactgatggtgcacctctcgccccaggattggcgcgcgcagccggaacaggcgctgcagcccttcgccctcagcgccgtgcaaggcgcctacgtgctggggcgtaacccggcgttcgactatggcggtaacgcctgccacttgtatgtcgaatacccgtggccggcgaatgtcgacaccgcgcgactgacccaggcctggaacgccttggtgcaacgccacccgatgctgcgcgcggtggtgcaggacaacagccgccaatgcgtgcaagcccaggtgccctggcaatcgctgccggtgcatgacctgcgcgaggccacgcccgaggcattcgacgctcacctgcaaacgttgcgcacacgcctggatcatgcctgccatgcccttgatcaatggcctatcctgctgcccgaagtgagcctgggccgcgagcaggcgattttgcattgctcggtggatttcactttgctcgattacgccagcctgcaactgttgctggtcgaactgacccagcgttacctcgaaccgacgcgccattggcccgcgctcgaagcgactttccgcgactaccttgagcacgaacgcagcgcacgcaacagcgccgcctggcacagcgacaaagcctggtggctggcccgcctggacagtctgccggggcgcccggacctgccgctgagtgagcatgccggtttgggctccacgcgtttccagcaccaccatggcgagttgagtagcgtgcaatggaacgcgctgtgttccctcgccagtgcccagggcctgagcgcggcgggcgtaacactcgccgcttttgccgaagtcatcgggcgctggagccaaagcccggacttttgcctgaacctcaccgtgctcaaccgcccgaacctgcacccgcagctgggccaggtgatcggtgacttcactgccttgagcctgcttgccgtgcacggcgccgacggagcgagttttgtccagcgcgcgcggcgtatcggtgcgcagctgttcgatgacctcgaccacagccgctttaccggcgttgaggtgttgcgtgaactggcccggctgcaagggcgtggcgccgacctgatgccggtggtgttcaccagtggcatcggcagcgtcgaacgcttgctcggcgacgccgggcgcttgttgcaaccgcccagctacatgatcagccagacgccgcaggtgtggatcgactgccaggtcagcgaccagtacggcggtttgcagattggctgggacgtgcgcgtcggcgtgctgcccgacggcatggccgcgcagatgttcgacgcctacgtcgacctgctgcaacgcctggccgccgacccgcaggtgtggcaggcgcgtggcgatatcgtgttgccggcgcaacgggccaatccacaggtcgaggccattgccccggcgcgcaatatcgccgccggtttcgcccaacaggcactgcgcacgcccgaggccgtggtgatcagcgaccgcgatggccgctacagttatcgccaggttgctcaacacgccgccgctgtgcgtgaggctcttgaagcgcttggggtcgaacgcggtgcgcgggtggcggtgatgctgcccaaaagcgcctggcaattgatggcggtgctgggtattacccaaatgggcgcggcctatgtgccggtggacattcgccagccggtcctgcgccgggaagcgatcctgcgtgacgccgggattgcagcggtaatcaccctgcaagcgcaggcattgccggacacccttgagctgccgcgcgttgccatcgacagcctctacgccgacccgcattggccaacccgcgagccgctggcggtggccgccgaggaactggcctacatcatctacacctccggttccaccggcacgcccaagggcgtaatgctcagccacggcgcggtggtcaacaccctcgacgacatcaaccagcgttacgcagtcaacgccgacgactgtgtgctgggcctggcggaattgagtttcgacctgtcggtgtacgacttcttcggcgccaccgccgtcggcgcgcaggtggtgctgcctgatccggagcgcggcgccgacccttcgcactgggcgcaattgatgctggaacacagcatcacactgtggaactcggtgccggcccaagggcagatgctggtggattacctggagaccgaacctgcggcgattccggggccgcgttgcgtgatgtggtcgggagactggattcccaccaccttgcccacgcgctggtggcaacgctggcccgacagccagttgttcagcctgggcggcgccaccgaagcggcgatctggtcggtggagcatccgatccgcccgccggatacggcgttgccgagcattccctatggccgcgccctcaagcaccaaaccctggaagtgctcgacagcctcggccgccaatgcccggtgggcgtgcgcggcgagattcatatcggcggcctcggcctggccctgggctacgccgaagacccgcaacgcagcgccgagcggtttatcacccatgccagcgggcgccggctgtaccgcaccggcgaccaggggcgctacctgagcgaagacgggttgatcgagtttctggggcgccaggatgatcaggtgaagattcgcggccaccgtatcgaactggcggaaatcgacgccgcctggctggcccatccgcagctggcggcgagcaccacggtactgcttggcgaacgtcacgagcgctcgctgtgcagcttcgtgacgttgcacacccacgcgccggacccgcagcgtgtgcgcgatgagctgcatgaagtcacggcccaggcgcgccacagccttgagcaggcggattttggcgcgcgcgccgacatcgaagcggcactggccgcattggaccacgcggcagatgcctcgctgctgcactggctggcgggcagcggtttgctgaacccggggcaagccatcgcattcgcgccgctgtgcgccgcgttgaacctcgcacccggccagcatcgcctgttgcgacactggctggcgttgctggtcgacagtggccacctgcaagccgacggtgacggctggcgctgcctggcaacaggcttcgatcaagatcatgcatggtcacagttcgcccggctggcgccgccaggcctgtggccggtggaactggtggattacctgcgcgacagtgcgacccgtttggccgagcaactcgacgggcgcctgagcccggccagcctgatgttcccgcaaggttcggcgcatatcgccgaagccatgtacagccgtggcctgcacgcccaggtgttgcaccgggcgatggctgaggcggtgagcgcgattgtgtcgcgtcagggccaacgccgctggcgcatcctcgaagtgggcgccggcactggcgcggcgagtgcgttgatcatcccggcgctggcgccattggtggccgccggggtgcagatcgactacgtgttttccgacgtgtcgagttacttcctcaacgcggcgcgcgagcgttttgcggcgtacccgtgggtacgcttcatgccgttcgacatgaacaaaccggcctgcgaacaaggcttgccggccggctcactggacctgctgctgagctccggcgccttgaacaatgcgttggatacgccgagcctgctcgccggtctgcgccaattgctgcaggccgatgcctggctggtggtgcaggaactgacgcgtgaacaccgcgaaatcagtatcagccaaagcctgatgatggaaacgcccgaggatgtgcgcgccagcaaccaccagctgtttgtgcacaccgatcaatggctggcgtggctgaacagtgaggcgggcgatcaggctgaatcgttggcgggtgccgacagcgtgttgaacctgctgggttatgacgtgctggtcgcacgcctgaaaaccgatcggccattgctgagtgcagaggccttgctggcctttatcgccgagcgggtgccgcgttatatggtgccggcgcaggtgcgggtacttgaccgtttgccggtcacggccaatggcaagatcgaccggcgcgcgctcaccacgcaggcggagcaacgcccactgcaagcggtacaccgcgcaaacactgaggtggcggatgaactggtgcagcgcttgatcgcgcagtgggagcgcgtactggactgcagcgggttgtcggcggatcaggacttctttgccgccggtggcgactcgctgttgatcgcgcagttgatcgccggcctgcgcgagcacgaacccttggcccaggcgcaacctttcgaccgcttgctgcgctgggcgctcagccaaccgacgccccatggcctggcccagcgcttgcgcagcgagtcgagcagcgagccgagccatgcaacaccggtggcggcgcccgcgctggatacgcgccgagcgccactgggcgggcgcgggcgcgtggatgcgttgacgcaactgagcggcggcgcaggcaccgcgcgcgtgctggtgcacgaagggctcggcacgctgttgccgtatcgcgggctgatcgctgaattggctggtagtggtccgctgctggggctggcggtgcacaacagcgacgactacctgagcctgcccgcggagcatgtcaacgcaaccctcggcaaacgctacgcgcaagccctgtgggacagcggccgacgcagctttgacttgctgggttactgctccggcgggctggtggccctggaattggccaaggccctgctgcaattgggcgctgaggtgcgtcacctggacatcgtctccagctaccgcattccgtatgtcgtcgacgatgaagtgctgatgctctacagctttgccgccaccttggggctcgacggcgcagcactcggtctgccgacggctgagcagctgcaagcgtcagcggccctcgacctggatgtgccgttactcaaatcccgtgtactggcggcggcccagggcattgctgatgaacagctgtatcgggtgtttgcccattccgtgcacgccagtcactacagcgatggcgcgccgtatgtgggcgccatccgcctgtttgtgccgagtgtcgccaaccccatgatccccgatcaccaggccagtttgcaggcgtggtggcaggccgcatcgctggcgccactgactgtgcacaccctgcgtggcaatcacttcgactgcttgaacgccgggctgagtgattatttgctggagaaacgcccatgacattgccattgaaaaccttggtggtcggctcgcgctttggccagctctatgcggccggtgtggccgccgccgagcagctggaattggtcggcgtgctggggcagggcagtcgtcgctcccaagccctggcgcgctacctggaagtgccgagtttgcaagcgcttgatcaggtgccaagcgatacgcgcctggcgtgcgttgcggtaggtggtgcagcacgcggcgaacagggcccggccttggcgcaggcgttgatggaacgcggcatggacgtgctgatcgaacacccgctgctgccccaggagctgcatgaactgctgcgcaccgcgaaccgcctgcaacggcgttgcctgctcaacagcttctacccgcaactgccctgcgtggcgcggtttatcgagctggcgcggcaactgcatcgccaacagggcattcgccatatcgacgcccagtgcgcggtgcaagtcagctacgcaacgctggacgtgctggcggcgctgttggaagcggtggggccgtggtcgctggattgtgtcgcgccggcgctgtcggcctggcgcgatatcagcctggtgatggcgcaagtgccggtgtcgctgcgtgtgctcaacgagctggcggccaatgatgacgggcgcatgcagatgctgctgcgcatcagcatcgccaccgacagcggcacactgctgttggcatcgccccacggcccgctgctgtggctgcccgctgtgcgcgcgccggtggaggatgccgacggtgtgtttgacctgttcgggccgctggcgagtgagcccttgccgtgtgcagaagtgctggaagccgccgcgccggattgggcccaggtgtaccgcgaggtctggccgactgcagcggcggatgccttgcaaccgttgatcaccggtgtggggctggcgcgcttgcagcagcgcagcgtggaggtcgtcgggctgtggcaacaggtcacggccgcactcgggtttccgcagcagccacccgtgacgttgcctgcggccagcctggcccaagcattggaggccgctcgatgagccagttgagtgaaatgctgcgcccgtttcgtcggcgcctggggttggcgattgggttgcaggcggttgccgggatctgttcgttgctgccgctgattgccctggcgcaattggccgacagcctgcgccaggcaccgccgctggcgccttcggccatggcctgggtggcactggcggtgggcgcgtcggcgctgtggttgtgtggccaaaccttggcactgcacctcactcatcaggtggatgccgacctgtgcgaccgcttgcgcgtgcgcctggccgagcatctgcaacgcctgccgctgggttggtttgcacggttggggcccgacggcgtgacccgttatgccgagcaggatgtacgggcgctgcaccagttggtcgggcatgcgcccacggatctggtcaacctgctgctgattcccctggccaccttcgcgtacctgctgtggagccacagcgccctggcgctgtggtgcctgttgccattggccgtgggagtgctcggctattggcgtttgggctcggcgcattaccgcgacgctgtcgagcagcgcaacggcgcgatccagcgcctgttcagcgactacagcgaattcgccggcaaccttggcctggtgcggcaatttccggacgcgggtattcatcgcaacgtgcaggaggcggtgcagcagtttgatcagcgcttcagccattgggtgagccgcgccgggcacctggcggccttgatccaggtgctgctgagtgccccgtggctgttggcctgggtggttatcggcgcgttgtgggtcggtgacgtcggggcggcgcagatctgtgcgtttttgctgttggtgcgcgccatggcggcgcctgttctggccatggggcacggcttcgatgcgttgaacaacgcgcgtgagagtgcccggcgtttgcaggcggtactcaacacgccgccgctggccgaacccgacgcgccgcacgtacctcgggacgccagcgtggagatgctcgacgtgaatttctcccacgctgacgtgccgatactcaggtcaatcaacctgcgcctggagcccggcaccacgactgcgctggtagggccgtcgggtgcgggcaaaagcaccctggccgggttgattgcacgctttatggacgtggacagcgggcaagttcgcgtgggcggggtggatgtgcgccagatcgccagccgtgagttgcagcagcagctggcgctggtgttccagcaggccggcgcgttgcgtctgtcactggcgcagaacatcgcgctgtatcaacccgaggccagtgaagcgcagattcgcgccgccgccaaagcggcctgcctggacagctgcatcatgggcttgcccaagggctacgccagtgtggtcgacgaggatgtgcggctgtccggcggtgaagtgcagcgcctggcgattgcccgcgcgctgctgtcgcgtgcgccgatcatgctgctcgacgagccgacgtccgccaccgacccgcaaaccgaacgcgcactgcgtgccgccttgcaggacgacgcggccggacgcacgcggctgatcgtcgcccatcgcctgcacagcatccgccatgccgagcagatcctggtgctgtgcgaagggcgcatcgtgcagcgcgggcggcatgccgagttgttggccgtggacggcgtgtaccggcagctgtggaacgagcaaacctcgaacgctgaacaactggagcctgtgtgatgagttttttttcgccgttacggcatttgcccgagctggcccggcgcgcactgcgcggggcgttggtgtggatgctgctggccgccgtactcgatggtttggcgggcctggccctggtgccgttgattctggcctggttcgaaggctcgccactgcagtcgagcgtgctgctgttgctggggctgacgctgctgcaggtggtggtcagttacgtcgcgcagcgccgcggttacctggccggtgcggggttggcggcgggcctggtcgcgcagttggtgcagcacctgccgcgcttgccgttgacccgccgtggccagcttgaagggctggtgcgcgggccggtgttcaacagcatgggcattcccgcgcatttactggcgccgctgatgacggcgctggtgacgccgacggtggtggtgctcgggctgttcttcattgagccgcgcctggcgctggtgttggcgctggcgtatctgccgctgttcggcctgttgcgttgggccgggcggcgcagcctgggcctggagcaacagcgccaggccgtggatcgccacgccgcgcagttgttgcagaccttcgcgcaacagcaggcgttgattcgcagcgccggcgacgccagccagggccagttggcgctgcgggatgccttgcatgagcaacaccaggccacgcgccgtctcaatcgccgcgccttgcccgcaggcctggggtttgccacggcggtgcagatggtgttttcgctggtgctggccggtggcgtgttcgcagtggcggcggggtatttgcccggtgcgctgctggtggcggtgctggtgttgctggtgcgttttatcgagccgctggcgcaactggcttacctggatcaggccttgcgcatggcgtggcaggcgctgtcccaagtgctggcggtgttggcggcgccgaccttgcacagcccgcagcccggagaacagccgcaggatgcgagcctgcaagggcacggcttgaacagcttcggcgagggtggcgaacacctgctcaaggacctggacgtgcaatgcgcgcccggcacgtttaccgcgattgtcggcccctcgggcgcgggcaaaagcaccttgctggcgctgcttggccggggcatggacccgcagaccggcgaagtacgcctcggccatgtcgacattcgccagttaagcgaacacaccctggcccagcacatgacccaggtgttccaggacagcggcctgtttgccggcagcctgttgtggaacgtgagcatggcgcggccacacgccacacctgcgcaattgcagcacgcggcgcgggaggcggcattggatgatgtgctcaccagcctgccggacggctggcacagtgaagtggggccgggcggcgccttgctctccggcggccagcgccagcgcgtcggcctggcgcgtgcgctgttgtcgccggcaccgatcctgctgctcgacgaacccaccgccagccttgatgcgcacagtgaggcgcgggtaaatcgcagcctgcaggcactgcacggcaagcgcacgttggtgttggtgtcgcacaacccgacgctggtgcgcgacgccgaccagatcctggtgctggaagacggcagcgtgagcggttgcggcagtcacgagcatttactggcgacacatccgtggtatgcgcggtttgctgagcaacaacacgggtgatggagtgccgggcatcaattgaaaaagtccctaaatcgaaaagtcggctgcttcgtttaaacgatactaatgcgaattattatcgataaatggggcggggcaatgtcacaccggggagcaacacaggcggggcgggggttcagacgtaacggcgcacaatgggggattgtgctggtattgggcttgagcccattggcacaggcgctggccgccgtgcagttgggcaatgtcgagattgccggcgaggacacttccggcgatgtgacgtcgccgggcgtgaccaccctcggcaagctgccgctcaagctgcgggagaccccgcagtcggtgagcgtgatcgatcacgagcgtatcgagcagcaaaacctgttcagcctcgatgaagtcatgcagcaggccaccggtgtgacggtgcaacccttccaactgctgaccaccgcgtattacgtgcgcggcttcaagatcaactcctttgaactcgacggcgtgccggcgatgctcggtgagacggccggctcgccgcaagacatggcggtgtacgagcgcgtcgagatcctgcgcgggtccaacggtttgctgcacggcagcggcaacccggcggccacggtcaacctggtgcgcaagcgcccgcaaaaggaatttaccgccagcaccaccctcagcggcggcagctgggaccgctaccggggcgaagtcgatgtgggcgggccgctgacgcccaccggcaacgtgcgcgggcgaatggtggcggcgtatgaagaccgcgactatttctatgatgtcggcaagcaagacacgcagttgctttatggcgtcaccgagttcgatcttagccccgacacgctgctgaccttgggcgcgcaataccagaccatcgaccaagtcaccaacatggccggcgtgccgatggccaaggacggttcgagcctgaacctgccgcgctccacctacctggatgtggattgggaccgcttcaagtggaccacacgccgggtgttcggctccctggagcagcaactcgatcacgactggaaagccaagattgccgccgagtatcaagacgccgactccagcctgcgctatgccggggcctacggcgccatcgacccgctgaccggcgacggcgggcatttgatgggcgcggcgtataaattcaacagcacccagaagagtgtggatgcgtcggtcaatgggccgtattcgctgttcggccgcagccatgaattactcctgggcaccaactacagccagggcgaaaccgagcagcacacggcgcagttcaccacgccactgaatgtgccggtgaatgtgtaccgctgggacccgagcagcgtgcccaagcacggcatcggcgcctacacctcgccgggctcgaccaccaccacgtccaagggcgtctacgcgctgacccgctacaaactgctcgacccgttgaccctggtgatcggcggccgcgccagttggtggaaccaggacgcgccgaagagccacttcacccccggccgggaaatcaccccgtatggcggcctgatctgggacttcgcgcagaactggtcgtggtacgccagctacgccgaggtgtatcagccgcagaccgggcaaacctggagtggtgacctgctcaagccggtggagggcaaaacctacgaaaccgggatcaagggcgagttggtcgatggccgcttgaatgtgtcgctggcggtgtttcgcattgacctggaaaacaacccgcaggtcgaccccgaacacccgagcgcggggcaaaacacctattacatcagcggcggcaaggtgcgcagccagggcttcgagctggaaagcaccggctacatcacgccgcagtggaacgtctctgcgggctacacctacaccaccaccgaatacctcaaggacaccaacaacgcctccggcgagcgctatgccgaattcacgccacggcacatggcgcgggtctggacccagtacgaactgccgtggcaggaacatcgctggagcgtcggcgccggtgtgcaggcgcaaagtgattactctacgcaatccggcgcggtgaccctggagcagggcggttatgccttgctcaatgcgcgggtcgcctaccgcatcgacgaccattggacggcctcggtcaacggcaacaacctggcggatcgcaagtactaccagagcctgtccaacgttaactggaacaaccgctacggcgagccgcgcagcctcaacatgaccttgcgaggcacgttctgatggccacgccggccctcggcccctggccgctgcgcatcggcctggcgctggcgggcagcctgctcagcagcctgcaactggcggtgctgctggcgcggcattatccgtggggcggcgggctggagcggctgtatgccggggtgttccttggccttgggtttctggtgacggtgctgctgtggtcgttgctggcgccggaccgcaagcgcgtggtgtaccgctccagcgcctggctgctgctgttcacaccttggttgttatgggatgggcagtggtcatgatgggcgcaccgagggcgctggtgcagcgcgtgcatgccggcgttggcggcgtgtttggcgtggtgctgtttgtgatcctgctaagcggcgcgtggagcatggcccatgaagatttgcgcgcctggtttcgcggcccttcggcgctggcgcaagggccggcattgccgctgtcgcagtggctgggaatcgcccgtgaacagggcttggcgctgggtgagttgcgtatccgcctgccggacagcagccactcggtggttgagctgtgcgcgtcgcccaccgactgcagcggcgcactggacccggccaatggtcgtgagctggcgtcgggcaatgcggccgacattctcttcaacctgcacaaaagcctgtttatcggcttccccggacgggtgctgatcagcctgctcggcgtggtgctgttgctgatgatttgggccggtagcgcgttgcacagcgggcgcctgcaagacctcaagcgtttgcgccgggaccgtggcgcgcgggtgtttgcccacgacctgcacaccttgatcggccgctggtgcgggccgtggctgctgttgttcggcgtgaccggcgcgttgtcgggtttgggggcgctgggcacgctgggcctggccgggcaagcgtttcccggtgcgccgcaacaggcctttatgcagttgctgggtgcgccgccgcccatcagtccgcaagcaggcacgacgcaggtcgatctcgatcaactgctgcgccgggacgccattgctcacccgggtttctctgcgcaaaacgtcgccttgcaccactggggcgagccgggcgcctgggttgaagtcagtggcatccagcaaggcttgcccagcaccgccgtcttcgaacgccatgcttatcgcgccagtgacggcgaagccgtgggcacccgcagcgccagtgggcgcggcgtgtggctgcaggcatttattgcggtgcagccgctgcactttgccgactaccgctgggtgccttatgccgggcccctgttgcgcgcggtgcatttcgccatggccttggcggcggcggtgctggtgctcagcggtttgtacctgtggctggagcgccgccgcctcaaggctggcgccggttggcaggtgttgttgcgcctggtggtgggtggaggcggcggcttgctggcggccacggctgtgttgctgtgcgccggggcgctgggtatcggcggcctggcgtggtggttctggggcagttggcttgccagcctgctgcttgtgtgtgccatgccgccgcgccgtcaaccgttgcacctgttattggcgatggccggcctggccttcgtcgcggcggctgtgctgcacctggcgggcagcttcagccacggcagcttagcgctatggccgatcgatcttgtgttgctgctgtgcggcgccagtgccttgtgggcgctgcgccaattgatttcttttacgcgtgcggcacgggctgccgccgccaatgttgtctgaggggataatcgtatgttggagctgctgaaacattggcgcatggtgctgaccttcgcgctgttgtacctgtcccagggcatttgctttggcatcgccatggacgccttgccgaccctgctgcgccatgacggcgccgcgctccacgcactggcgttcctgcccttggtggggctgccgtgggtgatcaaattcatttgggcgccgcaggtcgataaccattggagcccacggctgggacggcggcgcagctggatcattccgatgcagatgctggtgctgctgtgcatcgccatcctggcaaccaccggcctgagcgtggaaaccgccggcgtggctgtcggcctgctgattgtggcgtccctggccagtgccacgcaggacatcgccaccgacggcatggccgccgaatacttcgccgacagcatgctcgcgcggatcaatgcgattcaggtgggtggcaccatggtcggcttttttgtcggcggcgccggcaccttgctgctcagcggctacctggggcaaaccacagcattcacgctgctggcgctggtgccgttgctgagcctggtgtgtgtgggttggttgcacgtggcaccggccaaacccaaacatccggatgtggcgcatgcctcgttgtggcggtttatcaaacggccgaaggcgctgtcgctggtgttgctggcgttgctgtcggcgatgacctcggtctcggggttcggcttgtccaaactgttcctgaatgacgtcggctggtccctgcaagccatcggccaattgggcatgagcggtggcgtggtcaccatcgtgctcggctgcggcggcggcgcgtggttgatccgtgtactgggcctgtggccgaccttcatgctggcagtcggcatggccggcgtggccgcaatgacctggttgatgcaagccagcggcctgctggccacgcacaccgcgctgatctggctggcggtgggcctgggctcgttcgcgaccggcgccacctcggtggtgatcatgacggcgtccatggccttcgccgctcaaagtgatcaggccggtacggacatgaccgcggcgcagagcacgcgtgatctgggcgagatgctgtcttcgactttgctggttgggttgacggcacaggcggggtatagcggtgggtttgtggccgggatcgtcatggcgacgttggcattgtgggtagcgttgaacctgtcgcggcaacgtgtaggcgttaaagcagtagggtaggtgggccctcgagtgttgccattggaatagtcgccgccttcgctggaaaaggatttcaatagtgttaaattggcgccttattcatctcatcagaacctcgaactctacccaccgcaaggataaaaagtggacttaaactcttggataagcgcaacgcatgaaaggattcaattagccatttatgagtcgtatctgaatggggggctaggtgggtggcaggaaaacaccattagtaccgcagtgctaaaagctattggaggtagcggagctgtcagctggagcgattgtgctcagaaagtcaggtgggaggcgttcaagttaaacggtgtcgctgagactgagttcggcgatattgcattgttggttaaggtttgtttgtcgcccactgattgggtggatggggtggcattctacgaagccaaacgacaatattttaatccggcttggaagccgcttggctttcagtctctggacagtcaccagctatctcggataggtattgcaacccacgccggtcacgctctgttatatgacgcgaaccctgagcaagaaatcatcagtgcgacggccgtgcctaacgcattggctcgcccattagttgatatcattgggaaaggaaaagcagcgggggagcgactcagcaaatttggacggccgtgggtcatcgtcttagcgaataatctgcgcggatttgagttggactttgatcctgccgtggtcagtgcaatgaaacagtggatggcgtctaatcagccgcccgcattcattatcaatgctgcggtgtcgagtgcacctctgacgcttcggctggatagcttcccttcaaaactgcgaggcttttcaagagtgccggatgaccgcgtgccgccgccgccgggcgggagcacgccgccgtttaggccttgatcgtattgaatcattcaagtgccggcccatcgactttgattcaagtcgtgggccgcactggctacagagcacgcgttaggtgagttggcgattcgcgcagggcgctatcattcacctagatgagatatatcctctgcatgaattaagattttttcggggcagccaatctgcacgtagttcatgcattctgcgaacgtgaaatgcatgttcagctcgtcaagaattacctgattgttcaatgatgtgtgtgcctcgaaaagatagatgattttacttaaaaaagaatccgggtaggcttcaaggatataattagttttgttgcctatgtcttcgataattgacttctcgatcttgtattttttgtaaatgtgtctcatgaaatatgagaaataaatccttcggtttgccccggtaataaagtccgaccatctcaggctgtgctgtttgtgcaaaattctctcgggcaaatacagccgtatgcgcttatacaatctggaaatgtaaacggcagcatccttactgagaatgggataggtagaggcaagcactgagacggcaccagcacatagaaacgcgttcgccacgttgaaatggtttcggtcggccgggctggtatcacacgcgctaagaatcacgatcggaggaatttgtgccgcacccgacaattcttgtggatagagcttgccgtcagcgagcttcagataaccgtggctgtcgctgtcgtggccgccgtgcatatcaaatatgaccagcgcataacggtactcgctgagcgccgtgatcaattcagctttgttgctgatcgatctgaatacaatttccggtttgaaatcaggtacatatgcgccatttttgacggcttcctggattaacttcgggaactcttcactgtcaaatatgcgcatggtcttttcgatttcctgctgcatatgttgacggatttgatcatcaggcccgaatgaactgatcaccaaaattttactaaagtcattaatggttaatttgatttcatggttgttcgtcaggatcttttccttgatgaaacccggtgtggaaaatactctgctggtgttgtgcctgagcattagcggaaggccgttcaggtttgtccattcgagcgggaggttggaaattattttgatgtgtttgttgcaatcactggagatataatccagcaacccgtcggatgtactaataacatgcttgctgaaccgagcggcaagtttatggagttttgacgtgttttggttgcggatatttaaacccatgtcggaaagggtggggaagactaggttgttgctgaccctgagtttaatttccgctgcgagggtaggggcggcataaagataattgatcaggctgctgaaataaacttcttttttgtagtcctgagtaaaacggttggcgtgcgtttgatcaatatttgtttgcgattttgcataagtgatggattcggccatcaacgctgcgtccgaaatgtcggctcttatgagtgcgtgttttgtgtaacgcttggcgttgatagagtattccaggtcaatgctgaaatcagtaattaaataatcgacgctgggcatgcagatggtggatggatagtgctgagatatcttgctttttacctcatttaccaggtcgatggagcgccgggtgttttctacgtttgaggacagtttgattgtatcttccacactcaagccagggtgtatgccaatgcttttaagggtggcgatattgccgtgggtaaaaatggtatcgtttatcgttacatgagggtcgacaggcagcgccgggctgaatgtgtcaggcagatctgtataaatgtgctctttgtttcgtatgtgtgcaaaataaaattctcttaggctttcaatgctaagcgtctcgaaatagggaagattttttgcgcatatatcctgacgcagcgagacatagaatatgtctttttgaataatgtggtagtctggcaaaggcgcattgaggaatactactttgaaggtataggggagcctgatgatatcacttggggttttaatgaattctatgattcgcccgtggaatatgctgtccagccttgttctaatagcctcttcgcgcgtgcataataactctgcgatactcatcggtaaatcgtttatgtgcttgagcgccgctattgtttctggtgtgtgaacagaccctttcaagaatgttgattcggactctacggtgtcttttattgcatagcaaatactgaagttgttattcatttaacattctgttccgttgggtataaggcttcaaggtggtcaatgctattgaggtgcagcgagtgtgccgcaaaccctaactattatgtggcactgtttggtggttgtccgcaagcaaaatatttggaattatgttggcaggcaatgttacggcataacaatgtttgcgctgcgcagtcaagtcgatttccctctctccgataggttgctggtttttattactaccgtttaatactcttgggtttttaacacttcggatccctttgcaaacctgtgcagcgactactgaagtctgggcgattttcgctccaaggatgagcacgcttgtaagggggatcgtggacggcccatcgtgcggcataaaaagtctaaaactcgttaactgattgatatatataagaatgcttcggacgggttggcggtaagttgtaagaatatcgatacagtgccgtacattttattgacgccatcaaaacgccaccctaagatcgccgaaaaataatggcacaaagccatgtagagggatctagaaatgtggcgttttatgcgtcgggccggggttggcctgctgtccgtttttttctgcctgggctctgccagcttcgcgcacgccgcgcccccgcagaacacccccgacgacacccgttgcttcccgatcaaaaccatcgaactctctggtatcgacagcctctgcgaaggcgagcgtgccgagctgatcaaacactacatcggccaatggctgggcgtgccgcagctcaacgccgtgctcaaggtgaataccgaccgttacctcgtcaaaggcctggtgaccagccgcgcttatctgccgcaacaagacctctccagcggcaacctgaagatccaagtggtcgaaggcaaagtcggagatctgaaaggcgccgaaggcagcgacatcaacgacctacaactggccatgagctttccgggcaagtctggcgagttgctcaaactgcgcgagatcgcgcaaatggaattggcgccgggcaacaccgcgggcggcagtgatgcagtggtcaaaaacaccccgaaaaagccttggcgtgtcgggctgtcacggcacaacggcggccagcgcagcactgacgagaagcagtttgcgtctggattttacctttaaattttctaacgcccttgggcatcgagacacgacatggatgttcgtcagttcgccttcctcgcgcgccagccttctgctgccgtaaaaagccgttcccacttcctggggctgcctaaacgtgggttagcgttgattctggccaa

SEQ ID NO: 54 - DNA, 87216 bp, Pseudomonas poae FL10F
ggatgcattcccacgcggagcgtggggacgatcacttgggaccaagtcagtcaggcctgatgatcgttcccacgctctgcgcggtaacgccgcctgggacgctccgcgtcccatcacacgagtgacgcagagcgtcacgggatgcattcccacgcggagcgtggggacgatcacttgggaccaagtcagtcaggcctgatgatcgttcccacgctctgcgtggtaacgccgcctgggacgctccgcgtcccatcacacgagtgacgcggagcgtcacgggatgcattcccacgcggagcgtgggaatgctcagggggtaatcggcagcgcgcgtttgtgcgcggtcttgctgtaggcgccttccacaatcgccctcacccgctcactcaccggctcgcccatcaagtaggcatcaatctcggcgtaggtgcaggtgtaggcatgctcgtccaacttgcccggcgccaagtcttccaggtcggcggtcggcggcttgtgtaccaggttggccggtgcgcccagcgatgcagccaacaggcgcacttgggtcttggtcaggcccgacaacggtgccaggtcgcaggcgccgtcgccgaacttggtgaaaaaacccatcaacgcttcggcagcatggtcggtgccgaccaccaaaccgttgtgcaggttggccacggcgtattgcgcgatcatccgcgtgcgtgccttgacgttgcccttgatgaaatccacatgggcggcgctggcttcggttgcggtgaggctggccatcaggccgtcgacgctggcggcgatgttcagggtgtcgatgtggtccggggtgatgaaatccagcgaggcctgggcgtcgctttcatcggcctgagtcttgtacggcaggcgcatggcgataaaccgcgcagggtagtcttcgccacgcaactgttccaccgccaactggcacaaacggcccgccgtcagggagtcgacaccgccgctgatgcccagcaccaaagccttgcaaccggcattgcgcaaagtggtcttgatgaagtcgatacgccgttgaatctcctgcggctcgccgcccttgaccagcttacggttgatattcagttcctgtgcgatacgttcttgcatgtcacacctctttgtagtctgcattgacctgtgggagcgggcttgcccgcgaagacggcgtgtcagtcaacccattcaatgctgacccaccgctttcgggagcaagccccctcccacagaaaacaccttcgccgcgtactgcaaaaacgaggcgtcttcgcagacgttcttgatcgggtcatcggaaaacttcaccaccggctcgccgtgcacacgcaccagcttcatgacgatgctcagcggctccacaccctcgacatcgcaggccaaactggtgcccatgccaaagccgaatttggccttgccacggatgtgccgcaggatcggcaggcatttttcaaagttaaggccgtcggaaaacatcaggtccttggtcatcgggtcgatgcccagctgtttgtagcgggccaggactttgtcggcccaggcaatagggtcaccggagtcctgacgcaggccgtcgtaaagcttggcgaagtacaggtcgaaatccttgaggaaaaaatcggtgctgatgcagtcggtcaaggcgatgccgaggcggccacggtattcgcgcacccagttttccaacgccgcgttttggctttcgcgcaggcgcccgagttgctggtgcaccatcagccattggtgggccatggtgccaatcagtggcaggtcgaattcgtaggccaagtgggcgttgctggtgccgatgaattggccggggaagtcgcggcgcatgatgtccaccacttcacgctgggccttgaacgacaggcgccggcgcgtggagaagtcagagacgcgcaggtcggccagctcgtcgcggctgaggtttttctccagccagtcgaacttctggtagagcttgcgggtgacgtcttccagggttacgtcggggtatttgtcgcggttgcgcagctcactgaccaacgccagcaccggctgctcgaacatgatgcagtgcagcatcggcccgaccacgcggatgttcagttgaccatcgacttcgctgacatggatgtagcgcaggttgaagcggaacaggccgagaaagcgctcgtaatccggagtcaggtattcgcgaaagcgtgggttgaacagaaagcgcagctcgccttcgcgcatgtgcaggccggcgagtttttccagttcgtcgcgcaactgcgggatcaagtggccgagtttttccttggaacggacgatgaagttgtattcgacgtcgacattcgggtgctggtgcaacacggcctgcatcatggtgaaggtgtagtagtcggtgtcgagtaagccttgaatcaccggggactcgtagtcgtaggcgctttccatggtgtttctccttaacgcgtggccatcgcggccagttcttcgcgggtgctgctgatgacagcaccggccttgagcaactcattcaccgcctgtacgccgccctcttcgctgatccctcggcaggccggcaagtgcaggaccacctccaggccagccttgagcagttgcaacgcggtggtcttgacgcagtagtccagggccaggccaccgacgatcacgcggcgcacgccttgggctttcaaatactcgatgaccccagtcgacagtttgtcgtgcaggtcgtggtagcaggcaccgtaggggtgcaggtcgggttcgacgcctttccagatgaagtagtcgtagtcatacggcgtgggcagttcatccagcaaggtaaacccttccgtgcccggcacgcagtggctgacccaggtgacatcggcgtgggcaaggccagtgggttgcagcatctcgctgtgctgcgtgaccacccacggggcatgcggggtgtgcgcgtctttgctgccgacgcgatggccggccaggctggccatgtaattgagttcggaaccgatctgatcaccgcccgccaccggtaactcgttggggcacaggggcgtgaagctcttctgggcgtcgacgtcgaatgaagcaatggcagttttcgcgagggtcatggcggttctcctgtggcctacaaacaaaagtacacgtcatgtactttcattgcaagaaacatttagttatctatgctggagcaagtacatgacatatctgttcgatccgttagactgtgcgccaccgctgttcagaaggatgtcacatgccacttagcgcctacctccacaccgtcgacctgtgcgtgctgttctattgccgcgcctccggagaattgaagctgctgctgaacaagcgcgaagccgagcccttcgccgggcattgggcgttaccgggcgtggtggtgaacggcggcgtgcaagatctgagcctcaaggatgcggtggagcgtttgcgggcgagtgacaaggtcggttttgagctggcctggagtgagcaagtcggcaccgtgggcgacgcgtttcgcgacccgcgctgctggtcatcgtccacgtactacctggcgattgtggcgcaagcgccggcgctggctgagcatcaaggctggttcgcgctgaacgccgtggccgatggcgatatcaagttgccgttcgatcacaacctgatcgtcgccgcggtgcaggagcggctgttgtccaagtcgctgtacagcaatgtgccgctgatgtttttgggcgatgaattcagcgcgccggaagcgaccacgatcttctcgctggtgctggcacggccggtattgaagaccagtattcgccagcgtttgttgaagctgactgaagcggggtatttgcgtgacacggggcgcaaaaagcaaggcgacggcggccggccccaggcgacggtggagaacctgaagccgggggaagtgtatttctttgatcgcagttttgctgactgactcggtatttaccaataatgaagctcccacattcttaatcgatgctcggctttagttcatccagttgccgccatcgacgttgtaggtctgggccaccacatagtcggcgtctttcgatgctaaaaagacagccatcccggtcaaatcctccgccgtgcccatccgcccgaacggcacctccgcccctacccgcttcttcttctcgcccggcgccaacccttcatgcctggcaaacaacgcgtccacgccatcccagtgctcgccgtccaccacgccgggcgcgatggcgttgacgttgatgccttgcttgatcaggttcagccccgccgattgcgtgaggctgatcaccgccgccttggtcgcgcaatagatcgccaccaacggctcgccccgtcgcccggcctggctggccatgttgatgatcttgccgccgtgcccctggctgatcatctgccgggccgcggcctgcagggtgaacagcgtgccggcgacgttgatcgagaacagccgttcgtagctgtcgcgagtgatgtcgacaatcggcgccaggtcgaacagcgcggcgttgttgatcaggatgtcgagcttgccggcatggcttaccacggcggcaatcgcggcgtcgatggaggcttggtcggtgacgtccattgtgacggcatacgcctgtgggcctagctcagctgccgtggcctgggcgcgttgcaggttgatgtcggcgatggcaacggttgcgccctcggcgatataggcctgggcaaaggcgcggccgatgccgcgcgccgatccggtgatcagcgcgctcttaccttcgagtcgtttcatgcagaagtcctgtttatttggggtagccggcgcgtttcatttcgcgctcggtggtggactgagcttcgagcaacgcctggtcaaccgtcatgccgccggtaagcgccgccgagaacagcttgccgaccgaggtgccgatggcctggaattccgggatggtcacgtactggatgcccacgtacggcaccggtttgaccgaagggtgcgcagggtcggcgtgcttcatcatctccagcgtcacctgggcaaacggcgcggctttcaggtaggcctcgttgtaggtggactggcgggtgcctggcggtacgttggtgatgccttctttatcggcgaccagctggatgtagtccttggaggttgcccaggtgatgaacgccttggcagcgtctttgtgcttggaggtcgccggaatcgccagggaccaggcgtacagccaggaagaacctttgtcggtgacttcagtcggtgccgctgcaaaacctacgtcgtcggcgaccttgctctggcttttatcggtggtgaaggagccggcgacgctggcgtcgacccagatcgcgcatttgccgctgttgaacagcgccagggtttcattgaaaccattactggagacgccgggcgggccgtagtttttcagggtgttgacgtaatagttggccgccgccgtccactcggggctggtcagttccggcttccactgctcgtcgaaccagcgcgcgccaaaggcgttggccatggtgctcagcagcgcgatgttctcgccccaaccggccttgccgcgcaggcacatgccgtattggtctttgtcttttaccgtgagcttggcggcgaactcaccgagctgggtccaggtcgggtgggcgggcatgctcaggccggcctgtttgaacaggtcggtgcggtagtaggtcacggtgctttcgccatagaacggcaaggcgtacagggtgttgttgaccgacaggccctggcgcaccgccgggaaaatatcctcggcgtcgtagtcggcgggcagttgggtcaggggttccagccagtgcttggcgccccataacggcgtctcgtaggtgccgatggtcagcacgtcgaactggccgccctgggtggcgatatcggtggtgaggcgctggcgcagcacgttttcttccagcaccacccagttgagcttgatgtccgggtgctgctgttcaaagaccttggacaggcgctgcatgcggatcatgtcgctgttgttgacggtggcgatggtgacggtatcggcggcgtagctgggcatggccaaggccaggccggacagcaggaaaagcgcttgcgggagctttaacatggcggtttccacctgttgtttttgttgttgagcgctgattacagcagcttggccccaccctcacaaacgcgtgacgaacgctcggctgatacttttttaacctgggctgcaggatcaaaaaagtatcagtgccaggcgataccaggggtagcgcgcctgttgccaagcggcgtattttgcagtgattccataagtaaaagaggcatcagcatgcccatcaaccgcgccaagctgttcgagcatcgccctgccgaacttgaagtcatcctgcccgagccggaccagtgctttcgctggttcgaacatgactacccgtatgacctggcgcgctggaaccatcaccctgaattcgaaatccacctgatccgccaaggcagcggcaagctggtggcgggcgactacatcggcgcgttcagtgccgggcatgtcgcgctgatcggcccggatttgccccacgactggatcggcgacctggcccccggtgaatacctgaccgggcgcgacgtggtgctgcaattcgacggcgccgccctcctcgccctgcgcaacaccctgccggaactcggcgacttgcagccgctgttcgaactcgcccggcgcggcctgcagttcagcggcgacaccgccgtgcacgctgcgcgcttgatggaagacatcggcaacgcccacggcctgcaacggctgatcctgttcctgcaactgctcgacaccttgaaaagcgccccggcaacccacgtgcaggcgctggccagcccctgctacgcgcccaccctggatgcgcgcagtgccgagcgcatcaacaaagcctttgattacctgatgaccgagctgaccggcgacgtgcgcctgtcggtcatcgcccaacagctggacatgagcgagccgggcttctcgcgcttcttcaagcgcaacaccggccacggctttatcgacctgatgcgcaagttccgcgtgcagcgcgcctgccggctgttgctgcaaagcgacatgtcggtggcggatatctgctttgaagtgggctacgccaacctgtccaacttcaaccggcattttcggatcgaaatgaaccagacaccgagcgagtatcggcgcgaaacggggatgcatttgtttaaccgcatcgagaaaatgacacccagtcatttttgatcaaaaggtcgattaatttcgcttttttcccttttattcaagccattgagcaaagttggtacagcctgtgcaaacgtttgcggaacgaacttggtcggcaagttctccttcacccgcgaaatcgggtctaaccgcgtacgaatagggattttcaatgcaccccacctcaaggcgtcctgcttcctttggtgtttccttgctactggccgccgttacgggagtactcagcgcacccattttggcgcaggaaaaacccgccgatgactcagcacagggcgaaaccctggccccggaagccagcccgacgaaaaaaggcgcgtacctgtcggaatggtttaaccaggacctgaccctgatcggcagcaaagacatcagcttcggccccaagccgcaagatgacgtgtacctggaatacgaatacttcggccgtaaaggcccgttcgagttgtacggctatatcgacgtgccgaagattctcggcatcggtaacagtaatgacaaaggcgcgtgggaccatggctcgccggtgttcatggagcacgagccgcgcatctccatcgactacctggcggggcgcagcctggccatcgggccattcaaggaatggtatgtagcgtttgactggatctacgaccatggcagcaacaagtcgaaccgcgccaacaccctgtacagcggtttgggcaccgacatcgacacgcactcgcgggtcaacctgtcggccaacttctatgggcgttaccagtgggaaaactatggcgcgagcaatgaataccagtgggatggctaccgcgcgcaaatgaagtacatcgtgcccatcagcaagttcgacaacggcgcgtcgctgacctacatcggcttcaccaactacgatttcggctcggacctgcacaaggacaacccggcacgcaccgccaattccgtggtggccaccaacgtgctgctgtactcgttcactcacctgcgcttcaccctggtcggccgttactttcacaacggcggcaactgggaagacggcagcgagctgaattttggcgaaggcaacttccgcgcccgttcggacggctggggttattacgccggtgtcggctaccaattctgatcaaggagtattagatgaaagtgtttactcgtctctcgctggctattggcttggcgtttttgccccacgtggtgcttgccgatacgcctgcgccgatcaagcccaaagtgatgctgatcaccatgttcgcccccgaggcgcaaacctggatcgatcgcctggaactcaagcaggaagtacgcgtgccggggctttccgccgaatacccggtgattcgttgcaacacccaggacgtgtgcctgctggtcaccggcatgggccagaccaacgccgccgcgtccacgctggcgttggccttgtcgcccaaattcgacctgcgtcaaagctactttttgattgccgggattgccggtatcagccccaaacacggcaccatcggcaccgccgcctgggcgcattacctggtggagttcggcacccagtgggaactggattcgcgcgatgcgcctaaagactggccgaccggctacatcggcatcaacaccaaaggccccaacgaaaaaccgccgttggactacaagaccgaagtgtttgagctcaaccccaagctgcaagccaaggcgtttgccctgtcgcacaaggttgagctcaccgaaagcaaggaatccactgcctggcgtaaacactacccggccgccccggccaaccagccgccgcaggtcacccagtgtgacaccctggcgggcaacacctggttctccggcacgcgcctgagcgaacgcgccgaggtctggaccaaattgctcaccgacaacaaaggcgagtactgcaccacccagcaggaagacaactccacctatgaagccctgctgcgcgccagccgcgaaggcttggtggatatccagcgcctggccgtggtgcgtgcgggttcggactttgaccggccgtaccctggctacagcgaggtggacaacctgttgaaatatgccgaccaaggcgggtttgtgccggcgctggagaacctgtatcgcaccggcaatccgctggtacaggccatcctcaagaactggtccgcctgggaaaaaggcgtccccgaagcctgataaaaatcaaactgtgggagcgggcttgcccgcgatagcgttctgtcagtcagagagttgttgactgatgcgccgccatcgcaggcaagccagctcccacatttttttcgaccgcgttataaatccttatgccgttggatgcgccacattcagcgccttatccaccaacaattgcaccccttccagcatccgacaaatgcccagcgcgacattacgttgcgagccctcgatttcaaacgccatatggttagcaatctcgctgatggacgccaaatcctgggaagcattgaccagcaacgtttccgtgcccaggtcggcgcgcacggtgaagagcccatcggtgggttcggggatgggttttgcggggttgaggtagtggttgatcgcgcggtaggccacttcgtgcagggtgctggtatcgaagtctggttgacctggggggtttgggctgtctttgatcatggtggaactcctggtagtggagctgccatcactcgcggtcaaacgaagtggggtggcagctgaacgcgggttgaccgaccggaaccagggatccggcatacccgaaggtatcccgcgcacagctgccgcgacacgatacatcaagcgtagaaaaaacgcctgatataggtcttgggtgctgtagcgcactggtttagtcggacggtcaaatccgatcgctgaatggtcagcgacggcagtgaggttagtcagcgcccttccgaccgacaacctgaaacgcttgtgggaaacgtctgatcgagcgcgcctcccaaaacccagtgaagatcaaactgtgggagcgggcttgcccgcgatggcggcctatcaggtaaaaaactgttggctgacccaccgccatcgcaggcaagccagctcccacatttttttcgaccgcgttaacaatccttatgccgttggatgggccacattcagcgccttatccaccaacaattgcaccccttccagcatccgacaaatgcccagcgcgacattacgttgcgagccctcgatttcaaacgccatatggttagcaatctcgctgatggacgccaaatcctgggaagcattgaccagcaacgtttccgtgcccaggtcggcgcgcacggtgaagagcccatcggtgggttcggggatgggttttgcggggttgaggtagtggttgatcgcgcggtaggccacttcgtgcagggtgctggtatcgaagtctggttgacctggggggtttgggctgtctttgatcatggtgaaggtcctatgattgagtggagctgccaacattcgcggtcaagcaaagagggaggcagctgtacgcgggttgaccgaccggcaatcaaaggaaatccggcatacccgaaggtatcccgcgtacagccaccgcaacacgatacctcaggcgtaaaaaaaacacctgaaataggtttttgccgtagcagtacttcaattaatcggacggtcaaatccggtcgctaaattggcagcgacggcagtgaggttagtcagcgcccttccgaccgacaacctgaaacccttgtgggaaacgtctgatcgagcgcgcctcctgaagcccagtgaagatcaaactgtgggagcgggcttgctcgcgaaagcggtgggtcagccacagaaaggttgactggaacaccgcattcgcgagcaagcccgctcccacattttgagctcagtacatcaggtaaatgtgtgtattcggtcaaatgtgatttaaggcaggaagatgatcttgtccgcactgcccttgttcacttcctcgtagcactgcacgccatccgccaacgccacttcacgcaacccggtcggcagcggcaacgtcccttcatcaaagaagcgcccaaactgctccagcatcaccgcgcactgctcgcagttgtagagcaatgagttgatgcccaccaccgaaccgcctttgcgatacaacgccaacgccggcagttgcacatgcccatccaccggggcggcgatgattgcaatgcggccgaacggcgccagaccggcgaccgccgccggcaaccagaaaccggtggtgtcgaagatcacatccgcgccgcccttgaacacggcattaacctgcgcacccaaatcttccgggttgcccagcgtgatcgcgtcaaacccttgagcctgcagcgcctccgtctgatcagccttgcgcaccgccgccagcacctgcgcaccgcggattttcgccaacgccaaggccgcgctgcccacggcgccattggcaccgatcaccaacaaccgcgtgcctttggcgacaccgctgcgctccagggcatcccaggcggtggtgtatggcacgccaaggctggcggcctgggcgaagctcaagtgggatggcttatgcgccacgcctttggccgacacggtgaggtattgagcgtgggagccgtcagcaaaaaagccgaggtctcggccggtgccccatacttcttgaccgaccagttcctgcggcccctcgaccacaaccccggcgaaatcccggccgggaattcgtggcaatgtggtgtagggaaaacggccgagcacgttcttaacgtcgctggggttcaggccggcggctttgacctgcaccaggacttcaccggcagccggcaccggcttggcaacgtcaacgaaattcagggcggcgaggtcgccggtggcggaaaattgcagtgctttcatggccaatatccattgaagggaaacagggaatcagaacaaccaaccgctgacccactcgcgccccatgggccagagtttttcaccgagcaacatgcccatcaagccgaccagggcaattgcgggcggcgcgggtgagcggaagtccaaggcaccatagatcacgccgacaaacaggccgatggcgagggaaatcaggtagttcatgggggcggcgccttgtaggttgatgggctcagtgtagtgagcgcctgcctgaagcatcggccaagtgcttcaggatttcggccaaaccctcaacccgtgtagtgcgacggcgccacgccgagttcacggcggaacatgtcgctgaagctgctcggcgaataacccaacgaccgcgcaataccgctgaccgactggccctggatcagctcggccacggccgtggccagttgcacctggcggcgccattcggcaaagcccataccgaggtggttctggaacagccgcgccagggtgcgcacgctggccccggccgcctcggcgtgttgctcgaacgggatctccagcgacggcgccgccatcaccgcctggcaagcgttgaccaaacggcggtcggcgtcgaccggcatggcgatgcggatctgcgagcggcgtgcccgctgcaattccaacagggccaggccgaccaccgcgtcgtagtaaaccgcctcgccgttatcgccctgatcaaccaaggcgacgatcaactcgcgcaacagcccacccacttcaatcacctgcacctggctgtccagcgtcgccgccaaggccgggcgcagatagatattgcgcatctgcaggtccgagaccacgcgaatcccatgctccacgaccggcggcaaccacaccgcacgctggggcggtacaaccagggcttcgcgaggcgtctccacccacatcacgccgctcattgcgtagagcaactggccccagtcatggctgtggggctctacgtacaacccacgcgggtaggtgcgcgccaggggttgcacgggcacggcgtgatcactgaggtcggggggcgcggccagggccatgggctctacatcatcaagggcgaaccgccatggtaatgaccgctgcgcgacaatccgagtgaatttttaccgccaacaaggatcttttgcttacaccatgaaggcagggagcactcacaatggacttttcagcaccggtcaatggcaaggcgcgcattgactacacccaggacacgctgttcgggccgatggccaagcatgccgagtgccaggtaagcgtacagcgcacgccggagcgcacggtattgcgggtattccagccgctaccggatgatctgcacgcggcgcaaaccgtggtgtttgcgctggaggggcggcgcaccagcgcggtcgtaaaaggccgccagcgcatggcagaccacagcgtcaggttcgaactcaaaccccaataaaaagaggccggtaaaaccggcctctcgctgacacgcttaaccgtgagccgacttggcgcactcacagcccgttggcgccacacacggctcaccatgggcatggtgctcggcacagccctggcagcaatagcccttaccgtccttcattaccgcgtcggcgcccagtacacatttgcagtgcgggcagtcacaggttttatctggcatggtcagactcctttttcatggtcgtcccggtgcagcgaacgcggcaccttaagagatgactcccggcaacgcgccaaggttcagcccgttaatcggcctgacgggtattgctgcggtacataaacaccaaggccagcgccaggcagagcatcgccacgatgcggctgcccgacagttcgatggccgggttgccgagccagccgaagttgtcgatcagcatgcccatgcccaactggccgacgatcactgcaaccgtcgctaccgccgtaccgacgatgggcaccgcgccgaccatcaccatcatgtacaccacgccgaacagcgcgccggtcagttgccatttgggcacgtccagcaggctgacggcctgggccggctcgaagaagaaaatcaacagcgcggtggtgattgcgccgaccgcaaaggtcagcaaactgctgcgcaacacgcccaccgcctggcccaggcgaccattgatggcggcttgcacactcaacaccgcacccgcagcaatcaccagtaccaacaacacaatcagattcatcgccttaccctcgtgcaatcagaacaagtgccgccacaatcaacaccaaggcgatccagcgctcgccattgacccgcttgcgcgccgtgccgaaccagccgaaatggtcgatcaacacactcttgccgacctggcccgagaggatcgcgatcatggtcatggcaatgccgatatgcggcgtggccagggtcagcaccaccacgtacatcggccccaggaagccgccgatcaactgccagcgcggcaagtcggtcagcgccgggcctttttgcgggccgctgaacagcagcagcaaaaacaggattgccgtgcccaccccgaagatgctcaaggtcgcccatagatggcccacctgcacacccagcggcccgagcagcccggcctccaccgacaggcccatgcccgccaaaatcaccagcggcaataacagcagccgtagaaggtttttcttcggcgtggcctgggccacaccctcgattgaacgagcctgcatacatcacctgcgtttcaagaaatgaacatggcgcgcattatccggtggccgtgctgtgcgataaatgggagcatgctgataacacctttgcgtattacgcacagcctggaggccatgatgcagggcttgagtgaattgagtttcaaggcattgcgcctgtttgttgcggtgctggaccacggcagtttttccgaagtggcgcgccgcgaaagcttggcgccctcctccatttcccggcagatccagttgatggagcaggcgctcggccaacagttgctctaccgccacacccgtgccgtcagccccactgaggccgggcgcctgctcgggcaccatgcgcggttgatgctggaacaattggaaaccgccggccaagccctgcaggaacaggaaagcgaacccagcggcctggtgcgcatcaatgcgccgatggtgttcggccagcgccacctttcaccgtggctgggcgagttgtgccgccgctatccaaagttgcaactggatatccagcaaaccgacacctatgtcgacccgctgcaagacggcaccgacctgctgtttcggatcggcgtgctcaacgattccggcatgcaggcgcgcatcttcgcgccgcaacgctttcgcctcgccgccagccctgcctacctggcccggcatggcacaccgcgccaccccgacgagctggttaaccaccagtgcctggcctacaaaggcatcaccggccagcaacgctggttcttccgccgcgaccagggcgactggacgccctacagcgtcaaaggcccgatcaccggcaaccacgccgacaccctcacccacgccgccgagcaaggcctggggctggtggtgtttccgtcctggctgatcggcgaaggcttgcgcgcaggcaccttgcaggcggtgctgaccgagtacgacgtggcgacgacgttggagccgcagcagattgcggcgttatggccaggcagccggcggctgtcgctgaaggtgcgcacggtgattgattactttgtggagtgttttggggcggtgccgtattgggatcggtgaactggccggggttaggaggtaaaaattcctcggcgaaaaagtaggcttgttctgattttgcgggccaccattccccggcacagcatgctgcgccagactctggtcacttccgtacaggagagacaccatgaagtcaccgcgcaccgcaatccctgtctcgtcggaccaggccagcgccgatctttcaaagcggtttcatccagccagtaccggccaaaccatcattattaccgaggatggatgtacccttgcccggcctgcgccagccgggcaattccacggcaagcgaatcggttccatgagaggaaaacgggttattccggacgacctggatgcgccactgcctgacgagttgctgaacgcatttgaggcaggcttatgaacagaactctgatcagaacaaccactgcccaatcaaccacgcattcgccccactgatcagcgcaaacagaaaccacgccaatagccgcgtgggcaggcggttaacaaatggccccatcaattgcttgtcatcggtcatgcgaatcagcggatacagcgcgaacggcaactgcaggctgagcaccacctggctgagaatcagcaacttgccgatagcatcgtcacccatcagccacaccccgagaaatgccgggatcagtgccaggccgcgggtgatcaggcgtcgctgccagcaagggatacgcaggttgagataaccctccatgaccacttgcccggcgatagtgccggtaaacgtcgagctttgccccgaggccagcaacgcgacgccgaacaggatactggcgaacgccccgcccaccagtgggtcaagcaggtggtaggcatcctggatctcgaccacgtcggtgtggccggtcttgtagaacgcggcggcggcgagcaccaggatcgcggcgttgaccagcaaggccagggccagcgagccgatggtatcgatgcgcgccagtttgaccgcgtcctgtttgctggcgaggtctttgccgatcaggcgggtttgcacaatcgaggtgtgcaggtagaggttatgcggcatgacggtggcgccgaggatgccgatggccaggtacagcggcgccgcatcgctgatggccgacagtgacggggtaaaaccactcaatacgtctggccagtagggtttgatcagcaccagctcgataaagaagcacacgccgatggttgcgaccagcgccagcatgatcgcctcaaggcgacggaagccgcggttttgcaaggccaggatcaacagcgtatcgaaggcggtaatgacgatgccggtggtcagcgacacaccgagcagcaggtgaaacgccagggcgcagccgagcacttcggcaaggtcggtggcgatgatcgagatttccgccagcagccattgcgtgcgtgcggaacgtttgctgtagcgctcacggcacagttgcgccaggtctttgccggtggcgatgcccagccgtgaacacaggcactgcaccgccatgccggccaggctggccaacagcaccacgaataacaggctgtagccgtagcgtgaaccggcctcgatggccgtggcccagttgccggggtccatgtagccgatggagatcaacagcccagggccggcgaacatcagcgcccgtttgaaaaacgacgccttggggtcaacgatcacggaacccgccacttccggcgggcagaacggggcggtagcgattttcggcaggctgaatttcacgcggtatcccaggcaaacacacaagtcagagccgcagcttatcagtccgacgtgaccgtgcgcatcaccgtctcccggggcaggtcaaaggtgtcgaccacttgcaccaccaggtccagctcctggttcagcgcctcgcgttccatgcgctggcgaatcatgccgatcatcaacaccgacaaggtggtaatcgagtacgccgggccggagaacgcccgcacaccagtgaccagcaacatcgccgccgccaatgcctggcccaccaccggaatcgccgaggcagcgccacgacgtacgataaaaccggtaaaccccgccaacgccgtgccgctcaaggcagtagtggccgagcggctgatatcgatacggttgaacacgccctgctctttttgcgcggcggccttgagttcggcgtcgaaggcctgccggtcagcgcggctgagtttgtctttgtattgctcgatcaacttctcggcaacccgcgcctcaatgtccgccagtgccacggtttcaaccggttcatcgaacttgatgcccaaccgctgcgccacatcttcggcgatctggcggtaactcacgccgtggccacgggcaacgttcataaagctgtcaccgcccatgcgttgcaactcaatggccagcttcagcggctcacgcacgctggcatcgattgacgcgctgcgcttttgcgccatcaactcggcgaggaacttcagctcgtccggccgtgcgtgcagcaatgccgggaacagttccccgtcttcttcggcaaagcgcacttcgctgctgcgttgatcggcgcggatcatgccgcgccgctcctgcaacaggtcggtgtactgcaccacggtcttgagctgcggccaatacgccgcatggtcgaaagtggccaggtgcacattggtgactttggccttgagcgccggcgtgacctcaatggcataacggccaatgcagcgctcggtatccggtttcatcgccagtgcccagtccttactggagtggcaattgatcacccgacccttgagcggcgccgacacttgatcccacgggctcgacgtacagatcgccccgcccttcagcaacaggttgttcaacggcagttcacgcgcgacctcggggctggccagcacactcttgaccagaatgcgtgcaccgagggaatggccgatcaggttgatgcgccgtaccgccagcgactcggcgtgcaggtagctggccagctcgggcaacagggtcttggccacttcgtcgacccgcgcctcgacacttttgtaatggtcgaggaaatacgcaatcgccttgcccacgcccaccgtcgccgcacccaggccaccaccgccgagcatcgaggtgatgacgtctttgaacggcgcaaacaggttttccaggaaatgccccgccggccagaacagcatcaggttggtcgagccttcgatgctcgccagctgttgcttgaaattgcccagttgctgacggttgaagaacgccgaataaccgtgaacgtagagattgagcacatccccctggggctcgccgcactgtacaaaggtgggcttgcgggtgcggtgcatttcatcccactggtgttgcatgggccggtttctcctggtgacgatggacggcgatagtaacaaagcatgacgttggggaaggtgaatcctgaccgacgtgtgcagttatcagaacaaggatgccgctttggatttagccaggtagcgcgccggggaatcaccgaggttgcgtcgaaacaccgaggtaaaggcgctggaactgctgaaacccagcgcaaatgcgacctcagtgatcgacacaccttggctgagctgtgccgtggcttccagcaaacagacctgctggcgccaggccacgaatgtcatgccggtgctgtcgttaaaatgacgtgtgaaggtccgtcgactcatgttcgaccactgggccatttcatccagggagacggtttgcgagggcgcatccagaaaacgctggcaagcacgggccagacgcggctcggccggcaaaggcgcactgaggggcaatgccggcagcgtgccaatttcatcgatcagcagcgtcaatacgcagtgccggcggacactcgacgccgccgctggctcgatcgccagcgccgcttccagcaaatgcctgagcagcggcgacacctcgaatgcctggcaaccctgccccagccctgcccgctcagccgcttgagcatcgaggtaggtattgagcatgagcacatcgccacgcatgtgcatttcatggggcacgccgcccggcacccaaatcgcccgctgcggcggcaccacccaattgcccaggtcggtaaacattttcagcgcgccggtggcggcgtaggcgaattggccgcgcgggtgtgtatgccgcgcgaacacggtgccggaggggaatttacgcaaagtgaccagcgcttcggggtcgttgtcgtcaaaggtcttaatcatggcccgatattgtcaaaggatgacctggcatagcaagcgggccatcgctctgcgccctagcattcacgcctttgaagaaacctgctcaaaggaacgtccatgcagaagaaacacttggcgcttgcgctgttggtcaccttggtctggggcctgaacttccccatcaccaagctgggcctgcgctcaatcgacccctttgcgctcaccggcatccgctttgccctggccgccctgccgctggtgttcgtgatcaagcggcccgtcgtcccattccgctacgtggccgcttacggcgtgatcttcgggctgggcatgtggggcgtgatcaactatggcattcatatcggtgtcagcccggggatcgcctcgctggttattcaactcagcgtgttcttcacgctcggctggggctacctgctgttcaaggaaaaaatccgtgccgcacagtggatcggcgctgttctcgcgttgattggcctggcgggcatcatcgccggccagaccggcgagcacgcagtactcggggtgttgttcattgtgttcagtgccctggcatggagtgtcggcaacgtcatcatcaaggcatccggggtgaaggaaatcttttcattcatggtatgggccagcttgtttccgccaataccactgttcctcatggcgtggtggctgcacggcaacgccgccttcgcacacttgcccgagcgccttgacctgaccgtcgtgttgtcgatcctgtttcaggtttacctggcgacacactttgcctactggggctggaacacgctgctcaaggcctaccccgtatcgaccgtggcgccgctgtcgctgttgattccggtatttggaattgccagttcgatgctgatgctggacgagcacgtgtccctaacgaacctgatcgcgattgttgtgattattgtcggcttggccgtcgggctttaccgcaagcccacaaggcgatggtgaagcgaagttgtcgatcttgacctggccatccggaaacgtcgcttccagatacaccccccgtggcgagcgggcttgccccgcgttgggttgcgaagcagccccatcaaggaagatgcggtgtgtcagacgtaccgcagtggctggctttggggctgctgcgcaacccaacgcggggcaagcccgctcgccactatggtcatcaaatacttgcgcaaaaaaaaccgccctttcaggcggttaaaggtgctcggccttgatcagaaaccgagggagaaactgatcgtcatcgcgtggtccttgtcattgcgcgacaactgccccgaatagcccaggcccagtctgccgttctggctgatctggtaatccacgcccgcttccaccaccgcgctgtccttggcgatcggcacaccttgggtgctgaacgacgcgccgccgttgataaagctcaggtcggcatccggcttggtgtcgccaaatgcatgccgccaaccgaggctgccgcgtggggtgattttcgagccgttgcccagggtgatggtctggccgatgcgcacgcccagggtcgagaaggtcacgtcctggtcggcatcgccgcgcagggccgccgaaccgcctttctccttgatcgtgtcgctgtcgtagttgacgtaggccaggccggcaaacggttcgaccgccaggctgccggtggtgagggtataaccgacttcaccgaacacttgtgcgctgcgggccttgtagtcggctttgaggcgttggccttcgccgcccaccgccacgtcgcgcttgctttcgatgtcatgccagctgtacgccacacccatgcgcgcggcgaaggcttcttgctggtatgcggtgtaggccatcaagtggtagctgtcgacgtcggcgctggagctgcggcgcttggcgtccaggtcgctgcgggtgtagccggcggccacgccgacgcgccaggcgtcatccacttgtttgtcggtgccgagcaggaagccgccgaggttgcggtccagcttggcggtgttgctgtcgccgcccatgtggccccaggtgccgagtacccgcatccagccgaccatctcgccgtggcaaccggcgctactcaggcggttttcgctcggtgccaggctgttgcgtgggtcgtcctcgcggtagcagccgggttggcgcaggcgctcgttgaccgcgtcacggatgtaacgcgaatcttcaagcaacgcgctggcggtgctggcgtggatctcgccggacaagctgtcgaacgcggcacgcgccccggccgcatcagcgttgagcagcgcattctgcaccgccaccccgcccactgcggccccactgcccaatgccgccgccacgccgcgctggttacgcgtggccgccacgctggcgtagctgacgttgttacggctgaccgccaacgccacctgagtcgggctgtagttcaacgacgtgctgaggaacgccaggttctccaggttggtattactgaaggtgccgttcaccgcgcccgccgtcagcagtgtgtaggtggtcgggccggcatacggcgccaggttgatcacattcaaagtgccgcccaggttggcggtgcctccgaccgccagggcaccggttaccgacggtgtgatgaccaggttcagcgcacccgtactggcgttggtgaagttaccggccaccgtcagcttgccgccatcgggggtgacgctgccgttgttgaccagcgagccgacactgccgttaccggtcaggcctgcgccgttggccaccgtcacttgcccgcccagtaccgtgccggggttggccgcattgccgacttgcaacacgccttggtcgacggccacggtgccgctgaatggctggttgccggtcagcaacagcgcgcctgtgccctgcttggtgattgcgccggtgccggcgaggctgccgttgaagatgccattggtgttctgcacaaacagcatgcgcgcattgttcaggaaccggccttgcaggctcaacgcgttaccggccagcgtaccgccgctgacggtagtgccgccggagtaagtgttggcgccggtcagcaacaaggtgcccgaatcgagtttgtcgattgcgcctgcacccacgatcggcgcggcaatttctgtggtcacgcccgaattgatgcgtaccgccgccgtgccagtcggcgtcagcgtaccgcctgcacccgccgtcagtgtgtagccagggtcaagcacttgcaggccggtgaagctttggttgccgaccacggtgacggtgccgccctgccccgcgaacacggcaaactggttggtcgacgcctggccttgggtgccggtcgggtcggtccagttggtgcccgggccccaggtgccgctgccgccggtgatggtgccatccgggttggtgacgccgccgttccagaactggatttgccccggcatggtttgcaccagcaggttgagttggttggccaacgcggtttgcagggtgacgttgcccaggccgacaggcagtgaacccaccgtcaggccgttgtcggtcaagctgccgccgtagcggaacagttggtaaacgccgatgccgaagccgcccgcgtccgtgacattgagggtgccgtccagggtcaggttgcccgcgacattcactgccgtggtggatgcgcccggtgcgccgagggcgaagtccaggctggtgcccgacgacaacgccagcgaacccaccgacagcggcgtcgcggagccggccttgaggatggcgccatcggccatgttcaccgcaccacccaaggtgccgctgccgccgagggtcgcgccattggccacctggactgtcgcactgttcaacgtgccgttgaccagcaggctgccggcgttgacgttggtgttgccggtgaaggtgttgttgccgctcagcagcaattcgccggtgccggttttattcagcacgcctgcgccggtcaggttgccggtgtaagtgccgtcggcggcctgctcaaaggtcagggtcgcattgttggcaatcgcgccttgcaggctggaggtgttgccggtggtggtgccgccgttgagggtggtgccgccgctgtaggtgttggcgccggtcagcagcagcgcgccgttgccatttttcaccaggctgccggtgccgctgaccaggccgttgagcgccaggtcatggctgccggccaaggtcagcgggccgcccaggttgatggcattggccagttgcaggtcggtgctgccgtccagttgggcggcgccgcctacgttgagcgcaccggtgcccagggcagcgttgttgccgaggatcaattgaccggcgttcaagtccgtgccgccgctgtaggtgttggcgccgttgagggtcaaggtcgatgggccttttttcagcaggctgccggtgccgctgatgccgccgttaagtgtcagcgcgctgctgccgccgatagtcaacgcaccattgagtactgcggcgttgaccagcgagacggagccgttgctgtccagggtggtgccgtcggccgcggtcagcacgcccatgccaagtgcgctgttgctgccgaccaccaaggtgccgccattgagggcggtgccgccggtgtaggtgttgttgccgttgagcaccagggtgccgctgtcgagtttggccagggtgccgctgccggcgagcgtgacgcccagagtggcagtggcgttcgggtcgacacggatcgcggtgttgccggtgccgccattcaccaggttaagcacgcccgccgtgccggaagccaggttaaagccatcggtgacgaactgcaggccggtgatgttttgcgtaccgtccacgctcaccgtgccggccgcgccctggaacactgcgaaactgctggcccagctctggttgaggctgccgtcgacgttggtccagttggtgaggccgctggcccaggtgccgctgccgccgtcgatggcaccgttgccgagcaggttggcgccatcccagaattgcacggtggtgttgggcgccgtcaccagcaggttgaccttgttgctgatcgcggtctgcacctgcaggtcgcctggagtgacactgcctggcagggtgccgagggtcaggccgttgtcggtcaacgcgccgccgtagttgatgaggttatagacgccgctgccaaagccgccgatatcggtgacattgaggttgccgtccagggtcaggtcgccgccgacgttcagcaaaccgctgccaccgccgaccacgggcgcgccgaggccgacgtccaggttggaattgccgcccagcaccagcgaacccagcgacaacgtgctgccggtagccaggccgatatgcccaccgtcggccactgtcaccgcgcccgccagggagccgctgccggtcaaggtcgcaccgctgttcaccgccaccgcgccgctggccagcgagccgctgacattcaaggtgccgccgttgacgttggtggcgccgctgatgctattgacgccgctgaggttgagcacaccgctgccgtttttatccaggttaccggcgccgttcagcgcaccgtcaaaggtgttgttgaggttgctgccgcccaccgccagcgtactgccgcccgctacctggaccacgccattacccgccagcgtattgaggttggcgttgccgcccaggttgaggttggcgcccgtgcccacggtgacgccggaggtattgccgagcgcattattgcccaaggtggtcaggctaccgcccagcacgctcaatgggccggtgaaggtattggtgccactgagcagcaagtccgccgcgccgttcttgatcagcgccgcgttgccggcgagcacgccggtcaaggtcaggtcattgttgccggctacagtcaggtcggcgttgaggttgatggcattggtgagggtcagtggaacactggtgccgagcgttgcagcgccgccgacggtcaacgcgcccgagcccagcgcgctggcagtgcccaggttcagcgtaccggcattcagtgttgtaccgccgctgtaggtattgaggccattgagggtcagggtggccgcgccgtttttagtcaggccaccggcgccgctgacgacaccggccagggtcaggtcgttattgccggcatacgccaggttggcgttcaacaccaggttgttacccacgttcagcaaggtggtggtgtccaaggtcgacgtaccgccgaccgtgaggctgcccaggcccaacgccgaattactgcccagggtgagtgtgccggcgttcaatgtgatgccgccgaggaaggcattcggaccgctgaggatcaggttggccgcgccatttttgctgaggctgccggcgccattgatcgcgccgcccagcgccaggtcggcggtgccgccaatgcccaggttgcccgccaggttgactgcattagtggcgctgacgctgctgctggcgtccagcgtggtgccgttcgccgcattcaacgcagcattgcccaacgccgtattgctcgccaggatcagcccacctgcgttcaaggccacggggccgaggaaggtgttattgccgcccagcgtcaggttggccgcgccgttcttgatcagcccgccagtgccgccaatcgcaccattgagggtcagcgcattgctgcccgcgaccgtcaggttgccgttcagtgtgacgccattgcccagcgtagtcgcggtaacgctgtcgagggtggtacccgctgcggccgtcagttggccggtgcccagggccgtgttgctgcccaccaccagcgtgccgccattgagcaaagtgccgccggtgtaggtattggcgccactgagtaacaaggtgccggtgtccagtttggccaaggtgcccgcgccgtcgatgttcacgccgatggccgccgtggcgcccggatcaacacgcagcgccacgttgccgccggtgccgttgaccgcggtcaattgcccggccgcgccgttgacgaggttgtagccgtcggtgacgaactgcataccggtaaaggtttgcgtgccgttcacagtgacggtgcccgccgcgccctggaacactgcgaaatcgctggcccaggattgattgaccaagccgttggcgtcggtccagttggtgcccacgctgttccacgtgccgctgccgccattcacgacgccattggcgatggtttggctgccgtcccagtaacgcagcgcggcattgggcgccgagacttcgatgttgatctggttcgccacgccggtctgcaccaccaggtcgcccagggcgtaacccaccggcacgccagccacgttcaggccgaggttggtcagggcgccggtgtaattgaacaggcggtagacgccgacgccaaaccctccggcatccgtcacgttcaggttgccagcgagcgtcaggttaccgcccacattaaacaaggacgtggtagacggtgtgcccagggccacgtccacattggcgcccgccgccaatgccagggagccggccgacaaggtattgccgctgctcagcgccaggtgcccgccattgttgatattcacctgccccaacgccgagccggtgccggtcagcgtaccgctgttgttgacgttgagctgggtgctggccagggaaccgctgaggttcaaggtgccgccattgatggcagtgttgccggtgaggccgttgataccggtgaggttgagcgtaccggtgccgactttgatcagcccacccgtgccgctgataccaccgtcaaaggtgctggtgctgttgttggcgccaacggtcaggaggttgccgccgaccgccacatcacctgcaccgctcaaactggcaacgttggcgtcaacccccaactgcaggctggcgcctgcactgatattggcgccggggccgttgcccagggcgttggcgttcaacagtgtgaggctgccggacagcacatccacgccaccggtgaaggtattgctgccagccaagctcaggtcagccaggccatttttgatcaggttaccggcgccactgatcaggccattcaggctcaggtcgttgttgccagcgatgctcaggtcggcgttgagtgcaatcgcattgccgatgccaaaggacgcgctgttgtccagcgtcgccgcgccgccgacggtcaaagcgccgctgcccaggccattggcgttgcccagggtcaaggtgccggcattcagtgtggtgccgccgctgaaggtgttgttgccgttaagcgtcaggttggccgcgccgtccttggtcaaggtactggcgccgctgatcacgccgccgagggtcaggccattgctgccgcccacgttcaggccggcattcaaagccaggttattgcccagggtgacgggcgcattgctgtccagagtggccgcgccggcaacgatcaggttgccaaggcccagggccgtgttactgccgacggtcagggtgcccgcattgagggtggtgccgccgaggaagccattgctgccattgaggatcaggttggccgcgccatttttgctcaggccgcctgcgccattcaccccacctgcgagtgtcaggtcggcactaccgccgatgttcaggttaccggcaaggtttaccgcattggccaagctgaccgccgcattggcatccaacgtggtgcccgccgcggcattcaacgcaccgttgcccagcgcgcccgcagcgccgaccaccagcttgccggcattcagcgcggtgttgccgaaataactgtttgcgtggttgaggaccaggtcggcggcgccattcttgatcaagccaccgatgccggcgatggcaccgcccaaggtcaaggcgttggtgcccgcaatcgtcaggttgccgcccagattgatgttattggcaaggcttgccgccgtactggcatccagcgtggtacccgccgaggcgtttaacgccccggtgcccagcgccgtgttggagccgacaatcagcgtgccggcgttaagcgcggtggcgccgctgtaggtgttggcgccactgagcgtgaggctcgatgcaccggttttgatcaagcccgacgcaccgctgatgaggccgccgagggtcagcgcattggcgccgcctgcggtcaggttggcgttgagggtgatcgcattattcacggcgagcgccgcattgctgtttaaggtcgctgcgccgcccacggtcagggcaccggtgcccagcgcggcggcgttgcctactgtaagggtgccggcgttcagggtggtgccgccctggaaggtgttggcgccgctgagtaccacgctggaggtgccgtttttgatcaaggcggcggcgccgtcaatcacgccgttcaggctcagcgggttggtgccggccaatgtcaagttggcccccaggttgatggcattggccaggttgatgccggcactgttgtccagcgtcgacgcgccggtcacgctcagcgcgccagtgcccagggccagatcgttgccgacattcaaggtgccgccgttaagcgtggtaccggcaagaaaggagttggcgccgctgagaatcaagctggccgcaccgctcttggtcaacccgcctgcgccgccgatagggccggtcaagccaaggttactggtgccggcaatgttcagattgccgctcaggctcagcgcgttgttgaggctgatcgcagtgctggcatccagtgtggtgttgtcggcggcggtcagcgtaccggcgcccaatgccgtgttgttacccaggatcagcgaaccggcattcaggctggtgttgccggagaaggtgttggcaccgctgagggtcaatgcggcgaccccgtttttgaccaggccgccggtgccggaaatgatgccattcaggcccagcgcctgagtgccgccgagcgtcaacgcgcccgtcagcgcgacggcgttgccgaggctgaccgcagtgctcgcatccaaagatgtgcccgctgcggtattcagcgcgcccgtgcccagtgcggtgttggaacccaccaccaggccaccggcgttgagcgaggtaataccgctgcgggtgttgttgccggtcacggtcagcaggcttgcgccggttttgatcaagccaccagcacccgacatcacgccgctgagggtcagcgggttagtgccggtcagggtgaggttgccggtcaagaccaggttattgctcaaagcaggcgcgccgctggcgtccaggttggcggcggcggcaaccgtcaggtcgccgctgcccagggcattgctgctgcccagtaccaaggtgccggcgcccaggctggtagcgccggtatagccgctgttattgccgctgagggtcaggctgccgctgccggttttgctgatgcccgcagcgccggtgattgcgcccgcgagggtcagggcgccggtgccggtggtggtcattgcaccgccaaggctgattgcgttgttcaggctgatcgtgccgggtgccgacagcgatgtcgcacccgcgaagttaatcgtgccggtactcaaggcctggttgttgcccagttgcagcgtgccgccgttgagcgtggtgttgccgaggtaggtgttggcgtttgtcagcgacagttggccactgcccactttggtcaagccgcctgcgcctgagatcaccccggacaaggtggtggcgttggtgccttgtacggtaaggccgccagcgccgacggacaccaggttagcgatgttcaagccggcgttactggcctgcaggataccgccgttggaggtcagcacgccggagccgaacgtcgcattgttgttgaactgcgcaaccccgccattgagcgtggtgctgccggagacgaccgggccttgcagggtccaggtgccgctgttgagggtcaggttgttgaagttgatgtagttggcgctcgacaccgtgccagtaccggtagtgccgccgccaacgccgatcgggttctgcaggatcagcgagttggtgcccccggccccgccatcgactgtgcccgtagggccaaacgtcaggttgatgccaaccagcccgcccaagcccacgctgacttgcacaccgtcaccgacgctgacgctggagccagtaatcgcggtaaaggtgttggtactgcctgcgcccatcgacacgccgccggtgattgcaccggcgttggtaaaggtattgcccgcggcggaggtctcgaacgcgacccgcccgttgataaccccggtactgctgttggtcatgttgacctgggagccgccgtatatgcccaccaccggcgtgtcagccagggtaatgccgcccaccgacaaacccgtggaggtaatcgtgccgttgttggtgatgctggtggtgccggccgccgcgttattcaccgccagtgccaggccgtcgatgctcgtcaggttgagcccgagcaacatgccggtgccgcgcatgatcccgctggcattgttgaggacgctgaccgtgctggtggcgcccgtaccgataaaggccccgccgctcaataccgacaccaggcccaacagggccgggtcgagggtgccggagttgttcaagctgatgttgacgccggtgaggtccatcacgtggccacccagcgtcgcgttcatctgcgcgccggaattgacgttgacggtcaagccgttggtggcactgctgaagttattcagaaacagcggcaggctcggcacgcccgtacaggtcacggtagacccggccgtggaacacgtggccaatgcctcgggacttgccaggcccatcatcagccccacgatccccattcgaatagccatattcagcggggcaatacgcgatacaccggcagcagcaagtcttctttccacgtgacactccttcgtggttcaagcctttcatccatgaatgcgcagaagcccaaccctagtgacccacacgcatcgaatacgaaatacctgaccgtggcgacaactgatctagtttgtcgaaacggtagtagacctacagaaaagtcattgaattaaatggtattaatactttcgtaaacaccgcgtaagaatgggattacagccaacattcattgactgtcgcgacataaatacaagtttcaaaatgtaaaaaggcgctctaatagcgccctgtcgattcgctttaaagatcctggagttcgcaatgccccatgaaggcaacctgttacaagcagccgtggtgttcctgctcgccgccgtgctcaccgtgccgttggccaagcgtttgcaactgggcgcagtgctgggctatctgttcgccggcgtgatcatcggcccgtcggtgctgggcctgatcggcaacccgcaaagcgtggcgcagttctctgaactgggcgtggtgttgctgttgttcatcatcggcctggagctgtcgccgaaacgtttatgggtgatgcgcaaggcggtgttcggcgtcggtttggcccaggtgttgctgacgggcctggtgatgggcgtggtcgcgctgtggctgtttggccaggcgtggaacagcgcaattgtgctgggcctgggcctggcgctgtcctccacggcgtttggcctgcaaagcctggccgagcgcaaggaattgaaccagccccacgggcgcctggcgtttgcgattctgctgtttcaggacatcgccgcgatcccgctgatcgccatggtgccgttgctggccggcagcgatcacccaaccaccgaagcccagggcttgcagcacgtgctgcaaatcctcggcagcatcgccgtggtgatcatcggcgggcgctacctgctgcgcccggtgtttcgcatcgtcgccaagaccggcctgcgcgaagtgtccaccgccaccgcgctgctggtggtgatcggcaccgcctggctgatggaactggtgggcgtgtcgatggccctgggcgcgttcctcgccgggctgctgctggccgattcggaataccgccacgagcttgaatcgcagatcgagccgttcaagggcctgctgctcgggctgttttttatcagcgtgggcatgggcgccaacctcagcctgctgctcagctcgccgctggtggtgattggcctgaccttgttgctgatcggcttgaagctgccgctgctgtacgcggtcggccggctggtcggtgacctcaatcgcgaaagcgcgctgcgcctgggtgtggtgttggcggccggcggtgagttcgccttcgtggtgttcaagatcggtcgcgatcagggtttgttcgagccgcatctctacgatgtgctggtgctgaccatcaccctgtccatggccgtgacgccgctgctgctgttggtgtgcccgaagctgttcaagcccaaggtcaaaccggtggaagtgcccgaggaataccgcgccatcgagagcgatgcgccgcgcgtggtgattgccggcatgggccgtatgggccagatcgtggcgcggatcctgcgcgcgcaaaacatctcgttcatcgccctcgacacgtcagtggaaaccatcgaactgacccgcagtttcggtggcatgccggtgttctacggcgacccacaacgcccggaaatcctgcacgcagccaaggtcgatcaagccgagttcttcgtgatcgccatggacgacccggagatcaacatcaagactgccgagctggtgcgcaacctctacccgcacatgaaaatcatcgcccgcgcacgtaaccgccagcacgttcaccgcctggtcgacctggacgcgtcaccggtgcgcgagacgttttactccagcctggaaatgagccgccgcaccctggtcggcctcggtttgagccaggcccaggccgatgcgcgcatcacccgtttcaaaaaccatgatctgcaagtactcgccgcgcagcacgcggtgtacgacgacgccgccaaagtcatgcaaaccgcccaggaagcccgtaccgaactggcgcggctgtttgagatggatcggcttgaggaagagtccgacaaagtgtgagggcacggatgaacgatcttgcgaaatttctgacagaatacgccgcaatttcgttcatccctggagcgcttcatggccactttcaccaagaccgccgtcctgctggccctcgcgctcaccgccggtagcgtgttcgcagcaagcaagccgagcagcacacagaccatctcgaccctgggcggcaagttcaccttcaacttgcccaaggcctacatcgccgacacgctgcccaccggcaaggttgaggatggcaccgccgatacccaaggcacgctgtacgccaactcgaccaccaagagtgtggtgatcgtcgccgaaaccgtgcgcaacgatggtgccacgatcaaagacaatgacccgcaattcctcgatggcgccgtggcggatttcgtcaaggaccagagcgccgccctgcccgacttcaagaaactcaacgagaaaaaactgacctacaagggcctgggccttcgccaggtcgacagcaccgccacccagggcggcggcaagaccttgaactcgaccttcctcggcggctcgggcagccacttgctggtgatccaggccatttcgcgggcggatgatgtgaaaggccatgctgagctggtgaagcagattactggcggcaagtaacccgttctaccctgcaacataggaccaaatgtgggagctggcttgcctgcgatagccattcaccaggcaatatgtctggtgatggatataccgctatcgcaggcaagccagctcccacatgtttaaaccgcgcttacttcaggcttttctccagccaggccttcaaatcctgcacctctgcctcactcacggtatgcggcatgcccggataaccatgaaactccggcttcaaccccagccccaccaacacctcattcgcccgcgtggccgagttatacggcagcgcctggtccaacgtaccgtggccgataaaaatcgccagcttgctcaatgattcgctcggcttgagctcagccttgagcaccggcaacacactgccgctcaacgccgcgatgccgcgcaccaattcaggctgtcgcaagcccacctcgtaagacatgatcgcgccctggctgaaccccaccaggaacacccgatcgctttgcgtgtggtatttggccgtggcctggccgacaaactcttcaatcagcttggcgctgcgttgcaggtcggcggtttcgccgttgtaatcgccgtcgcccggcgtcttggtaaaccagcgatagccgtgcgggtccactggcatcggcgcgcgtgccgacaggtaagtccaggtcgacggcagcgcgtccttgatgccaaacaggtcttcctcgttgctgccaaaaccgtgcaggaaaatcaccaacggctgattacgcgcatcgccctgggtctgttccaggtacgacaacggcaagtccgtgtgcaaggtggaatcggcgtgggcagcaccggccaccagggtcagtgccagggcaaacagtttgagcatggggaagttacctcagggtttgcgcaacagataggtgtccatgatccaaccattttccaggcgcgccgccttgcgcacccgttcgatttcttcagccacttcactgactttgccgctgatgaggatttcgtccggcgtgcccaggtaggcgccccagtagatatccaggtcctgatcggccacggtgcggtaggaatcttcggcgtcgagcattaccaccagggtgtcggcatcactcgcctgccctgccgccaaacggcgcccggtggtgatctcgatggaacggccgatgcggttcagcggcactttgtgctgggccgccagggcctgcacgctggtgataccggggatgacttcgaactcgaattcgctgcggccactggcgaggatcgcctgcaggatacggatggtgctgtcgtacagcgcggggtcgccccaggccaggaaagcgccgacttcgccgtcagccatttcttcgttgatcatgcgctcgaaggtctgctgcttgtcgcggttgaggtcttgcacggcggtggtgtagtcgatatcaccgcgcacacgctcggggcaatcggcctcgacgaagcggtagccgggctcggtgatgtaggtctcgcagatctcgcggcgcaggtcgatcagcttgtctttgctctggcccttgtccatgaggaaaaacacgtcggtgcggttcagcgctttcacggcctgcatcgtgatgtagtcagggttgccggcgccaatgccgatgatcaggatgcgtttcatgggttgctctcattgcggggcgtgaattttgccatgttcaggcgctcaggcgtgagtttccaggcgcaggcgccaaacgttgttgaagcgcagttcagtggcggacagcggctcgacgtcgatccggtagaacatcgacatcgggaactgcaacacgtacagcatcgcggcacgaatcacaaaggggtgggtgattgccactacgtgaccgggttgggtttcgagggttttcatccactgcccgacgcgtgcgcacagctgctccaccgactcgccgccatggggcgcacaggtgctgtcggtcatccaggcggttaattggtcagcgtcgagctggctgagggcctggcctttccagtggccgaaatcagcgtcgcgcagggcttgctcgatctgcgcgttatcgccaaacagccccgctgtttgccgggttctggcctcgggcgcgcacaccaggcgcggttttttcttgaagcgcccggcgtgggacaacgccgcgctctgccaatccatcacgacggattcgtcatcgggaaaccgcccctgtttttgcagcggcgtggcggcgtggcaaatcagggtcaaacgggtggcgtgcatcacaattcactctgtttcgacgcgcagccagcgtagactgctgaagttatctcaacatgttacaacgaacatgaaagaggaagccggttcaatgcttcggcctgtccacgggctcggttcaacgcctgagtcaaatgccggggcgggccaggtaaagcacctgatagcccgtcccgggatgttcctcgttcaaggcctggcccgatagggtgatccgaatcaggcgccacgcttgcacatccagcgccaaaaatactgcgaaggtatcagggctatcagccaactgctgattgcgccgtttgccctcggccaatagcgcggcgcgatccgcgtcaggctccagcgcccactcctcgcgatacagactcaatgcgttctgcgctggcccgcgctgcacgtccagcggcagccagctctcgatatgcgggcggccaaagctgtcgagcaccttttgaaatcgctcaccgagcaaaaaatcggcggcctgcaacgggtcggcccacaggtacaccgacgcatacacattgcccggcgcctgcccacgctcctgggcaataaaggccttgaacagcaacccttcggcgtgatcccacaacggccccaactgcgcggcgcggcggcgaatcacgcccatgtcgtagtcggctggcaggcggtgtgaatactgtttggcgaacatggcaacgctcctgtgcaagatgaggttttagcttgcgcagtggtgatgatttcaacaagatatgggcagatataagtgcgataaggattggatatgactgacgcgctcaaacccctggatatcgacaccgtccacgccttcgtcctggtcgccgatttcgccagtttcacccgcgccgccgaagccctcgccacctcccaggccgccatcagcctcaagctcaagcgcctggaagaacgcctcggttatcgcctgctggaacgcaccccacggcatgtgcggctgtcgccccagggcgagcagtttatcgttgccgcccgcgccttgctcaacgcgcatgagcgcgcactcggtgacatgggcacccacgcgccacggcgcctggtgatcggcatcagcgaccacgtggccggcccggacctgcccacctggctcagccgcctcgcagcctacgacccgctggtgattcttgaagtgcgcatcgcctcgtcccgcgacctgatggctgcgttcgaccgcaatgagctggacgccgtgatcgtgcgcaacgaaggcgaccgccaggatggcgaggtgttggcggtggaacgctttggctggttcgctgcaccaacctggcaacacagccccggcacaccgttgcgcatggcaaccatggcagcgccgtgtggcgttcggcatttggcggtgagggctttggacgcggcgcgtatcgactggaccgaagtgtttgtcggcggtggcgtgatggcggtgggtgcggccgtgagcgccgggttaggcgtggccgccctcgcccatcgcgtggccccggccggggcggtggacgtgagcgagcaatacggtttgcccgccttaccggtcagtgaagtggtgctgcacagccggatcagcgacgcgcggtcgcgcgaaacattgcgcgccttgagcgcaacgtttcgcggtgtgctgcagcgctgactcaggcgacaggtgcttcctcgccgacagccgccgcttgcgtttgcaactgcgcggcctgctggctgtagtcacgcaggtagacgatgaactcctgcaacaggcgatcccacaattccagttggctgcgcaggtgctgggtgccaaccccggccaccaccacgtccatttccatcaacaaaaactcgccctgcagcgacaaccgcgcaaagcgtcgcgacgcgttccacacctgggccaggccttcgggcagttcaccttgcacgcgcagggcgcagctgtaggtgaagtccacgtaactgcccggctccgccgccgcgttgccgaagcgcacggcaaagccgatgccctggctggcactgagcaattgcacgatgccgttctgttcggtctggttgacgcggtagccggcctcttgcagcaattcggtgaggctcttgggggtaacgctgttgatcagttcactcatggtcagtcttccttgttgatcaatgaaatgcacttgcaacagcgtagtcggattttcagcctgcgtaatcgatcaggcggctggcgccaaaccggcccccagcggcgtcgtcaccgggttgccactggcaacaaaatcttccttgcgcagcaccaccagggcaatcaacgacaccacgccggtcgccacgtagaagtaccacggcgaggtgatgtcgccggtcaccttgatcagccacgtggagatcagcggcgcgctgccgccgaacaccgcaaccggcacgttgtacgccacggcaatcccggtggaacggatgcgcgtcggcagcagttcactcatcagcgcataggtggacgaggcatacagcccgaacagaatcgccaccgccatcaacggcgcaaagaacgtcgcgggtgtggcggtcggcgccgacttgaacagccagaacatcgccagggtggccaaggtgccgatcaccatcaggaacggtttgcgcccgtatttatccgtgaacgcgccgccgaacggcatcacgaaggctgccgaaaaactcgcgacaaacacgtagagcaaggtggtgccgctgtcgaacttgaggatcttggccatgtaggtcgaggcgaaggtcagcaccaggtaaaagatcgagctgtgcaaggtgatgataaaaaacaccagggcgattgcgcgcttccactgccagacttcgcgcagcggcgcgcgggaggtttggccggcgcgttgcagggcgagaaactccgggctgtcttcgagcttgaggcggatgtacatggagataaaacccagcggtgcggcgatcaggaacggcacgcgccaggcccattcctgcatcaggtcggcgcccaggatccaggtcatgccattggccacggcgccgcccagcagcaggccgagcacggcggtgaccatcaaccagcacgtggcaaaaccgcgtcggccggggccggcgtattcggaaataaaactggtcaccgtgccgatctcgccaccggccgaaaagccctgcacgcagcgcaccaggatcaacaggatcggcgcggcgatgccgagggtggcgtaagtcggcaacaggcccagcaacaccgtggagccggtcatcatcaccagcgccatgatcagggtttttcggcggccgatcttgtccgccaacgggccgaagaacagcccgcccagtggccggataaagaagctcagggcaaacgcggcgaagctcgccagcaggctggtggtggggtcatcggagacgaaaaaggcctggccgatgtacacggcgagaaagccgtagacgccgtagtcgtaccactcgatcaggtggccggaagtggcaccgagaaacgcacggcgccgcttgcggaccgtgtcttgcgcgtgattgcccatcgaagggactccttgtctgatgatctgtccatgaaaaacgggtctagggaagcgcggcgatactcgctgctttcagccactgccgcaagtcagtcttgaggattttgccgtaactgttcttcggcagctcgcctggaaacaggtactttttcggtttcttgaacgaagccatgcgctgtaaaaaccacgccgtcagcgcggcttcatcaaggggctggccgctgcgcgtcaccacaaacgccaccaccgattcgccccattgcgcatccggctcgcccaccacacacacctcgaacacttcgggatgctgcgccaggacttcctcgacttcacgcgggtagacgttgctgccgccggtgataatcacgtccttggagcggtctgtcagcgtcaggtagccggccgggtcgagaaagccaatatcgccggtcagcaaccagccctccaccaacgtctggcgcgtggcctcggggttgcgccaatagccttgcatcaccgtggcgccgcgcacggcaatttcgccgcgctcaccagtcggcaccggttgctgccgagcgtcgagaatgcggatttccacacaggcttgtgcgtgcccgaccgaggcggccagggcggcccagtcggcgcgttggcggtcggcgatcagcgcgcggggcaatacgctgatggtcatcgggctttcgccctggccgtagatctgcaccagccgcgggccgaaggtgtcgacggcctcacacaaatcggccaggtacattgggccaccgccgtagacgatggtcttgataccttcgcctgcatagccctgaacgcgcgcctgttcaaccatgcgtttgaccatggtcggcgcggcaaacagcgaaacatcgcccaactcggcggccaggccgaacaactcggcggcgtcaaaaccctgggacgccggcaccacatggcgtgcgccgcagcgtacatggatgaagttgtagagcccggcgccatgggacatgggcgcggcgtacagcacggcgtcatcgccgctgaccgagtcgacatccgtggtgtaacacagcgacatcgcgaccaaattgccgtgggacagcatcacgcctttggagcgcccggtggtgccggaggtgtagaacagccacgcgaggtcctggtccaggcgcggcaccggctgctccagggtcggccagccacgggttggcggccgtgtgtggccgtccagttccttgcagcgttgcggcaagtcccgcgatcccgagaacacccggccgccatcggtaaagatcaaacgcgcctcggcgttatccgcgatccacgcggcttcggccgggtgcaatttggcgttgatcggcaccactacgccgcccatccaccagatggcgtagagcaattcgaggtaatcacagctgttcttcatcagcacggcgaccgcatcacccgccaccagtccatgctggtcgaccaggtgtgcggcgcgttggcgaacatgcacggcaaaggtggcgtaatcggccacctgccgcgtgccttcgaacaacgccgggcgttgcgggtggcgacgctgggtgtcgtgcaaccagttggcaatgttcatggctcagtaccggcgcgcgtgcaggaccgaggcgtagttggcgacggccatgccgcccatgttgaacaccaggccgaactccgggttgggcgccgccaggccgatcggttcgccggtcaactgccggaacgccagggcatgcatcgacacaccggtggcacccaccggatgccccttggccttgagcccgccggacaagttcaccggcaagcgcccgcctgcgcgcaccacgccactgtcgagcacgcggtggccttcgcctttgggcgccaggcccatggcttcgtagatcagcagctcggcgatagtgaagcagtcgtgcacctcggcgaaactcaggtcggccagggttatattcgccccgcgcagggcggcgtgaatcgcccgttgcgggccttcaaaggcaaggatgtcgcgctgggcaatcggcaggaagtcgttgacctgagtcatcgcgcgaatctgcacatcacggcgaaacgcccgcgcacgcttgggcgaagccaggatgatcgcggcggcgccgtcgctgatcagcgagcagtcggtcaggcgcagggattcggccacaaacgggttgctcttggacacattgttgcagtgctcgaaatccatcacccggtgcatctgcgccaacgggttggccatggcattggagtggttcttggtggcgatggccgccatcgagcccagcgggcagtggtagcgctcggtgtattggcgcgccgcgcggccgaacaactgcgggaaactcaagccggcttcggccgggtcattctgataaccggcgccggccaacgcctgggtgacctcggcggtggacgtgtgggtcatcttctcggcgcccaccaccagcaccagctcggcgctgccggacaggatcgcattgaccccggcctgaattgccgccgagccggacgcgcaggcgttttcacagcgcgtggccggcttgaagcgcaggccggggtcggcctgcaacagcaaggaggccgcaaacccgtcgggcaccagccccgagttgaaatgaccgaggaacaacgcatcgatttctgacgcatcaatggctgcgtccgtcagggcttcgcgggtgacctgcacgatcaggtcctcaagggtggtgccttccaggcgaccaaaacgcgaatgaccggcggcaacaatggagacgcaatcagctggcataatcaattttcttctgtttttgatgcggacatttacctacaatgacgcaccactgggcgctcgccaattcgtgtaactacttacacggataagtagccccacgtgagaaaagcaacgaggcaggatgcccaatgaacgcgtttacacagccattccccgacatcgaacgcctggcgttccagctctcccccgccccgcaactggtcacgcgcaaccgcgtaatggtcgattgcaacgaggccttcctgcagttgttcggctattcgcgcgacgaattggtcaaccagctgaccctgctgatctacccgtcccaggccgactatcacgccatcggcaagcgtagccacgactggctgctggagagcgaaaacggcttctattccgacgaacgcttcatgcagcataaaaacggcgaagtgttctgggccaagtcccacggctacacgctcacgcccaaagacccgttcaagctgatgatctggcacttcgagcgcctggaccgcacccaccaaggcaccggcgacctgacgccacgggagcgcgaagtggcgatgcacatcgtcaacggcctcaagtccaaggaaatcgcgcaacgcctgggcatctcgcaccgcacggtggaagtgcacagggcgaggctgatgaagaaactcgaggtcaaaaatattgtggagctggtgtcgaagatgattttcgtcggcggtcgcgcctggctatagctcaacttttaacgcgcgttgacggaattttcatattcggctgtctatgctgcgcaccttcgttggggagtaaccggcttctgacccgctcagaagcgttcgtatcaacatattcggcaacctgccgtggtacgaacaccgttgaggttggtgagaccagcgacacatccatgcctaaagtcgggcgtgtggttgtgtcgttgactcatacagcccgactggaagccttaccgtgaaccccatttcccttatctttctcgcccttgccatgtccacggacgcctttgcggcggccatcggcaaaggctccagcctgcacaaaccacgcctgatcgaagccctgcgtgcgggcctgatctttggtgtgatcgaagccatcacgccgatgatcggctgggccatcggccatgcggccacccgctgggtggaagattgggaccactggatcgcctttaccctgctggtcgcgctgggtctgcacatgatctacaacgggttgaaggccgacgatgacgaggttgaaaaaccgacgcagcattcgttcatgatcctggcggttaccgcctttgccaccagcatcgatgcgttggcagtcggcgtgggcctggcgtttgtcgatgtgaacatcctggtggcctcggcggcgattggcctggcaaccatgaccatggtgaccatcggcatgatgctcggtcgcgtattggggacggtagtgggcaagcgcgccgaaatggtcggcggcgtggtgttgatgctggtgggcgcgacgattctttacgagcacttgtcggcttaacggcccgcactgaacaaatgtgggagcgggcttgcccgcgaaggcggagtgtcattcaacagactcattgactgatccaccgctttcgcgagcaagcccgctcccacagtaggtctgcggcgttttaagccgcgtggctttccttcttcaaactttccatatcaatcacgaagcgatacttcacatcgcccttgagcatccgcccatacgcttcgttgatgccctggatatcgatcatctcaatgtccgagacaatcttgtgcttggcgcagaagtccagcatctcctgggtttcctggataccgccgatcaacgaaccggcgaggctgcggcgtttgaagatcaggttgaacaccgtcggcgacgggtgcgggctgtcgggggcgccgaccagggtcatggtgccgtcgcgcttgagcaggttgaggaaggcatccaaatcgtgcggcgcggccaccgtgttgaggatgaagtccaggctgttggcgaccttggccatttcgtccgggttcttcgacaccaccacttggtcggcgcccaggcgcaggccgtcttcgcgcttgttcggcgaggtggtgaacagcgtcacatgcgcgcccatcgcatgggcgatcttcaccgccatatgcccaagcccgccgaggccaaccacgccgacctttttacccgggccgaccttccagtgatgcagcggcgaataggtggtaatcccggcgcacagcagcggcgccacggccgccaggttcgcagcatcgtgggagatgcgcagtacgaacttctccttgaccacgatgttgtccgaatagccgccaaaggtattttcgccaccgaacaccgggccgttgtaagtgccggtaaaaccgttctcgcagtattgctcctcgccctcggcgcaggaggcgcagtgctggcagctgtcgaccatacagccgacgccggccagatcaccgactttgaatttgctcacattggcaccgaccgccgtgacacggccgacgatttcatggcccggcaccgacgggtacaaggtgttgtgccactcgttacgcacagtgtgcaggtcggagtggcacacgccgcaatacagaatgtcgatctgcacgtcatccgcccccggcgcacggcgctcgaaggtgtaaggcttgagcgcatccttggaatcccgagcggcgtagctgtaagtcttggccatttggttcacctgttgaactgacggtagaggtcagtggaccaatatagacactgaaccgttcaaccgagcacatccgtacaagcccttcgtggggtttgacgcaatagtgaggctgagccttttgccccctgaacccaaggagttttcgatgagcacattcgttgccaaagacggtacccagatctacttcaaggactggggcagcggcaagcccgtgctgttcagccacggctggccgctggatgccgacatgtgggaataccagatggaatacctgagcagccgtggctttcgcaccatcgccttcgaccgccgtggtttcggccgctcggaccagccgtggaccggtaacgactacgacaccttcgccgatgacatcgcccaactgatcgaacacctggacctcaaggacgtgaccctggtgggcttctccatgggcggcggcgacgtggcgcgctacatcgcccgccatggcacgtcccgcgtcgccggcctggtgctgctgggcgcggtcacgccgatcttcggccagaaacccgactacccgcagggcgtcccggccgacacattcgacggcatcaaggccgggctgctgaaggaccgcgcgcaatttatcagcgacttcaacacaccgttctatggcatcaacaagggccagaaagtctcggaaggcgtgctgacccaaaccctgcaaatcgccctgctcgcctcactcaagtcgaccgtggactgtgtcaccgtgttctccgagaccgacttccgcccggacatggccaagatcgacgtgccgaccctggtgatccacggtgacggcgaccagatcgtgccattcgagaccaccggcaaagtcgcggccgagatgatcaagggcgcgcagctgaaggtctacaaggatgcgccgcacggttttgcggccacccatgcccagcagctgaacgaagatttgctggcgttcctgaaccgctgaaacaactgaatcacccgctccttgtttggccgggcttgccctttaagcaaccacaatgcttaaaacagcgaagatcaaatgtgggagcgggggtttgctgacctcactcacccgtgctcgcaaaggctgcaacgatttcatcgatcaccacccgcacccgcgccgtatgacgcaggtcagcatgggtcaccagccacacctcatacggcaatggccgagtgcgttccggccacagacgcaccaacccatccagctcaccactgcgcaccggtagctcgccgactccgaggccggcagcgatggagcgacgcaccagcaagctggagctcagcgccgcaacaatgcgcccacggcccaagggctcgcagaccaagttcatgtccttctggctttgcaagtgcggttggtagaccaccaggtcatggccttcgaacaggctacccggctgcggtgcgccgtggcgttcgagataggcacgggaggcaaacagccccaccggccaacgcgcgatacgccgggcgatcaggtcggggttgtccgggcgaatgttgcgcacggtgatatccgcttcgcgcttggccaggctgagaatctgggtggatgcatccaactgcacccgcacgtcggggtgcttgtcatgcaagcaggcaatcgccggaatcaggaagtcgatggccagtgaatccgtggtgctgacccgtacggtgccggtcaggcgatcatccagcccttgtatctggcgttgcagttcgaaggctgagtgttccattttttccaccgacagcaatgcggcttcaccgacggccgtcagcgcatagccgtcagaagtgcgcaggaacaaggtggcatttaacgatttctccaacgcattgacccgccgcccgacggtggcttggtcaacccccaagacccgtgcggcgccgcgcagtgtcgactcgcgacacaccgccaggaacacccgcgcatcatcccaattcatgtttgcccccgtgatgcatatttgcatcttaatgccgtgtaatcgcagcattattgcatcacgagttcccggtatgctggcgccagagaaaaaactcaggactgcctcgtggccgggctggggatgatctggctgaaccgcagaccgctcgccacggtcccaactcatacgctcatcgctacaggaactttcaaatgacgcttcccaaagaaatgaccctgatcgaaatcaccgcccccggcggccctgacgtgctgcaaccgcgccgggctgacgtgccggtggcggggccgggtgaaatcctgattcgcgtgcacgccgccggggtcaaccgcccggatgcgttgcaacgtgctggcaagtacccgatgaaaccgggcatgagccccattcccggtttggaagtggccggtgaagtggtcgcattgggcgaaggtgtcagcgagtacgccattggcgataaggtttgcgccctgaccaacggcggcggttatgcgcagttttgcgcggtgccggccagccaggcgctgcccattccagaaggcatggactggattcaagccgctgccgtgccggaaacctttttcaccgtctgggccaacctgttcggcctgggcgacgcccacaccggccagcgcgtgctgatccacggcggcaccagcggcatcggcaccaccgcgctgatgctgtgtcgcgagtacggtatccaggcgtttgccaccgccggcagcgccgacaaatgtgcggcgattgccaagctcggcgccgagccgatcaactaccgcgagcaggattttgccgaggtcatcgcgcaaaaaaccgacggcaacggcgtggatgtgatcctcgacatcatgggtgcctcctacctcaacaacaacctcaaggccctggccatggacgggcacctggtgatgctcggattcctcggcggcggcaaggccaacgacgtcgacctgctgaccatcctcggcaaacgcgcggtcatcaccggctcgctgctgcgcgcccgcaccaaggacgaaaaggccgccatcgccgaacaactgcgcgagtatgtgtggccggtgctgtcagccgggcgctgcctgccgataatcgacaaagtgtatgaatacaccgacgccgcccaggcccatgcgcggatggaaggcggcgaccatatcggcaagattgtgttgcgggtggagtgaataccagcgcccccttgtggcgagggagcttgctcccgctggggtgcgcagcagccctaaaaccagcgaccgggatcagccaggcaaatcaccggtgcagggtttgggagggcttcgccctccagcgggagcaagctccctcgccacagggatcaagcaaatcaggctatccggcgtacaccgggtaatcggtatagccctgctccgaaccaccgtacatgccttcagcccgcagcgggttcagcggccagccgttgaacaggcgctgcggcaagtccgggttggcaatgaacgggcgaccgaaggcaatcaagtccgccagccccgcctccagcagtttttcaccgcgctcagcggtgtagcggccggcatagatgatccgcccgctgaaggtgctgcgcacggcctggcggaaggtctcgggcaagtccggggcgttgtcccaatcggcttcggcgatggacacataggcaatccccgacgcctcaagcaccttgatcgcttcgatgtacgtgtgatgcgggtcttcctccaccaggccgatgtacacgcggtcctggtcggtgccgctgaacaacggtgaaaaacgcacaccgaggcgttccggcccgaccacggcggtcacggcttcgacgatctcgcgcaggaagcgcaggcggttgtgcagcgagccgccatattcgtcatcacgctggttggcgtgggccgaaatgaactggttgaccaggtaaccattcgccgcgtggatttccaccccgtcaaacccggcgtccaacgcattgcgcgccgcctgggcgtaatgcccgaccaattcctcgatctcaagtacgctcaacgcacgcggcacgggcggctgcttcagctcgccggtgcccggcccggtttcgataaaggctttggcttgttcagccgcaattgcagacggtgcgaccggcgcggcaccctctggctgcaacgcgttatgggacacgcggccgacatgccacagttgcgcaaaaatcaccccgccttcggcatgcaccgcttcggtgacggtgcgccaaccgtcgatctgcgccggtgtgtagatgcccggcgtccaggcataaccctggccgcgcggctcgatttgcgtgccttcgctgaccatgaagccggcgctcgcgcgttggcggtaatactcggccatcaggccggtggcggtatcgccaggttgcgcgctgcgttggcgcgtcagaggcggcaatacaacgcggttgttcaaggtgtggtgccccagttttactggggtattcaaacgactgctcatgtgcaaatttccaaattcaggacgagccaaagcgttggcggctcttgagagccgccaattcatacagcgattagttaattcaagcggtgagtttcagcagtgctttagccacatcgctggagctggccgggttctggccggtcaccagcaagccatcttcaagcacaaaggactgccaatcggcgcccttctcatagtggccgccgagtgccttgaaatcatcttcgatcaggaacggcaccacgtcggtgaggcccactgcggcttcttcggagttggaaaaaccggtgacgcgacggcccttgaccagcggctcgccattcacggccttgacgtgacgcagtgcgcccggtgcatggcagacaaagccaatgggcttgccggcgcgctcgaacgactcgatcagcgcgatggacaccggtgattccgccaggtcccacagtggcccgtgaccacctgggtagaacaccgtgtcgaagtcgtcggcgttgaccgtgtccagcttgacggtgttggccagggcctgctgcgccgccgggtcggcggcgaaacgccgagtttgctcggtctgcgcgtcaggctggtcgctgaccgggtccagcggtggttggccgccggccggggatgccagcaccagctcggcacccgcatctttgaaggtgtaatagggcgcagcaaactcttcgagccagaagccggttttacgaccggtagtgcccagctggtcgtgagaggtcagtaccattaatactttcattttccagtgcctcgatcgatgtgaatgtcagtaggttcagggcaacccaacagctgtcgggtcagcagcagcgcctcgtcaaaaggcgcggatgttcgggtgatcttgctcatgacgctggttcccaaccacaacgcatacaggcgttgggccaggctttcgggcgcttgctgtaccgtcagcgagccgtctgcgacgccgtgctgcaaggcctcgacgagcaaggcgatggtgcgtgcagtgccgcgttgcagggccagacgcatcggctctgaaaggtctgacacctcggcaccgagtttgacggcaaggcatttacccgcatcggtgcagccggtctggttgtcgacccaggtgtgccaataacgcatcaacttggcggccccggacagttcgggttgctggaacagctgctccacgccctgcacgtagtggtcaaaataggtgtcgagcagaacaacgccaaaagcatctttggaggtgaagtagtgatagaacgaacctttaggcacatcggcggcttgaagtatttcgttcaaccccaccgcagaaaatcctttgcggctcacaatcaattgcgccgtatccagaatggtctgccgtgcacttttagtggcgttagtcatggttcacctcgtccgattagaccagtcgtctagttcgttgaggggatgttaggcgtcgcgaaaaacttcaacaatgtcatatccgcaaggattccggacatgcgccaaaggcggttgccgtttgcccggttcacgccgacaatcccctctcccgcgccccttggagaatgacaatgcacagcgttgcgctgatggtttacccgaacttccagtccctgagcctcagcctgggctcggtgttcgagtgcgcgaacctgctgcgtggcgaaccggcctatgagtttcacctggtctcggaaagtggcggcgcggtgatgacctcccagggcttttcggtgaataccacgccgattcgcgcgcaaggctatgacaccctgatcgtcagcggttacctggaatttcgcttgcccgaggccaatttgctcggactggtcaaggcggcctccgcgcagtcgcgacgggtcgcctcgttgtgcatgggcattttcgtattggccgaagccggtttgctcgaaggcaagcgcaccaccacccactggattcacgcgccggcgtttcgcaagcgctacccggctattcacctggaagaagacaagctgtttgtggtcgacggccaggtctggactggcgccggcatgagcgccggtgtggacatggccctggccatggtcgaggctgacttgggcagcgacctcgcccggcgcattgcgcgcaaattggtgattgcccaacgtcgcggcagcgagcaatcgcaattgtcggcattgctggaactggaccccaagtccgaccgcgtgcaactggcgctggcctacgcccgcgagaacctgacccacgacctgtcggtggaagccctggccgacgtggcacggctgagcccacgtcaattcagccgggtgtttcgtgaagaaaccgggcaaacaccggccaaggccatcgaatcgctgcgcgtggaagcggcccgggcgatgatggaaaccagccgtcacccggtcgaagtggtggcccgcgaaaccggcttcggtgatcgcgagcgcatgcgtcaggcgtttctgcgcgcgttcgggcagccgccgcaggcgatgcagcaggtgctgttcaacgcgggtgcctagcggcagtgataagggctttcgctcttgagttcttcacccgtgtccaggtcacggatggtcaccgtgcccttcgggttgttcatgcagaacgcattgcgcaccgagtagatgccgtggccttgggtggtgaacaccatcttggccggcgtgccgttggcgtcaacggcggtgaccttgtagttacccgacatcgtcaggcagccgcccaaggtcagcaagacgccagcgcaaacaatgagtttgaatgaagtgaaggtgttcatttcgcatccttgtgaaattcagggcccaaccggccgacgcgtttaggagccgccgtgcccggttaagttcaacgttgtgtttaatgcagcgccgcccgcgtgatcaagtagctcaccaactgcggatcatcctccagctcaatcatctgcgccgggcgcggcaggtcatccagcaccgcacgccagaacgcctgggacacttcgtcctggtcgtagaaacgcaccagccaattcgcctcgccgctgctcaacacctgggtggcgatggcgcggccaatgcctttgcggcggtagcgcttgaggatgaacaggtcggccagctccagcgcatccatgcccggcagttcactgccttcgatcagcaggaagccggcgatatagccatccaccagcagcagatttgcgctccattgcgggtcttgccagtagcgggtcaggtgttcgtcatggatgtagaaacggccatccgcctcgacatcttcctgttcccaatccgacgactcgtaggcgtagtactggtaaagattgcggatcagctcagacgcatcggggccggtctggatcaattcgacggtggtttcaggcattgggctctcagtgaaaattacgcaaggcctcattgttcacaaaacccgtacacacgccaatacattgcacaacctttctgtttgctgaaccgattgcggatttgtttggccgcacccaaaatcctgaaacatttagaataaacttcgctgaatactctttttctcacgccctttttcaaggacacgcactttgaccaacgtctgttccgccggcctggatgtgggctttgcctccctggattacctgcagattttcatcctgggtgtgatccagggcattaccgaactgctgccggtgtcgtccacggcgcacatgcgcgtggtgcccgccctgctcggctggcaagaccccggctcggcgttttcggcggcgatgcagttggcggcgctggcggcggtggtcagttatttctggcgtgatgtgcgccaggtcactaccggaagcatcggcgcggtgcgccggggcgactacaacgacccatggttcaagctggccgtggcgattgtgttggcgaccctcccgatagggattgccggcctggcgctgtcgtcgaccttgaacacctgcaactcgccattgcgcgggctgatggtgatcggcatttcctgcgtggtcatggcggtgttgctggctggcgccgagctgcgcgcgcgccacacccgcgacatgagccagatgcgcctgcgcgatgcgttgatcgtcggcatcgcgcagattggcgcgctgattcccggcgtgtcgcgttccggctcgacgctgaccgccgcgctgtttctgaacttcaagcgtgaagaagccgcgcgcttttcctttctgctgggcctgcccgccatcgccctcgccggcttgaaagagctgtgggtgctgctgcacgccgacatgcccgcccatgcctggtcgcacttgatcttcggcctggtggtcgccagcgtctcggcgttcttcgccatctggggcctgatgcgcttcctcgagcggttctccacctggccgttcgtgatctaccgcgcgctgttgggcgtgttcctgattgtggcggtcagcactgggttgctgagctaagccttcggctcgctggttagccgatcatgcgggtcggcactcgaccagcaaaccgccctcctcgcgcacatggctttcgatcaccaccggcaggaaacgttgaatcacggtcatattgctgtgcaaatgctcgctcatgtgcggcgtggtaaagcgcccgccgccggccaacgccatcggcaacagcagttgatccgccaggtgctcacccaccgccgtgtcggtgccctgccactccaaggccgggtcgatggccgcatcagccacggtctcggcccgcaccgtggccatgccaaacgcgctgaacacttcagtgacatgcgcgtggacgtactccagcatcaaaacattgcccggcccttgctgtgggtcaatctcgaccgggaagcactgcgcctcggtgaagcccaggcgttggcgagtgcgcttgaattcccgcgcgctgacctgggcgggcagcccggcattcaaggtggtggcgcgtttttccaacagcttgccgcgctgcatcaactgtaacggcagcagctgcgatggctggatgaatacctctatctcaccgccgcccgccgggacgaaaccgtggcggttcaggttcaattcgacacgcgcacccatgcgtcgcaacaacggcagccaggcgcgctgcaaaaagtccaccggcggcgccagcgggttatgggtgccgccgctgatcgtcacgtggctggcgcttggcgcacgcaacagcgccggtaacagcgtttgcagcaccagcgtgcaactgccggccgtgccgatggcaaagcggtactcgccgccttgaatcagcccgggctcgaacagcaggctttgcgaccccagctcagcgccttgcaccttggcgccacagacttcggcggccgccagcacggcggtcaggtgctggcgcatcaagccgggccggctgcgtttggcgcggatgtttttgatctgcaaggtctgcccggtcaccatcgacaagctcaagccactgcgcaacacctgaccgccgccgatggcgccgtcgagttcaatcacgtcctgtttcatgttcatccttatgcgtagcgtttgacagtgtcccgcaggtagtggtcgagccgttgtgagtctgcttgcgtgcgtggcaaaaccggcgcctggcgttccagttcgcgcaggataaattcatgcaacgccggtcttcgtggaccgtaggcggcttcaccggcattgcgtttgagcgcgagcagcgttgctacttcatccagcagttgcgggtcatccaccgtgcccagcagctcggcaaacgtcatcggtggccgccccaggcccaggtcgatccaacgcactgccagcaatggccgcagcacgtagaagtactttttgaaccgcacctcgtcgccttgcaagtagccgcgaaaattcttcttggccatcgacaggtaatggttgcgcgccgctggcgggctgtagaacgcctcggccaaggcacgcagttgcgccgtcgcctcagtctcctggcgatacaccagcggcgagtccagccactccagcaaggtgggattggatttacgcagcaggcccagagtcttgcgcagttcccagccactcacgtccagttcgtcatccagcgggcgttcgatcacgtcgcggggcgcatccacctgcacaaaccaatccggcttttcgacgtagacaaagcgcacgtcatagtcgctgtcggtggaggcaaaaccccaggcgcggctgccggactcgcaggcatacagcacggtcacattgcgctcgcgctctatgcgcgccaactcatccagcacccgcgcgcgcatggcctcgctcaatgggtgtcgttgttgcttttccatcacgtctcccctcttaaccttttacgcacaccacctgacgcagggtgtgcagcacttccaccaactcgcgttgggcgtgcatgaccttgtcgatgtccttgtaggccatcggaatttcatcaatcacatcggcatccttgcggcattcgacgtgggccgtcgcgcggatctgatcggcgacggtaaaggtgttcttcgccttggtgcggctcatggtgcgaccggcgccgtggctgcacgagcagaacgattcttcgttgcccaggccgcgcacgatgaagcttttcgcgcccatggagcccggaataatccccagctcgcccttcttcgccgacaccgcgcccttgcgcgtcaccagcacctcttgaccaaagtgccgctctttttgcacgtagttgtggtgacagttcactgcctccagcgccacttcaaacggcttgctgatgacctggcgtgtggcctggaccaccgcgcgcatcatcaactcgcggttctgccgggcaaaatcctgagcccagcccaccgcttccacgtagtcatcgaagtgctggctgccttcttcgaaataggccaggtcgcggtccggcaagttggccaggtgctggcgcatgtccgcctgcgccagctggataaacaggttgccgatggcgttgccgacgccgcgcgaaccgctgtgcaacatgaaccagacacggttggcttcatccaggcacacctcgacaaagtggttacccgtgccgagcgtgcccaaatgcttgcggttgttgctgtgctcaagcttcgggtatttgtcggtgatcgccttgaagcgcgggtgcagcgccgcccatacctgatcagcctgggccggcacattttcccaggtacctttatcgcgacccgcacggctgcgagtgcggccatggggcaccgcggcttcgatggcgcagcgcaacccgtgaaggttgtccggcaaatcgctggcggtcagcgtggtgcgcgcggcgatcatgccgcagccgatatccacgccaacggccgccggaataatcgcgcccaccgtggggatcacgctgccgatggtcgagcctttgccaaggtgcacgtccggcatcaccgcgaggtgcttgaagataaacggcatcttcgcggtgttcatcagttgctggcgggcttcaggctccaccggcacgccctcggtccaaagtttgatcggcttgccgttggccacttccagcagttggtaggtcttctcttgcatggtcttgattctttcttggtaggccgtcactgcggcgttgacagggctatagcagcgggcgtgccagctttttcaacacttcactaaaaatatataactcattgttttatttatatatttatagcggtccagatttaaatctcgaaaaccgatgacaagcgcactcgcccattcatatccttgtatatcgttacttatcttttggtctagccatgaaacacaagcgtaccgtcgccatcgggtttatcggttccaaactggatcgcgtcggcaagggcgccaaccgctggaaccactggcgccccagcgtcggcttgtgccagcaagccgacgtgcagattgaccgcctggagctgatccacgacgtcgacgcccgcgacgtcagcctcgctgaacgggtgcgcgccgacatcctgcagatctcaccgcacaccgaagtgcgcctgcacgcaatggcgctgcacaacccgtgggacttcgaagaggtctacgccgcgctgcacgatttcaccaccgactatgccttcaataccgagcacgaggactacctcgtgcacatcaccaccggcactcacgtggcgcagatttgctggttcctgctgaccgaggcccgcaacctgccggcgcgcctgatccagaccgccccggcacggcgcggcaatgacgccgcacgtgccaccggcacccacacactgatcgacctcgacctgtcgcgctacgaccgcatcgcttcgcgctttgcccacaagcgcctggaaggcctggcgtttctcaagtcggggatcgctacgcgcaatgccgccttcaacggctccatcgaacagatcgaacgcgtggccgtgcgctccaaggcgccgatgctgttgatcggccccaccggcgccggcaagtcattcctcgcccggcgcatctacgaactcaagcgcagccgccaccaggtgcaaggccgctttgtcgaagtgaactgcgccaccctgcgcggcgacggcgcgatgtcggcgctgttcgggcacatcaagggcgccttcaccggcgcgcaaaacgcccgcgacggcctgctgcgcgcggcggatggcggcatgctgtttctcgatgaaatcggtgagctggggctggacgagcaagccatgctgctcaaggccatcgaagaaaaacgcttctacccgctgggcgccgaccaggaagtggccagcgacttcctgatcatcgccggcacccaccgcgacctgcgcgggcacgtggcccaggggctgttccgcgaagacctgtatgcgcgtatcaacctgtggacctttgacctgcccggcctggcgggccgccgtgaggacatcgaacccaacctcgatttcgaactggagcgtcatgcgcgcgaacaaggccgccgcgtgcgcttcaacctggaggcacggcgccgctacctggcgttcgcctgttcgagtgaagccgcctggctgggtaattttcgtgagctgtctgcttcgatcacacgcatggcgacgctggccgacagcgggcgtattgatgaggcccaggctgaacaggaaattcaacgcttgcgctacgcctgggggttgtctgcgcctcaggctgaatggcaagccttggtgcctgcggacctggacctgtttgaccagctgcaactgaaagcggtgatcgaggtgtgcttgcaggccgacagcctgtcggatgcgggtcgcaggttgttcggggtttcgcgccaggccaaggcgcaaccgaatgatgcggatcgtctgcgcaagtacctggggcggttttcgattgattggaggcaggtggcggcgctcaagtaacgctggttgtgtatttttttggggggggcatatccgttatttgggtgatggttgagatcggttccgctcttacagcgggtcacttttggaaaagagccccaaaagtaaccaaaagggctcttgccccaccactcggcaccgagcctaagcgaggtgccgagtggtggggcgaggactttttggttactttttggtccctcaaaaagtgactcgctgtaagagcgaaaccctaagccgccgttaccgcagtaacggatatgcccccaaccaaaacccaacggaactttgccaacaaataatcgcctgaatccggtaggctcaccctttttattcaaggagttattccccatggccaaagccaccgcccgtcacatcctcgtttccactgaagacaagtgcaacgaactcaaagcccagatcgaaggcggcgccgatttcgcagaagtcgccaaagccaactccagctgcccttccagccgtcaaggcggcgacctcggttcgttcggcccaggccagatggttaaagaattcgacaccgtcgtcttcagcgccccggtcaacaccgtacaaggcccggtgaaaacccagttcggctaccacctgctggaagtcaccagccgccaggactgatccagtctgtgctgatgctataaacaacggcccgcctcttggcgggccgttgtgcatgtgatgactagcgacgctcaagccgttaacgtacaaatccctgatcttcacccggcgctcaaggctgacaatgcgattggctttttccacaacattcctaagctccgccctggccctgctgctggccagcaccgccgtgatcgcggccccgcagacctacctcacggtctacggcgaaccggccaagtaccccgccggcttcacccatttcgactacgccaaccccaacgcccccaagggcggcagcctgcgccgctcggccatcgagatcgggcgcttcgaccacgtgctgccgtatatcgacaaaggcatcggcgtctcccaggtcgacggctggctctacgccccgctggcccagcgttccctggatgagccctataccgtctacggcctggtcgcggaaaaaatggaacgcgccgacgacggcctgtcgctgcgcttctacctgaaccccaaggcgcgcttcgccgatggcacgccaatcaccgccgaagacgtgcgctacagtttcgacctgctgatgacccaaggcagcctgcgctttcgcaccctgttcgccgacgtcaagcacgtcgaagtcgaaggcgagcgccaggtgcgctttgatttctccagcaatgaaaaccgcaccctgcccctggatatcgccaccctgccggtgttcccagagcactggtggaaaacccgcgacttcgctaacggcggcggctacgaagccccgctgggcagcggcccgtacacgatcagcaagatcgactccggcagcaccatcacctttacccgcgaccccgactggtggggcaaggacttgcccgtcagccgtggcctgtacaacttcaatcacttgagccttgagtacttcggcgacaccgaagtggcccgccaggtgctgcgcggcggcgcctatgacttcaaccgcgagttctccgccaccggctactccatcggctacaacggcccggcgctggacgatggccgcctgcaacgtgcacacctggccaaagagatgccgcaaccggcccagggctatgtgttcaatgtgcaaaagcctatgttcaaggaccgccgtgtgcgccaggcgctggcgatgctgtgggacttcgagtgggccaaccggcagatgatgcgcaatctgtacatccgccagcagagctacttctccaacagcccgctagcggcgagccagttgccgacgaaagaggaactggcgattttggagcctctgcgcgggcaaatccccgacgaagtcttcacccaggtgttcaaggccccggtcaccgacggcagcggcatgatccgcgacaagcagttgcaagccctgtccctgctggaagaagccggctggaaaccggacggcgacaagctggtgaatgcccagggcgaaccgctggagttcaccttcctcaacgcccaggcgggcctggagcgactgttgctgccgtacaagcgcaacctggcgcaaatcggcatcaccttaaatatccgtcgcatcgactcctcccagtacgtcaatcggctgatgacccgtgactacgacatgatcgtcaccggctttccggtcaccacctcgccaggcatggagctgtacaactacttcggttccgccgccgcgtacgactcgggcgccaacaactacatggtgctgcgggacccggccgtcgacacgctgatcaagggcctggtcaaggccgacacccaggcgcagatgctcacctacgcccacgccctggaccgtgtgctgcaatggaattacctgtggattcccaactactacccgcccggcacctccgccgcgtggtggaaccgcttcggccgcccggccatcgaggccaagaacgacgaagcgctggaaacctggtgggaaatcagccctacgcccctgacgaatgagcaaatgaatgccgagttgaaaaaacgcggaggtacgcgctgatgtttgcctatatcgtgcggcgcctgctgctgatcatcccgacgctggtgatcatcctgctggtcaatttcgtcatcgtccaggccgcgcctggcggcccggtggagcaagccatagcgcacctgcaaggcatcggcggcggtggcgtcggcggttcatccggcgaaggcatcagcagcggctcacgggccagccgtggcctggacccgaagttgatcaaggacatcgaaaaacaatacggcttcgacaagcccgcgccggaacgcctgtggctgatgctcaagagctatgcgcaactggatttcggcaacagcttcttccgtggcaaaagcgtgatcgacctgatcctggaaaaaatgccggtgaccatttccctcggtttatgggccaccttgattacctacctggtgtcgatccccctgggcattcgcaaggcggtgcgccatggcagcagctttgatgtgtggagcagcaccgccatcgtcatcggctacgcaatgccggcgttcctgtttgcgatgttcctgattgtggtattcgccggtggcacctcgctgaactggttcccggtgcgcgggctggtctcggagaacttcgacgagctgagcaccgtgggcaaggttgccgattacttctggcacctggtgctgccagtcacggcgctggtgatcggcgggttcgccacgctgaccatcctcaccaaaaactcattcctgaatgaaatcacccgccaatacgtggtcaccgcccgcgccaagggcttgagcgaacgccgcgtgctctacggccatgtgttccgcaacgcgatgctgctggtgatctcgggaattccccaggcctttatcagcgtgtttttcgccggttcgctgctgatcgaagtgatcttctccctcgatggcctgggtcgcatgagctacgaagccgccgtgtcccgcgactatccggtggtgttcggctcgctgtttatcttcaccttgttcggcctcttgataaaactcatcggcgacctctgctacaccctggtggacccgcgtatcgacttcgccgcgaggaacgcctgatgcttaatctgtctccggtggcacgtcggcgtttcgagcgcttcaagaagaaccgtcgcggctggtggtcgctgtggttgtttatcggcctgtttatcctgaccctgggcggcgagttgatcgccaacgacaagcccttggtgctcagcttcaagaacgagctgtatttcccggtgatcaagcgttacaccgagcagcagttcggcgggcagctgccgttccaggccgactaccgcagtgactacgtgcaaaagctgatcaagcaggacggcggctggatgctgttcccgccgattccgttcagcgatgacacgcccaattacgaactgacccgccctgcccccagcccgccctcggcggtgaactggctgggcaccgacgaccagtcacgggatgtgctggcgcgagtgatctttggcgcgcgggtgtcgatcctgttcgccctggcccttaccgcgatcagcgccgccatcggcattgccgcaggcgccttgcagggttactacggcggctgggtggatttgctcggccagcgcattctggaggtgtggtccgggctgccggtgttgtacctgctgatcatcttgtcgggctttgtcgagccaaacttctggtggctgctggggatcatggcgctgttttcctggctggcgctggtggacgtggtgcgcgccgagttcctgcgcggacgcaacctggaatacgtcaaggccgcacgcgccctgggcctgggcgacggcaagatcattcgccggcatatcctgccgaacgcgatgaccgccacattgagttacctgccgtttattttgaccggggcgatttccaccttgagcgccctggacttcctcggtttcggcatgcccgccggcagcgcgtcgctgggcgaactgatcgcccagggcaagcagaacctgcaagcgccatggctcggcctgacggcgtttttcaccttggcgctgatcctgtcgctgctggtctttatcggcgaggcattacgtgatgccttcgacccacgttcatgagtgattgcagatgaacctgatcgaaatccgcgacctcagtgtcgccttcagcggccagaccgtggtgcgcaacctgagcctggacgtgcgccccggcgaatgcctggcgctggtcggcgagtcgggctcgggcaagtcggtgacggcccattcgattctgcaactgctgcccgaagccggcacgcaaaccacgggctcggtgaagtaccgcggccaggagttgatcggcgcgtctgccgccacattgcagaagctacgtggcaaccgcattgcgatgatcttccaggagccgatgacctcgctcaacccgctgcacagcatcgaaaagcagatcggcgaaaccctgctgctgcacaagggcctgggcggcaaagcggcgcaggcgcgcatcctcgaattgctcgaactggtgggtattcagaaaccccaggagcggctcaaggcctatccgcaccaactctccggcggccagcgccaacgggtgatgatcgccatggccctggcctgtgagccggaattgttgatcgccgacgagccgactaccgcgctggacgtgaccgtgcagcgcaagatcctgttgctgctcaaatccttgcaacaacgcctgggcatgtcgctgctgctgatcagccacgacctcaacctggtgcgcagtatcgcccaacgcgtgtgcgtaatgcgtgccggggaaattgtcgagcaggctgactgccagacgctgttcaacgcaccgcaacacccttacagccgcctgctgttggacgccgagccggctggcgatgtgctgtgcagcgatgagcgcgagacggtattgcaggtggacgacctgactgtgcaattccccctcagtggcggcctgttccggcgcaaaacctacttgcgcgccgtcgacggcatcagcctcagcgtgcagcgcggcaagaccttggggattgtcggcgagtccggctcgggcaagtcgaccctgggccaggcaatcctgcgcctgctcgactccaccggcagcattcgctttcaggacgaagccctcgacccgctcaacaaccagcaaatgcgcccgtggcgcaagcagatgcaggtggtgttccaggacccttacggcagcctcagcccgcgcatgtcggtcgaacagatcatcagtgagggcctggaagtgcatgcgccgtgcagcctggctgaccgcgacgcgcaagtgattcaggtgctcaaggacgtgggtcttgaccctgacagccgccaccgttacccccatgagttttccggtgggcaacgccaacgcatcgccatcgcccgcgccctggtgctcaagccggcgctgatgctgctggatgaaccgacctcggccctggatcgcacggtgcagaaacaagtggtggcgctgttgcgtgagctgcaggaaaagtacggcctgacctacctgtttatcagccatgacctggcagtggtgcgggccatggcccacgacatgatcgtgatcaaggacggcaaggtggtggaacgcggcgccagccatgaggtgtttgaagcgccgcagcacgcgtacaccaaagaactgctggcggcggcgcagctgcccttgtaggcgccgagattgttcccacgctctgcgtggtaacaccgcctgggacgctccgcgtcccgcacgccaagtgacgcagagcgtcacgggaggcgttcccacgcagagcgtgggaacgatcaccgttcacaggattcggcacgcatgaatagcaacgaaagcctcaaggactaccaacaggttcgcggcctggcgatccaatcgctgttcgagattatcgagcagtccagcgaaggcacggtgattgtcgaccgtgacgccaatatcgtgtggatgaacgaacgctacgccaagcgcttcggcctcaagagcgccgatgaagccatcggccagccttgcgaacaggtgatcgccaacagcctgttgcgccaggtggtgcgtaacgaccagccgatcctgctggatatccaggacacgcccaaaggcccgttggtggtgatgcgcctgccgattcacgacgacgcaggcttggtgatcggcgcaatcgggtttgcgctgttcgatgagttgcgcaacctctcgccgttgattgagcgctacctgagcatgcaacaggagttggcctccacgcgctcgctgttgcgctcgcggcagagcaaatacaacttcgcgcactttatcggcaccagcgcggccagcctggaagtcaaacgccgggcgcggcgcagtgcgagcgcggagtcgccggtgttgctgctgggcgaaaccggcaccggcaaagagttgctggcccaggccatccacggcgcttcgccccgagcgcacaaagcctttgtcagcatcaacagcgcggcaattccccatgacctgctcgaagccgagttcttcggcaccgcgccgggcgcgtttaccggtgccgaccgcaagggccgtccgggcaaattacagatcgcccagggcggcacgctgttcctcgacgagatcggcgacatgcccttgccgctgcagagcaaactgctgcgggtgttgcaggaaaaggaatacgagcccgtaggctccaatgaaatgctgcacagcgatgtgcgggtgattgccgccacgtcgatggacctggaagcggcgatcaagcgcggcgagtttcgcgcggatttgtattaccgcctgaatgtgctgccgatccaggtgccgccgctgcgggagcgcctggacgatattccggcgttgagcgaggcgattctggaagagctgcgcagccagcatgaactggcccctgaggcactggcgctgctggcccggcatgcgtggccgggaaatatccgcgagctgcgcaatgtgctggagcgcgcggcgttgttgagtgatgacctggtgttggatgcccaggagattcgcgcggcaattggcacgttcagcccagtggcgcgtggcgcggtggagacggttgcgggcgagacgtttgcggcggcgcgggaacgctttgatcggcaggtgattggcgcagcgttggcggcgtgtgaaggcaatgtggtggaggcggccaagcgattggggcttggcaggtcgacgctgtacaagaagatggtggcgttgggcatcgcctaatctctataaagagacaaaaatctcaatatcaagacactctaatgtgggagctggcttgcctgcgatagcggtctgtcagcctatacacctgccactgaagcaccgccatcgcaggcaagccagctcccacattgaatcttcatttgtctctaaatagagatagaattcaaagcccccgctcagatacacaatattatccttatatatcaattggttaggcagttggcacagatctcgctatagcccctctccaaagcctcaccccacaaaaataacaattcgatctggagacacaccatgagtgtgatcatcgccctggcagccctcgcgctgctgatgttggctgcctaccgtggctacagcgtcatcctgtttgcccccatcgccgccctcggcgctgtcctgttgaccgacccgtccgccgtcgcccctgcgtttaccggggtgtttatggagaaaatggtcggctttatcaagctgtatttcccggtgttcctgctcggcgcggtgttcggcaagctgatcgagttgtcgggcttttcgcgctcgattgtggcggcggcgatccgcttgctcggcacccgccaggcgatgctggtgatcgtgctggtctgcgccctgctcacctacggcggcgtgtcgctgtttgtggtggtgtttgcggtgtacccatttgcagcggagatgttccgccagagcaatatccccaagcgcctgatcccggcgaccatcgccctcggtgcgttttcgttcaccatggacgccctgcccggcacgccgcagatccagaacatcatccccagcaccttcttcaacaccacggcctgggccgcgccctggctgggcctgatcggcacaatctttgtgttctgcaccggcatgctctacctggcgcgccagcgcaacaaggcccagcgtgccggtgaaggctatggcaccgagctgcgcaacgagccggaaaccgctgacaacctcgccctgcccaacccgtggatcgcgctgtcgccgctgattctggtgggcgtgatgaacctgctgttcacccactggatcccgcagtggtacggcaagacccacagcctcagcctgcccggcatgagcgcgccggtgaccaccgaaattgccaagctcacggcgatctgggcggtgcaggcggcgttgctggtgggcatcgtcatggtgctggtgtttggctggtcggcgatcaaaagcaaactcgccgaaggcagtaaaagcgcggtcagcggtgcgctgctggcggcgatgaacaccgcgtcggaatacggctttggtgcggtcatcgcctcgctgccgggctttctggtgctggcggactggctcaagggcattcccaacccgctggtcaacgaagcgattaccgtgaccctgctggccggcatcaccggttcggcgtccggcggcatgagcatcgccctggcggcaatgtccgagagctttatttcggcggcgcatgcggccaatattccccttgaagtgctgcaccgcgtcgcggccatggccagcggcggcatggacaccctgccccacaacggcgcggtgatcacgctgctggcggtgaccgggctgacccatcgcgaagcctacaaggacattttcggcatcacgatcatcaagacccttgcggtgttcgtggtgatcggtactttctacgccaccggcattgtgtgaggttttcatgacgacattgaacggcaagaccgccctggttaccggctccaccagcggcatcggcttgggcatcgcgctgagcctggcagaggccggcgccaacctgatcctcaacggcttcggcgacgccagcgcggtgatcgcccaagtgcaggcgttcggcggcaaggtcggtcatcacccggcggacgtcagcgacccggcgcagatcgccgacatgatcgcctacgccgagcgtgagttcggtggtgtggatatcctggtcaacaacgccggcatccagcatgtatcggcggtggaagatttccccgccgagcgttgggactcgattatcgcgatcaacctgtcgtcggtgttccacagcacgcgcttgagcctgccgggcatgaaggccaaggggtgggggcgtatcgtcaatattgcctcggtgcatggcctggtcggttcggtgggcaaggccgcgtatgtggcggccaagcatggcgtgatcggtttgaccaaggtggtcggcctggaaaccgccaccagtaacgtcacctgcaacgccatctgcccgggctgggtgctgacgccgctggtgcagaagcagattgatgaccgcgcagccaagggcgtcgatccgcagcaggcacagcatgacttgctcgcggagaaacagccgtcgctggagtttgtgacgccgccgcagctgggtgagttggtgttgtttttgtgcagtgaggcgggtgcgcaggtgcgcggggcggcgtggaatattgatggtggctggctggcgcaataaatacaggcactgaacatcaaatgtgggagctggcttgcctgcgatagcggtgggccagttgactcatttgtcactgatacaccgctatcgcaggcaagccagctcccacagtttcgacctgtgttggctgggcgctgggtacaagaacaagagacttccgcatgtccgaaatcctctggcaaccctcccccgaacgcatccgcaacacgcggatggaccagttccggcgcttcatcaatcagcgctacagcctgcagctcggcgactacccggccctgcaccagtggagcatcgaccagcgccccgacttctggcaggccatcgtcgcgtacttcgacgtgcaatttcgcagcccgcccaccgcgacgttgatcgaagaggccgaaatgcccagcgcccaatggtttcccggcgccaccctgaactttgccgaacacctgctgcgccgtcgcgatgatcacccggcggtggtcgcgatcagcgaggacggccagcgcgaacaactcagctatgccgaactggctgcacatgtcgcgggcctgcaaaacagcctgcgcgcggccggtgtcggggtgggcgaccgcgtcgccgcgtgcatgcccaatacctggcaaaccctggtcggcatgctcgccaccaccagcctgggcgcgatctggtcgtgttcatcgccggacttcggcacccaaggcgtgatcgaccgctttggccagatcgagcccaaggtgctgatcacctgcgcgggttatcgctacgccggcaaggacatcgaccagacggccaagctgaatgaaatcctcgaacgcctgccgtccctcgaacagttgatcatcgtgccctacgcgaggcctcaagcgcgtgtcgaggactaccagactcacgccagggtcgcgctgtggaacgaggtttaccaacccggcggcgagcctgagtttgtcgcggtgccgttcgatcacccgctgtacattctctattccagcggcaccaccggcgtgcccaagtgcatcattcacggcaccggcggcgtgctgctcacccacctcaaggaacacgggctgcacgccgacctgtcacgcgacgactgcctgttctactacaccacctgcggctggatgatgtggaactggctggtgtcggtgctcgcgctcggcgccacggcggtgctgtatgacggctcgccgtttcaccctgggcctgcgcgcttgatcgacctgatcgacgcggaacggatcagcgtgttcggcaccagccccaagttcctcgctaccctggaaaaggccgggctgcagccgcgcctgagccacgcgctgggcagcctcaagggcctgatctccaccggctcgcccctgtcaccgcagagctacgactacgtgtaccgcgagatcaaggccgagctgtgcctgtcgtcgatgtccggcggcaccgatatcgtctcctgctttgtgatcggcaacccggtgctgccggtgcgccgcggtgaaatgcagtgcaagagcctggcgatggccatcgaagtgtgggacgaccagggccagccgttggtcggcgaaaaaggcgagctggtgtgcacccggcactttccggcgatgccgattggcctgtggaacgacccggatcagaccaggctgcgcgcctcgtatttcagccagtttcccggcgtatgggcccagggcgactacgccgaacagcgcccgaatggcagcctgctgattcacgggcgctccgacgcggtgctcaacccaggcggcgtgcgcatcggcacggcggagatttatcgccaagtggaaaaagtcccgcaggtgctggaaagcctggccatcggccaacgttggaaaggcgatgtgcgcgtggtgctgtttgtgcgcctggctgacggcaccgaactggatgaggcgcttgaacagcagattcgccaagtgatccgcgccaataccacgccacggcatgtgccggcgaagatcctcgccgtcacagacatcccacgcaccatcagcggcaagatcgtcgaattggcggtgcgtaatgtggtgcatggcgagccggtcaaaaacactgacgcactggccaacccgcaggccctggagcaatttcgcgaccgccctgaactggcgtaaagatgaaaggtttcagctcccgagcactcatttgaagacaaaaccccaatgcatgctatttttcggggggtagtcagccgctcccgtctcgcgggataatcggattttgttgtacttaaaagtgtcaggtgtagggctttttcatgaatggaacatccaccggtagcgaagccgctgcattgattgcgcggctggactgggcgcaaagccccctcggtgaggccaatgaatggccgcaaagcctgcgcacagccgtcgatatcgtggtgcactcaccgatgccgatgctgttgctgtggggcagccaactcacgcagctctataacgacggctttgccaagctcgcgggcaacaaacaccccaccgcgctcggccagccggcgcatgagacctggccggaactggagagcttcactgcgccggtctacgacgcggtcctcggcggcgaggtgcgcacgttcagcgagcagcgcttcgtgctgcaacgcaaccatcgcgacaccgaaatctggctcgacctgacctacagcccggtccgcgacgaaagcggcacggtcgcgggcattctggtcaccgccatcgaaaccaacgaacgccgcagcaaagccctggaactgcagcagcgctccgaagacagcctcaaggcccagcacaacagcgagcagcgcctgcagctggcactggcggcgacggacgcggtcggcacctgggactgggatatcggcgaagaccgctttattgccgacgcccacttcgcctacctgcacggcgttgacccgagtgatgccggcctcttgccgatcagcgagtacctgcaaggcgtgcaccctgaagaccgcggcatggtggcgcgcagcatcaagcactgcatcaccttcggcaccgaatacgccgaggaataccgcctgctgcaagccgatggccaggtgcgctgggtgtttgcccgaggccgctgctacaaggaccatcatggccgcccggcgcgctttttaggcgccgcgctggacctgaccgagcgcaagcacaccgagcaggccctgcgccaaagccagaccgagctgcagttgatcatcaacgccatgccggtgctgatcggctatgtcgatcacgaacagcgttttcgcctgaacaacagcgcgtacctggagtggtacggcatgacgccgcaagagctgtacggcaagagcatccgcgaagtgctcggcgatgaggtgtatgccgggcgcgccgacaagatcgccgccgcgctgcgcggcaaggcctgcagcttcatgaccatcacgccgcaccacgacggccggccgcgccatgcgttgatgaagtacctgccgcgtttcagcaatgacggctcggtgaacggtttctacatctttgtgatcgatgagaccgaacgcaaactcaccgaagaagccctgcgccacctcaacgaaaaccttgaagaacgcgtggcccagcgcacccaggcgctggccgaggccaaccagcgcctgcaaaacgagatgttcgaacgcgagcgcgccgaagacgcgctgcgccatgcgcagaagatggaagcggtgggccagctcaccggcggcatcgcccatgacttcaacaatatgctcaccgggattatcggcagcctggacctgatgcagcgctacatcgcggccgggcgcagcgacgaaatcggccggtttaccgacgcggcggtgtcttccgcccaccgcgcggccgccctcacccaccggctgctggcgttctcgcggcgccagtcactggaccggcgcccgttggaccccaaccagttggtggcctcgctggaagacttgttccggcgtaccaagggcgcgcacatcacgctcaaagtggaactgggccgcgatatctgggcggtgaacaccgacgccagccaattggaaaacgccctgttgaacctggtgatcaacgcgcgcgacgccatgcccgacggcggcgaattgctcatcgaaaccgccaacagttacctggacggcaccgacatcaccacgctggaaccggtcaaggccggcgattatgtgatgctcggcgtgagtgacaacggcagcggcatggcgccgaagattctggccaaggcgttcgacccgtttttcacaaccaagcccatcggccaaggcactggccttgggctgtcgatgatctacgggtttgcccagcaatccggtggccacgtgaccattcaaagcgagcccggcaaaggcaccagcgtgcgcctgtacctgccgcgcctgcacggcaccgcgctggaaagcagcctgccggcgcacatgagcgaagccccgctggcgctggctggcgaagccgtggtggtggtcgaggacgaccccgccgtgcgcatgctggtggtcaatgtgctggatgaattgggctacaccgcgcaccaggcggcggatgcacgcacggcgctgccgctgctggagtcggatttgcgtgtggacctgctggtgaccgacgtcggcctgccgggcatgaacggccgccaattggcagaaatcgcccgccagcaccggcccggcctgcgtgtgttgttcatgaccggctacgccgaaaaggccgctgaacgccagggtttccttgaagacggcatggacatggtggccaagccgttctccatcgaactgctggcgacgaaaatccgcagcatgatcaacgttgacgaatgagttcaggcataatcgcgcgcccttccgtttgaccgttgcaaggtaacaacatgaaagcccaagcccgtcacatcctggtcaagaccagtgaagaagccgaacagctcaagcagcgcattgccaagggcgaagcgtttgatgtgctggccaagaaatactcgacctgcccgtccggcaagcgcggcggtgatttgggtgaagtgcggccggggcagatggtcggggcgattgatgcggtgatcttcaagaagccggtgaaagtggtgcatgggccgatcaagagcaagtttgggtatcacttggtgcaggtgttttaccgcgactgaccagagagcggacgcggagcgtccggtgaggcattcccacgcggagcgtgggaacgatcagtgcggtcaaatgtgggagctggcttgcctgcgaaccgccgcaggcggccattcaccgcgcaatcaaagcccctggcacctgaatcacccggctcgccaaccgatgcccagccaaggccgcctcctcaggtgactgacctttcatccggctggccaaatacgccgcactgaacgaatcccccgcggccgtggtgtccaccaccttctcgaccttcaacgccggcacggcaaagcgctcgccgtcacagcggatcaagcagtcatctgcgccgcgcttgagcaccacttcggcaatttccgggtacgccgcaaacacctgttcgctgtcggcatggccaaacaacgcacgctcgtcgtcttcggtcagcaaggcgatatccacctcggccaaaacggcgtgatacgccgcgcgcgccgcttcgacgctggcccataaacgcgggcggtagttgttgtcgaaaaccaccttgccaccgcgcttgcgcgtttcgctcaaggtttgcagtaaccgcgtacgcccgatttctcccagcacggccagggtaatgccgctgaaatacaccacgtcgtaacccggcaaagccgccaggatcggctcggcggccggggtggcgaagcagtcgcgcacggcggcttcgttgcgccagtagaggaatttgcgctcgccgttggcgtcggtctggatgcagtacaaaccgggtagacggtcgcgcaagcgttggaccatgcccaggccgaggccttcgtcggtccattgttggcacatggcatcgctgaagctgtcatcgcccagggcggtgacgtagtcgacgctgccgatatcgcccaactcacggcgcaggtagacggctgcgttgagggtgtcgccaccgaagctttgttggaggctgccgtcggcgcggtgttggagttcgatcatgcattcgccgatgagggcgatgcgcggttgtgtgttcatgcctgggtctctcggtgttctggagggcctcatcgcaggcaagccagctcccacagttggaatgtattcacgcttccaatgtgggagctggcttgcctgcgataggcgcgacgcggtttagaagcaggtatgcaaggactcgatcacctgcaactgctcatccaccaggcagcccacttgccatttgtcgaaggtcaggcacgggtgcgaggtgccgaaggagatgatgtcgccgatacgcagttcaacccccggcgccacgctcatgaacgcgtgctggtccatcactgcggtgactttgcaggcggtgacgtcatcgccttcggccggcaaaataccggccttgtagcgcttgagcggcaccggcaggccggcgtcgtaggcaacgtcgcgcttgcccagggcaatcaccgcaaagcccggctctggcaacgattgcacatgcgcccagacttccagcgccgggcgcaggccttcgttgaggtcgctgcggcggtcgagcacgcagcattgcgcttctttgtagatgccgtggtcgtgggccacgtagctgccaggtcgtagcacgctgaggaagcggccagcggcattttgtgcttcaaacgactcggcgatcaggtcgtaccaggccgagcccgaggcggtgatgatcggcttgggcaggtcgaaagaaccgttgttttgcaggtcgactgccaggcgtaccaggctcgcggcaaagtcgcggatgccgctgacggcgtgttcgccgtggatcacgccttcgtagccttcaataccggtaagggccagggccggctgggccttgatcgccttggccagctcgcgcacttcctgctcgctgcggcaaccgcaacggccaccgaccacgccgtactcgatcatcacgttcaggcgcaggccgcgggcggcgaagaacaggccgaggtcggcgacgttgtccgggtgatcgaccatgcagtggaagtcaaaatcctcgtcggccaacaagtcggcaatcaacgccatgttcggcgcgccgaccagttggttggccatcaatacgcggcgcacgccaccggcataagcggcgcgggtctgcaccgcgttagccagggtgatgccccaggcgccggcttcgatctggcgttggaacaatgccggcatcatgctggttttgccgtggggcgcgagttctgcgccgctgttgctgacaaatgcctgcatccagcgaatgttgtgttccagggcgtcgcggtgcagcaccagggccggcaggctgacgtcgcggaccaggtgggcgccaacggcggcggcgcctttttcaacggcattgagggcagacataaaaactcctattcgttgatgcgacgggccaggttgttggcgctgtcgatcaacacccggcgatagtcgttgtaatttttaatcgcgtcggcccgtggggcgacgatgcacaaggtggcgatgctgatgccttgcgcgtcccgcaccggggcggcgaagcaatgggtaaaggtgtcggccacactgtcgaaagagaagaacccgtcgagggtggcctgacggatctgcgccaggaacgtttccaacggcaggcgctggccgtccggcaggatgaagtcgtcgtagtcgatcaggtcgatgatttgctggtcactcaagtgccccagcagcaggcgcccggaggcggtccacgggatcggtgcgttttcgccgatgtccgacgatatgcggaaatgccgctcgccttcgcgcatcagcgccaccgtgtatttgcgcccgttgagcaggcacatctgcgcggtttcgtgggtttggctgacgatttcctgcaaggcgtggtcggcctcgcgggtcaggtcgaaatggcgcaggtgcgcctggccgaggaagtacaactggcggccgaggtagacgtggccgtccttgcccaccgtttcgagaatgcgccgttcaagcaacgaggcgaccagttcgtagacggtggatttggggctgccgatgccgctggcaatatcattcgggcgcaggggctggccgatttccttgagaaaatcgaggatatcgaatgcacggtccagtcctttggcgcggcgtttgatggtgtcttcggtcatggcagtagtcggtctctgttgatcgttcccacgctctgcgtgggaatgcataccgtgacgctctgcgtcacagaagcggacgcagagcgtccagggcggcgttcccacgcagagcgtgggaacgatcgtttaagaatggggcatttagccttttttcttgtaggccacgcaatcgatctcgaccttgcagtccaccatcatgttggcctgcacacaggcgcgtgccggggcgtgttcgggggtgaagtattcgccgaagactttgttgaaactccagaagtcccgtgggtcttccagccatacgccgacgcgcaccacgtctttgagttcgtagccggcctcttccagaatcgccaccacgttgcgcatggtctggcgggtttgttcgacgatgccgccgttgatgatttcaccgtcgactgccggcacctggcccgagacgtagagccagccgtccgcttccaccgcgcgggcgaaaggacgaggttggccaccgccggcggtgctgccggtgccgtaacgagtaatgctcataaagttgctcctgattaaaaacgaatgttcttcaaaaattccgccaggcgcggcgattgtgggcgttcgaagatgtctttcgacgtgccctgctcttcaatgcggccctggttcatgaatacgatcttgtccgacacttcgtaggcaaaacgcatttcgtgggtgaccagcaacatggtcatgccctcttccgccaagcccttgatcacgctgagcacttcacccaccaactcggggtcgagggccgaggtgacttcgtcgaacagcatgaggctggggttcatcgcaatcgcacgggcaatcgccacgcgctgttgctggccgccggagagctggcccgggaaatggttgcgccgctccagcaggccgacgcggtccagccatttttcggccagggccacggcttcgtccttgcccatcttcttgaccttgagcaggccgagggtgacgttttgcaacgcggtaaggtgcgggaacaggttgaattgctgaaacgccatgccggtcatcgcgcggtgctgggcaatcacgcgttcagggtgtcgcacgcgcttgccggcgatttcgctgtagccgatggactcgccgtccagggtgatctggccgccctggaattcttccagcaggttgacgcaacgcagcagcgtggtcttgcccgagccgctggagccgatcaacgtcaccacgttgccgcgctgcatggacaggtcgacacccttgagcacttctacctggccgtactgtttacgcaggccgcgaatgttcagcagcggttggttagtttgaggttggttcatggcaaggccacccgcttttcaatgtagcgcccgaataactcgatggcgtagttgatgacaaagaacagaaacccggcgaacaggtagaactccagggtcatgaaggtacgcgcgatcacttgctgggtgctcagcagcaattcagccacgccgatgaccgagagcaaggtcgaggccttgacgatttccgtggaggaattgacccaggtcggcaggatctggcgcaacgcttgaggcaacagcacgtagcccagggattggtagaacgtcaggccaatcgccttgcccgcctccaattgcccacggggaatggcttgcagcgcaccgcgcacgatttccgagacgtgggagccgcaaaacagcgtcagcccgacggcgccggcctggaacgcggtgatctgccaacccagcgccggcagcatgtagaaacacgccaacaccagcacaaacaccggcgtgccacggatcaggtcgacatacagacgaaacggcgcgcgcatccagaacttgccgtaggtcaggatcaacccggcgacaatgccgatcagcgtaccgaaaataatcgccagcgcagacacatacacgctggcctgaaagcccgcccacagggtgtcccgggcgatccacaactcatgcaaccagctgggggattcgtacatggaaaccctccttaacgacggatcgccagacgctgttccaggtaacggagcagcatggcaatgaggtaacaggcagccacgtagagcgcagtcgtgaccagccaggtttcaatcacccggtagctttcgacgttgatcttgcgggcgtagtaggtcagttccggcacggcaatcgcagccgccagggaggtgtccttgaacagcgagataaagttgttcgacagcgccggcaacacattgcgcagcatcaccggcacggtgatataggcgcggatacgccactcacccaagccaatcgccaggccggcttcgcgcaagcccttgggaatattcaacagcccggcgcggaacacttcggtgaggtaggcaccggcgtacagcgacaaggtgatgatgaacgaggggattttgtcgagacgaatccccagtgacggcagtgcaaagtagatcaacaagatcagcacgaggatcggcgtattgcggatcaccgtcacatacaccgaggcgaagactcgcaacgcgcggtgtttggacagcatggcaaacgccatcatcaaaccgatcacgcagccaatcgcgatcgacagcagcgccagctcaaggcccaggccgagccccgccagcaagctggggaaatcacgccacacggcggcaaagttcaactgatagttcatggtcggcagtacctgattggggcgccgtcagcgacgccccagggtttacgatttacttgaactcaaccgggaaaccgatcgcaggttctggcaaatccacgccgaaccattgcttgaacgaggccttgtaggtggggaattccacaccggtcatggcttcatgcaacgcggtgttgacgaagttcagccagtcctgatcgccacgcttgaccgcgcacgcgtaggtttgcgggctccaggcgtaggtcgggctgcggtagcggccggggttctgcaccatcaggtacttgaccgaggattggtcggtggcggcggcatcggcgcggccggagttcacggcctggtacatcaggtcgacgctgtcgtattggtcgaccttggctttgggcaatgcctggtgcaccagctcttcggcgtagacgttttgcagcacggccacggtgacgccgtcgcctgcggcttgcaggtcttcgatttccttgtacttgctgttgttcggcaacagcaggcccacgccttcgcggtagtacggcaaggtaaatgcaacttgctgcgcacggctggcggtgacggtgatgaactggcaactcatgtcgaccttgtcggtcagcaggttgggaatacgtgcgtcagacgactgcaccacaaactcgaccttgctcgggtcgttgaacagacccttggcgacgatacggccgatgtcgatatcaaaaccctgcaacttgccatccgctccctggaagtgccacggcgcattggtactgcctgtacccacgatgagatgcccacgcttgagcacatcatcgagcttgctgtccgccgcctgcactacgcttgcgagggaagccgatgcggcgaagagaaaaacacacgctttaaacacggaaggtcggtgatgcatgacaagcactccaggagctgtgtattccgctataccggaacttagtatgtaacaacggaatagacagcagaaagtgtgccacacggggtaacagaaaaatatgattgtgaaaaattcgttttgaatcatggagataatggtctgtgctgggtgaggcgcttggccagcggttggaagcagtctgctactcagggacacacagtgacaggtggcgcaccagggtggcgttaccgtgcaccgtagcggggctgttattgaactcctgtgggagcgggcttgcccgcgatagcggtgggtcagtcatcatcaatggtggctgagctgacgccttcgcgggcaagcccgctccctcagcggggggggggcgttgttgctttgagtattgtgtgggtgtggctgattttttgggttgggctaggctgggggtatctgtgtgtaggagccgggctgatgaaggtaagaattttggtggttgtgctgtgttggtgggtggccggaacggcattggccagtaatgatcggcgtgaatgcaaggaagaattaaccaagctgaaagaggcttacagcaccgattacaccagccagaaccatcacggctatcgcaaggcgaaggcgtcgcgggacaatgaggaatacaagaaatgcgcgagtcaggcgcgcaaggcccgtgaacgcgtggaacgtgacgcagatgtgtaagcgtgtctacctgtgaaggttgacagtagacgggggtgatctctcgatttagcgtaacccgcacagctacttggccgggtacacaaggagatcgtcatgggtgttgtgataacggaagtcagggactacaacgaataccagcagatattggatgaacatccactggttatcgccgtgttcactggtcaaggctgcgtggcttgcaagggagtcgagtcaagctttactgatatcgccctagcgtacgccggccgtgtcaaaagcctgatgctcgacacagcgcaaaccccaagggtccaaggggtaagcggcacgcccacctttgtggtgtacagaaatgcccaggaggtcgacaacatcaaggggattgtcgacccagatgagcaaaactactatctggacaaactgtttactcactatgccaacggcaatccagctccgttcacctatgagccgccaccgccaccggcaccaacagcacctgcgtcacccgccgctcatccaccgctgccacggtaaggcgccagccttcatgctcaaggctgtcgccgaccatcggcaggcggtccagcaggctcatgactaaacctgcgagggtctgataatcgtcggtggcgacggccttgaagccggtgcgctggcgaatctggttcaggttcacggcgccattggcacgaaaaccctcgccttcctcgacaatatccggcccttcaatctcgctggcatccggcaattcaccggcgatggactcgagaatgtcggtcatgctcaacacccccatgaagtcgccgaattcgttgatcacgaacgcaatgtgggtggattcctggcgcatctgctccagggcgttgaggatcgaaaaactctccagcaggttgatcgcgcggcgtgccaggtgctccaggttcggctcgttgccggccaggtattccttgagcaactccttcttgtgcacgaagcctaatggctcatcgatagcgccgtggcggatcaacggcaggcgcgaataggacgaatgcatcaatttcaggcgaatagtgtcgcgatcgtccgacagatcaatacagtcgaccttggcccgtggggtcatcaaggtgcggatcggtcgctcggccaattgcagcacgccgctgatcatcacgcgctcgcgtcgatcaaacaacgggccctgggcggcatccggctcgcccatcaggtcagcaacgtcgtcatccatgccttcgacggccaggctgcgaccgccgagcaaacgcatcaccgcatgcgcggtacgctggcgcaccggcaacgtgccttgcgccgacttcttgcggcgggcgcgggcaatctggttaaacacctcgatcaggatcgagaaaccaatcgccgcatacaaatagcccttgggaatatggaagcccaagccttcggcagtcagggcgaaaccgatcatcatcaagaagcccaggcacagcatgatcaccgtagggtgcgcgttgacgaagcgggtcagcggtttactcgccacgatcatcaagccgatggacacgatcactgcgatcatcatcaccgccagttcatccaccatgcccacggccgtaatcaccgcgtcgagggagaacaccgcgtcgagcaccacgatctgcgccacgatcggccagaacatcgcataggccacattgcccgagcgctgggccacgtggccttccaggcgctcatgcaattccatggtggccttgaacaacaggaacacaccgccaaacagcatgatcaggtcacggccggagaagctcttgtcgaacacctcgaacaagggctgggtcagcgtcaccaaccaggaaatactcgccagcaagcccaggcgcatcagcaacgccagggacaaaccaatcaaccgcgcccggtcgcgctgctccggcggcagcttgtccgccaggatcgcgataaacaccaggttgtcgatgcccagcaccagttccagcacaatcaaggtcaacaggccgagccaggccgttggatccgctaaccattccatttatagagtctcgtaatagatttcagaatgccggacacggcaaagcgcggtcagtggaccgggacaaggttagcagtcggaatacggggtgctttaacgggaacagcagcaaatgtcttggggaaagacgactgggaggctccaagagggtgttcatgcaagtcctgaaataacaaaaggacttggatcgtacaggcgaaaccaaaatttcccacaacgcaaaactattacaagatctgtcctccaagccgacataaaaccctgtgggagctggcttgcctgcgatacgggcaacccggtctgtcagtaaaaccgaggtgatgctatcgcaggcaagccagctcccacacaagctcgcgaaggcagccacaccgctaacccgcacagcacgatcaagcttccaacttggcgccctgcttgacctgctggatataccgcgccaccgccggccctttctcaaagcgccggtgaatcagcgacagccacgacgacgcctcactgccctgaatagcgcgatacaccacgcccggcaaactcacatgcccaaccatcgacgccggcaccaccgccacaccctgccctaacgacaccagcgccaccaccgccaccaacccacccggttgcggccccaggcgcggcgcaaaaccgccctgggccgcgacatgcagcgtgccgctgatttgttccggcaggataaacgtctcgttttgcaggtgctcacaaccgatggctttgagctccagcagccaggaagcctgcggcaacgccaacacaaacccttcgctgcccaggcgcaccgcttcgatgccatcgggcaaggtcatgggcgagcgaacatagccaatatcataacgcccgtccgccacggcgctgggcagtgtcgccatcgcgcattcgcgcacattcacgctcacatcgggatttgcctggctgaacgcctgcatctgccgctgcaacaccccggagtacaccgccgaagccacatagcccaactcgatatgaccgatctcgccacgcccggcgcgctgggcattgcgctgggcgaattcgaactggcgcacggtggcttcggcctcgatcagcaaggccgcgccggcctcggtcaggctgacttcgcgttgctggcggataaacaagcgagtgcccaagctggcttccatgtcctggatttgccgacttaacgtcggcggcgcaatgcccagttgctcggcggcgcgggtgaagttgcgctgacgggcaacggcgaggaagtagcgaaaatggcggatttccattgtgacattagctcaaaggtaatgaagcgcttcagtccagctaacaaaaaccgcagccgctgggaatacgctagcgagacctcaacactagagagcccttgcgatggccgtcaagcgtattgcccttattacctgcaaggtaattaaaccatgaaccgtgtcagccctcgcttcacgctgctcaccgcctccggcgtgtgctcactgatcgtgctcgacaccaatatcgtcgccgtgaccctgcccagcatcgcccgcgacctgggcgccaacttcgccgacatcgagtgggtcgtcagcgcctatatgctcgcgttcgccgcgttgttactgccggccggcagcatcgccgaccgttttggacgcaggaaaacgctgatctggggcttgagcattttcatcctggcgtccctggggtgcggggccgcgccgaatgcgttgttcctcgacatcgcgcgcgccgtcaaaggggtcggcgcggcgttgctgctgacctcggcgctggcttcaatcggtcacaccttccacgatgaagccgagcgcgcaaaagcctgggcgttctggggggcatgcatgggcgtggcgatgaccgccgcgccgacgctgggcggcttggtcacgcagtacctgggctggcgctggattttctatctcaacctgcccgtaggcctggggttgatggcgctggtgctgcgggcgattcctgagtcccgcgacactcagtctgcacgcctggatccatggggcagcctggccttcagcgccagcctgttgtgcctgatctgggcgctgatcgaggccaatcgtatcggctggggcaacccactgacttacgcgcgactgatcggcggcgcactgttgctgggcgtgttcgtgatggccgagcgcgtgcaacagcggccaatggtggacctgcagctgttccggcacccgcgctttatcggtgcgctgctgggcatgtttgcctacgccggttgcgcccaagtgatgatgacgctgctgccgttttatctgcaaaacggcttgggtttttcggcgattgcctcgggcctgggcatgctgccgtttgcgctgaccatgctgatttgcccaaggatcggcgcgcgcctggccgggcgatttgcaccggcgacgatgatggcgaccggcttgaccctggtcggctgcggcaacctgttaagcgcctgggcggtgactatcggcggctacctgcccttcgccctggcgattgcggtgacaggcgccggtgcaggcctgctcaatggtgatacgcagaaaaacatcatggcgtgcgtgccacgggaccgggcgggcatggcgtcggggatgagtacgaccatgcgcttcagtgcgatcatgttggccatcggcgtgtacggggcgttgttgagcagccatagcgagcagctgctgcgcgcgactatcgacgtgcagtggcaggcacaggcggcggggattgcatcgcgggtggtggccggtgatatgccggcggccatgacattattgccggagacggcccgcacggtggtgcaaccgctggcgcggcaagcgtttgtgagtgggttcggcgaggtattgtgggtggcgggtttgttggcgttgctgggggcattggtggtgggggctttgatgcgaaaaccgattcccctgctgccccagtctttgccaacacactgaattccatgtgggagattctatggttgaggggcaaccctcaaccaatcttcggttggtattcggtttgtcctttcatcaaggc

SEQ ID NO: 55 - DNA, 86332 bp, Pseudomonas poae FL10F
tattgaaacaaaaacaaaaaaatgtgggagcgggcttgctcgcgaatgcggtggatcagtcaataaatcattagctgaacaatcgcattcgcgagcaagcccgctcccacatttgagcttcggtgtttaggacgtgtgatttcagccttgggcgaaatcgcgcagcgcgtcgccttccatgcggtaacgcacccattcttcctgcggctgcgcgccgatggatttgtagaaggcaatcgccggctcgttccagtccagcacgctccactcaaaacgtccgcagccgttgtcgcaggcgattttcgccaggtggcgcagcaacttcttgcctgcgccgccgccgcgttgctcggggttgatgtagaggtcttcgaggtacaggcagttgctgcccagccacgtggagtagctgaaaaagaacaccgcaaaaccaatcggcagaccgtcacgcgagcagatcaggccatgggcggtggcgccttcgctgaacaggctgcgttcgatgtccgccacactggcgatcacttcgtgccgggctttttcgtactcggcaagctcggtgatgaacgccaggatctgcgcagcatcgctgggcacggcggggcgaatctcgatggtcatgggcgagccttgggcaaattcaaagcacacatactaaggcggtttgatgacgaattgcagcgcaatttagtgctggccggggcgccttactccgtcgtgggctaatgcaagcaccaccaagcacacaacaatcagttgcgctgtgcatgctaaaaatcggccataactctaacgacctcaaggtttagccatgcatgccactgcacccgtaaaaaaacgaagcgcaaagctcttcgcgctgttttgcctggccagctttctgctgtcgctgtcgtacggttcgacgtttctgctgtcgctgctgattcattcgcgcggcggcaacgagcacgatgccggcagcgtgatctccaccgcgatgttcagtacctttgtggcggtgctgttctccgggcatctggccgatgcagtgggcgccgcacgcgcgattgcgtggaccggcgtgttgctggtggtggcctgcctggggttcgccctgatgccagggtttggccacggcttgatgctgttcgggctctcattgggcctgggctggggcgtgttctacaccttgggcccgattatcgtcagcttgttggtggagccgtcgcagcgggccaagtactttgccttgctgtcgggcagcatgttgagcgggatcggctccggccctttgctcgggcgagcggcgagtgcgctggagctgccgctgaccagcgcgttttacatcgccgggctcgccagcctcgtcggggtggtgatgttctggcgcatgggcgcgcaactcaagcagcacgccaatacgccgacctcgaggatttcctgggccgccagccgacaggtgctgtcatccgaggcggggtttgccatcctcatggtcggcctgggcggctgtgtatttggcggcctgtcgtcgttccaaaccagctacgcagccgcacgtggcttggactattcgctgttcttcgccgggttcctgagcgccgcgatcaccagccgtttgttgattgccggccacgtggtcaagcgcgatgcctactgggcggcctgtgtgttgtccgcgatcatgctcggggcagtcgcactgcttgcgtttggcgtgagcggcaacctcagttacttgctggccgctgccacgctgggcgtgggatacggcctgacgtattcggtgatcaatgggttggtggccaacgaagcaccggctggcactacgtcacaggccttgctgctgttcagcctggcgtactttgttggcgtgttcgggttcccgtggttggcgggccagatcatcgtggaccatggcctgcccacactgctggcgattgtggtgggcgtggcgctgtttaactggctgatcgcggtggcgcggctggtgtggcgcagcgtctcggcacacaaaatcttacaggtacgctaataccgttcgtcgccatcaaggcacgaaccgcaagtgagggctgaccaataaagggtaaggacattaatcatatggagacaccctcatgaagaattccaagtttgccgccctcgccctcaccggcctgttgtctgctgcctcgctgagcgcctttgctgccacttcgtccaccggcacgaccgacccggtcggcagcccgcccagccctgccacgcaggaatcgcagaaatcgatgggcaccggcctcgacaccaatggtggcgcgatcatcgacaacagcgccggcgctgaccctcgtacgcagggcaacgacacccaacgccaggctccggccgccgttggtaacggcaagatgggcccaggcatcaacaatgagcccaagatcaacaaaggcgacgactcgaacatcccaggcgcgccgaaacaacctgcgccttaatgcaccaatagccacaccaacacccgatcatttcccagtgaagaggtacgcatgaacgtcgatagaaaccttgaaaaagaagtcctcacccgcctgctgcacgcccacccgaacggtttgggcaaggaggtgctggataactaccgcggcgagaaggaagtggccagtgtcttggcgttcctgcaggaccgtgggtttatcaaggatgggcatgtgaccaccgacgacgccggtgaatattcgttgaacctgccgatcaagctgactgcgtccggcgttgacgaggcgcgcaagctcgacggcgaacgcgcgtagtaaaagctggctaaaacgaagatccaaatgtgggagcgggcttgcccgcgatggcgtcgcatcagtcactatttttctgactgatccaccgtcatcgcgggcaagcccgactcccacatttttgttcggtgtatatcgtgagaatcagcgctgtgccgagaccagcagcatcattgggcgctcttgctcttcggccaattctggccgagctttcaggtccgcttcgcttggcccccactcctccacatgactgagcgtaaaccccgcgtggatcaacagattgagcaacgtgcccagcgtgcggtgctgtttgatcacgccctcggccagccagttcgttacccgtgggccttccagttgatagccatccacaggccagctcttgcgcccctgatcatccaccaaccaacccggattacgcggcgccataaagatcgggtgctcgatggaaaacaccaggcgcccgcccggcaccagcgcttgatgaatacgcgcgaacagccccttgaggtcaacgatgtaatggaacgcaagtgagctgtaggccagatcgaatgcgccagcgggcaggtcgagctgttccaggtcggcaatcgcatagttgatgctcggcgccgaggtcatctcggtggcccgcgccaacatcttttgcgacacgtccaggccgagcacctgcgctgcgccctgctcctgtgcccagcggctgaaccagccgtaaccacaccccaggtccaccaccttcaagccacgcatcggcggcagcagtgcctgcaacgcgggccactccggcgcaccggccaggccttcgaccgagcggcccattttgctgtagccctcgaagaaggctggcgtgtcgtagatattctgggtcatgggctgattccgtgcgaagaaggccctattttgccaacaacgcatccacttcgtcagtaccgggtgaagtcgccgggccccagcgcgtgaccgccagcgcagccgccgcattcgcgcggcgcgccgcagcagccggtttcaagcctttggccaacccggcaaggaacacaccggcatgcgcatcgcccgcgccgttgctgtcgacggcggtcactttgaagcccggcacatgctcggcctggccttggcggctgacccagcagccattcggcccatcacgcaccaccagcagtgcctcggcaggcaaatggcgattgagttcgagcagggcctcggccagcgtaccggcgccggtaaacgaaagggcttccgggccattgctggtccagatatcgatgcgcggcagcaaggcgaccatcaaggccgaatccggcgccttgaccaacggccccgggtcgaacaccaccgtgatttcacgcggcagcgccaacagccaatcgagcaacgcctgggccttgccttcaagcaacaggctgtagccgctgacgtacacgtagtcgtccgcacgcggtacgaccccggccaaatcctcagcgctcaaatccccttcagcgccgatatgcgaaatgaacgtgcgctcggtggtggcctcggtcagcgatacgcataaacccgtgtccttgccggtgctggccgcttgagccatctccacgccttcggcctgcatcgccgcgcgggccaggtcgccgaagcgcccgttgccatggcggccgaggtagaccaccggcaagccgttacgccgggcggcggccatcacgttgaaaccaccgccggcttcgaagctggcggattgcgccagcacgtcgccgccggtcgccggcaaggtgtcgagggccatgaccaggtcgacgatgacctggccggtgtgcagcaatctagacattagggctctctactaaagccgggcgacggtcagctgcgccgcccagtaccgcgtaaatcccaccggccaccaggaacgtgacgatccagcccaggccgttgtggcccagccaggagtcggacaacggcccggcgaaccagatgttttcggcggtggtgccgatggtggtgaagctgaagcccagcacaatcgccacggcccaggcgccgaaggcacgccactccacaccgccgcgataccagtaggcgctgcttgggctcacgtccagcaggtctttggcgctgtagtagtgacggtgaatcaagtcgactacgaagatcccgacccacgcggtaatcggcacggccagcagcgagatgaaggtgatgaacgggccgtagaaactgtcggcgatcagcatgaagtaaatcgaaccggcgaagatcgccacgatgtcgacgatcacggcgtgcacgcgcttgaccttcaagccgagggtcaaggtggtgaggccggccgaatacaccgagaggttattcgacagcagcagcccaccgaatgcggtgatcaggtacggcacggccatccaggtcggcagcatgtcgcggatcgcaatgatcgggtcggtggccgaggccaggtcgttgttgcccaccgacagcaagccgccgagggtgatcagcagcaccagcggaatccccgcgccaaacgcggcagacgccaccaggcgcacggccttgacgctgcggtgctggtagcgcgacatgtcggcaccggcgttggcccaaccgataccggtgccggccgccatggtgccgacgccgatgatcattgcgctcagcggcgccggggtggcgttgaacactgcgctccagtcgatggtggcgcagagaaagccgcccaccagaatattcaagccgccgaaaacgtaggtggcccacttctggatgaccagcaaggtcgcgtggccgaggccggaaacggacaaggtcagcaagacgaaaatggcgatgaagatcagcgtcagcaccggcgcgcttttcgcctcgaccggcgagtggaacaggatcgaacacaacgacagcagcacgaatgcagccgtcgtggtgttgacggtttcccagcccaggcgcgacatcagcgacacgatggtcgggccgatattgccgcgcacgccgaagatcgcgcgggacaaggtcaggctgggcgcacggccacggcgaccggcaatcgagatgatcccgaccaccgcgaaagagcctgcggcaccgaggatcgcgacgataatcgcctgccagattgccaggccgcgaaacgctacgagggtcgcgccgagcggcaaaccgaggatgctgatattggccgcgaaccacacccagaacagttgcagcggatggccgttgcactcgctttcaggaaccggttcgataccgcgtgtttccaattgcccggcactttggccggaagaaggggtgctcatgaggggtgctcctggtgcctgtattgttgtggttgtggcagatagtcaaagctctaaccggtcgtcctgactcaaacacgatttgatgtgggagctggcaagccagctcccacaattttgatttgcggtgcttatcgaatgtgcagcagcccttgcaccagcggctgcaagtccaagccattgacctgcttgacctgttcaatcatcgcctcaggccagcactgcaggcccaaacacgcgcccagcatcgcgccgagaatcgcggcgatggtgtcggtgtcgccgccaaggctggcggccaggcacaccgcttcaaatgcattcatcgcgcccaccgccacttgctgcgcgagggcaaacgacaccaccaccgattcctgggacgcgacggaggtgccgatcaattcatagagcaggtcggcgaacagggctttgtcgccgctgccgacgctcaaggtccgcgcccagctgatacgcgtggagatgcgcccaccggcaatccagtggccatggttttcggcctgctgggcgatctgggtgccgatgttcagcgcttcgcccaggtccacgccgttgatgccggccgagaccaccgccgcaacggccgccgcgctggagatgcccaacgaggtgttgtgggtgacctgacaggcctggatcaccgcttgaataaactgcgccgggtcgctgacatcggcggcgatcccgacgggggtgatgcgcatggccgcgccattggtggtgccgtagcgcccggattcttccggggtgtggccggcgaggatcatgtcgatggcgcgcttggtcgatggcccgagcaaatcctgcgagcccttggcacgcatcactgcttcccagtcgatcaggcgctgggcgagcacggtgggttcgatcttgccgcggccttgcaccagcaattcgccgaccaggatcgcctgttcggtgtcatcggtgatcgagcctgccggcatgttcggcgcgatgggctggtcggcgtcggcatcttccagtgcggtgatggcaccgaagcgctgttgcacctgctcgcggctcagggattgtgtgggcatgcccagggcgtcgcccagggccaggccgtaaaaggccccgagggcgcgattttgcgcggtcattttgaagctccaaactgcaggtgcaggcgaaagtgcagagggtcgagcaaactttcgacgtactccatgaaacgctcgcggcggtcgtaagtggtgcgcgaggccttgagaaacaccgtgccggccgggcggccgagcagctcggcgtcttcgtcgctcaggggctcggcgccgatccactggtcaccttcggcgccgatgtagccgtaggccgccagggtgatggtcagggaattgtcgatcaggccgacgcggggcaggctttccagacttccggcggcaggcatcaacgagcgctccagggacaccgcagtgccatccgtggtgcgccgacgccggtcgagggcgataaattggtcgctgccgaaacggctgagcaggtccgggcgggtcacggcttccaggcgcaggatgtcggtggtgaccagcgcgccggtatcggccagggcctgggcccagccgttgcgttggtcgagcaccatgccgtcaaacgtcacgatggagccgacgccgctctgggtggcgatgtagttacgccgtttgagctcagccagggcttcgcgcaaggtgccccggctgaccgcgaattcttcggccaactgatgctcacccggcagcagataaccgtcggccatcactccagcctcgatacggcggatgagctcgtcgacgacgcgttttttcttatcaaatcggacatgtctaatcatgtacaaattgataaccgaaagcgtccgatgacagcaagcgaattatttcagagagatgaaaaaactggcctcagggctcgaggccaatgcggaaaaacgccccgccactccatacgccaagccagttctgaccgttgatcggacggctcaccgccagttcgaccaattggtaaaacacgttgcgatgcacaagggcttcgaggttggtacgcacccgcagatagggcgagggttcctgggtgacggggtcgatgacgacgcgcagcgggtgttcgaggccagcctcgatgggctcgtcgacgttggtggtgaagcgcagcacctgctgttcaccctgcccttcgacgtccagagttactgcgacaaagggcgcatcatcgacgctgatgccgaccttttccacgggagtgaccaggaaataatcatcgccatcgcggcggatgatgttggagaacaacttgaccatcggcttacgcccgatcggcgtgccctgatagaaccaagtgccgtcgcgggcgatacgcatgtcgatgttgccgcaaaaatccgggttccacaggtgtactggcgccggccccttgcccttgggcagttgggacaataggtcattggccttggcggaatcggacatgcagtgctccttgagtgttactgatctcccatgcccagcaggccgcgagcgtactgcgccagggggcgggcaatcagatcttctggcttgttgtcgtggaacgtcagtaaaccgccacgactgcgaatacgtgcagtatcaatcaaatactgggtgctggtctcgatcaacatgatctggataacgccgctgtccagaccgacgcggtcgagggcttgctgatcggtccactcatcggcattgccaatccggtcatcggctgccgcaaagcggcaatacagcaggtaatgcgcacccgccgcacgggcttcggacattgcttgttccaaaccttccggcttacgggcgcggcgcaccatggggaagtattcgacgaaaccgttgaaggcttcttcggccaccacgttaggccgcgggtaggcgctgcccggcggcacaaaggcgccctgggcgataaatacaaaggagtccggctgtatgcgaatcgacgcggtacggcgtgtatcactgtggtccagcaacccggcgtcgctcatctgataacgggtgccttcggccatatcgctgacggtcatgcaaccactcagcgtcaatgacgccagcaacaaaaccagactacgcatcctaatcctccagaagccggtgacggaaaaccggcgaatgggcacgtgatgcagaatccgcgccattcaggcgcagcacaaaacaaatgtgggttttgcgaaagcctggaaactagccgccgatgatcttcatgatggttgccccacccgagaaagccacttcctgtttatcgccaagcgccttcatcaacaggccttgcaaggccgggagggcctggtggcgcggttggtcgagcaggtcgccgacatagtgccggttgctcgacgacaggcagccatgcagccagccggtcgacgacaggcgcaggcgtgaacaagtacggcagaacggcacgctctcgttggcaatgacgccgaagaagcccttgcccggtacttcgtagcgcaccgcagtggcgtcgaccggggcattggcttgcaggtattcgtggtgttcgccgatcaggctgagcagttgctgcaggctgacgaactgttgcaggaaggcatttgagtccttggccagatggcccatgcgcatcagctcgataaagcgcagctcgtagccacgctccaggcagtagtcgagcagcggcatgacctggtcaaggttctgcccgcgcagcggcaccatgttgaccttgatcttgatcccggcggcgcgagcctggtccatgccatcgagcaccgtggccaggtcgccgccacgggcgatgctgcgaaaggcgtcggcgtcgagggtgtcgagggacacgttgatgcggcgaatacccgcgtccaccagcagcggcagtttgcgcgccagcagctggccgttggtggtcaggctgatatcgctgaggcccatgccgcccaccgcgcccatgaaggcttccagcttggggctcaccagcggctcgccgccggtgatacgcaggcgctcgatgcctgccgcctcgatcaggtacgccacgccacgggccatggcctcggccgagagttcgtcctgggcagccaccagccgcttgccgttcggcacgcagtaggtacacgcgtaattgcaggctgaggtcaggctgattcgcagattgcgaaaccgcctgccttgacgatcaacgatcatggatcactccggcataggatgattcgggcgtgctaaaaactgacttataaatcagcttttagcaaggtccttgcctgagtatattcctggggtactgcaactggcagcaaatcattgcgccattacggtcgggaatggcttaagtagcagggctttcactgctcttgggctcagcgctcggcaactcggcgctgtgcttgcgcttgttgcccatgcgcacgccgatgtccatcaggaactggaaaaaaccttcctgatcttccagcacgttactccagaacggcgagtggtacagcgccacggcgccgtgcaccaacgcccaagcggcgcagtagtggaagtacggcggcacgtcttcaagcttgccttcactgatgcggcccttgatcagcaaggtcaggcgttcgaaattcgaggcccggatcttatgcagctcttcgaccatttccggcacttgatggcccttgaccaccttctcttccaggcggtcgaacaggcgatagcgttgcgggtctcgcatgcggaattcgaaataggcccgggacagggcttctttgtctttgtcgacatcggccgaatgcagcagctcgttcaagtcgcgctcgtagtcgagcatcaggcgcaggtagatctcggccttggacttgaagtgcttgtagatcgtgcctttgccgatacccacggcatccgcaatcatctcgacggtgacgctgtcttcaccttgttcgagaaacagcttgagtgcggtgtcgagaatttcctgttcacggcggcgaaactcacggaccttacggggttctttttgcatgggggagaggtctgcagaggtcaatgtgggagggttgcgcagggccattgatacgtggcgatacgatttacccagtgcgagggattatcccgactgaacagtcgttgggcaacgcctatgtgaacccgttacgcacttaactttcagcgcgccaacgtttttgcccttctcagtcagaaacaatacacataaatgacacccgtgcacccacgcaatgagaactcaagcgaagcgcgcgtattccaaatctgtttaaaaaacgatcagatgcgactggactgaatgggatagtgatcaatacttcaactgtcgacgtggcatctcccccaagtgacgcgtcgacctgggtaccgacggactgtgtgcccttgttttactcctaatggtcttagcccggattcaccccccagaacccgggttttttttgcctgcgatttggtcacttcagccggcgacgtgagccagcgggaacagacgcttgaagttgtccgtggtttgctcggcaaagcgctcatacgactctccccgcagcatcgcaagataatccgccacgtcacgcacgtattccggcaagttcggcttgccacgatgagggatgggcgccaggtacggcgaatcggtttccaccagcaggcggtcggccggcacttggcgtgccacgtcgcgcagtgcatcggcgttgcggaaggtaacgatgcccgacagggaaatgtaaaagcccaggtccagggcggccttggccatgtcccagtcttcggtaaagcaatgcagcacgccggcctggggcaacgccgcttcgcgcagcagggtcagcgtgtcggcacgggcgccacgggtatggacgatcaccggcttgccggtttgctgggcggcttgcaggtgcaggcggaacgacgcctgttgcagttccgcggcttcaggctcgtagtggtaatccaggccggtttcgccaatcgccaccacgcgtgggtggttgagctcacccagcagccaatcgagggcgggggcttcaccgggcttgaggtccagcgggtggataccgaccgagcaatcgacatcggcataacgatcagccagtgccttgacgtcggcggcgttctcggcgctcacgccgatgcacagaaagtgccctaccccacgctggcgcgccgcttcaagggcagcgtcgagcgagccgccgtgctgggcaaggtcaaggcgatcaaggtggcaatgggaatctacgagcataggtaaatacaacttcattcactgaaagtgtctggccaacgatacacccgtcggccacggaaattaacgccggccgagcaagccgacccactgcaccagcaatgcttcgagcaacagcacgcggttgaggttggccttgccgaggaccttttgacgctgggccagaatccagtcctggatgttcagcaccttgtcctgcgcacttttctgcgcgaggtactgcaccaccttgcgcatgtccggcaggcccaggccatgttcgtcctgggtcaactggtagcgcaggatcaggctcgaccaatcgcagaaccagtcgaacagcagcagcaacggaatatccttccaggcgctttcggccagttgcgtcgcggacagctcctgcttgagcagctttttcacgccatccaccaccagcgcgcgttgctcgcgcacgccttgggcgtgcagcttcaccgccgccaggggcgaaccggctgccagggtcagcaattcgatgcgttcgtcttcgccgcactcgggcagcgcctgcgccagccactgcaggctcatggcttcgctcggcaacgggcaggcctgctgcacgcagcggcttcgaatggtcggcaacaagcggctggattggtggctcaccagcagcagcaccgtatcgcccgagggttcttccaggctcttgagcaaggcgttggcggcgttgatgttcatcgcttcaaccggctcgatcaacaccaccttgcgcccgcccatctgcgcggtttgcaccacgaagctgacgaggtcacgcacctggtcgaccttgatcgccttgtcggcttcctcaggctccagcaggtagttatcggggtggctgccggccttgagcaacaggcaggatttgcactcaccgcacgcttccaggttgaccgggcgctggcacagcaggctggccatcagtcgctcggccaacgcgcgcttgccgatacccgcaggcccatgcagcagataggcgtgggcatgctgggcacggccggccaactgctgccagaggctgtcctgccacggataggcctcagccacgggcacgctccagcagcgtcggcaacagggcgtcgatggcctgctgcacctgcgtcagcggctgggccgcatccaacaggtgataacgcgccggctcagccttcgcgcgctggaggaatgcgctgcgcactgcatcaaaaaacacctggccttcgagttcgaagcggtccaggcgaccgcgggcactggcgcgggccatgccgacttccaccggcaagtcgaacagcagcgtcagatcagggcgcaagtcgccctggacgaaggtttccagggtggcgatacgcgccaggcacaagccccgaccaccgccctgatacgcgtaggtcgaatcggtaaagcggtcgcaaatcaccacggcgccacgtgccaacgccgggcgaatcacttcggccaggtgctgggcgcgggcggcgaacaccagtagcaactcggtgtccgggttcatctgttcttcacctggagccagcagcacttcacgaatgcgttcggccagcggcgtgccaccgggctcacgggtcaacaccacttcgatgccttcggcgcgcaagcgctcggccaggtaatcgcggttggtgcttttgccggcgccttccgggccttccagggtaataaacaagccagtcacaggcagtccttagtcagagtcattgcgggctttgcggcgcggcggtatccagcccaggctcggcgggcttttcaaccggcgcctgggctggcacttcggcaggcggcgccgcgtcttccggcggtttcaccgccggtgccgggctggaacggtaatcggcacggcgcttgagctggaactcgcgcacggcggcattatgcgcatccaggtcatcggagaaaatatggctgccgtcaccacgggcaacgaaatacaggctgctgcccggcaccgggttcaacgccgcatggatcgcttcgcggccgaccatggcaatcggcgtcggtggcaggccggcgatcatgtaggtgttgtaagggttggcttccttgagatgggcgcgggtcaacttgccgttgtagcgctcgcccaggccgtagatgactgtggggtcggtctgcagcagcatgccgatcttcaggcgtcgcacaaagacgccggcgatctgcccgcgctcttccggcacgccggtttccttctccaccagggacgccatgatcagcgcttggtaagggtcggtatacggcgcatcggcggcgcgcttgctccattcttgagcgagcacatcatccaggcggttgtaggcttttttcaggaattcaacgtcggtcatgccgcgcacgaagcggtaggtatccgggaagaaccggccttcgggaaacacgccggggtgaccgagcttgtccatcacttcactgtcggtaaggcctgacagggtctgcacgatcttttcatgcttggcgagggccgaacgtacctggcggaagttccagccttccaccagcgtcaggctgtattgcaccacttcgccgcgttgccacaggccgatcaagccttcggcggtgaggcctggggtcatgcggtattcgccgctgtgcaacggctggccgtcgaggttgaagcgccagtacagacgcaaccagaaggcgccatcgagcacgccttcggtttcgaggcgattgaaagtgcccgtcggggtcgccccagcaggcacatccagtaattgttcctgggtcagattcaggggctgcttcagcgcagagtcgagcttccaggccgagaagcccagcagcaagcctgccgagaccaggccgatctgcagcagtaaaaccagttttcgtatcaactcaaatttccaatagcgcgcgaacaatgccctgcagtttacgggtgagcggcccaaccgaccagctcatcgcagcgcaaccacgcaccggccaaatgccatagacgctgttgcacacaaagacttcgtcggcctgctgcaactgttcaacgctgatgtcggccacggccagcgggatgcccagcgcttgcgcctgagccagaatctcggcgcgcatgactccggcaaccccgcaacgattcagatcagcggtcagtaacacgccatttcgaaccaggaataggttgctgaagacgccctcgatgacgcgcccggacatatccagcatcaaaccttcggcatgctcggcatcctgccactcggcgcgggcgatcacttgttcaagacgattaaggtgcttgagaccggccagcaacggctgctcggccaagcgggtggcgcacggaaacaggcggatgccgtcagttccatgagcgtcgggataggtagcgggcggattgccctgcaagatacggcgcaccggcgcgccggggttgatgccatacccgcgcaggctgtcgccacgggtgaggatcaatttaagaacaccgtcgcccagggcggcggcataagccagcacttcattgcggatcagcgtgtgatccgccaccaaggcaaggcgcctgcaaccctcatcgaggcgctgcaggtggcggtcgagcagcacaggctgcccagccttgacggcgatggtttcaaacaaaccgtcgccatatgccaggccgcgatctttcaggggcacgctgcccgctggctgaccgtcgacccagctgtgcatcactgcgcgaaccggcggaacaccagggagccgttggtgccaccaaacccgaacgagttggagatcaccacgtcgatcggcatcggctgcgctacgtgaggcacgaagttcaggtcgcaaccttcgtccggctcatcgaggttgatggtcggcggagcgacctgatccttgatggccatcacactgaagatcgcctcgactgcgcccgccgcacccaacaggtggccggtcatggacttggtcgaactgaccgccagcttgtaggcgtgctcaccgaacaccgacttgatggcttcggcttccgccaaatcgccggtcggggtcgaggtgccgtgggcgttgatgtactgcacctggtcggcgttgaccttggcatcacgcaaggcgttggtaatgcaacgcgcagccccggcaccgtcggacggcggcgaggtcatgtggtaagcatcaccgctcatgccaaagccaatcagctcggcgtagatggtggcaccacgcgccttggcgtgctccaactcttccagcaccagcgcaccggcgccgtcggacagtacgaaaccgtcgcggcccttgtcccacggacggctggcacgcgttggctcgtcattgcgcgtcgacagcgcacgggatgcgccgaagccgcccatgcccaggccgcaggcggccatttcagcgccaccggcgatcatcacgtccgcttcgtcataggcgatgttgcgcgccgccatgccgatgcagtgagtgccggtggtgcatgccgtcgaaatggcgtagttaggcccctgtgcacccaagtggatagacaggaaaccggaaatcatattgatgatcgagcccggtacgaagaacggtgaaattcgacgggggccggaatcgtgcagcgtgcggctggtttcttcgatattggtcaaaccgccaatacccgaacccatggccacgccgatgcggtcacggttggcgtcggtgacttccaggccggcattacgcaccgcctgaaaaccggctgccaggccgtattgaatgaacaggtcgagtttgcgggactctttgatcgagagatattcctcgacgttaaaaccctttaccgagccgccaaaacgggtggaataggcagaaaggtccgtgtgtttaatcagaccaataccactgtggccagccagaatgccctgccaactgctcggcacatccgtgcccagtggcgacaacatacccataccggtgactacgacgcgtctacgcgacacagcactctcctttttctaatgacgacacttcgcttcaacgctctgttttcaacagagctaaagaaaaaaccgcacgccgttacagcagtgcggtttttccctaacagcaagcgacgactacaaactattacgcctggtgggcagtaacgtagtcgatagcagcttgaacagtagtgattttttcagcttcttcgtccgggatttcggtctcgaattcctcttccagagccatcaccagctcaacggtgtcaagggaatcggcacccaggtcttctacgaaggaagcgctgttggtcacttcttcttctttaacgcccagttgctcggcgacgattttcttgacgcgttcttcgatggtgctcataccttgtttaactcctaatggacaaattcaggcagctggccagtgggtaagtgtatagaaagccatttcagcttttcaactgaaagcttcaccctgtacccggtcggccacctgcctataaattaagttgcagctttataacggattttagacagctcgtatgacatttttttgaagcgatccgtcacaatttaactcatgtacatcccgccgttcaccgggattgtagccccagtcacgtatgccgcaccgtcggatgccaggaaagtgaccacgtttgcgatctcttgagcctggcccagacggcccagcggaatctgtgtcagcaaggcttcgcgctgtgcttccggcagttcgcgggtcatatcggtgtcgatgaaccctggggccaccgagttgaccgtaatcgaacgcgaaccgacttcacgtgccaatgcacggctgaaaccttccagaccggcttttgccgccgcatagtttacttggcctgcgttgcccatggcacccactacggagccaatattgataattcgaccccaacgcgccttggtcatgccgcgcaaaacccccttggacaggcgaaacagactgttcaagttggtatcgaccacgtcgtaccactcgtcgtctttcatgcgcatcatcaggttgtcgcgggtaataccggcgttgtttaccagaatagccggtgcgccgaactgtgccgtgatttcagccagtaccgcagcaacggactcatcgctggtcacgttcagctcaaggccggtgccctgcacgccgttttctttcaaggtggcggcgatacgctcggcacccgaggcggacgtagcggtgccgatgacaacggcgccctgacggcccagttccagggcgatcgcctggccaatgccacggcttgcgccggtaaccagtgcaactttaccttgcagactcatgcaggcttctcctaagttcggggatcagggattcaggccagtgccgcacgcgcggcagcgaaggcatccggggtattcaggttggcagtcgacacaccgtcggcgcagcgcttgttcaggccggccaggactttgcccggcccacactcgaccagctcggtggcgccgttggcggccagggtctggaccgactcaacccagcgcacaggcttgtagagctgctccagcaggtcgcgcttgagggtgtcgaggtcggcggcaacggccgcgctgacgttctgcaccagcgggatctgcggcgcctgccagttgatggcggcgatggactcggcaaaacgctcggcggccgggcgcatcagctcgcagtgcgacggcacgctcaccggcaacggcaaggcacgcttggcaccacgggccttgcaaccctcgatggcccgctcaaccgccgccttggcaccagcgatcaccacctggccaggggagttgaagttcaccgcactgaccacttcgccctgggccgcttctgcacaggcttcgatcacaacggcatcgtccaggcccaggatagcggccatgccgccctgcccggccggaacggcctcctgcatcagttggccacgacgctcgaccagcttgaccgcttcacccagggtcaggctgcctgcagccaccaaggcgctgtattcgcccaggctgtgaccggccacgtaagccgggcgcgcgccgccttctgccagccacaagcgccacagggcgatcgaagcggtcaggatggctggctgggttttgtcggtttgattgagttgttcttccggcccctgctgggtcagcgcccacaggtcgtaacccagggcatcggaagcttccttgaaggtttccaggatcaacggatgttgcgcgcccagctcggccaacatgccgagggactgcgaaccctgccctggaaagacgaatgcgagggatgtagacatgtaacaagcccctaatgatctggtcgtcaaaataaacgctcccgattttgagatgaatccaagggtgggagcgcacgaaactgacagattggatggtcaattgaactggccggtcacatttaagcactcccgggccaattcgcctaaagcaacagatcctcaagacggccatgcaagcgttgcggcaggttttcctgaatctcgatcaacgcccgcgcaatcgcactctggaagccttgcacacccgccgagccatggcttttcaccacaatgccctgcaagcccagaaaactcgcaccgttgtgccgcgccggtgccaggtcagcctgcaagcggcgcatcaacggcagcgccagggcgccgaccatgcgtgatgccaggttctgcttgaacaaggcctcgatacgcgtggcgatcatagtcgccaagccttcgctggacttgagcaggatattgccgacaaacccgtcgcacaccaccacatccgcttcgccgcgatacaacccatcgccttcgacaaagccgatgtagttcaagccccgcgcgccttgcaacaaggtggcggcgagcttgacctgctggttgcccttgatgtcttcggtgccgatattcagcaacgccacccgtggccgggtcacgcccagcgcctcggcggccaccgagcccatcacggcaaactggaacaggtgctcggcactgcaatcgacgttcgcgcccaggtcgagcaactggcaatagcctttctgcgtcggaatcgcagcgaccatcgccggccggtcaatcccgggcagcgtcttgagcacatgccgcgacaacgccatcaacgccccggtattgccggcactgacacacgcctgcaccttgccgtcgcgcaacaactcaagggccacccgcattgaagagtcgggcttgccgcgcagcgctgtcgccggcttgtcctccatggtgatggtttcgctggctggcgtaatcgtcaggcgcgcgcgatccaccgccggatggctggcaatcagttcttcaagaagggagggttgaccgacgagggtcaggtgcagcgagggtgtggcagacaggctggcaatgcaagcctgaacaatgctgcggggaccgaagtccccgcccattgcgtcaatcgcgatgacttgagcagacaagtgattactcgtcagcgcccttatcgatcactttacggccacggtatacgccttctggcgatacgtggtgacgcaggtgaatttcaccggtggttttttctacagacagagtgcttgccgtcagggcgtcgtgcgaacgacgcatgtcacgggcagagcgggattttttgttctgctgaacagccataattgattaactcctaaacgtttgggtcacgctttaactgcgccaatacactgaacgggttggaccgcgttacctcgtcctcgctcggctcggcctcgtcatcgagaccctccggctgctggcattcttccggatgatgagcaggcacaatgggcaaggcgagcagaagctcttcctcgatcagtgcatgcagatccaaaggatcttcgcccagttccagcacgtcataacctttcggcaacgactgggtattcgcaccctccttcaccacagcgtaactgcattcgctgtgaatcggcagggtgaccagctcaagacaacgctggcaaaccattttgacttcggtgtcgataaaactgtggattaccacagacttacgttcatctcgttcaaaaacgaatttggcctgcaccgtaccgacagtgtcggaaagcgggtcgcagagtctctccaaatcggccagcagcaattcaccttgaagggaagtgccacgatctgccaatttgcgcgggtcaacgtgaggtggaatcgggtcattcaacataggcgcagcattatagggatgcacccggccatgtcaaaggaaattcagccctgtgcgtcagctggtcgcctcgctagaatctccaactgccttaaggagacgcccatgctgcctttattactcgcatccagctcggtttaccgccgggaattgctgagccgcctgcacctgccgtttatctgcgcctcgccggatatcgacgaaagccaccgcgaaaatgaatccgccatcgaactggtcaagcgcctggccgaagagaaagctcgcgccctcgccagcagccatcccgggcacctgattatcggttcggaccaggtggccgcactggacgggcaaatcatcggcaaaccccacaccttcgaaaacgcccgcgaacagctgctggcagccagcggcaagcgcgtgagcttccttacaggcctggcactgctcaacagcgagaccgggcactgccaggtcgactgcgtaccgtttacggtgcagatgcgcgcgctggacgctgagcggatcgagcgctacctgcgactcgaacaaccctatgactgcgcaggcagtttcaaggctgaagggctgggcgtaagcctgtttcaaagcactgaagggccggatgcaacaagcctcgtaggcttaccgctgattcggctggtggacatgctgctggctgaaggcgtgcaaatcccttaagcccaccacaaaaccaatgtgggagctggcttgcctgcgatgcacacacctcggtacatctgtcgaaccgaggtgatgctatcgcaggcaagccagctcccacatgttgaaccctgtcgcttcgaggtatcagcgcagggttgggccctggaagcccatgtacaacgccaacttctccgccacgctggcgccgagcttcttggagaagcgatcaaacggcgattcctcgacggtgaaatccaccaattccttctcgccaatcacgtcccgggctaccgaactggcactgcccaggccatcgatcaggcccagcggcaatgcctgctcacccgaccacaccagcccggaaaacagctccggatggtctttatccttcaggcgatcaccacgcccctgcttgacgctggcaatgaactgacggtgagtggtgtcgagcacgccctgccagaactgggtttcgtcggctttttgcggctggaacgggtccaggaaagccttgtgctcacccgaggtgtaggtgcgacgctccacgccgagcttctccatggtgccgacaaagccgtaaccggccgccgtcacaccaatggagccgaccaggctggccttgtcggcatatatctggtcagcggcgctggcgatgtaataggcacctgaggcacccagatcggaaatcactgcatacagcttggtgtccgggtgcagcgcgcgcaggcgacgaatttcgtcatatacatagcccgactgcacgggactaccgcccggactattaatacgcaggatcacagccttgaccttggggtcgtcaaacgcagcacgcaggctgctgacgatattgtcggcgctggcggattccttgtcggcaatcaccccgcgcacttcgatcaaggcggtgtagttgctgccacgggtggcgcttttttccatgtccatcagcgggctgaacagcgccagcatggcaatcagataggtaaaggtcagcagcttgaagaaaatcccccagcgccgtgcgcggcgctgctcctgaacgctggccaggagagtcttctccagcagcttccagcttttatcatcaccgctctcggccttttcgggcgctttccactcgtcactcatgccatcaaccccagcaaagacttattgggcccggctgagccaggcctgcagttcagaaaaatgatcaatcgtcagcctgggctcgtattgctgcaaggcctcggcagcctgggcaccgtagctgacggccacgctgtccatgccggcgttgcgcgccatcatcaagtcgaaggatgcgtcacccaccatcaaggcctggcgcggcgctacgccgcaatgcgccaggatctgctcgagcatcagaggatggggtttgctggcggtttcatccgcggcgcgggtgatgtcgaaataatcttcatagccatgcgccttgagcacccgatccagcccgcgacgagccttgccggtggcgactgccaaccgataaccctcggcgcgaaagacctccagcgactgcactacaccgtcgaacaacggcgaaggcgtggcttccagcgcaatgtagtgatcagcgtaatggtcgcgaaaggtcaccagttcagcgtcgctgatctgggggtacagggtgcggatcgcctcaggcaaacccaggccgataatgcccttgaccgccagatcggtgcacagctcgaagcccgagcgggccgaggctgcgtgcattgattcgacgatccggccaatggaattacacagggtgccgtcccaatcaaaaatcagcagcttgtaatcaaggtgcgacactcaaacgctccacggtcttggcccacatctcatcgaccggcgcctgcagcttcagctcgccgccgtcaggcagcggcacggtcagcatgtaggcgtgcaggaacaggcgcttgccgcccaggtcgcgaatttccttggagaaatcctcgtcaccgtacttggtgtcgccagcaatgcagtggcccgcgtgcaaggtatgcacgcgaatctggtgagtacgcccggtcaccggcttggcctcgaccatggtggcgaagtcgccgaagcggcgcagcaccttgaacagggtcagggcttctttgccttcctcgtcgacttcgaccatacgctcgccggagcgcaggttgctcttctgcagcggcgcacggacgctcttgatcgaactggcccagttgccacgcaccagcgccatgtagcgcttgtcgacaccgtcgccacgcagggcggtgtgcaagtggcgcaacatgctgcgtttcttggcgatcatcagcaagccggaggtgtcgcggtccagtcggtggaccagttccagctccttggcgtccgggcgcagttgacggaaggcttcgatcacgccgaaattcaggccgctgccgccgtggaccgcaatgccgcaaggcttgttgatcacgatcagtttgctgtcttcgaagacaatcgacgcctcaaggcgctgcaacaggccctgggccagcggcacgggctcgtcacgctcaggcacgcgcaccggcggcacacgaacgatatcgcccgcctgcagcttgtactcaggcttgatgcgccccttgtttacgcgcacttcgcctttacgcaagatgcggtaaatcaaggtcttgggcacgcctttgagcctggccaggagaaaattgtcgatgcgttggccggcatattccggcgagacctcgagcagctggacgctgggggtctggggggcggtagtcgtcatggcggcgatgataacaattttttatggaattgaagcacttaatcattgctgctatagtcgcgaacgccgccaaaagcggcctggacagaggacttgcggcaaattgccggccctgaccatcgcaattcatcaggacgcgaggccgtcctacggggctttcgccaccttggaaggctcgagattgtaacaagcgcaggtgacatgaggcctgaagcgagtgcagaaagcagagtgaatactcgcgttccgcgccgatatttacggccagttcacaaagtgcagtcagtcttgagccagaccatggcgaatgcttcggaaacaacgcctgttaagagctgagtgagagcgcagtcgcccacattcagtcttgtttagccatgagcgtggactccccattggagaacacggtaaatgccaacccgctgcggattctgcgcgcggcagcacccgaattatcagggatacgtgtagggtggagatgcacaaccgtcggaccgtgtagcactaggcttatatttagacgcttcatctcgtccacagtcgccggttgattcctcctcctgaccttagcttttgttgaagtggtgcctttgtcaccgccgctaacaagcaggacgcgtccgtcgcgataccggcccaattggctcgttattgctggacactggagtggccaaccactcttgacgcacctgacaccgaccgtgagaagtcgtgtgtgccgaacgccgtttccggcagcccggaaaccgacggtacaacatgaaaagaatgctgattaacgcaactcaacccgaagagttgcgtgttgcactggtagatggccaacgcctctacgacctggacatcgaatccggtgcacgcgagcaaaagaaggccaacatctataaaggccgtattactcgcatcgaaccaagccttgaggctgcctttgtcgatttcggctccgagcgccacggcttcctgcccctcaaagaaatctcccgcgaatacttcaagaaagcccctgaaggccgcgtgaacatcaaggacgtcctgagcgaaggccaggaagtcatcgtccaggtcgaaaaagaagaacgtggcaacaagggcgccgccctgaccaccttcatcagcctggctggccgttacctcgtgctgatgccgaacaacccgcgtgccggcggcatctcccgtcgcatcgaaggtgaagagcgcaacgaactgcgtgaagcgctgaacggtttggtcgcgccagccgacatgggcttgatcgttcgcaccgccggccttggccgcagcagcgaagaaatgcagtgggacctcgactacctgctgcaactgtggaccgctatcaaagaagcgtccctggatcgttccgcgccgttcctgatctaccaggaaagcaacgtgatcatccgcgccatccgcgactacctgcgccaggacatcggcgaagtgctgatcgacagcgttgaagcccaggacgaagccctgaccttcatccgccaggtgatgccgcagtacgccagcaagatcaagctgtacgaagacagcgttccgctgttcaaccgtttccagatcgaaagccagatcgagaccgccttccagcgcgtggtcgaactgccttccggcggctccattgtgatcgacccgaccgaagccctggtgtccatcgacatcaactcggcgcgtgcgaccaaaggcagcgacatcgaagaaaccgccctgcagaccaacctggaagcggctgaagaaatcgcccgccagctgcgcctgcgtgacatcggcggcctgatcgtgatcgacttcatcgacatgaccccggccaagaaccagcgcgccgtggaagagaaagtccgcgaatgcctggaagctgaccgcgcccgcgtacaggtcggccgtatctcgcgcttcggcctgctggaaatgtcccgtcagcgcctgcgcccatccctgggtgagagcagcggcatcgtctgcccgcgttgcaacggcaccggcatcatccgtgacgttgaatcgctgtccctggcgatcctgcgcctgatcgaagaagaagccctgaaagaccgcaccgccgaagtccgcgcgcaagtgccgattccggttgccgctttcctgctcaacgaaaaacgcaactcgatcaccaagatcgaactgcgcacccgtgcccgtatcgtcatcctgccgaacgatcacctcgaaacgccgcacttcgaagtgcagcgcctgcgtgatgacagcccggaagcccacagcggccagtccagctacgaaatcgcagctgccgcagctgaagttgaagaagtccagccagccgccgcgacccgcaccctggttcgccaggaagcggccgtcaagaccgcaccggcacgtgccaacgctccggtcccggccgaagcggctgcaccggttgccgcaccggccgccctgcctgagccaagcctgttcaaaggcctggtgaagtcgctggtcagcctgttcgccaccaaagaagagcctgttgccccggttgtggttgaaaaacctgccaccgagcgcccggcgcgtaacgaagagcgtcgcaacggtcgccagcaaagccgtaaccgcaacggtcgtcgtgacgaagagcgcaagcctcgcgaagaacgtgcaccgcgtgaagaacgcgcgccacgtgaagagcgtgcaccacgcgaaacccgtgaagaaactccaaccgtagcccgtgaagaacgtgcaccgcgtgaagagcgcgcaccacgtaccccacgtgcaccacgtgaagatcgcaagccacgtggcgagcgtgaagaacgtgtgcgtgaactgcgtgagccactggacgccgcacccgctgttgccagcgaggccgccagcgaagaacgcccggctcgccagccgcgtgaagagcgcgccccacgtgaagagcgccaaccgcgcccgccgcgtgaagagcgtcaaccacgtgccgagcaagccgctgccgccagcgaagaagaagtactgaccggcgaagagcaacaggaagatggccaggacaacgccgaaggcgatcgtccacgccgccgctcccgtggccagtgtcgtcgcagcaaccgtcgtgagcgtcaacgcgatgccaacggcaacgtgatcgaaggctcggaagagaccggcgaaaacacagaagctgctaccaccgaaccgactggcgccgaattggctgccggcctggcggtaacagctgccgtggccagctcggtcatcagcgcacctgctgaagcccaggctcacgagcaagctgagcgcgccactgccgctgtcgaagagaccgtagcagtcgaagcgccagtggctcaaacaccaattgccgaaacaccagtggttgaagcaccggttgttgaagcgcctgttgtcgaagcgaccaccccgatcgaagcccccgtggtgccggaagtggaagtcgcgccggttcgcgaagcccaaccagaagtggaagtggctgctgtggagcctgcaccggtggttgaacctcagccagtggttgaagccccggttgttgaagaagctgctccggccgtgcgtgaagttcgcgaagaacagaccgccttccagtgggctgccgagccagtggctgcggttgaagcgccagcacctgcccctgtggtagaagaagcgccggcaccggttgccgaagtggttgccgaaccggctccagtggttgagcctcagccggtggtcgaagcgccagtggttgccgaagtcgccgccccggtggttgaagcagcccctgccagcgccctgaccgaaaacggccgagcgccgaacgacccgcgtgaagtgcgtcgccgtcgcaaggaagctgaggcggccgctgcagcagccgctgccgcagcgcaagcgccagccgctgaagccgtggttgagcacactgccccaatcatcgacgaaaccccgcgttccgtcgaagaagtggcagagcacagcccaaaggccctggaagcagagcacgagcctaaacccctcgtctgattccatccgccactaaaaagccccgccaggtaaccctggcggggctttttttttgcagttattgcgcaggcactcagcaatcaccgggtaaaaatcgaccttatggcgcgacaggcaccaggtcaaacttgctggcctggtgctgatacaacaaacaatcggcccccggcctgcacccactgaaatgcttcaatttggcgggcaagctgtagtaagagcccggaggatagtcgacagtcttgccatcgataatcgcgtagaacgtaccttcaagcacaacggttggcagcgtttgcgcatggaaatggtcggggttattcctgccggcgggaaatctgacaaacgcctcatacgggccgaaacccaacaggtcacctttcagattggcataaaaaatacccccgctacccggtacctccttccacaccagcgtggagacgggagctgaaaccaccacatccggctgagggggcgggatgtaggcccacgcagaggtggagagtgaaagggtcaggccgatagctgctttaagcgttttcattgaggcactcactgtaaattcatttttacacctcagcctcgaaagaaaataatgccacttcagtgaatgaaaacgcaggcaataacagcattctgcctctgaactgatggcaggaaatatggctgcacacccagcgtgcgccacacttggcagtctagaagaggaaaactgaaaagctactgcgggctcacccgccgaagtgcagtgcttgcggcacgtccacatcccacaaaacgccgggatcatcgacgctcacctccagcaggccacccttggcaaacagcggctttgcaccgcgatcaccggacaacgcgcacaaggccgccccccatgcacggccgaaccccacaggatgaccgtactgaccgtcatgcaccggcacgctgatactctcgtctgccagcgcggcggccacgtgttcaatactcgaaggcgagatgaacggcatatcccccaacaccaccagccagccatcgcttgggctgctggctgcgactgccgccgccaggctgtcgcccatgcctgccgactgcagcagcaacacttcacaaccgtagagacgcgccaggcgaatcacttcaggacggtccggcgaggtcaccagccagcgcttcacgacacgttcaggcagattcaacagcacctgctcgatgaccggccgcgtcacgccatccaagcctacgcaatcggccagcaacttatcgttatcagcccccgcctcggctcgaaaacgactgccctgcccggccgccagcacgattgcggtaatgctcattcagccgccatcggtaacggttttttctgcgtcggtgccacgccatttttgattgcgacgatttccgccatcaacgacagggcgatctccgacggcgtgtgactgccgatatgcaaaccgatcggcccatgcaaccgtgctatcgcctccgccgacaaacccagcgccgcgaggttttcccgacgtttttgcgtgttgacccgcgaaccgagggcaccgatgtagaacgcgctggaattcaacgccgtcagcagcgccatgtcatccagacgtgggtcgtgggtcaggcagacgatggccgtgcgctcatcggtctggatgttcagcaccgcctcatccggcatgcccggcacaaagcggccgtgctgttcttcccagccataggcaaactcttcacgggggtcgcagatcagcacttcgaagtccagcagccgcgccatctcggccacgtagcgtgacaactgccctgcgccgatcaataacaaacgccaacgcgggccgtaaatggcccgcaggcgttcaccatcgaaggtcaccacgtcggttttgcttgcactgcccaaactcacagtgccagtggccaggtccaactctcgggcgacgatttcatgcgcctcgcaccgttccagcagctgcgcgacccagcgccagtcgtcgacccgttcttcggtcaggcgcaacgtaccgccgcacggcaagccaaaacgcgctgcttcatcacgggtaacgccgtaggtcaccaattgcaccggcgggccatcatccggcaaacgcccgtcctgcaaccttgcgatcaagtcatcctcgatgcagccaccggacaccgacccaatcaccacgccatcgccacgcagggccaacatcgcccccggcggacgcggcgcactgccccaggtctggaccacgctgtaaagcaccacgcggtgcccggcgcgacgccagtcgagcacgctgcgcaagacattcagatccacactgtccatcaacactcctgcacacgatgcggcgcaaataaccgattggccaatgcggtatagaacgggcaatccaacgcgagtttcatctgcgcaggccacctctggcgattgatgaagtggttactgactgtaaatcaaaaaaaaccaaaagtgacccaccagaaacgcaaacgccccgaacacgtcggggcgtttgcagcgcgttgggtgctttcacaccctcggcaagttacttgatagcaggggcaggaccttcagccacacccaggtcatcttccggacgggtgtcggagatgccagtaccgccagacgccagctcgctgtgcagcttgtcggtgtccagttccttgacccatttggccacaacgatggtggcaacggcgttaccgaccaggttggtcagtgcgcgggcttcggacatgaagcggtcgatacccaggatcagcgccaggccggcaaccggcaggtggccaacagccgacaaggtcgcggccagtacgatgaagccggaacctgtcacgcctgcagcgcctttggaggacagcagcagcaccagcagcaaggtgatctggtgggtgatgtccatgtgggtgtcagtcgcctgggcgatgaacacggcagccatggtcaggtagatcgacgtaccgtcgaggttgaaggagtagccggttggaatcaccaggcctactacggatttcttcgcgcccagacgctccatcttgatcagcatgcgtggcagtgcggattcggaagaggaagtacccagtacgatcaacagttcttcacggatgtagcgaaccagcttcaacacgctgaaaccgtgcgcgcggcagatggcgcccagcaccaccaccacaaacaggatgcaggtgatgtagaagcagatcatcagctggcccagttgcaccagcgaacccacaccgtaggcaccgatggtgaacgccatggcgcccagggcaccgagtggcgcgagcttcatgatcatgttgatgatgttgaacatcacgtgggcgaagcgatcaatgaagtccagcaccggcttgccgtaggcacccaggcgatgcagggcgaaaccgaagatcaccgagaacatcagcacttgcaggatgtcaccgttggcgaaggcgccgacgatggtgttcgggatcacgttgaggataaagccaacaacgctctggtctgcaccggcagtcacgtaggcagcgactttagaggcgtccagggtagccacgtcgatgtgcatgccggcgcccggttgcacaacgttgaccacgaccaggccgatcagcagggcgatggtggaaacgatttcgaagtacagcagcgcgtagccgccggttttgccgaccgatttcatgctttgcatgccagcgatgccgctgacaacggtgcagaagatgatcggggcgatgaccattttgatcagcttgataaagccgtcacccagtggcttgagggccacaccggtctgcgggtagaagtgaccgagcaaaataccgataacgattgcaacgatcacctggaaatacagggatttgtacagtggctgacgagtcgtcattgcaaagttcctcaatcgcaccgtgtggcaaagatccgccattgcccacgacacttgaattgcgaaccctcctgcactggagggatttgttgtttgcgaggtctgtaggaaccagcctgcgctgtaatacttatcgcaaacgccgtgccactttgcttaaaaaccctgaaggcctttagacatcagggcttggggtttccaagctgccgccagtgccgccaacaaggtggcggaaatccgcccacgcacctgatctcgtcctacaatttggcggatatccgccttgtcgccttcccgtggggtggctaccatccgccactccatggacgaggccctcacatgcgtgaacgtaccatcgccagccactatgcgcgcgccgctctcggcggtgcgcgccgggcgggctacgactactcgggcctgctgctgcaggtcggtattgccccggagttactcaccgaaccgcgcgcccgcatcgcccccgagcaatttacccggctgttgcaaatgctatggctggcgctggacgacgaatacctggggtttgccgaaggcccgagcaagcgcggcaccttcgccatgatgtgccacgcgctgattcactgccgcaccctggagaaggctctggaacgcggcttattattttatagcctattcccgcagggtccgcgctggcagctgacaagagacgccgacatggcccgcctgagcctggacgattcgcagctgtgggacccggaccacttcctcagcgaatgcctgctggtgatctggcaccgcctgggcagttggttgatcggccagcgcatccggctgcaccaggccaccttcagttacccgatgccggcgcatgccggcgaatatgacctgcttttcccctgcccccaggtgttcggtgcggcgcatagcagcctggtgtttcccgcacgctaccttagcctgccgctgctgcaggatgaacgcacacttaaacactttctcgagcgctcccccgccgacctgctgtcgcgaccggatgaaggcgacagcttgagcagccaactgcgccgcttgctgagccgcgaccgcacgccctggccagacctggaagccgtcgcccagcacctgcatatcagcccgcaaaccctgcgccggcatttacgtgaggaaggcaccagctttcaggcactcaaggatgagttgcggcgggacatcgccatctaccatttggggcgggcggatttgtcgttgcaggagattgccgagcaactggggttttccgagccgtcggcgtttcatcgggcgttcaagaagtggacggggctgacgccgggggcgtatcgggcgcaggagagttagaggggtgttgtgtgtgctggcctcatcgcaggcaagccagctcccacatttgatcgggttcacataatcaaaaggtgggagctggcttgcctgcgatgggtccggtccaggcgatacagatcaaaccgccggaaagtgaatcttgaacgccgcgccacccagcggtgagtcgcccaaggtcaggcgcgcgctgtagctttcaatgatgtccttgaccaccgccagaccaatgccctgccccggatgctgacggtccagccgctcgcccctttgcagaatccgcgcacgctgatcaggcggcacccccgggccgtcatcctcgatgcacagctcggtgccttcgaggctttccgtgaggctgatgcgcacttcgctcaggcacagccggtaagcgttttccagcaggttgccaagcatctccaacaaagcgcccttctcaatcggcaagtcgcactcgggcggcaaatcaaacgtcaccgtcacgcgcttgtcgcggtagaccttgtcgagcgtgtcgcacaggctttgcagtaccggctccaagcgcacctggtggcgcaccaaaccgcttttgcgcaggctggcgcgctgcaactggtagccgatctgctggctcatgcgctcgatctgcgattgcaacacccaggcctggccgcgatcttcagggcgctgggccatgtcttcgctcacgccttgcaacaccgccagcggggttttcaggctgtgggccagatcatccagggaatcgcgatagcgcgcgcgctgctcacgctcgctgtgcagcaaacggttcagcgagccggtcaggcgcagcagctcgcgagggtgctcttcggagaggctttcgcgggtgccgccttcgatctggtcaagttcctgactcagccgccgcagggcttgcaggccccaggtcaggcccagccacaacagcgtcagcaacacgagcaaggccgcgccgaaaccgaggtagaggttttcctgcaaaccttcgagggtcagctgatattcgcgcaccggttgcagggcaacgatactgaacgccgcgctcttgccgccgagcagcttgacctcgacgtcatacacgaaaaattcctggccgttggcctcgcggatgcgtgcaaactcgttgccgcgcccgtcgtagcgcggcttgtagttgatgttttcttcctgggtcgctcgcgaacgccagaccagatggccttcacggtcgtagatatagccgagcaggcggctgtcggtgaggttgaaacgctcgtccggcaactgcgccggcatcagcaggcggttgttttcgacccgcgccgcagaaatcagcgtggtgacgtccgaggccaggcgctgctcgatggaatcctgcaacgccaggctgaacgccccttgcatggcgggcaataagcccagcataaacaacacggccagggtggtggccgcgagcatcaagcgcacacgtaacgagcgaatcaacggcagcgctcattaaacaggtaacccagaccgcgcacggtgtcgatcggcttgaacccgcccgggccttccagcttgcggcgcaggcgccctaccaacacttcgattacgttcggatcacgctcgtcgtcatcgggatagagctgttccatcaagcggtccttggcaaccacttgctgatggtgacgcatcaggtattcgagaatccggtactcataggcggtcagcgccagcggctgctcatccagggacgcttgcttgcggttgaggtccagcagcagtggcccggcgacgatggtcgactgggtgaacccgctggaacggcgcagcaaggcgttcatgcgtgcttccagctcttcgaactggaacggcttgaccacgtagtcgtcggcgccggcggccaggccttcgaccttgtcctgccagttgccgcgtgcggtgaggatcaggatcgggaaggtcttggcctggctgcgcagttggcggatcaggtccaggccgcccatgccgggcaggcccaggtcgatgatggccaggtcatggttgaattgcccggtctggtacagggcttcctcggcattggccacggcctcgaccacgtgcccgctgtctgtcaggcgggtgaacaggtgatgacgcaacagcgcctcatcttccacgaccagcaatttcataaggctctccaaggcaattcaactgtccgacagggggatatcatagcggccctgcaagtcttgcgggcgcagtttaatgccattgtattggcccgtcaggtgttcgtagccggcgcggtaggccggttgcacgttagcctggcccagggactggccccatggcgcggcctggctgcctgcgtcttcgaagctgacacgctggatcaggctgctggacttcttggttttctcgccgccaaatgccgcaaaagcaccgtccgaagcctgcacgccggccgtggcactgagcatgcttaacgccaatatcagctgtttgatcgcagtcatggtgcttacctctacgcgtttggctgttgaagccagactacgcaagcgcccctgaactccccctgaacaggctctgaaccctggctgaaccgttgcgggctatccactggcgcgccaactgacgcaaaataccgcgcatgacgcccctacccgcttgctgcaccccactcgacgcccattggccgttgcccactccgttacccggcacggtgttcctgagcactcgattcgacccgaccttgttggccgccggtgatttccagcgcagcgccgtgccgccaccggccagcatccagcgctcagtggccaagcgccaagccgagttcctcgccggccgcttgtgcgcgcgcgcggcgctgcaacagctcgaccagctcgattgcgtgccggccatcggcgaagaccgtgcgccggtgtggcctgggcatatcagcggttccatcacccacagcaccgggcatgcggcgtcgattgtcgggcacaaggcgcaatggcgtgggctgggcatggacctggagaacctgctgacactggagcgcgccgaacgcctggccggggaaattctcaccgccgaggaaatgcagcgcctggcaaacgtgccgcgcgagcaggtggcattgctggtgacgctgacgttttcggtcaaggagagtttgttcaaggcgctctacccgattgtgcacaagcgcttttactttgagcatgccgaggtggtggcgtggtccgagaccgggcaggtccggctaaggctgctgaccgaattgtctgccgagtggtgtcatggcacggagctggaggggcagtttgcggtggagggtgagcagttgttgagtctggtggccgtcagggcctgatctgacgccatcgcaggcaagccagctcccacatttttgaatgcattccacctgtgggagctggcttgcctgcgatagcgatctcacgccttctcctgatccctgggccaactcaagctgaagcacgccccacccaggttgttgctcttgctgatcaacgcccgaccgccgtgccaataaatcacccgccgcacaatcgacaaccccaggccatgcccgcccgaggcacgggtgcggctgtcgtccaggcgcaggaacggcgtaaagatgcgctcccaggcgctctccggcacgccggggccatcgtcttccacatcgatgcggcaacgcacctggcccacctgatagctgatcaacacctggccctgggcatggcgcatcgcattgctcaccagattttgcagggcacggtgcaggtagcgcggctcggcgtcgacccaggcgtcatcccaatgcgctgaagacaggcagatgccacgcgctaccgtgacgtgcgggcgcagtggcgacaattcgccgatcacctgatcgagcaacgcgctgaggtcgacgcgctggaaattcagctccggcgcgccctgctccaggcgcgcatacgtgagcatttcatccaccaggccatcgaggtcctggatatcgctgtccatgccgtccatgtatttacgccgcgcctcgggggtggtggcgtcgccgatcatctccaggccaaagcgcaggcgcgccaccggggtgcgcaactcatgggacaccgcgcgcaccagttcacgctggatcgccagcaactgctgcaggtgctcggccatgccattaaaagccgccgccaggcgccccaccgaatcggcgccgcgcgccggcacgcgcacttccaggttgcctttggcaatgcgcgtggccgccgcttccaggcctttgagacgccgctcgagctggcgcaccaacaaatagacgatcaagccgatcagggtcaggctgatcagcgcgatcaaaatcaaccattgcggcggataagggttcatttgatacagcgggccaatctccagcacccacggcgtaccgaccatgccggcaaatacgcggattgaatcgccgcccttgcccaaggccatcaccgtatcgccttccgagacccggcggcgctggtcgtcgtccatgtcggcctgatccagggtcatcaggtgcatgtcaaaaccaaagcccttggcttcttttatatccgcgagcttttgcggttgctcggcgaccggaaagcgcaccagttcgtcagccagcaggtaaatcgtcgcgcgggccagttgctcgctgatttgctgcacttcgcccgtgagtaccagttgcgacggctcgctgaccaaacgcaacacccgcgccgcgtgcggcccggtctgttgcaccagcacctggccacgctgcaggcggttacgctggctcaggtctaactgcgcatcggccagcgggcgcaactccaggggaatgccgagcaaacgctcccacacagccaaggcacgctggcgctcgatggggctcatgggttgcaggttgtcgcccatcaacgcaaaggtgccatgggcgaggcgctcgcggtattggccgctgcgcacttcattgagcaggtgcaaggccagcacgccgagcagcgccaccagaatcagcgccgcgcacatgccgccgtagatgcgcaggaagatcgagttcacagcggcatatcggcagcggcttcggggacgaacaaatagcctttgctgcggatagtcttgatcaggcgcgggtggatcgggtcgtcgccgattttcgggcggatacgggaaatacgcacatcaatggagcggtcctggccgtcatagccgataccgcgcaaggcgatgaagatttcttcgcgggacaaaatgcgcccggcattcgccaccagcagccacaacaggtcgaattcggcactggtcagttcaatgccgccgttgtgcaaccaggcttcgcgcagagcgttatcgaccaccagcgggccaaattgcaggcggcgctggttttccacggcaaccggttcagccggctcgctgcgccgcagcaaggcctggatacgcgccagcaacaggcgcgggcgcacgggtttgcacacgtagtcgtcggcgcccatgtccaggccctgcacctggtccatgtcgtcggtgcgcgcggtgagcatcaggatcacaccgtcatagcgctcgcgcaccctgcggcagatgctcaggccgtcttcgccgggcagcatcaggtcgaggattaccaggtcaggctgttcggcgatgatgcgcgccgccgccagggcgccgtcgctttccaccgacacgcgcaggccgttgctttccaggtaatcacgggtcaactcggccaatcgctcgtcgtcctcgacgatcaaaatttgccaggcttcttgctccatgcgctacctcgtttctaattattgtcatctacggggaacacaatactgcccctatatgaaggccgattgtagccatgggccagccctctagcacaagccgggaaatccattcggtgatcaggtttttttgtgatagggttcgcgccctcaaaaatccaacagacggtttttgcctaggaatattcgatgacaaacggtgtaatccagcagtactgcggcctacacgggcattccacgtttcatacacattttacccacagcgttatccacaggtagtgcgttgctaagccccccaaaacgcattatcttgtacctcggcgctgaaaaaaccctacatgtagggttttaagcgaaaaaaccaaacacagatcagacaagaaactcaagcgctttcttgctcccgtttggttgaaccaaagcattttttcaaagcccaaaccgcgcacgcggatggcagccgttttccagcctcaacagcggaaagcggtacgggtgttgcagtgcttgaagcgagcaactgtcacccaccaggaatacggtgaagggcgcttcaaggcccgaaccgaagacttcggcatggaagcggcgcgatgagctcccttcctcctgtcccgaagttgttatgccaggcccaggcctgttgtaagtgcttcaggacggaacggtgggcaccgtgatggtgcccaaataaatatagaatgtggagacaaccccccatgcaaaccgacacaactcgcgagaacccgcaaggctccgtgccgcaggccgctgattcgaacctggatctgtccgccaccgcgcccggccaattgcgcgtgatcaagcgtaacggcactgtcgttccttacaccgatgacaaaatcaccgtcgcgatcaccaaagcgtttcttgcagttgaaggcggcaccgctgctgcctcgtcgcgcatccacgacaccgttgcccgcctgactgaacaagtcaccgcgaccttcaagcgtcgcatgccatcgggcggcaccatccacatcgaagaaatccaggaccaggttgaactggccctgatgcgtgccggcgagcagaaagtcgcccgcgactacgtgatctaccgtgactcgcgcgccaaggaacgcgccgtacgcactccagctgaagaagcggccgtgcaagctcacccgtcgatccgcatcaccctggctgacggttcttttgcaccgctggacctgggccgcctgaacaccatcatcaccgaggcctgcgaaggcctggaagaagtcgatggtgacctgatccagcgcgaaaccctgaagaacctgtacgacggcgtggccctgaccgacgtcaacaccgctctggtgatgaccgcccgtaccctggttgaacgtgagccgaactactcgttcgtgaccgcgcgcctgctgatggacaccctgcgtgccgaaggcctgggcttcctgaaagtcgccgacagcgccacccaccacgagatggctgacctgtacgccaaggccctgccggcctacatcgccaagggtatcgaattcgaattgctgaacccggtcctggctacctttgacctggaaaaactcggcaaggcgatcaaccacgagcgcgaccagcagttcacgtacctgggcctacaaaccctgtacgaccgttacttcatccacaaggacggtatccgcttcgaactgccgcaagtgttcttcatgcgcgtggccatgggcctggcgattgaagagaagcataaagaagaccgcgccatcgagttctacaacctgctgtcgtccttcgactacatgtcttcgaccccgacgctgttcaacgccggtactctgcgtccacagctgtcgagctgctacctgaccaccgtgccggatgacctgtcgggcatttaccacgcgatccacgacaacgccatgttgtccaaattcgccggcggcctgggcaacgactggacgccagtgcgtgcattgggttcgtacatcaagggcaccaacggcaagtcccagggcgtggttccgttcctgaaagtggtgaacgacaccgccgttgccgttaaccagggtggcaagcgcaaaggcgctgtatgtgcctacctggaaacctggcacatggacattgaagagttcatcgagctgcgcaagaacaccggtgatgatcgccgtcgcacccacgacatgaacaccgccaactggatccctgacctgttcatgaagcgtgtcttcgatgacggcccatggaccctgttctcgccatccgaagtaccggacctgcacgacctgaccggcaaggccttcgaagagcgttacgagtactacgaagccctgtcccagtacccaggcaagatcaagctgttcaagaccatccaggccaaagacctgtggcgcaaaatgctctccatgctgtttgaaaccggccacccatggctgactttcaaagacccgtgcaacctgcgcagcccgcagcagcacgtgggcgtggtccacagctcgaacctgtgcaccgagatcaccttgaacaccaacaaggacgagatcgccgtttgcaacctgggctcgatcaacctgccgaaccacatcgtcaacggcaagctggacaccgccaagctggaacgcaccgtgaacaccgccgtacgcatgctcgataacgtgatcgacatcaactactactcggtgccacaggcgcagaactccaacttcaagcaccgtccggtcggcctgggcatcatgggcttccaggacgcgctgtacctgcagcacattccttacggttcggatgctgcggtcgagttcgccgacaagtccatggaagcggtcagctactacgctatccaggcttcctgcgacctggccgacgagcgcggagcctacgagacgttccagggttcgctgtggtccaaaggcatcctgccgctggattcgcaacagatcctgatcgagcaacgtggccagaagtacatcgacgttgacctgaacgaatccctggactgggcgccggttcgtgcccgtgtgcagaaaggcattcgtaactccaacatcatggccatcgcaccgaccgccaccatcgccaacatcactggcgtatcgcagtcgatcgaaccgacctaccagaacctgtatgtgaaatcgaacctgtcgggcgaattcaccgtgatcaacccgtacctggttcgcgacttgaaagcccgcggcctgtgggactcggtcatgatcaacgacctgaagtactacgacggttccgtgcagcagatcgagcgcatcccgcaagaactcaaagagctctatgccaccgcgttcgaagtggacaccaagtggatcgttgacgccgccagccgtcgtcagaagtggatcgaccaggctcagtcgctgaacctgtacatcgccggcgcatcgggcaagaagctggacgtgacctaccgcatggcgtggtaccgtggcctgaaaaccacttactacctccgtgccctggccgcgaccagcaccgagaagtcgaccatcaacaccggtaagctgaacgctgtttccagcggcaaccacggtgatgattcggtactcgcagcccctgccggcccagcgccagtgccgaaggcgtgcgcgattgacgagccggattgcgaagcctgccaataaaacccgccactcccgaggtctgacctcgggatcggccctcgataaaccctgccaacggtggggtttatcgaggatggtttttacctcgatgccctgatgactccctgggccagttacctgaccttagttttcgacagcaacgtcgcgtcaccgtgggttgggactgcacctttagtcccgtacaactcctcccggccgttcatgaccgcaaccgcatggccgtccctgtcaatggtccctacctgaccactcgccaaatctgcagccgaccctttggagatgtaatcctccaaccccaaacgcttcagcccggcttcgctgtaatcaccattgttcaaggattgcagcccttgttcaaaggttgtcgccccgtcattaccctccatttgtgcgcgcttggcagccaaggcatattggaacgttgcgttttttaccatctccttgtcactgccattgaagttggcggcctttttggctgtttccaactcagcatccgttaagctgaccttggtgccatccatttgaactacgtcatagcccccctcagttttcttaaccgatttgttcagtttctcagggtcatcggtacccgcagctttgaacaatgccttaatgcctgacaccgtcgcgcagttgccctcctgcccctgcacgaagccagtggtgatctgttcatccgttaattttgaatcccttttggtcggtttagccggatcataattttccaaattggccgaggcactatcggacttgaatgttggcgcttggtctattcccgggctgggagctgggcccgggcgcggagcggggcttggcccgccaccactgccaccgccaccgccaccgccaccgccaccatcgctggaataatcgccgctggaaaggcccaacgcctcgagcaaccttttaaaccaatcccgggatcgcccttcaacgtccccacctgcgccaaacccggaccctgctgcgacaccgccaccgccatcggagccaaagctaattgaacccttactgtcgttaccagcaaagttgatgcctgagtcgttagcattgtttgaacgattaactaccgaagcgcctgcatttccaccattggccgtatcaccgcccaataaagagttaatgccggacctgagcatagaagagatttccatacaccccctcacatcctttttagataaacacctaatgaagggcgcgggcagcgcccaccaaaaatcgaataaagcaacgcgcgcaccaaagcgggcaaagttgggttgtctaaaacatcactacaaccggttactttggcgcagggctcgtagattccttagttccaaaaaggccggttattgcatcgaccacgctttttagaacttccattgctttactcttcaggtctttatcagagacgtcggcatccttatttgcatcgtctatttttttatctttacccagttcatcggcaccgccgtttttgcctgaatcgtctgcatttttgcccttacccagttcgtcgaccgctcccttcttgcccttaccgagctcgtcggttgctcctttcttatcgtctttaccctccgcaccctctttggaaaacatctcctttattcgattaatcattccatccatttcttttattttttcaccgccagtcaaactgctcgcgtccgctggggctttctgagaactggggccgttatattcgccgtaagcaatttgcccgccgccactccccgagtttggaggcgcagcaggcgcatttgcggcagggccattattcatattttctgggtagttgctcacacctgccgcaccattcgaaatactggaaaccataacaacctccgcacttgataaagatgacgaccccttaaaacaaccggtggtcgaaacatattaagaaatccacatgcttattggtctgtttcattctcttacgatttgtggcaggcgacagacatcaggttccaccagtaaagaactttcacgtaacgatatgtggcaacgactaaaacagcgcaggactatgttccattcaatgtaagactttatcttttccacatcgactgagtggccaactaacgagcaaaaaaaaacccctcgagcgaggggttttccaatgcagcaggttaaagcatcggcatcaggtcatctgaatgatggtctgcatgatggtgctctgggtggagatggtcttggcgttcgcctggtagttgctctgggccttgatcaggtccaccagctcgttggtcaggttgacgttggagttctccagggagttggccacgatcgaacccaaggtgccggcttgcggggtgtcaaagcccggttggcccgacgcgaaggtttccttccacgtcgtgccgccggctggctgcaggccctgttcgttgttgaagctggccagggagatctggccgatagccttgctctgctggttgctgaacgtggcgaacagtacgccgctgccgtcgattttcaggccggtgatctggccggtagcgtaaccgtcggtggttggcgggttgcggtaggtggcagagttgtactgggtgatgttggccatgttgatggcgatgcccgtcgggttggcatccgcaccgtttttagtccacacgccattagtcacggtgcctgggacccaaccggtaatggtcaaggtggtgccagacaccgcagggcctgtgatactggtgagcttgccggaaccatcaaaggacaacgtggatggcacaggcgcgacagcaccgctacctgtcggcggggtgccatccgggttgcgaccatcaatcagggtataagcgttccacttgttgccgtcggttttaaccaggtactgcaccatcgggtgcgcgttgccctgggagtcgtacaaggtggtgctgtactgagtggtgaaggtgctggtgtcgttcgggtcaaacgccttcttggtctgatcgatcggcagttccgaagagttcaggttactggtggagtccactttggtggacgccttcggcggcaggttcgacaggttcagttgcaggtcggtcaggccgcccttgttgatcttgccgttatcgtctgcggcgtaaccttgcaggcgcgaagtaccggtgttgttggtgatgtagccatctttgtcggcacggaaggcaccgctgcgggtgtactccagcgagccgtcgctgcccttttgcacgaagaagccaccgccctggatcgccatgtccaggatgccgccgctgttgttcacgtcgccctgggtgaactgctgggacaccgccgccaggttcacaccgttaccgatgctgttctggccggtgcccagtttggacgccgcgtagatgtccgagaattcggcacgggacgatttgaagcccgtggtcgcaacgttggcaatgttgttgccggtcacgtccagttgtttgttggccgcatagaggccgctaaggccgatgttaaaagacatgtttctctccttctgccgtatttagccggctctatgtaccgatagtctgaatttgcgacagcttgacgctgcccatgccgcctgcgaggttcagcagcatttcgccgccggtcttgctcaacgtcacgctggtgacggttgccggcaacgacgttgccagggcaaccgagtcgcccttgtcattcttggtggtggccgcaaaggtgtaagtcccggcaggcgcgacctcgcccttgtcgttcttgccgtcccagataaagctggcatcgccggcgctttgggcgcccatgtcgatagtgcgcaccacgttgccgtctttgtcggtgatcttcaccgagacgttaccggtcgccgccgtcaccgccaccgagccggtcatgctcttgctggtatcaaccatggccttgtcggtctgggtgatgatcgagcgccctaccagcgacgacgcttgcagtgcttgcgaggagctgaagttgctggagatcgcattcaccgagtcgttcagggtgttgatgccttccaggctgctgaactgcgccagttgcgctacgaacgcgccgttgtcctgaggcgacagcgggttctggtttttcagctgggtcaccagcagttgcaggaaggcgtccttgcccagcgactggttacccgtcgccgcgctggcagcgctgccgaggctgctgttgtcggtagacgtcttgaccttggcgttaaaaaggtcctggactgccgtgttgttagtggtatcaacgatggccattatttggcgccccttatcactgacccagggtcaggaccttctgcatcatggttttggcggtgttcatcatttccgcgttggtctggaacgagcggctggcggagatcatgtcggccatttcttcgaccacgttgacgttggggtagtagacgtaacccttttcgttcgcggccgggtggttaggctcataacgcgcttccaggttgctctggtcttcgaccacgccgagcacctgcacgccttgaccggcggcatcctggttctggaacagcgagtcgccgctaccgctctggccagcctggccgccctggaacatggtggcgaacaccgggtgacgggcgcggtaagtctggtcaatgctcgaagacacagtctcggcgttggcgatgttactggcgacggtgttcaggcgcgtggtctgcgcgctcatgccactgccggcaatattgaaaacactggctaaggacatggcttactctccacgcagggctgacatcagccctttgaatttgctgttgagcagggtgaagctggcctgaaagttcaccgagttctcggcgtaggccgattgctcgagctgggcgtcgacggtgttctggtcgatcgatggctgcatcggcgtgcgatacagcagcgactcgtccccattgcccaggccttgcgcttcgatatgacggctgttggtcatgttcaaggcgaaggtgccgttcttggtcttgtcctgctgtgcggcgagcacggcggagaagtccagatcccgagccttgtagttcggggtgtcggcgttggcaatgttgttggccaggacttcggcacgctgggcgcggaagcccagggcttgttcgtggataccgagcgctttatcgaagctgatgctcatggcggaaacctttaggctgacctgcttttcgtatctgggttatagcaaggcgcatgccaattcgctcaggccccgtatttaaagggtttccgggatggttgccgccggcaatgccagaaaagcggcaatcaccttccgcgtggcgccagtaaagcggcaagggcggttgccgcttttacaggggcggcaagggtgggaagagacaaaccgaggtggccgagactcgctgaccgtttgtctgcactgtcatttctgacagttgttatgtgtatcggctcggaggccttattgggggacatcccaccatgcgtcatgcagaggttaaaaatgttgaacatcccgtctccacgattcaacgagcaagattcagcgacccccatcgcgaatctgaacaccacgcttattgtcggcgatgttgccaggttgacgctcaacttccctgtcgaaaacggagacaggatctatttgaccctgagcagctccatctttggcggcgagcataaccagagctttcaaattgcccagaacgcccccaaaatcgagcttctgatacctaaatccatagtagaaatgagcgccggcaacgtcgtgcatttgctgctgagtatccagcgcactggacaaccaagaacctccgcaccgacagggagagtactcatcaacaagctccccatcatcatcgtgccaacgccaggcacagtatgggacttcagcaacggtttccagggctgggtagcccaggggccctatacgggcagtctgctgcacgtgaacaattcgaccgtgcgccttgacccgaccctcttcacagcgacccgcgcccacatcatcactcgccccgtgccggtggttgcagggcgcacatacgattgcagctttgtcgccattggcggcgcggccaccagcgatggttcaaccctgtacatgacgatgaacggcacccgcattggtgcaaatgtacaaaaccttacgctaggccagccgcaaaccgggaccgggaccttcactgccaccaccacaggcgatgtgcggctaggtatctttaacgatgcagtgcccaacgggcttcatggcctatccctgagcaatgtccgaatgacaccgcgcccctgacgtcggccgaggcggcacagccaaccgcttgcgcgcataaaaaaacgggagccccttgccggggctcccgttttttttatacgcaaaaaccgctcacttggcctaatgccgatcagttaagcaaacgcaatgcttgaagtagcaaagatcaaatgtgggagcggcggtggttttgcgcttaactgactggcattagtcacttggcctggtaaatgataccggggctgcactgcaccatctggtaatgatccggcaagccgttcagcgcctcggacgcgccgaggaacaagtaacctccgcgtttgagcgtaccgtggatacgcaacagaatgtccttcttcacttcagccgagaagtagatcagcacgttgcggcagaacaccatgtcgaacttgcccaggctggcgtagctgtcgagcaggttgaacgagcggaactccacccgactcttgatcggcgccttgaccgcccagcgcccagcccctttcgggtcgaagtagcgttgcaggcgctcctgggacaaaccacggcccagggccaggctgtcgtactcgccggtcttgcagttggtgagcatagtgccggacaagtcagtggcaacaatttgcgcacccgccttcaactggcccatgttcgtgcgctcgaactcgtcgatggacatcgagatcgagtacggttcctgccccgaggagcaggctgccgaccagatacgcaggcgctggcccgggctggccttgatggcctccggcagcactttgctcttgagcacctcaaaggggtaggtatcgcgaaaccacaaggtttcgttggtggtcatggcgtccaccaccatttccttgagcccgctgcgcggctggccctggatgcgctgtaccaactcacccagggacttgatgccctgctgctccatcagtttgttgagacggctggataccaggtactgcttgttttcaccgagcaatatgccacaggctttttccaggaagacccggaactgttcgaaatccaaattacccgtagacaatgataccgcctcttaaatcgtgtgaccgccaggggaactccccttagccgtgatctgctgccttgatccggtcgactacccgggatgccaggtcatcagggcggaacttggccaaaaagtcatcggcaccgaccttcttgaccatcgcctgattgaatacacccgacaacgaagtatgcaggatgatatgcaatttttgcatgcgtggatcgttgcgtatctcggccgtgagggtgtaaccgtccatttccggcatttcaatgtcggagatcatcatcaagaattcttcttctggcttcttgccttcatctaccagtttgcgcaagtaatccagggcctggcgcccatcgttgagggcgaccacttccacgccgacggtttgcaggcagcgactcacctgcttacgtgccaccgaggaatcgtccacggtcagcacgcgcagagaaatcgccttgtgcgccgtctcggcgtccaccacacctaccgatatggattcggaggtaggcgctacttcggcgaggattttctccacgtcgatgatttccaccaattggttatcgacccgcgtcaccgccgtgaggtagtgatcgcgcccggtacccttgggcggcggatggatctcttcccagttcatgttgacgatgcgctccaccgagcgcaccaggaaaccctgggtcttggtgttgtactcggtgatgatcacgaacgggctctggcggtcctgcaaaccggcggaaccggtggccatggccaggtcaagaatcgggatggtcgcgccacggatattcgccacgccacagaccacggggctggatttgggcattatggtcagcttgggacactgcaacacttcccgcactttaaacacattgatgccgtatagctgtttgccatccaggcgaaaaagcaacagctccaggcgattctgccccaccagctgtgtacgctggtttactgaatccattactcctgccatgccctgactcctacgctaaaacctttgggagtgcgacgcgcactcaacactaaacggcacgagctttgctatttattagtttatggatatcaaaacgacagtttcccgacgccccaacctccaacgttactgcagattgctctgcgtcacgctggctttgtttgccgtgggctcaggcaccacggcccgtgcagataatgccaccttgcctgatctccttatcggcgtcactcaaggctttcttgagttcactgtagaagattatctggcaaccacgcagacgcctgggcgttatgaaatacaggtcagccaactggacccacgcctgcgcatgccaatgtgcgacaaggaattgacagccacgctggaaagcccggcccagccgatcggccgtgtgacggttaaagtgcgctgcgaaggcgcttcgccctggactgtgttcgtaccggcgcaggtcaagctgttccgcgatgtggtggtggtgacgcggccgctgaaacgcaccggcattatcgggttcgacgacgtggccctgcgtgaacgggatatcagcctgatcaatcagggctacctcacctcgctcgaccaggcagttgggcaaaaacttacccgaccaatggtcactgaccaagtcatcacgctggtccatcttgagcaggccgaggtgattcgcaagggcgatcaggtggtcatttccgccaccagtggcgggctgactgtaaaaatgccgggtgaagcactgtccaacggcggcatgagcgaacagatcagggtcaaaaacctcaactccaaccgtgtgatcaaggcgcaagtgacggcccccgggcaagttgaggttgctttatagttcactggcataggacgcctgcttttcctacactgtgcgcacgatgtgtgcacgtgcaggtttattgtcaatcgagcctaaagtttgtccgggtatggccgaaaacatggcaagcgtccaaatacccagaggtttttttaacatggtcattgatttcagtcgtttgaataacaccccggcgttgcccggcaacacgcgtaccagcggtgccaaggacagcgtagaagccaaggcccaaccagcccctgccgccaaagcagaacaggccggcgccagccaaagcggggaatccgtacacctgagcaatgaggctcaacagttgcagaaggtcactgactcgctgcgcgaccaaccggttgtcaataaagcccgcgtggccgagttgaaacaggctatcgccgatggcagctataaagtcgacagcaaccgtgtagccagcaagctgcttaacttcgaagccgagcgctaggcaaaggcctgcgcagggcttttggacgcttaaaacccaaggccagccatgcaccacgacgaaaatttgcttcaactgatcattgatgatctggcgccgacgcaacatttgctcgagctgctcaaagaggagtccctggccctgtacggtcgggacatgcgtttgctggaagaaattctggcgcgcaagcagtcgctgatcgtgctgctggagcagcatggcaagaagcgcagcgaaattctcatcagcctgggcctcccggctgatcacgacggcctcgcacaactggccagccactcctcggttggcgatcagttgctggcgcagagcaccgcactcaatcaattgcttgccctgtgccaggaagccaacctgctcaacggtcagtcgatccagctgcagcaagctacgaccgccaatcagttgcgcatacttcacggcggtgagcctccggccctgtacaacgcccaaggctccacctcacgcctggtcaagccaagcacccgcagccaagcctgacgccggtttaccgcgcgccctatccaaggcgcgccacatactggcaaaatgccggttcttgcgtgtagtcgtattttgtctggagatggaagaaacgtgttcaacgcccttaatgcggaagatgccccgcagccacccaaggtgctcaccacgcctctggaaatcgccggcacgttacggatgctgcaagaaagccatgatccattgatcatcactttccatgaacgcagccaacgcttccaaagctacctggtggacgttgaccgggacagcaagacgctggccctggacgaaatgatcccgcgtgacggtgaacgctatctcgagaatggcgagccctttcgcatcgaaggctttcatgatggcgtgcgagtcgcctgggaaagcaacggcaccctgaccatcagcgaaaaaggcggccaccgcatctacaccggcagcatgcccgacgaggtggtctaccatcagcgtcgcaatgcattccgcgcggcgctgaagctggcgcaattggtcagcatcgaactgggcggcgagaagctcaaggcgccgatcagcggcaagctgctggatatctccgccactggctgcaaattgcgctttgaaggcgatatttccgagcgcctgcaactgggccaggtttacgatcgctttattgccgccctgcccttcggcagcatgaccacgtctgtcgaactgcgttacctgcatttcgaagacaagatcaacaccaccttcgccggcgtacgcttccacaatatgagcggcttggtgcagcgccaggtggaacgttttgtgtaccaactgcaacgtgaagcgcggcgctttgacaaggatgacgatttttaagggttaaaggccgcggcaaaaaaacgggcagctcctgatgggagctgcccgtttttgctttcaggggcgcgccctgctcaggtcatgcgggtgttcgtccgggcttagaggctcgggcggcccttcaaaagccggctcatccgttggttgctgcggatcagtctcaggctccgggtccggaacaacggtctgcatttgctcctgtaccaccgcctcatccacgcgcgggtcgaggcacgccaccagcggcgagctggacatgctgtcgggcatcgccacgtggtgcagcggtgcgtcgtccacttgatgcaagttggtcaccgccttcggccggatacgccacaccaggatcaacgcacacaggctgaaaaatgcatacagcatgtggctgccaaacagcttcatcgccacaccggccaacaacggcccgacactcgcaccaatgccgtaggtcaccagcagcatggccgtcagcgacacacggcgatcaccttcgacatggtcgttggaaaatgccaccgccaacgggtacaggcagaactgcaccaacgaacacagaaaccccgccacaaacagcacttccaacggcacccgcgtcatgatcgccagcggcaacgccgccactgccaggcacagggcgaagcaacggatcagcaaggcccggtcataacgatccgacaaccagcccagcggccactgcaccagcagcccggcaaaaatgcagcagcccatgaacagaccgacctgctcagtcgtcaggccttgttgcgaagcataaaggggcgccaaaccatagaacgaaccgacgatcacgccggcacccaatacggtgcttaacgactgcggcacgcgcttgataaaaaatcgcggctccatcggcgcaggatgcaggggcgctgggtgaatgcgtcgggtcatggccaccggcaccaggcacagggcaaagcacagcgcgaccagcatcagcaattcaaggccgagctcggggtgcatcaccaggatcagttgacccagcaccaggcccagataggacgcgatcatatagccgctgaacacgacgccacgttgcttggcatccgcctgctcattgagccaactttcgatgaccatgtattggcacatcatccccaggcccacgatcatccgcagcacgatccaggccggcagccagttgaccaggccatgccccaacaccgccgcaccgacaatcccggcacaggtggcgtacgcacgaatatgcccgacccgggcgatcaggcggtgcccgatcttgccgcccaacaccaggccgaagtagttggccgccatcagcgcacccacccacaggctgtcaacgtggtcagccgccaagcgcagggcgagataagtactgagcaggccggagccgatcagcatcatcaaggaggcgaaataaagggctcgaaaagatttccagatctggcgcatcggcgttccgagcggctccttgcagtgagagacagggctatcggcatgatagtccggggttgccgggtccggacaggcgatatgcgctgtagccggggaatattttgcttatatagctcagacgctgcatggccgcgtgcgaggtacacagggtgcgataaatacatcgcgcccctgctgtgaaccccgatcaccggcaaggttcgaccggtgtttgacgagcacccacaaaaaagccccgccagagcactctgtacggggcttttttggagtttgaatctggtgtcccagggccggttcgaacggccaaccttccccttaggagggggatgctctatccaattgagctactgggacaaatgacagccggcgggccaaaggcgcggcgacggacggcgtgcatgttaacggccgaggtaggttttgtcatgtcgtccgttggctttttgagtgtaggccgatccttgtaagggctgtcgcagtttcgccgtgtaaaaccggacacttggcgccatcgtgcaaattgcactcccccaaaatgccagcattgcaaattgcaacgaaacgcctccgaaaaacatagctaacccattgtttttattgagataaaaggttggcacgggacctgcaatacttatcttataaaaccttcggcccagccactgcggagaacacgaacatgaacagcgcccttctgttaagcctcaacgctctcgccttggccgcactggtcctgttccatttccaatcaacccacgacgacgttgcgcaaatcagccagccggtgccacaccacctgcaacagcgcccgcagttggcggtgatgactccgacggtgcaatcgcccattcgtgtgacccaggacacccaggccgcacctgcatccgagcactgggttttctgaggaaatctttatgacgaaacccgcctggctgttcctctgcctgaccctggcaaccggcgcatttgccttgagcaccacctctcaagacggtgaaaccaccgccctcatcgccaccggcgtgttcgccggcttgctggtcatcacccttatcgttggccgccgcatcaagttcgatcccgtgctgcgctaacgcctgccttgcgtcgccttcgcataccttatgtcgccttgccctagtaaatcggcaaattgccactagtcttaaagacgagggcaaaaggccatattgctatacgatgtgcggcctaaaaccctttcgcggcttggacttacgagaagttccctcgtggaatcacgcgttgaaattttttcaaaccagtccgcaaaaatgcaaatgagtgctggcataaagcctttaggcagttcaatatttgtcacagaattgacgccaaggaactgtcaaatctgaggcatgatgcggcctctttgcaattcgggttgaactttggtcgtgagccttgtcttaacactcatcttgcggccaattccaaaaaccgctcccctgaactaaccggttaaatatatgcgcccattgaaacaggcaatttattccagccgtacggctgacaagttcgtcgtacgtctgccagacggaatgcgggaacgcattgccgaggtggctcgcaatcatcaccgcagcatgaactccgaaatcatcgcgcgcctggaacaaagcctcattcaggaaggtgcgctgggcgaagagttaagcatgcgcctggacagccctgagctgtcactgcacgaacgcgaactgctgcagcgttttcgtcagctctcccaccgccagcaaaatgccctcgtctcgcttatcgcgcacgacgttgaggcggccgcagaagccaattaatctgcagttgaaagccgaagccagccatgtgctggcttttttttgcctgagatttgggaaagaaaggcctggaggagaaagcaagcgggagcagagttgctcccgccggagggctatagcagaaagattgtcgccaggcccaggaagatgaagaagccaccactgtcggtcatggcggtgatcataacgctggcgcccattgctgggtcgcgcccaaggcgcgccagggtcataggaatcaatacgcccatcaatgccgccaacagcagattgagggtcatggcggccgtcatcacgacgcccagcgaccaactgccatacagcaagtacgccaccacaccgatcacgccgccccacaccaaaccgttgatcaggcccacggccaactcttttcgcaacagccgcgaggaattggccgtactgacctgatccagcgccatcgcgcgcacgatcatggtgatggtctgattaccagagttgccgccgatacccgccacaatcggcatgagggcagcgagggccaccagcttctcgatggagccttcaaacaacccgatcacgcgcgaagcgataaaggccgtgatcaggttgatcgccagccaggcccagcggttatgcagagaacgccagaccgacgcgaagatatcttcctcttcacgcaaacccgccatgttcagaacttcggtttcactctcttcacgaatcaggtcgaccatttcgtcgatggtcaaacggccaatcagcttgccgttcttgtcgaccactggggccgagatcaagtcataccgctcaaacgcctgcgctgcctcgtaggcgtcttcatccgggtgaaaactcaccgtgtcgctggccatcagatccgctactttcttttccggatcattcaccagcagacgcttgattggcagcacgcccttgagaatgccttcgtagtcgaccacgaacaatttatcggtgtggccgggcaattctttgaggcgacgcagatagcgcaataccacttccaggctgacgtcttcgcggatggtaaccatctcgaagtccatcagcgcgccgacctggtcctcgtcataggacagtgcagagcgcacgcgctcacgttgctggctgtcgagcgcttccatcagctcatggacaacatcacgcggcagctcaggggccaggtcagccagctcgtcggcgtccatctccttggccgcggccaggagctcgtgatcgtccatgtcggcgatcagggtttcacggaccgagtcggatacttcgaggaggatgtcaccgtcgcgctcggccttgaccaactgccagagggtcagacgatcgtccagcggcaaggcttcgagaatgtaggcgacgtcagcggagtgcaaatcatcgagcttgcgctgcaactcgacgaggttttgccggtgaaccaggttttcaacgcggtcgtggtgcggaccttcctggcggtgcgtgaggtcttcgaccacgcgctggcgctgcagcagctcgataacctgagccaaacgatcctgcaggctgtcttgtgttttctttacttctacttcggtcataggcgaactccactcccagcagcggggcacgccggaaggatcaatcagtcaattcatgattggtaaaacggggtactgagtaactactgggtaagtccatggaggtattccacaagccccggcggggctgacgggcgcaatcatacaccgcccggccgttttaaacgttaaaaaactggaaagaacaagcgcttgcgagccgaagctgagcattggctgcatctatgaactgcgacgacgcaagctgaaaggaaaacacatggcggggcgagaaaaagatgaagtcctacacaaaccccagacggcaaaaagcccgcactaggcgggctttttgtttgtatggtgcactcgacaggattcgaacctgtgaccgctcggttcgtagccgagtactctatccagctgagctacgagtgcagattgtgtttttagaccagatcacaactggttgaagccgagccacttgcattgctgcaactgactcttaaatggtgcactcgacaggattcgaacctgtgaccgctcggttcgtagccgagtactctatccagctgagctacgagtgcatttgttgccgcgcattataggccgttcaatctctatgtaaagctattttttcgtttaatttcaacaacttagcgaaaaaaccagattgcaacgtactaagcaaataatggcggagaacgggggattcgaacccccgacacccttttgaggtgtactcccttagcaggggagcgccttcggccactcggccagctctccgcaacacggggcgtatattaaccacgttcatccccgtttgcaaacataaaaaacgataaaaattaaaggcttggttcttcgtccttctctttcttgatccgcaggtagatttcctcgcggtggaccgctacctctttcggagcgttaaccccgatacgtacttgattgcctttgacgccgagcacggtcacggtgatttcgccatcaccgataatcaggctttctgcgcaacgacgagtcagaatcagcatacctttctcctcacgcatttcagttcaggaacaacagtctgcaaaaaaaaggccttcgacctacaacccaaaggtcatagccctaccgcctaagtattgtcgagcgcaccaaaaagaacatgcgcccgacaaaaaaatgaaaggcgcggtaagccgcgccttcctggtatcgcatcactcgccctgtcgggccggagcgtccaactcaaaagcggtatgcagcgcgcgtacagccagttccaggtacttctcttcgatcaccaccgagactttgatttccgaggtggagatcatctggatgttgatgctttccttggccagggcctcgaacatgcggctggcaacgccggcatgggaacgcatgcccacacccacgatcgacaccttggcaatcttggtatcgccgaccacttcacgggcaccgatttccttcgcagtgctcttcaggatccgctccgccgcatcgtactcgttacggtgcacggtgaaggtgaaatcggtggtgttatcgtgcgaaacgttctgcacgatcatgtcgacttcaatgttcgcgccactgataggaccgaggatcttgaaggccacgcccggagtatccggcacgccacggatcgtcagcttggcttcatcgcggttgaaagcgatgccggaaatgatcggctgttccatggattcctcttcatcaatagtaatgagggtgcccggaccctctttgaagctgtgcaatacgcgcagcggaacgttgtacttgccggcgaactcaaccgcgcggatctgcaacaccttggaaccgaggctggccatttccagcatctcttcgaaggtgatcttgtccaggcgctgggccacggacaccacacgcgggtcggtggtgtaaacaccgtccacatcggtatagatctggcattcatcagccttcagagctgctgccagcgccacgccggtggtgtccgaaccgccacgaccgagcgtggtgatgttgccctgctcatccacgccctggaagccagctactactaccacgcgcccggctttcagatctgtgcggattttctggtcatcaatctgcaggatgcgcgccttggtatgtgcactgtcggtcaggatgcgcacctgactgccagtgtaggacactgccggcacgccacgcttgttgagcgccatggccagcaaggcaatcgtcacctgctcgccggtggatacgatcacatccagctcacgcggcagcggctgttgatcgccactgattgccttggccagatcgatcaggcgattggtctcgccgctcatggccgacagcaccaccaccaggtcgtcgccggcatcgcggaatttcttaaccttgtcggcgacctgctcgattctttcgacagagccgaccgaggtgcctccaaatttctgtacgatcaaagccatttctaagccgcctcagcccgtaaaggggcgcccaataaaaacaaatcttccagcaccggagcgagcccatgactagaccatgggctcgtgaacagcgccttaaatgccagcctcgacaaacggcacggtcagggccagggccgcgtccagggcaccggcgtcaacaccaccgccttgcgccatgtccggacgaccaccgcccttcccgcccactgccgcggcggcttgcttcatcaaatcaccggccttgagttggccagtcaggtctttggttacaccggcaaccagaacgaccttctcctcatggacaccgccgagcaggatcactgcgcggccgagcttgttcttcaactgatcgaccaaggccaacagcgccttgccatcctgaccgtccaggcgtactgccagaaccttcacacccttgacgtccagggcagaggccgacagatcgtcgcccgccgcactggccgccttggcctgcaactgctccagctgtttttccagcgcacggttgcgctccagtacggcggacagcttgtcgaccaggttgtcgcggctgcccttgaccaggccggccgcttccttgagttgttcttcagccgcattgaggtaagccagggccgcagcaccggtaatcgcttcaatacgacgcacacccgacgccacaccgccttcgctgatgattttcagcaggccgatgtcgccggtacggttggcgtggataccgccacacagttctaccgaaaagctgccgcccatgctcagtacgcgcacttcgtcgccgtacttctcaccaaacagcgccatggcgcctttgtttttggccgtctcgatatcggtttcttcggtttccaccggggtgttcttgcgaatctcggcgttgacgatgtcttccagcgccttgatctgctcaggcttgatcgcttcaaagtggctgaagtcgaaacgcaggcgctggctatcaaccaacgaccccttctgctgcacgtgctcacccagcacctggcgcaacgcggcgtgcagcaagtgagtggccgaatggttcaaagcggttgcatgccgtacgtcggcatcgacctgcgtgtccaccggcgcgccgacggtcaagttgcccaataccaacacaccgtggtgcaggaacgcaccgccggtcttggtggtgtcgcgcacttcaaagcgaccggacgtggaactcaggaagccacagtcacccacctggccaccggattcggcgtagaacggcgtctggtccaggaccaccacagcctcttcgccttcgttcaacacgtcgaccgatttgccgtctttatagatggcaacaattttggccgagccaacggtgccctgataaccagtgaattgagtggccacatccaccttcaccaaggtgttgtagtccaggccaaaggagctggcggaacgtgcgcgtacacgctgggcttccatctcacgctcaaaaccggcttcatcgacggtcagctcgcgctcgcgggcgatgtcggcggtcaggtccatcgggaaaccgtaggtgtcgtacagcttgaacaccacatcgcccggcaccacggtgcctttgagctcagccaggtcctgctcgaggatcttcaggccgtgctccagggtcttggagaactgctcttcttcagccttgagcacgcgctcgatgttggcttgctgctgcttgagttccgggaaggcatcgcccatctcggccaccagcgcggcaacgatcttgtagaagaaactgccggtggcgcccagcttgttaccgtgacggcaggcgcggcggatgatacggcgcagcacatagccacggccttcgttcgacggcagcacgccgtcggcgatcaggaagccgcaggaacggatgtggtccgacaccaccttgagcgacgactgattgtcgttggcgcaaccgatggccgcagccgacgcgctcagcaggttggtgaacaggtcgatctcgtagttggagtgcacgtgttgcatcaccgcactgatccgctccaggcccataccggtgtccaccgacggcgccggcagcggatgcaacacgccatcggcggtgcggttgaactgcatgaacacgttgttccagatctcgatgtaacggtcgccgtcttcttccggcgaacccggtgggccgccccagatgtcggcgccgtgatcgtagaaaatctcggtgcaagggccgcacgggccggtatcgcccatggtccagaagttgtcggaggcgtaaggcgcgcctttgttgtcgccgatgcgaatcatgcgctcaacgggcacgccgatttcttttgtccagatgtcataagcttcgtcgtccgtcgcgtagacggtgacccagagtttttccttgggcagcttcaacacgccggtcaggaaggtccaggcgaaggtaatcgcatctttcttgaaatagtcgccgaagctgaagttacccagcatctcgaagaaagtgtggtgccgagcggtgtaaccgacgttttccaggtcgctgttcttgccgccggcgcgtacgcacttctggctgctggtggcgcgggtgtaggcgcgcttttcctggcccaggaagcagtccttgaactggttcatccccgcgttagtgaacagcagggtggggtcattgcctgggatcaaggagctggaggctacacgggtgtgaccttgctcttcgaagaagcgaaggaaggcttcacggatttctgcgcttttcattaggttcttccacggaggctgcggccaaaggccagtgctaaacgtcatcagacggagcgacggcaaagggccgcattatatcggccctttgcccgtggtacagcgtgtttatgtgatagaaacagtcaattagacggtctgcactgtcattttcgggaaaactcgacaaatgtcgccagcacttgctcgatctgtgcccggctgacgtccaggtgagtgaccatgcgcaggcgcgacgcggcgctcaacttgatcccgcgctcggccgcaaatgccttcaacgcctgggcccgatcaccgatatccacgtagaccatgttggtctgcaccggctctaccctgtagccggcctggcgcagttcatcgcccagccattgggcattggcgtggtcctcggccaggcgctgcacctggtgatccaaggcatacagccctgccgccgccagggaaccggcctggcgcatgccgccgccgaccatcttgcgcaggcggcgcgccttggcgatcaacgccgtggtgccgcacaacaccgagccgatcggcgcgcccaggcctttggacaggcacaccgacaccgagtcgaaatgctcggcaatttcccgcacatcgacgcccagcttgaccgccgcgttgtagatacgcgcaccgtccagatgcagcgccaagccatgttcacgggtaaacgcgcgcgccttcgccaggtactccagcggtaacactttgccctgcatggtgttttccagcgccagcaggcgggtgcgggcgaagtggaagtcgtcgggcttgatcgccgccagtacgtgatccaggtcgagggagccgtccgcctgcacttccagcggctgaggctggatcgaaccaagcaccgccgcgccaccgccttcgtatttgtaggtgtgggcttgctggccgacgatgtattcctcgccgcgctcacagtgggccatcaacgccagcaggttgctcatggtgccggtgggcacgaacagcgccgcctcgaagcccaggcgcttggccagttcggcctccaggtggttgacgcttgggtcttcgccgtagacgtcgtcgccgctgacggcgctggccatcgcgtcacgcatgccgggggtgggttgggtcacggtgtcgctacgcaggtcgatcacagacatgaaacgcgcctctaacgggttagataagttccttttgtggatgattactgcgggcaaagccacggaatatcaagccctggctgaattcaatcgaataccaaccaaacaaaccgatataggttatcgatacggcaaccgtgcagtttgtgaaaaaccgtgttaaaaactctccgccgccagggttctggcggcaacgttctcagggcggggtgcaattccccaccggcggtaattgcacgcaatgtgcatagcccgcgagcgcttggcgcctcgaactgctcacgcaggacggcgacaaggtcagcagacccggtgtgatcccggggccgacggtcatagtccggatgaagagagaacgggattggcacctaagggccgcaccctgggttcatgcttgcatgacgcagcggttcgtacccttaaatcccattcgattcataacgccctgtttttttcttaaacaggagtcagaacatgcaacccaccgcaatcgacagcaaaagcaaaaaccatcacggcgagcgcgtcgcgtttatccaggcctgctggcacaaggatattgtcgaccaatcgcgcaaaggcttcctcgccgaaatgattgcccagggctaccaggaatcggacatcgatttcttcgaagtcggcggcgcctttgaaatgcccctgcacgccaagctgctggccaagaccggccgttacgccggtatcgttgccgccgcactggtggtggacggcggcatttaccgccatgaattcgtcgcccaatcggtggtcagcggcctgatgcaggtgcaactggaaactgaagtgccggtgttctcggtatcgctgacaccgcaccacttccatgccggcactgagcaccacacctttttctacgagcacttcgtgcacaagggccaggaagctgcacgtacctgcgccgacacgctgcacaaggttcgcgctatccgtcgcagcgagccgcgtgccgtagccgtctaagcaacaccacaaaaaacccagcctcagagctgggttttttgtgggagctggcttttgtgtgggagctggcttgcctgcgatagcatcaccgctgtgtgactgacatacctagttgactgcatcgcaggcaagccagctcccacataagccagctcccacacaagccagcacccacatttggactcggttaagccttaaggtttacgccaacccaacatccttggtcggcacaatcaatattcctgcgcgcaaaccattcttcaccttcgggttcgggaagatgatgcgggcgccctcctcctcgatcacccagcgggtcttggccacgtcttcggccagcagatagcccttcgccaatggcgaaaagttttccacatcagccggcaagtgcagcaggaacgcgtcgctgtgcttgatcacttcacgcgataccgcaaacagctgcagcccttccaggctctcggtggcaggctcggtgccttcgatgatctgcttgaggcgcgcctccaggcgggaaacatccacgccctggttctgcccgaacggccgcgccttgcccaattccagggtgaaggcttcggcgtccagttgctcgtaggtaaacgcggtaaaggtgatcgaggttttgttctgcagcagcaccgcttgcatgccggcagcgcacaggcgcgccagctcgtggcgcgaatgctgacgaccttctttccacgggtacagcgcgaactgctcgatcttcgagccgcgaatggcggtgtgcaggtcgtaatgcaggcgcgggcggcccggcaagctgaagaagctgcgggccagttgctcaagctcggcggcgcgcatggcctccgggccgatgttttgttcgtgacggccgttgaacagccggttgacgtccagctccaggtaacgctcgccgcggcgcatggcctcggggttaccgaacaggaacagaatgcgattgcggggcttgatctccccacgggcgatgccatgcaacaggcggtcgagcagttcgatcggcgcggtttcgttgccatggatgccggacgacagcagcaagtcgctgccattgtcctgggcctgcggcgggcgcacttcaagcgcgccctcgctgagccagcgcatctgcacgccgtcgacagtcagttgaattttttgcgccggttcgcgaccggcgagggtcagttcaagcagtttgccgagggcgagcataagcggcttccttagtggttgcagcctgggccatggacgtgatcgtcgtcatcaccttcgacgtcggccggttccatttccagttgcaggctcatcaggttggtggccaatgggcgcatcagcaggttggcgtactcggcgtcgccttcttccacgtccacaccgatcagcagttggccacggccgtcgtgctggatccagatctccttgccctgccagaccacggcgacgcgggtgcaggaggtttccagctgggtgccgtcggtgtcttcaagaatcagtttcagggtgtcggtggtcataaataattctcagccatagggtgtaaaaaagaggtggcgttaattgatctggaaaggataaaccgagcccagtttaaggatttgcgtcagttcatccagtgccgtccggcactcaagcagcaattgcgggtcagccaggtcggtttcacgcaggctgtcgcggtagtgcttgtcgacccattgggtcagtgtctcgtacaacggcgcggtcatgataacgcctgggttcaccgccgccagctcagtttcattcaaggccacacgcaaacgcaggcacgccggcccgccgccgttctgcatgctttgcttgaggtcgaacactttcacttcgcgaatcagcccacccgatgccgtcaggccttgcaggtattgccagacgcgttcgttggcgcggcactcttccggcacgatcagcagcatcgaaccgtcagggcggctcagcaactggctgttgaacaggtaggaacgcaccgcgtcctcgacactgacctgggcgcgaggcacgcacaccgactggaagttaccgcccagcttgcccaacttgccttgcagttcacccagcatctgctcggtattgaggaacgcgtcctcgtgatagaacagcacctcgccgttgcccactgcgatcacgtcgttgtggaacacgccagcatcgatcactgacgggttctgctgagcgtagaccacgccgtcatccttcaagccgtgcaggcgcgcgacggcctgggaggcttcgagggtctggcgcgccgggtatttctgcggcgccgggtaacgggtgtcgaacgcgctgcggccgaatacgaagaactcgacgcccgcttcgccatagtcacggcagaaacgcgtgtggttggccgcaccttcgtcgccgaactgcgccaccgccggcaacgcggcgtggtgggcgaagtgcttctggtcggcaaacatcgcgcccagcacgcggctggtggtcgggtgctcaatgctgcggtggtatttgcaattgaggttggcggcggtgaaatgcacgcggccatccgccgtatcggcactcggactgacggtggcggcattggccacccacatgctcgaggccgagcagctggcaaccagcagcggcatggcttgcttggccgcttgctggatgacttgagcgtcgctgccgccgaaaccgaggttgcgcaaagccgccacgtcaggccgttcctgcggcgccaacacgccttgcacaaagcccatgtccatcagggctttcattttttgcaggccctgcaacgccgcttccttggggttcgaagactgctggctgttgctctgggacgcgacgttgccgtaggacaaaccgccgtagttatgggtcggccccactagaccgtcaaaattgacttcataggatttcatcggcgaggctccacgaacatctgtttttataggcatcaactgcggccttgaaaacaccgcatttctctatctgtaaatccaatcaactgtgggagctggcttgcctgcgatggcatcacctcggttgtactggaataccggggcgcctgcatcgcaggcaagccagctcccacacaagccagctcccatctttagatcagcgtaatgccgggggttagcgttgctggaaccaccaagcttggagtttccaaagacgccaccgggtacgcacaataatccgccgcgtaataagcgctggcgcgatgattgcccgaagccccaaccccaccaaacggcgcggtgctcgcggcgccggtcagttgcttgttccagttgacgataccggcgcggctttccagccagaactgctggtagcgcgcctcggaatccgacaacaagcccgcggccaaaccgtactgggtgttgttggcctcggcaatcgccccggcaaaatcagcgtagcggatcacttgcaacagcgggccgaacagctcttcatcttcgcgctcggtcacgccggtcacgtcgataatgcccggcgtcagcaacgcagcctgatcctgtggctgggtcatttccagcagcgccacggcgccattggccaacatcagttcctgcgcgtccatcaaggctttggccgcgcccagggaaatcaccgagcccatgaacggcgccggttgttggtcgaacgcgccgactgcaatcgtcgcgctcaccgccaccaggcgcgccagcaacgcatcgccccacgcgccttgtggcaccaacaggcgacgcgcacaggtgcaacgctggccggcagaaatgaacgccgactggataatggtgtagaccgccgcatccacgtcggccacttcatcgaccaccagcgggttattgccgcccatttccagcgccaggatcttgtccgggcgcccggagaattgttgatgcaagtgattgccggtgcggctggaaccggtgaagaacaagccgtcgatacctgggttggctgccagcgcgatgccggtttcccgcgcgccttgcagcaggttcaacacgcccgccggcaaacccgcgtcgatccagcattgcacggtcagctcggcgactttcggggtcagctcgctcggtttgaacagcaccgtgttacccgccagcaacgccgggacgatatgcccgttcggcaagtggcccgggaagttgtaagggccaaacaccgccaccacaccgtgaggcttgtggcgcaatacggcggtggcgtcgcccaacgggccgctcttctcgccggtacgctcgcggtaactttgcaccgagatcgctatcttgttggccatgctggtgacttcggtggccgattcccacagcggcttgccggtttcttcaccgatgcagcgggcgatttcatcggcgcggcttttcagcgtagcggcgaaggtttccagcacgctgatgcgttcttccaacgggcgccgcgcccagcctggaaacgcctggcgtgcggcctgcacggcggactcaacctgctcggcagtggcgccattgccggcccacagcacttgctgggtcaccgggttgcgcgattcaaacagttcaccctggccagccagccagctacctgcgatatacagcgaattcattatttcgactcccgagcagcagacaacgcaacagcacgcacttgatcacccaccaccagttgcaggcgtttggcggtctgtgggtcgaccaccagggtgcctgccgccagccgggccggagcggcagtaatgcggcactcctcgcgcttgcggttatggatcaggaacggcgtggcgtcgtcccccggcgtgccgatggccaacaccagtgactggctgtcgcgcacagcacggattttgctggtttcacactccaccgccgggccggcgtcgaaaatatcgacatagccctggtagctgaacccttcgctcttgagcatgctcagcgccggctcggtgtccgggtggaccttgccgatcacgttgcgcgcgtcttcagacaggaagcagctgtacagcggaaacttcggcatcagctcagcgataaacgccttgttgcccacgccggtgaggtagtcggcctggctgaattccatcttgaagaagtgccggcccaggctttcccagaacggcgaacgcccggcgtcgttggacacgccacgcatctcggcaatgatcttgttgccgaacagctgcggaaattcagcgataaacagcatgcgcgccttggccagcatgcggccgttgaggccgttgcggtaatcggcgtgcaggaacaacgagcacaactcggaattgccggtgaggtcgttggccaaaaacagcgtcgggatctcgcggtagatattcagctcctgggaggcgctgaccgtcaggccgacccggaagttgtaccaaggctcgcgcaggccgacggcaccggcgatggcggaaataccgaccacgcggccctcgtcgttttccagcacgaacaggtagtcggcatcgccgcgcccggcttcgccgcgaaaggttttttctgcccagccaacccggtgagtcaggcgctcttcgttggccggcaaggtggtgaggccggtgccggtgctgcgcgccagatcaatcagggccggtaaatcgctgctgcgtacgggacgaacgatcatgctatctcctcaaacgggccgctgcctggcagccacccgcgacactcaattctttaaaccgcgaccaggcgcacactcgcgccctcgccgacacccagggcttcagcggtttccaggtccagggtcaccggtttgccgggcgcgtagtccaggtccagcatcaccgcgcggtaatcctgcaactgcgcgttgctcaccaagtactggcggccggcgcccttgaccatctcgccgatcttcaccggcaccacgcggctctgggcgatcgagcgaatgcccgagacccgtgcgtgcagcgttgggccgccgtcgaagatgtcgatgtaatggtcggtctcgaagccttcacgcatcaggatgtcgaaggtgatctgcgcacgcggatgcacctggcccatggcttcctgggcggcatccggcagcagcggtacgtagatcgggtagtgcggcatcagctcggcgaggaaggtgcggcttttcagcccgcacagacgctcggcggcggcgtaattgaggtcgaagaagttgcggccgatggcgtcccagaacggcgagtcgccgttctcgtcgctgtagccgacaatctcggtcaccaccgagtcggcaaagcgctcggggtggctggcgacaaacagcaggcggccacgggagttgagttccgaccacggcgaaccgaccagctccggcaccacataaaaactggtgagcaggctgttgccggtcaggtcgtggcactgggaaagcacgtggatcttgttgtgaatcttcagctcgcgggaggcgtgcacgaaggtttcgttacgaaagctgtagaacggctccgaataaccggcggatgcgacgatggccgaacagccggcgagcttgctggtctcggtgtcttcgagcacgaagaagtagctttcttcaccgttgaaactgacctcggccgcgaaggacgcttcgctggcggcgatcttgtcgctcaggcgttccacatcatccggcaaggaggtgacaccaatcgggctgtccgcagccagacgctgtacctcgcccagatcagccatttgcgcggggcgcatcaccagcatggtgtcactccttaactcgaaaaactcacagagggaaaaatgccggacacaggatctggattcacacagatccaatgtggggagtcttttgtgggagctggcttgcctgcgatgcagacaactcggtgcatgtgttacaccgagttgaggctatcgcaggcaagccagctcccacagaaaccggctcccacatttgattcggtccggcatacaaaatttttgctcgacgcctgttcaccaggcgccgaacggtccatcaggcttgcgtcaacgtcttcacggcacgctcaaaacgatccaggccttcgttgatgtcggcctcttccaccaccaggctcggggcgaaacgcaccacgtcggggccggcttgcaggatcatcaggttttctttttcggccgcgttgaacacgtccttggcacggcctttgaacgcatcgctgagcacgcaaccgatcagcaggcccatgccgcgcacttcggtgaagatcccgtattgcttgccgatctgctccaggcgcgccttgaacagctcgtgcttggcattcacgccggccagcacttctggggtgttgatcacgtcgatcaccgcttcggccaccgcgcacgccagcgggttgccgccgtaggtggtgccgtgggtgccgaccaccaagtgcttggccaggtcttcgcgcgtgagcatcgccgcaatcgggaaaccgccgcccaggctcttggcgctggtgaggatgtcaggcgtcacgccgtaatgctggtaggcaaacaggtggccgctgcggcccatgccggtttgcacttcgtcaaacaccagcagcgcgttgttggcatcgcacagctcgcgggcaccttgcaggtaagccagttcggccggcaatacaccgccttcgccctggatcggctccagcaccacggcgcaggtcttgtccgacacggcggctttgagcgcgtccaggtcgttgtaaggcacgtgggtgataccggtgattttcggcccgaaaccatcggagtacttcgactggccaccgacgttgacggtgaacagggtacggccgtggaagctgttcagcgcagcgatgatctcgtacttctcggtgccgaaacggtcgaacgcaacgcgacgggccagcttgaacgcggcctcgttggcttcggcgccggagttgcagaagaacacgcgctcggcaaaggtagcgtcgatcagcttatgcgccaggcgcagggccggctcattggtgaacacgttggagacatgccacagcttgttggcttgttcggtcagtgcaccgaccaatgccgggtgggcgtggcccaatacgttaaccgcgatgccgccggcaaagtcgatcagctcgcgacccgcctggtcccatacgcgcgaacctgcgccacgcacagggatgaaggcggcaggtgcgtagttgggaaccatgacctggtcgaaatcggcacgttgcaccggggcttgctcaacggacatcggagtctcctgaagaggaacgcctgcctggaactggcagacgatgcagggattgtaaggacagttttcagcgccaccttgtcgccaagcgacaacttcttatagcgccaaccccggttttacgcgggtttacggcaatgcgacatattgcgtcgcaatggcgcagtgtaaaccagcggcgaatgtttcggcacaacgctccggtatccgatcaccccatgcccttgcgatattccaatagcgccacgcccgcgccgtctgccgatttacttgagcactttaaccacgcacaaggattggcaacatgcctgactctgcacaccaaacgccgcccaaccccctttcggttcagcccgaccaacattacgcgctgctcaaaagtgccatcccgcgctggctcggcgaaacctccccgcgccgccgccaggcgctgggccaaagtgctgcgcgcctgcctcaagcagtgcgcgacacggccgcacacagccaaggcgaactcaaacgcctggccaccgcccactgggacgcgcaaaacaccgtcgaaaacgcgcttgcccacgtgcaggatgcccagcactttggtgaacctatcctcaggctcgccctgaaaacacagttcggtctggacctggatgtcagcaataccttcctgcgcctgtacatcccccagacgattcccggtttccccctccgcacgggcgccgcgcgcacctggacggtctcactgctggaggccgccctgcacaacttcgaacaccaggaaaccgaggccgacgcctatgaaagcgcgtcgaccttcatcacccgcccggacgccagaggccacttcgacaccttgccagccatcaaagccgtggtgtccattcgcgcctttacccagctgtgccgcgatctggacatcggcgcgctgtatgccgcctacctgcaagaacaactggccatgaccgagccggtcgcacacgccgtcttgcagctaaaagtggaacgcagccagaaagccgagttgcaggctgccttgcaatgggcgttgatcaacggcgacctgcaactggattatttccgactgattcagggcctgctcgacggcctggacggcatgcgcctcgacggccaggcgttgcgctaccacgacctgagcctgatgggcgcggacttgcccggcatcattgtgttcggccccgaccttgaattctcacggggtgcagcacgcctggtggcttatgtgccgggcgacccggagcacccgatcaaggaatacccctcgtcccaggccatgcaaaaagaactggtgcgccaactgcgcgatgagccttaccagcggttcttcagccgctttgtgccccacgcccaacgcggccacttcttcgccaacctgagccaattgctcggccagatcacctggcacccttacgttcagggcagcagcgcgccgatctggcgtcaaacccctaccgacaacccacgcgtacgctttgtcgccaccccgggcggtcacgacctgtggcgccaccagtaccaacgcaggctcaatcaaatccttaacgacggccgcacccgcgccgtcgccacggcgaccgtggaccgcaacgcgcgctgggcgctgtgggattcactggtgaatgttgcgtcgtcaatcctggaagccgtcacgttgatcgtcgcgcccttcgtgccgtttgccggcgagctgatgctgggctatatggcctatcaactgctcgatgaggtattcgaaggaatcatcgactggagcgaaggcctgggcagcgaggccgtcgggcacctggtgagcgtggtcgaaaccctggtgcaactgggcgcctttgccgccggcagcacgattgccatcgccgagtttcgcaacgccctgccccaaccgatcatcgactttatcgaccgcttcaaaccggtagaactgcccaatggccagacccgctattggaaacccgacctgactgcgtacgaacagccgatcagcgtgccgcccggcacctatcgcgataccgcaggcgtgttcgcgtaccagcgcaaaaacctgttgaggcacgacgccaaggtcttcgcggtagaaaaaggccaggccgccgacaccttgcatatccagcacccgtctcgccccgacgcctatcgcccgagcgtgcggcacaacggccagggcgcctggcacacggagcttgagcggcccctgcagtgggaccaggaaacactgctacgccgcctcggtcacagcgtggaaggcatcagcgaagccgaccaggcgctggcgctgaacatcagcggcaccgacgaaaacgccttgcgcaaaatgcacgtcaataacgaggcaccgccggccctgctgctggacaccctggaccgcttgcgggtcgaccgggacattcaaaccctgatcgaccggctcaacagcgatgacccccaggcctacggcaaagtggacccacaaaccaacctgcaactgctgaccggccacggctattggcccgaaacccgctgcctgcaatttatcgatgcccaagggaacgtcgcctgggcgtttggcgacgaccaactgcccgccctccagatacccgagagccacttgaacaacggcggcctgctcaaggcgatactcaccctgctgccgcccaacgatgccgccgaagcgtttggcgcggcggtcggcgattcgcgcctgagcctggacatgcgcgccgcccacctgcgtaaaaagctcgcggcgattgccgaagaaaagcgcgcgtccctgtttcaatcacactatgcaacctaccaaaccacccgcaacccacgcgcacagcgcctgatggacgccgcccctggcctgcctgcacgcctcgcggaaaaactgctggagcgcgccaccgccaaagaactggcagagttggacgcgcagcgcacgccccagcgcctgagcctgctggcacgtagcgccttcgaagaagtacgcctgagtcgcgcctatgaaggcctgcattttggcgatcaaagcctggacacacagcgcctggccctgcactcactgcccgcgatgccgggctggccggcgcaggtgcgcctggttatccgggactacgcggccaacggcaccctgcgtgaccagatcggtgccgacgatgcgcccatcgtgcgcacgttggtgcgcagcgaaaccggcgaatacaccgcccatgacgaagacggcgcactcggtgcgcccactgacttttactcggccatcctcaacgccttgcccgaaacccaacgccaggccattcattcaggcatcgatcagggcccccgcctgcgccagtacctggcgcggcatgccatcgaacgtaagcgtctgcgcgaactgctcagccccgaccctattcgcaaaccgacgtatgaccctcaagtcatgaagctgctcggcggcatggacggctacagggcacaagctgactatggtgacgggccgccgccgctgctggcccaggtacgcgagctgttccccgcgatcgacgatgacctggctcaaaccctgctcgcccacctgcaaaccctgccgtcaggtgccagcaatcagctcgcttacctgcgtgagcaacgccaactgttgcgccagaacctgcaaacctggcaggccgcgatcccgcgcatcgaccccgaaacccagcttgaaatgagcgccgggcgccgctatgacgaggtgcagacccgcaggatgatggccgagcaactggaggcgtgctggcgccgggaaaccgagcgggacgaatacttcagcactcccgaactcaacggctataccctgaggctctacggcccggggcctacagacctgccggagctgggcatggctttcaaccatgtctcactgctgtctctggtgggcgacggccccatgctcggcatcgacacttttcttgagcggttccccaacctgcgtcacctggaaatcaggtcgatcccgctgggagacttgccgccacagctcagttccatgccgacgctcaacagcctgatactgagcgactgcgacattaccctgacccaacaaagccttgaccggttaaacggcatgcatggcttgcacgcgctcgacctgcacaacaatgccctggggctggtgcccgatgtgcaagcgatgcccgacctgaccctgctggacctgtcgaccaccggcatcgaccgcgtgccgaacggcgtggtggatcgcccgcggttggaattagccatgctcagtgacaataaaatcacccaacttcccccagaactgttcagcgtcaccccgaacaccgcgaggaagttcgacctctccgacaacccacttgagccaccggcacttgaacgcgtcaaaacctattgccaggcccacggcgaatttttctcagcccaggcccctcgcgaggaacgggccaggctcatgaacctttacccgacttttctggaggccgaagcagaccgctttatcttccgcctgcccggcaacatggacgccgtcgcccctaccttgacgcgccttgaggccgaatatgcgcaactgggcaccgaccttcagcagtgggccttgaatgtacccgaccaccaccccgtcctcggcatcctgctggacgagcagaccatcgccgaggagcaactcgcgcgccagcgcttcaaggccttgcttgaagatgcctggcgtcgtgaaagcgaagaggatgaagaaagcctgggcgatcatttcacccactccgtcatccttgaaacatcgaccatgggcccgctgccggagctgagcgcaacgttcgatcatgtctccaacctcgaaatcaagggcggcggcgtcaccaacggcatcgacggcatgcttcgatgctttacccaactggaaacgctgacactcagccaatgcacattaggcaagttgccggacaccctcgcgcggttgccgaagctctcgaccctgagcctggagcaatgcgcaatcaccctgacccaggcggacatcaacctgctggctgacatgacccaacttgagtacctgagcctgaccaataacccgctgaacctggcacccgacatcagcaacctgtcgcaattggcggcgcttcatttgagcaacaccggaatcagcgaagtaccccgcggcctcttcaggctgccggatctggaaacggtggacctgagcaacaacctgatcagcgaaatcccggctgatttgctggagtcgacgacggtctatggccaggattgcgatttcagtaacaaccagttatcgccaacgagcgtgggctatctcaggcaacactacctgcgtaccggcattgattttcaggtggccgccgccactgtggacgagcacggcgtgccgctggtggtggtaggcccaacgccgatggacgagtaatcagccgcgctcggagggcaccgacgacaactcgaacgggctgctgctgcgccgctggttgcgatcttcacgcggcgtggcgccgaagaagttgcggtaggcgctggagaagtgcggccccgaggagaagccacacgacaggccgatctggatgatcgacttgctggtttgcatgagcatctggcgcgccttgttcaggcgcagctccaggtagtactggctgggaacgcggttgaggtattgcttgaagatgcgctccagttgtcgtcgcgagacgcacacatgctgggcgatttcgtcggtggtcagtggctcttcgatgttggcttccatcagcaacacggcctgggtcagctttggatggctggagcccaggcggttttgcagcgggatgcgctggcgctctccgccttcgcggatgcgctccaccaccagttcttcggaaacggcaccggccagttcggcgccgtggtcacgggccaataccgccagcagcaggtcgagtaccgacatgccaccgcaggcggtcaggcgatcacggtcccagtcgaacagatggctggtggcgatgaccttggggaaacgctcggcgaaatcgtcctgccagcgccagtgcacggcggcgcggtaaccgtcgagcaggccgagttgggccagcgggtacacaccggctgacaagccgccgatcacacaccctgcccgcacaagctgcttgagcgcagtgctcagttgggacgcgatgacggtcggcggctcgtcggccagcaggaacagtttctggaaaccttcgagcttgccggcccacggctcacccggcaattgccaggcgccgccggtggcaggctcggcgagcaggaacgacaactcgtagaccacatccggatgcacccgctgagcaacgcgcaaggcctcctcagccagcgcaagcgtcagggcttttgtgctgggccaaatcaggaaaccaattttatgggcggtcatggaatgctatccgaagcgagtaacggtaatgaagacaagggccaatgctagcccggaaaccaacacaaatctcaaaacatatagcgttccaatgtgggagctggcttgcctgcgatggcggtgggtcagtgagcacatctgtttctgatacaccgctatcgcaggcaagccagctcccacaggggattgggatctatttcaagactgcgaagcatgcactaaaccggtgcacaaaagcagccttgattacttcaggctgcccgacaggaactgctgcaaacgctcggactgcgggttcaccagcacttcacgcgggttgccacgttcttcgacgatgcctttgtgcaaaaacaccagctggttcgacacttcacgggcaaagcccatttcgtgggtcacgaccaccatggtgcggccttcctgggccaggtcctgcatcaccttgagcacttcgccgaccagttccgggtcgagggccgaggtcggttcgtcgaacagcatcacctcaggctccatcgccagggcgcgggcaatcgctacgcgctgctgctcgccaccggacatatggccggggaacgcatccttacgatggcccacgccgactttggccaggtaatgctcggccttttcgcgcgcgtcttttttcgacatgcccagcacgtgcaccggcgcttccatcacgttttcaagcgcggtcatgtgcgaccacaggttgaaatgctggaacaccatcgacagccgcgaacgcatacgctgcagctgcttcgggtcggcggccttcatggcgccgtccttgttggccaccagtttcagctcttcgttattgagcagaatcttgccggcgtggggttgctcgagcaggttgatgcagcgcaaaaaggtacttttgcccgaaccactggagccgatgatgctgatcacatcaccggccgcggcggccagggacacacctttgagcacttcatgactgccatagcgtttatgcaggtcttggacttcaagtttgtacatgcggtcggttctcacaaaaacaggtggtcagtcgttgagcaagcgcccgtgacgcagcgcttcgcgccccgccaccttggccagccagaaacccgcttgggcataacgtagccgttcaacggcaaacaacacccccgaggtgcccgcgcagacaatgctcacgcgatcagtcagagggtcaatcacttcaaaaatctcatcgcccgcttcaacccggtcaccggctttacgcaggtaactgatcacaccggcatgcggcgcgaacagcagttcggtgccttcgaagggcaagccttcgcagggttcgtgctgcggcgcgggccattcgcctttgatcaggccttgctcggcgaggaacgcgaggatgccttcagcgtggaagatcgcttcgtcgcggcccgtgtcagcctggccgcccagctccagcgtggtcgccaggcaagccagtggaatctgcgcgtccgggaatgcccgcgacaaacgcaaccatggcagcgagcaggcttcatcgaacgaactgccgccggaatcttccgccagcaacccgaccttcacattcaaatgcgccgacaacgaacgccactgcggccagtgctgcggcagcgcgtacatgtgcagcgcggcttcggcgtcgcaatgcaggtcgaggacgatatcggccgtacaggcgtggctgagcagcacccgttgcatgccttgcagctggctgctcggctcaggtaacgcggcgagtgcatcggtcattgcctggcgaatcatgcgcacattggcgtgcgggtcatcgcccagcttgcccttgagccgttcggtaaccggctcgctcaactcgacgaaatcacggttgaagttcttgccgctgccgacctcgaaacggccttggtggctgccttgcagcagctggcccaggcccatcgggttggcgactggcaccagctcgatcacgccattgagcgcaccttgctgttccagttcggtcaggcgctttttcagttcccaggcggcgcgcatgccgggcagttcatcggcgtgcaggctggcctggatgtaggccttgcgctcgccgctgccgaaacgaaacacgctcagctggcgctcgcagcccaggtggccccagggcaacaggtgatcgatacgttccatatcagtgcttccgtggagccaggtagctcagccagcggcgctcggccaacttgaacaggcgcaccaggataaaggtcaggcacaggtagaacacgccggccgtgatataggcttcgaacggcaggtagaactgggcgtttaccgtgcgcgcggcgccggtgatgtcgatcaaggtgacgatggaggccaggctggtggtctgcagcatcatgatcacttcgttgctgtactgcggcagcgcccggcgcaaggccgacggcagcaggatgcggcggtacagcttgtagcgcgacatgcccatggccttggccgcttcgatctcgccgttcggcgtggccttgaggctaccggcgatgatctcggcggtgtaggcgctggtgttgattgcaaaggccaggcacgcgcagaacgtggcgctggacagcagcggccacatgaagctctcgcgtaccgcttcaaattgcgccaaaccgtagtagatcagaaacagctgcaccagcatcggcgtgccgcggatcacgtaggtgtagagccaggcggcgccattcacgatcggctgcttggacacgcgcatcaagcccaaaggcaaggcggcgagcaagccgaagaacagcgagatggccaacagtttcagggtggttaccaggccgccgaggtacagcggcatggcctcccagatgacgttgtagtcgaagatcatagatcagccgcccttacgcctaccgagtagcgcttctcaagatagcgcagggccagcaacgacacgctggtgatcaccaggtacatcgccgccactgcgaggaagaaggtaaaaggctcgcgggtggcatctgccgcctgcttggccttgaacatcatgtcttgcaggcctaccaccgaaatcagcgcggtggccttggtcaataccagccagttgttggtgaaaccagggatcgccagccgaatcatctgcggcaccatcacccggaaaaacacctggaaactgctcatgccatacgcaaggccggcctcggcctggcccttgggaatggccatgaaggcgccacggaaggtttccgaaaggtaggcgccaaagatgaaacccagggtgccgataccggcggccaaggggttcaagtcgatatagtcgtcatagccgagcatcggcgcgacgcggttgagcaagtcctgaccgccgtagaaaatcagcaggatcagcaccaggtcggggatcccgcggatcaccgtggagtacaagtcgcccagccaggccaaccagcgcaccggcgacaggcgtaacgcgaccccgatcagacccagaacaatggccaaggccatggacgacaaggcgagctgaagcgtcaaccatgcgccatcgaggatgacggccccgtagcctttcaacatgattcaggtcctcgaaaagggggatgaaaaaatggcgcaaaccgcaggaattctgttgcttgcgccattctggacagacagctaggacgagttacttagggtcagcgccgtaaatatcgaagtcgaagtatttgtcctggattttcttgtattcgccgttggcacggatcgctgcgatggccgcgttgatcttgtccagctcggccttgtcgcctttacgtacagcgatgccgatgccgtcgccgaagtacttggcgtcggtgaactgtgggcccacgaacgcgtagcctttaccggccggggttttcaggaagccgtcttgcagcagggtggcgtcagccacggtgccgtcgaggcgaccggcttccacgtccaggtagatttcgttctgcgagctgtaaggcacaaccgtggcgcctttaggggccaggacttccttggcgaagcgatcgtggatcgaaccgcgttgcacgccgattttcttgcctttcaattcatccaggctgtcgctgacctgggtgccttccttcatcaccagctgggctgggctcaggtagtagcggttggtgaagtccacggacttcttgcggtcttcagtgatggacatggacgacaggatggcgtcgatcttgcgcactttgagcgcagggatcaggccgtcgaattcttgctcaacccatacgcacttgaccttcatctcggcgcacaaggcgttgccgatgtcgtagtcaaacccgacgatgctgccatccggcgccttcgaggcaaacggagggtaagccgcttcgataccaatcttcaggggcttttcatcagcgaaggcctgcatcgacagcacggacagcgccagggcgcccaacagcacaagtttcttcatcttgggactccatcggtatagggcaaaaagcagaatgagccagggcccacgatgcgacttaagtgaaaccgaatagcggtgctgcgtcctaccccgaattacgacgggagacgacgagcgagtgatcggcattctaacgacaggccggaagccgatatttcctcaatgcgacaacaatttacagaagcactgagaaagcggttccagcacattgacagcctctgttttttatgcagagacaaaagatattaaacctgttgatgctgcaaattgcgggcctattattcgcaaacccttctagcacggcaagtctggcgtttaatcttatttctgagggtgtctaaaacgcgggttttcagggcataggtgtagcacatcgcctcaggattgggcgcggggttacacatttgctggtctcggtaacattcagaaacgtcctacgcgctaagtcgatatttattggcctacgcatagatcgttctcacgctctgcgtgggaatacatcctgtgacgccctgcgtcacgcctcaagagcagacgcagagcgtccagggcggcattcccacgcggagcgtgggaacgatcattgtggtatgcacgccaaaggtgggagctggcttgcctgcgatagcggtctgtcagccaacccacctgtgcctgacacaccctcatcgcaggcaagccagctcccacagtgatccggtttcgccagtgatatttattggcctacgtatagatcgttcccacgctctgcgtgggaatgcatcctgtgacgccctgcgtcacgcctcaagaccagacgcagagcgtccagggcggcattcccacgcggagcgttggaacgatcattgtggtatgcacgccaaaggtgggagctggcttgcctgcgacagcggtctgtcagccaacccacctgtgcctgacataccctcatcgcaggcaagccagctcccactgtgatccggtttcgccagcgatatttattggcctacgcatagatcgttcccacgctctgcgtgggaatgcatcctgtgacgccctgcgtcacgcctcaagagcagacgcggagcgtccagggcggcattcccacgcggaacgtgggaacgatcattgtggtatgcacgccaaaggtgggagctggcttgcctgcgatagcggtctgtcagccaacccacctgtgcctgacacaccctcatcgcaggcaagccagctcccacagtga

SEQ ID NO: 56 - DNA, 85529 bp, Pseudomonas poae FL10F
tttttctccgctttcgaccgagaagatcgaaacgttaatagagccaaacaacaccgctctaccaactccttctgggcctcgatgaactgaagcaaatcgctgtcgaattctgcgtaactctttgtttaccaacgagttttccgtttcgactgcgccggaagtggggcgaattatagacttccagattctgccgtcaacccttaatttggcttttctatcaaacaagcgaaaaacctacaattcccttctatatagagagccaaacagatccaagtgagcaatatattgctcaaaggcaaactgttaagcatcatatgccttctgcttctctactatgactttggacgaacaccctcaatgaccaccccaccccgcagcctggcctcggcattgtttcccgtcggcctgctgttaatcgccatggcttccatccagtccggcgcgtcgctggccaagagcatgttcccgattgtcggcgctcagggcacaaccaccctgcgcctgatattcgccagtgtgatcatgctgcttctcttacgcccctggcgcgccaagctgaccgccaagtccctgcgcacactcgtcatctatggcatggcactgggcggcatgaacttcctcttctatatgtccttgcgcacagtgcccctgggcatcgcagtagcgttggaatttaccggcccactcgccgttgccatctacgcttcgcgccgagcggtggactttctctggatcggcctggccatcaccggccttctattgttgataccgatgggagaagccagcagcggtatcgacctgaccggtgccgcctacgccctgggcgccggcgtctgctgggcgctctatatcctgtttggacagaaggccggcaatgacaatggcgtccagactgccgccctcggcgtgatgatcgccgcactgtttgttgcgccgatcggcatcgtccacgccggcaccgcactgcttacgcctgcgttgatccccgtggccattggtgttgcgattctctccacagccttgccctacaccttggaaatggtcgcgctcacccgccttcctgcccgcaccttcggcacgctgatgagcatcgaacctgctttcggcgcgctgtcgggcctgttcttcctgcaggagcatctgtccttggcgcaatggctggccatcacctgcattattctggcttccgtaggcgccacactgacgatgcgcaacgaatccaaaccgttggtgccagcggactgatcatctttaaaggtaggtctggtatttaccgttcatttaggccatgtttaagccgtaaacgaaggtcattcatggagaatttcgacaaggacagctgaacgctacaatcgagagcgagtagagcctgcttcgagcctttttgcgcagcggctattaaggataggaatgaaacgaattttgatactgttactggtcgtgggcattgcgggctgtgctgcgaccaccaagacagaagtgaaacggggcaaaaaagggctgcatatcaactgttccggcctgtcctcctcctgggaccagtgctacaccagcgcaaccaactcatgtggtgccaagggctaccgggttatcgccaaatccggtgacaattccgaagagccgggcgactaccctttcggcctcaaccctgccggctataccagccgcagtatgatcgtcatctgtaaatgaccgcccgagcagtccacgtccgactgctcccccttcttgaattgctgacatcgacccggccattcgcgacggggcggctacactcctgctcgacaatcgagcaacggagttcccatgacgcacaacaagaaaatcgtattggtagtgggggctggtgatgccaccggcggcgccattgccaaacgcttcgcccgcgagggttatgtggcctgtgtcacccggcgcagcgccgacaagctgcagcccctggtcgacagcatccagtcagcaggtggcgaagcccatggctttgcctgcgatgcgcgcaaagaagacgacgtcatcgccctgatcgaacagatcgaaaccgagctggggcccatcgaggcgttcgtcttcaacatcggcgccaacgtgccgtgcagcatcctcgaagaaaccgcacgcaagtacttcaagatttgggagatggcgtgtttctccggtttcctgaatgcgcgcgaggtggccaagcgcatggtcacccgcaaccgcggcaccatcctcttcaccggtgcgactgccggcttgcgtggcggcgcggggttcgcggcgttcgccggggccaagcatggcatccgcgcactcgcgcaaagcatggcgcgagaattgggccccaggaacattcacgtcgcccatgtggtggtcgatggcgccatcgacaccgacttcattcgcgacaacttcccgcaaaaatacgcccagaaagaccaggacggcatcctcaaccccgagcacatcgccgacaactattggtacttgcacagccagccacgcgacgcctggaccttcgaactggacctgcgcccctggaatgaaccctggtaaccccagccaaaaaacaacaataagcagcgagcatcgaccatgagtaaaaccctggaattcttcttcgacctcggcagccctgccacttacctggcctacacccaactccccgccctgtgcgccgaaaccggcacgcaactggtgtatcaacccatgctgctcggcggtgtgttcaaggccaccggcaacgcctcgccgatcaccgtccccgccaagggccgctacatgtttaatgacttggcgcgctacgcccagcgctacaacgtgacgctcaggttcaacccgcacttccccatcaacaccctggtgctgatgcgcgcagtcaccggcatacaactacaccagcccgaacgcttccaagccttcatcgactgcctgttccgcgccctctgggtcgaaggccgccacttgggcgaccccgctgtcgtagccgcagtgttgagcgaggccggcttcaacccagaagacgtgctggccctggccaatgacgaaagcgtgaaagccgccctcaaagccaacaccgagcaggccgttcagcgcggcgtgttcggtgcgccgagtatgtttgtaggagaccagctgttcttcggtcaggaccgtctggaatttgtgcgcgaagccctcagctagaggttgatagccaaccgcccttgagcgccgccagtcggcccgggtcaaggcatttgtcgactatatggccgacgccctggcccaggcccccgaactgcagccgatcaaatagccgctgtgcgcacctgcaaccattccagcgccgccccgctcagcaacgggctgaggcgctcgcgaacttcggcgtggtaggcgttgaaccactcgcgctcatccgccgtcagcagcgacggctccaggcaacgggtgtcgatcgggcacaaggtcagggtttcgaacctaaggaattcgccaaactcggtcttgcccgcttcacggttcaacaccaggttttcaatgcgcacgccccaacggcctgggcggtaagtgcccggctcaatcgaagtgatcatgcctggctgcatcgccgtttgcggtgcagtggcagcctgataggcaatcacctgcgggccttcatgcacattcaggaaatagcctacgccgtgacctgtgccgtggccgtagtccacgccttcggcccagatcggcgcgcgagcaatcgaatccagcagcggcgacagaatgcccttggggaaatgcgcacgcgacaaggcaatcacgcccttgagcacgcgtgtgcagtcgcgcttctgttcttcgctcggcgtgccgatcggcaccatccgcgtgatgtccgtggtgccgcccaggtactggccgcccgagtcgatcagcagcaaaccatcgccttcgatcagcgcgtgcgcttcttcggtggcgtggtaatgcggcatcgcgccgttggcgttaaaggcggcgatggtgttgaaactcagcgacacataaccggggcgacgggtacgggcggctgtcaggtgttcatcgatggtcaactcggtgatgcgttcacgccccagcgcactgtccagccaggcgaagaattcgcacagcgccgcgccgtcctgctccatggcttggcggatatgctcggcgtccgccaggctcttgcgcgatttggccagcgtggtcgggttcagcccttcgatcagcttaacgccggcatcgaggttttccagcaaaccggcggtcacccgcgccgggtcgacttgcaggctcgcgccggacggcaccgcacgcagcgcatttgccacttcgctgtagtcgcgcagggtaacgccatcctgctccagcaccgcacgcagctcggcatcgactttgctcagcgccacaaacaacgtggcttgctgctgattgatcaaggcaaacgacacaaacaccgggttgaacgacacgtcaccgccacgcaggttgaacaaccaggcgatgtcatccagggtggcgatgaagtgccagtcggcgcccttctctttcaagccggcgcgcaacgcggcgagtttttcgccacggctgacggtggcctggggtggcaggtgttgatagatcggctggttcggcaaggtcgggcggtcttgccagacttcattgagcaggtcgatatccgtacgcaaacgcgcgccgcgctccgccagcttgccgcccaaggcacgcgccgaagccacggccatgaccgcgccgtccaccgccaccactgcgccttccggggtttgttcggccagccattccagcgggccgggttggccgggctgcaacttcaccagctcaatgccgctgcccttgagttccttggtcgcctgctcccagtaacggctgtccgcccacacaccggcgaaatctgcggtgacaatcagcgtgcccaccgagccatgaaaccccgacagccattgccgcccctgccagtaacccggcaagtactcggacaagtgcgggtcggccgacggcaccaacagggcatgaatgccctcgcggctcatcagttcacgggtatgcgccaggcgctggggaaccgttccatgggtcaaaggctgcgtactcattgtgtctcctgctaaccactaataattgttatgtgctgcgaatgaaaaatcagacggcccagaacgccggtgcactggcgagtgcggccttgatcaactgcacagcctggtcgatgtcctgctcggtggtaaaccggcccaggctcaaacgaatggtgcgaccggcgctgcgagcgtcatggccgagggccaaaagcacgtgggacggcgcattgctcgccgaattgcacgccgaggtcgccgaaaacgccatgcctgcgctgagcgcggcggcattgaactcaccttcgctgaacgtcaggctgagggtatgcggaatacgctgggtggcactgccattcaggcgcacacccggcactgattccaactgatcgagcaggcgctggcgcaaggcaacgatactggccttttcttcaacaaaggactgcgccgccaaggcaaacgcggtgcccatgcctgcaatctgatgcgtcgccagggtgccggagcgcaggccgccttcgtggccgccaccgtgaatctgcgccaagaccttctgctgcgcccgcgggccgacatacagcgcgccgatgcccttggggccatacagcttgtgcgcggaaaacgacatcaaatccaccggccattcagccaggtcgattgccactttgccggcaccttgcgccgcgtccacgtgcagcaacgcgccgtgttcacgcacccgcgcgccgatggcggggatatcgttgacggtgcccagctcgttattcaccagcatcagcgagaccagaaaggtgtcttcgcgcaaggcttcgctgaccgccgtggcgctgatcaacccgtcggcgtccggcaccagataggtcacggccacgccggcttcctgcaactggcgcgcggtgtccagcgtggccttgtgttcgatctggctggtgatgatgtgcccgcccgccacgccgcgcgcctgggcgacgcccttgatcgcaaggttgttggattcagtcgcaccggaggtccagacgatttgctcagggctggcaccgaccaagtcggcgacctggcgccgcgcctgctcaaccgtttgccgggccgcctggccgaacgcatgggaactggacgcagggttaccgaaattggcattgaagcccagacactcgaccatcacttggataacccgctcatccaccggcgtggtggcggcgtagtcgaaatacaacggacgtttattcatgacgtttaagactcgcagagcgtattcccgagaacagcgtctcaggggcatcaaccggaacagaggtcgtcaggtttaaccgatcgaatgccattaaaaaaggaccactttaggcaattgtgcgtaggaacgctcctgaaactcagcttaacaggctgaagtcgcccaatggcaaacaaaaagcccgaggttccataagggaatcctcgggctttttgccactgagcaccggctcaactgggacgaccatgcagtaccacactgcgttcggcgttcatttcgccctggtgatcgaaaccaaagggcttctgtggctggccggtcagcgcggcacgctgctgttggtattcatcaaacgacaggccgcgacggctcaaagcctccagagccaactgtttggtttcttcggcggtgtaggggcgcgattcgggcgatggatgggtcgcacatccggagaggacggcgctgacaacaatcaaggaaacggcgagaaagtggttcatggtgaaggccctgcaaaggaggtttcgagtcaatgaacacaggctactcctgcccttgcgcggtgaaaaatcaccgcccgtgatagtcgctatcaaccattcaggcacttgcgatagcgagccctttatattcttttaaggtctataaatatggaaatacgttcatttacggaataaacctaaccctctataaatagcctcacacagatatcaacactgttcgccacgcaactgttgcccaggcaacagtcattcaacaaaaccccaggcagccaacagcttcacttttcagcagtgagcctgcagcccacgccaaacaaggcttccagccgttggtacagctcttgctcaacacatttcacttcactcgctatgtacctctgttgaaaaaggaactgttcatgacccgtcccctgaatgtcgtagccctgtccggcggcacctggcgcccatcgcgcaccctcgtgctgacccaagccgtgctggccgagctggccaccttactgccgatccagaccacactgatcgaactgggcgatatcgcccggccattgggcggtgcgctgtcgcgtgacgagctgccggccgaagtcgaatcgcaactgttggccatcgaacaggccgacttgctgatcgtcgccgcgccggtgtatcgcggctcttaccctgggctgctcaagcacctgttcgacttggtcggcctcaattcgctgatcaacacgccggtcttgctcgccgcaaccggcggcagcgaacgtcacgcgctggtgctcgatcaccagttgcgcccgctgttcagcttcttccaggcattgaccctgccaatcggcgtgtacgccaccgaggctgacttcaccgactaccaaataaccagcgagcccttgaagggccgcatacgccttgccgcagaacgtgcagcgcctttgtttgccgcgcactccccttctctgctgaaaatcgcttaaggatttgtcatggatgttttctggttcctgcccacgcatggcgacggccactacctcggcaccacccaaggtgcacgcccggtcacactcaattacctcaagcaagttgcgcaagcggctgacagcctcggttactacggcgtgctgattcctaccgggcgttcgtgcgaagactcctgggtcatcgcctcggcgctggtgccattgaccgaacgcctgcgttacctggtggcgattcgcccgggcatcatttcgcccaccgtctcggcacgcatggcggccaccttggatcgcttgtccaacggccgcttgctgatcaacgtggtgaccggcggcgaccccgacgaaaaccgtggcgacggcagcttcctcgatcacagcgaacgctacgaagtctccgacgaattcctacaaatctggcgacgcgtattgcagggcgaatcagtggatttcgaaggcaaacacctgcgcgtacagaacgccaaggccctttacccgccggtgcaaaagccgtatccgccactgtacttcggcggttcttccgacgccgcccacgacctggccgccgaacaggtcgacgtgtacctgacctggggcgagccgcccgccgccgtcgcggaaaaactcgcggatgtgcgtgagcgcgccgcacgccacggccgcacagttaagttcggcattcgcctgcacgtgatcgtgcgtgaaaccgaagaagaggcgtggaaagccgccgacaaactgatcgaacacattagcgacgaaaccattgcagccgcgcaaaaatccttttcgcgctttgactccgaaggccaacggcgcatggccgccttgcacgacgggcgccgcgacaacctggaaatcgcccccaacctgtgggccggcgtcggcctggtacgtggcggcgccggcacggcattggtcggcaacccgcaacaagtggccgagcgcatcaaggaatacgctgaccttggcatcgagagcttcatcttctccggctacccgcacctggaagaggcgtatcgctttgccgagctggtgttcccgttattgccggaaccttacgccagcctcgccgggcgtggcgtcaccaacctcaccggcccgtttggcgaaatgattgccaatgatgtgctgccgaaaaccaaggcctgagtgctgtcagctcggcttatgtgagagcggttttttgtggcgagggagcttgctcccgttcgactgcgcagcagtcgccagctttgggggcgctgcgcaccccagcgggagcaagctccctcgccacaaaagccagctcccacattttggcttcattgccaaacagacattgaggaaaccccgtgacagccaaaccccacagcgtcctgccctcgccgctgcaaaccgccaaactgctggccgccgagttcgccctcaccgccgtcgaacgcgatgagcgtggcggcaccccgaaaaccgaacgtgacgccctgcgccacagcggcctgctggccctgagcattcccacccaatacggcggcctcggcgcgcgctggagtgaaaccctgggcatcgtgcgtgagttcgccaaggtcgacagctccatcgcccacgtcttcggcttccaccacctgatgctcgccaccgtgcgcctgtttgcgcgcccggaccaatggcaaccctggttcgaacagacagcgcgcaaaaactggttctggggcaatgccctcaacccgctggacacgcgcacggtggtcaaggatttcggcggctggcgtgagttctccggtaaaaaaagcttctgctccggcgccagcgactcggaaatgctcatcgcctcggcggtggatgaaagcgccggcggcaaactgctgatcgccgcgatccccagcgggcgcagtggcatcaccttgcacaacgactggaacaacatcggccagcgccagaccgacagcggcagcgccagcttcgagcgggtgcgcgtcgaggaatcggaactgctcctcgacccaggcccgctgagcacgcctttcgcctgcctgcgcccgctgatcgcgcaattgacattcacgcatatgtttctcggaattgccgaaggcgccttcgaagaagcacgcaattacaccctgaccgaaacccgttcgtggcacaaatcctcagccgacgacgtgcgccaggacccttacgtgctgcaccactacggcgaattctgggtcgcactggaaggcgtgcgcctgctggtcgaacgcgcggccgacttgctcgaccaggcctgggccaaaggccccaacctcagcgaacacgaacgcggccaattggcgattgccatcgccaccgccaaggtcgccgccacccgccaaggcctggacctgtgcagccgcctgtttgaagtcaccggcgcacggtccacccacgcctcgctgcgcctggaccgccactggcgcaacctgcgcacacaaaccttgcacgacccggtggactacaaactccacgaactgggggactgggccttgaaccaatccctgccgattaccacgttctattcctaagagaggtgcccatgcagcttttaaccttaccgccctcgcccgcccttgcgacgtcgatccgcgccacggcccaggtctttgaagaccccaaatcccaggcgctgctcgaccacatccagcaagtggcgcccagcgaagccagcgtgctgatcatcggcgagaccggcaccggtaaagagttggtggcgcgccacatccataacctcagcgcgcggcgcaaccggccgtttgtggcggtgaactgcggggcgttctctgaatcgctggtggaagccgaattgttcgggcatgaaaaaggcgcgtttaccggcgccctcagcgccaaggccggctggttcgaagaggccgacggcggcaccttgttcctcgatgagatcggcgacttgccgatggcgatccaggtcaagctgctgcgcgtattgcaggagcgtgaagtggtgcgcctgggttcgcgcaagagcattccgattgatgtgcgggtactggcggccaccaacgtgcagttggaaaaagccatcaacgccgggcatttccgcgaagacctctactaccgcctcgacgtggtcagcctggaactcagccccttgcgcgagcgccccggcgatatcctgccgctgacccggcacttcatcgaagcctacagccagcgcctcggctacggcccgatcaccatcagccgcgaggccgagcacaaactcaaaagctacagctggccaggtaatatccgcgagctggaaaacgtgatccaccacaccctgttgatctgccgtaacggcgtgatcgaacgcgatgatttgcgcctgtcgaacatgcgcatagaacgccaggacgacagccagcacggcaccgacaacagcgccgaagcgttgctggcgcgggcctttcaaaagctcttcgaggaacaggccggcgccttgcatgaaaaggtcgaggacgcgttattgcgtgctgcctaccgcttcagccattacaaccaggtgcacaccgccaacctgctgggtttgagccgcaatgtcacgcgcacccggctgatcaagatcggcgagttggcggtgaacaagcgccggcccggcgaaaacctacaaggcgagcggatgttgcacctatccatttaggcggcagtgcaacgcgttgtcatggctgcgctcaaaactgcgcagcacctggaatgaaccgaaggtcaccgccgtggcctggtgggcgcggatcagcgtccaaaaaccttcctcgccgtgctcaaagcatttaaacgcggcctcgccctcctcgcgcgtgcgccactgcaggtaattgagcacccgccggccgtcatcgctgacttgcacactcgcattgataaagccgccatggccctgggccaagcgctcgctctgggtggacaaggccgccaccagcgcgagttgctgccggggctcgacctgaaactcgatcaattgagtgaagctgagattcttctctgatacctgcatgaacactcccctctctctgtaggcagaatcttgcgattcgatgccacgcagggtaaaacctctagttaagtcaaggtcaagcgtttatctggagtttttatgcttaccaagcaactcaccgtcggccaactcgccgctcgcagcggagtcgcggtcacggccctgcatttttacgaagccaaggggctgatcaagagcaatcgcaatgccggcaaccagcgccgctatccacgggatgtgttgcggcgggtggtggtgatcaagatcgcccagcgtttgggtattccactggcgacgattggcgaggcgttgcagaccttgccggatgggcgcacaccgacgactgaagactgggaacgcctgtcggcgctgtggcgagaagatttggatgatcgcatcaacaaattgttgctgctgcgcgacaagttgagtggctgtattggttgcgggtgtttgtcgttggaggcctgcccgttgcgcaatcaggatgaccaactcggtgaacgcgggccgggcgcccaattgctggagcccaccaccgcctcctgatctgcaaccccaatcactgtaggagctggcttgcctgcgatgcagacacctcggtatctcaggcacaccgtggtgatgctatcgcaggcaagccagctcccacatttgctctgcgttgaggctcagaagcctggggcaatctggcctttatagcgggtcaaaataaactggcgcacttcatcggagttcaacgccttggccagcttctgaatacgcgggtcgttgatgttgtccggccgcgccaccaggtactcgacgtacagcgatttgcccttctccacaatcaacgcactgttggtatcaatccccgcttccagcgcgtaattggcaaacacaaaggccaaatccacctggctcaccgaacgggccagcaaagcgccttccagctcacggattttcaggtgcttggggttctcggcgatatcgcgtggggtgctgagggtgttgctcgggtccttgagtttgatcagcccggcttcatccagcagcaccagcgcgcggccggtattcaccgggtcgttggggatcgacacggtggcgccgtccttcaactcggcgatgtttttgattcgcgtcgaataggcgccaaacggctcgatgtgcacgcccaccactggcaccaggtcggtgtggcgagtcttgttgtaatcgtccagaaacggccggtactggtagtagttggcgtcgatgttcttcagcgccagctgctggttgggctggataaagtcggtgaagactttgatctgcaaatccacgccctccttggccagcaccggtttgacgaactcgaggatttccgcgtggggcacgggggtcgcgcccaccaccaaggtctcgttggcgaacgcattgaacgacaggacagcagccaaaatggccagggactttttcatgaatgctccaaagacagctttataagaattaacggcggctgtaacgcgccaccaaacggtcaccggtcatttgcagggcctgtaccagcaccagcaacagcaccacggtgaccaccatcacgtcggtctggaaccgctggtagccgtagcgaatcgccaggtcacccaggccaccgccgccgatcaccccggccatggcggtgtagtccaccagcacaatcgcggtgacggtcaccgccgccagcagcccgccgcgggcctccggcagcagcgtgtggcggatcacctgccaggtactcgcgcccatggcttgggtcgcctcgaccacaccgcggtcgacttcgcgcaacgcggtttccaccagccgcgcaaaaaacggcgtgcagcccaccaccagcggcgggatggtgcccggcacgccaagggaggtgccgaccagcaaggtggtcagcgggatcagcacaatcagcaaaatgatgaacggcagcgagcgcagcacgttgaccaccaccgacagcagccgatacaccaccagcgcttcgtgcagctggcgcttgccggtcaaaaacagcagcacgcccagcggcagccccagcagcacggtaaaacccagcgcggcgccgagcatgctcagggtttcgaggcaggcttggccgatgtcggcccagtagatgtgtttaaaccactcggccatggcttaggaccaatcgtgacgtggcggcttggtgccattgagcaaccagttgcccaccacgtggtatttccagcgcaccgggtcgtgcagcgtgtgcacccgcgcgttgcgccagtggcggtcgaaattgtgtttcttcaaggtcgagcgcgtgccgccgagttcgaacagcttgttgctggcttcgatggcgatttcagtggtcagcaccttggcccgcgccacggccagggaagcatgggcgacgttgtcttcattcggcgccgggcgtgccgcgtccagggccaaaccggcacgctccaacagcgcttcagcggcttcgagacgaatatccagggcaccaacctggatgatggtcagcgggtcttcactggctttttccaccccggcgtctatccatggccgcgcaaattgctgcacgaactgcacggtgtcacgcaaggcggcgcgggcaatcccggcgtcgatggcggcagtggtcagctgtgcgaaagggccagccagagtcggtgaatcataggatttatgcgtaggaaacacattgaaggccggcacccgcaggttctgcgcgagcaccgtgccacttgaagtcgtgcgctggcccatgctgtcccagtcatccaccaccaccaggccttcggtgccacgcggcacaaaagccaactgcgcattttgctgctcatccagcgccagcaccgccaaccagtgggcgtacagcgaaccagtgcaataacctttgcggccgttgatcacaaagccgtcgccaacgcgtcggacgctggcctgaatgtcctgcacgttcttgccgccggtttccgacagcgcattggcaaaccgatggccttgcagcgccaggccgaagaaatgcgcctgctgctcgggcgtgccttgcaggcgaatatcttccagcaggcagtaatggttctgcgggatttgccccagcgacgggtcggccgccgagataatcgcaatcacctgggccagcaccgcgtaggacacctgcgcgccaccaaattcgcgcggcacgctgatgccccacaggccgctgttggaatacaggtcgaccacctcggcgggcacctggcggctgcggtcacgttcggcgtcctgctcgagcagcacggcggcgacttgatgggccacggcaatcgcctgggcttcatcgcggatcagttcagcgtggggcgtgtgaatcgggtaatcggcagatacaggcagtacagacatacaacgctctcgggcgaatggtttacctgatgcattgcagcttctgtgccgagccggaaaccgctggtttggccgcaaaatcgcgatccaaaagcgcctttggcgcagcaatctgcccgttcactgttgcctggccaacacctcgtcggctacccgcaggccgcatgatacgtggcctatagtgaaaaggccgtgcctgtccaaccaccacctgtggagaacgatatgagcgttaaacctatccccgagggttatcacagcgtcacgccatacatggacatcgacaacgcgagcgatgccattgagttctacaagaaagcctttggcgccacccaggtcatgcgcctggacatgcccgacggcaaggtcggccacgccgaactgcgcattggcgactcggcgctcatgctcggctcgccctgcgctgacatggccttgcgcaacccggccgaacacaccagtgtcggcctgcacctgtacgtgaacgacgtggatgcgcaattcaaacaagccgttgcggccggtgccagcgtggtgtccgagcccaaggatcagttttatggcgaccgctcggcgagcgtgaaggatccgtttgggcacctgtggtttttggctacgcgccaggaagacctgaccgaagcgcagatccgggagcgggcgatggcgatgttcaagcaaggctgagatctcaacagcaatacatatcccatgtcggagctggcttgtgtgggagccctcagcgtttgagagatctaggctcctacacacttcatgaacaacccctccacgctttcccccttgccccgaacgccgcgtgattccacgatgcaggcaatcatcacaaggagtcattccatgttcgccggattccaaaaagaccagtgccacgtcaatggcgtggacatcagctaccgcaaaggcggtacaggtcccggtctgctcctgctgcacgggcacccgcaaacccacgtcatctggcacaaagtcgccgaacaactggccgaacatttcaccgtggtggcggccgacctgcgcgggtatggcgacagcagcaagccactggccgacgaccaccatgccaactactcgaaacgcgaaatggcccgcgacggcgtcgaactgatgcaagccctgggcttcgagcagttctcggtgctggcccacgaccgtggcgcgcgtgttgcccaccgcctggcgctggaccacccaaaggccgtgcaacgcatggtgctgctggatatcgcgccgaccctgtcgatgtacgcccagaccgacgaagccttcgcccgcgcctattggcactggttcttcctgatccgcccggcgccgttgcccgaagcgctgatcgagagcaaccccgagctgtacctgcgcagcgtgatgggtagccgcagtgccggcctcaagccatttaccgatgaggccttcgccgaatacctgcgctgcctgcagctgccgggcaccgcgcgcggtatctgcgaggactaccgtgctgccgccggtatcgaccttgaacacgaccaggcggacatcgacgccggcaatcacctgaacctgccgttgctggtgatgtggggcgccgaaggcaccgtcggccgctgtttcgagccgctcaaggaatggcagaaagtcgccaccgacgtacgtggcaaggccctgcccgccggccattacatcgccgaagaagtccctgaactgttgctgggcgaggtcctgaccttcctgcgctgaatgctgtaaccccgtgacctgaaagacccgcctcgcaggctgctgatggcctgcgacgggttctgcttgcccaaaaaacgattgagataataacaatgacactcaaaaaactgctgggaaccctgtacgtacaggtgctcatcgccatcgcgctgggtgtgttgatcggccacgtctggccgcaagtcggcatcgacctcaagcccttgggcgacgggtttatcaagctgatcaagatgatcatcggcccgatcatcttctgcacggtggtctccggcatcaccagcatgcacgatgtaaaacaggtgggccgggtcggcggcaaggcgctgctgtacttcgaaattgtctccaccatcgccctgctgatcggcattctcgcagcgcacctgttgcaccctggcgtgggcttcaatatcgatgtgaagaccctggacagttcggccatcgccggcttcgtcggccaggcgcagcacagtgaaggcgtgaccggctttctgctgaacgttatccccggcacctttttcgatgcgttcgccaagggcgaaatcctgccggtgctgtttatttccgtactgttcggcctgggcctggtgatggtcggcgaaaaggcccggccactggtgggtgtgatcaaccaggccagcgaggtgtttttccgcatcgtcggcatgatcagccgcgtcgcgccaatcggtgccttcggcgccattgccttcaccatcggcaagtacggcgtgggttcgttactgccgctgctgaagctggtcggcaccttttatgtcaccgcgtttttctttgtcgcggtggtgttgggcagcattgcgcgttacgccggcttcagcattttcaaattgatgggctatatcaaatcggaactgttgattgttctgggcaccagctcatcggaatcggcgctgccgcagttgatccagaaactcgaaagcctcggcgcctccaaaggtgtggtaggcatcgtggtgccgaccggctacaccttcaacctcgacggcaccaacatctatatgaccctggccgtgctgttcctggcccaggcgaccaacacgcacctgccgctggaacagcaactgaccttgctggcggtggccatgctcacgtcaaaaggcgccggtgcagtggtgggtgcagggtttgtcgcactggccgccagcctggcggtggtgcctaccgtgccggtggcggcgatggtgctgattctgggcgtcgaccgtttcatggctgaatgccgctcgctgaccaatatcatcggcaacgccgtcgcagccttggtggtggccgcctgggaaggcgaactggaccgcgaaaaaatggcccctatcgccctcaagcgcggccgacatgcgcgggctgctcaggcagcacaggcgaagatcgctgccgagtaagcaataacggccaggcgcgccggaaggtgcgccgatccagtgctattctggcggctcatgccgccacgcttgtttctgatgacccataagaaagataccgtgcccctacccgaagacctgcgggtgttcctgaccgtgatccgcaaggcgggtttcgccgccgccgccgatgagctggggttgtcgcctgcgtatgtcagcaagcgcatccagatcctcgaaaccaccctggccacccgcctgctgcaccgcaccagccggcggatcgccctgaccgaagacggtgaacgggtgcagcgctgggcggtgcgcatcctcgaagatttccagcaactctccgatgaactctccgacgcccatgacagcccgcgtggccatttgcatttgtgcagcagcttcggctttggccgcaaccacgtggcgccggccctgtcgttgctggcggaacagtacccggacctggaaatccgcctggacctgttcgaccgcgtggtggatatcgtcagcgaaggcttcgacctggagattcgcgtcggcgatgacatccccggccagcacatcggccgacgcctggtgagcaatcgccgggtgctgtgcgccgcgccgtcttatctgaatcgacgcggcacgccacagcacttgagtgagctggaacagcatgactgcctggtgctcaaggagcgcgacaacgccttcggcatctggaacctggagcgcgatggcgcccccgaaagcgtgcgtgtacgcgggccgctgtcctccaacaatggcgagatcgtgttgcagtgggcgctggacgggcgcggcgtattgctgcgctcgatgtgggatgtgaagccgctgctggaacaaggcaagctggtgcaggtgctgcacgcctacacccagagcgccaacgtgtgggcggtgtacccgacacgcttggcctactccggaaaactaagagcctgtgtggagtttttgcaggagcacttcaagggtttgtcgatctgaccgtgccgcccacattcacaacgagtgaacacccccgcctgtggcgagcaggcttgccctgcgttgggctgcgcagcggccccaacactggtgacgccaatctggctgtagaaacgcgtcgcctgtattggggctgctgcgcagcccaacgcgagcaagctcgctcgccacaggggttgggggttgggggttggcagtaagcgtgcgggtgggttcaacaatgtttgtcctcgcacaccgcacctcgtcggttggcgctgtaccccagccatgcagtcatgaccagcaaggcactcagcggcaacccatgaaacaagacaatcacctgggccggcgtccacgtcaggtaaaacggcccgaccatcaacatgcccacgccaaagccggccatctggatcagggtcaataagctgaaaagcggcagccgcaggctatccggctcgctttgcgcgcgggacaccaacgccacctcggacacaccatcacccagccccgcccacaccaccagcagcactgccagccacagttcggtttgctggaaggtcaggataaagccgctggacatcagcgccacgcccagcatgaacaagcgctccatggcttgggtaccgcggcctttgagcagcgcactggcgatgcgcgcgccaacgaacttgccacacgcccacgccgccagcaggtagcccatgacagtcttggccgtgtccggcgaaatgtactgcgacagcaccggccagccgacgttatgcgccgcgctgccaagggtgtcgagcatgctgatcaacaacatcgccgccagcaccggcgccccacgcagcccttgggtcagctcgcgccactgcgccgaaagcccgcgatgcgcggcgacggccactgcgtacaacccacgcaatggcaagatcaggcaggccgccagcacataggtgccgatattcacggcaaacaccgcctcgaagccgcccgtggcgatcaacagcccggagagcagactgccaaacaccgcgccggtcgccgccgccgacgtgatccacgcattggtgctcacccgctgctcaagcgccacccatgtcggtaactggctgttcaggccaatggcaaacaacgaattgcacagcccgataccaaacgcgataaagggcagcacgctgagctgatgcgccggtatcagcaccagcagcggcaatagcaacagcgccctggccaggtccagccccgccagggtgctgcgccctggaaagcgccgaaaaaacggaatgccgaacaggctggcgacaattccgccggtgacgcggcacgccagaaacacactgacaaataccacgctttggctaagccaatagacgtaggtggacagcgccaccatgttaaggaacgcaccaaagtccgagacgccacgggcgaagatgatcaatcgggcgttgcgggtcgacagcgttgattcgggatcaacgttgagcacatccatgtcaggcgcttccttttcttatcatgagccgacttccttgtcggtcccacttaaggccaaggcgccgggcgtgtcaaccaagccaggggttggccgccagatgctcgcgctcaaatgccttgatctgctcgcggcgttgcaaggtgctgccaatcgcatccaggcccaataacagcgcggtcttgcgcagggtgtcgatctggaacgggatgacttgaccatcggccaagcgaatttcctggttttccaggtccacactgatctgcgcctggtccgcctggctcacggtttgcccgagtgtgtgcaacaccgcctcgtccagggttatcagcaacaccccattgcgctggcagttgtcatagaagatcccggcaaagctgctgccgatcagcgcgcggatgcccatttgtttcaagccccacaccgcgtgttcacggctggaaccacagccgaaattcggccccaccaccataaagctcgcgccctgccaggccggctggttcagcacgaagtccggggcaggctcgccggacgccaggaagcgcaggtcgaagaacagcccgcgatccaggccgctgcggtcgatgcctttgagaaactgcttgggcatgatcacgtcagtgtcgatattcgccgccagcatcggcgcggctttgccggtgaccagggtgaaaggttgcaggctcatgcgcggtctccaaagtggcgaatatcggtgagacggccggtaatggcagccgcggcgaccattgctgggctcatcaggtgggtgcgtgcgcccgcgccctggcggccctcgaaattgcggttggtgctggaggcgcagcggtcgccgggggccagcacgtcatcgttcatcgccaggcacatcgagcagccggactggcgccattcgaaaccggcgtcgataaagatcgccgccagcccttcggcctcggcctggtcgcgcacttcggtggagccgggcacgatcatcgcccgcacgtggtcggccacgtgtttgccgcgcacaacgctggcggcgtcacgcaggtcttcgatacgcgcattggtgcaagagccgataaacgcatggctgatgacgatatcgctcagcggcatgccggcttccaggcccatgtagttgagggcgcggcgcatgtcctggcgcaggatcaggtcgctgacgtcctgcgggtcgggcacacgggcgccaatcggcgcggcctggtcggggctggtgccccaggtgaccatgggctccagggtgttggcgtcgaggtgcacttcctggtcgaacaccgcgtcggcgtccgaatgcagctggcgccagcccaccagcgcctggtcccacaacgcgcctttgggcgcacggggcttgcccttgaggtaggcgaagactttttcatccggcgccatgaacgcaccacgcgcaccggcctccaccgccatgttgcaaatggtcatgcgcgcctcgacgctcagcgcgtcgatggtcgagccgcgaaactcgatggcatagccggtggcaccggacgcgccgatcttgccgatcaacgccatgatcacgtctttggacgtgaggcctggcgccaactcgccctcaaccgtgacacgcatgcttttcagccgcttgtagaccagggtctgcgaggccagcaggtgctcgatttccgaggtgccgatgccaaacccaaacgcaccgagggcgccgtaggtggtggtgtggctgtcaccggcggcaatcaccatgcccggcaggataaagccctgctccggggcgatcacgtgttcgatgccttggcgtttgtcgaggatgtccagcagttcgatgccgaagtcccggcagttctccgccaggtacgacacttgccgcgcgccgcccgcgtcgggcattgcggcgatgcgtttgggcgtggtggggttcacatggtcgaccaccgccagtgccgtgccggggcgccagacctcacgcccggcctcgcgcaggccgctgaaggcctgggggctggtgtattcgttgatcacctggcggtctatataaagcagcacatggccctggtcatccagggggcacaccgtgtgggaatcgatgtgtttgtcgtagagggttctggcagtcatttttcttcggctcacgtttcttgaggctggctcaacggcttaccccatcctacgcagccgccccgccccatcaatggcgcctgggtgatggcttggaacatgtttcgtgttcgatcagcaactgaacgctctgtgaatgtgaaccagaaacattttctttcatttcccccttagggatttctgtctctcatccgtcttaacttagatacagcccgtcgcgtcagcaaaagctacgaccggccttttccgggcctctttcgccccctccgatcaagaccctcattcacatgtcgaagaagtcacgctcaaaactctggtttctcgtacacagctggttggcattgcccatctggttttttgtactgatcgtctgcgtcaccggcaccctggcggtggtcagccaggaaatcgtctggctggccaacccggatatccgcgcgagcaaaccgtcggatgacgccgaaatgctgagcttcgaccaggtgatcgcggccatcaagcgcgacgagcccaaggcgatcgtgcagtcgatcatccgcccggacgaaacgcactttgcgctgagtgtcgacctcagctacccggacgggcgctccgtggaggtctacgtcaacccgtacaccggcgcgatccagggcatcagcccgtcgttcgatttcaagcaatttacccgcgccctgcatggctggtggctggtgccgttcaccaacggcttcagttggggctggtatctggtctcggcactcggcctgccgttgctggcgtcgctggtgaccgggctggtggtctacaaacgcttctggaaagggtttctgcgccccaccctgcgcatccgccacggcgcgcggatcttctggggtgacttccaccgcctgagcggtatctggtcgatctggtttatcgcggtgatttccatcaccggcacctggttcctgatccaggcgattttgggcgataaccagatttccatctccagcgaaccgatcgtcccggtgattgcccgcgagaaagtgccgatgtccgcgcccggcgtgccggctccgatgatcgcgctggacgaagccatcgacattgccacccaacgcatacccgggctggacgccacgttcgtgttcctgccgctcaatgcctacagccacctgcaaatcggcgggcgcggctggtacccgctgatgttccagaccgcccagctcaacccctacagcggcgaaatcgcggtgtcgcacttgctctccgaccgctcgacgctggagttcgtcaccgaatccatgcgcccgctgcacaccggcgactttggcgggctgtggatcaagttgatctgggcgttcttcggcctggtgctgagcatgatggtgttgagcggcctgctgatctggaccaagcgcaccgcgctggccaccctcaatgccctcaagcgcgaagccaaggcgcagcgcgcgcctgccgccgcccccgccctgcaggctgaaacttcggaggccaaataatgagcaaggtcactgctgcaacgccgccttcgccgctgcgcgccttttggctgaaatggcggttccatatcaacattctgctggtgctggtgccgctggggttcatgcccaagtactttgccgatgccgcgctgtttcgcggcgacaccggcattggcgagcggatcgtcggtgatgtgcaggtcgggccctggagcctgaaactcgccgaattccgcaatgaaggcccgcgcccggacccggccggcccgatgaaattcttcaacgccgccctgtgcgacacctgcgctgagcaggtcaaggccacctacctgcgtatcggcaagccgcgcagcctgcgcgccgccggggtgatcttcttcggcacgccgtaccgcatgggcgccgccctgccagtgccggagcgcacgccggccgacgccgaactgtgggtcaccatggaaggctgggacggcaccatgcaccagggttccatcccgctaagccaggcctcgcctgccaccattgcctggctgaacaagcaaggagttaaaccatgatgttgacgcgcctgacccgcgccggtgctgcgctattgctctgcgccggtttcagtaccaccgcccttgcccacaacccgatgtgcgaatgcaaggaaatccccggcgagcaaatccagtgcaccggcggtttctccgacggcagcggcgcccccggtgtaaccctggacgtgatcggctacgacgaaaccatcctgctgcccggcaagctgggccaggattcgaccctgaccttcaagaaaccctcagccgagttctatgtgctgtttgatgcgggccccggccacgtggtggaaatcgaccaagcggatatccagccccaatgagcaccacacaggttgtacgccccgccggtgccggccacgaaaccctttacgtgctgctgctgtgcctgatcatcctggcggtggccggttcggtgatcgccctgcacggtgacacccaggaagtcgcggcactgcccagccaccagttggatgcgcgccgcgacctgagcgccgccgagcaaggcatctacgccgacctgcgggtgaccctggatgaaatccagttgctgcaacaggagcaaagcgccctgccgacgcctgagcaattggccgaagaagggttcgcaccgtttgcccaggacgccagctcggtcagccgtggcgaccatcgctggcagctgctggaacctgcggcttatgtgggcttgagccaggcgccgagtgccagcggctcgttgctgatgcgcgtgcacggcgccgagccggatatctggctcaatcgccaagccaacctcgccgccccttccgacctcactgaccaggcgctgatcgcagccggctggcagcaggtggtcgcgcaattcgatgctggcgtcacgcgccagcaccgtcactgaccgagaagaccgagtgcccatgtctatttcatctcccctgttacgcctgttgctggtcagcctgttcagcctgctgctggcgccgttggcaaatgccgaggcggctaaacgcctgcgcatcggcattacgctgcacccttattacagctacgtcaccaacattgtcggcgacaaggccgaggtggtgccgttgatcccggccggtttcaacccccacgcttacgagccgcgcgccgaagacatcaagcgcatcggcacactggacgtgatcgtgctcaacggcgtcggccatgacgatttcgccgaccgcatgatcgccaccagcgagcgcccggacatcccggtgatcgaggccaacgccaatgtgccgctgctggccgccaccggcaatgctgcacgtggagcgggcaaggtggtcaacccgcacaccttcctgtcgatcagcgcctcgattgcccaggtcaacaacatcgcccgcgaactgggcaaactcgacccggacaacgccaagacctacacccagaacgcccgtgcctacggcaagcgcctgcgccagatgcgcgccgacgccctggccaaactgaccagcgcgcccaaccccgacctgcgcgtggccacggtgcacgcggcctacgactacctgctgcgcgagttcggcctggaagtcaccgccgtggtcgaaccggcccacggcattgaacccagccccagccagttgaaaaagaccatcgatgaactgcgcgccctggatgtgaaggtgatcttctcggagatggatttcccgtccacctacgtcgagaccatccagcgtgagtccggcgtgaagctgtacccgctgtcgcatatttcctacggcgaatacacgcctgagaagtacgaagtggaaatgaccggcaacctcaacaccgtggtgcgggcgattcaggagtcgggggcatgacggcggcggagcagctgaaagtcgccagcatgggtccgaccctcgacttcgacaatgtgtcactgaccctcggccgcacggtgatcctcgatagcgtgagcttccaggtccagccgggcagcattcatgccctggtcggcccgaatggcggcggtaaaagctcgctgatcaagaccctgctggggcaaacgccgcaccagggccaattgcgcctgcaatggccgaccacgcccggcaccatcggttatgtgccgcaggcgctggagttcgaccggggcttgccgatgaccgtcgacgacttcatggccgccatgtgtcagcgccggccggcgtttctgggcctgtccaggcactacgccggggcgattggcgaggcgctggagcgcgtcggcatgcaggacaaacgtaaacgccgcatgggcgcgttgtccggcggtgagcgtcagcgtgtgttgctggcccagggcctgattcccgcgccgcagctgttggtgttggacgaaccgatgtcggccctcgatgaagctggcatccaggtcttcgaacgcttgctgaatgactggcgcctggccgggattaccgtgctgtggatcgagcacgatctggaagccgtgggccgcctggccgagcgtgtcaccggcctcaaccgccgcgtgctgttcgacgccacgccgaaagaggcgctgaccccggaccgcctgctgaccctgttctccacccaccctcggagcccggcgcaatgagttatgaagcgtttcgtttgatggtccagggctgggcctcttccgggtatctgccggaagcgctggcctatgggtttgtggtcaatgccttgcttgccggtctgctgatcggcccggtactcggcggcctgggcacgctggtggtggtcaagcgctttgcgtttttctccgaagcggtcgggcatgccgcactgacgggcgtggccgtgggcattcttttaggggaaccctacaccgggccgtatggcgcgctgttcggctactgcctgttgtttggcatcctgctcaattacctgcgcaaccgcaccggtctggcgccggacaccttgatcggcgtgttcctgtcggtgtccctggcgttgggcgcgagcctgctgctgattttggcgggcaagatcaacgtgcacatcctcgagaacgtattgtttggttcggtgctgacggtcaatggcaacgacttgctggtgttggccgtggtcggctcgctggtgatggccctggcgttgccgttgtacaaccgcatcatgctcgccagtttcaacccgcaactggcggcggtacgcggtgtggcggtgaagaccctggattatttgttcgtgattctggtgacactgatcaccgtggcggcagtcaaggtgatcggcgccattctggtcggtgccctgctggtgattccggcggcggcggcgcgcctgctgagccagtcgctcaagggtttcttctgggtttcggtggtgatcgccacggtgagcacgctgtgcggcattctgctgccgatcatcttcgacctgcctatcccgtccggcgccgccatcattctggttgccggtatcgccttcgccttcgccgccatcgcgcgcggcacagtgcccagcctcaaagggaatcttggataatgcgccctgtctttcgcccactggccctggccgtcgcctgcctgctcagcacctcggcgctggccgccgtagacggctttaatcccaacgacttcaaagtcaaccaaggcctgggccatgccgccctgaccaaagccaaaaagccggtcaaggtgctggcctcgctgcccatcacttacggcttggccgaggtactgctcaagggcaccgacgtgaaacttgaacgcgccgccccggccaacctgcccggctcgcggcaggtgtcctacttcaccgggcgcggcgcccaggcgttgaatagcctggctgtggacgccgacgcgaccatcggcctgcgttcgttgtgggccgatgacccgctctacccggtggcgcggcgcagcaatatccgcatcgtcgaggtggatgccgcgcgcccggtggacggtggcttgccgggcatcgccgtgcagccgggcagcactgacggcttgaacagccagccgtggcaatcgagcaacaacatggggcgcatggccgatgtgatggccgccgacctgagccgcctggcaccgaaggccaagccgaagatcgacgccaacctcgccgccctcaagcaacgcctgctcaagctcagcgccgacagcgaagcgcgcctggcccaggcagacaacctgagtgtggtcagcctgagcgatcactttgcgtatctggtcagcagcttgaacctggaagtggtcagcaccgatgcacggccggatgcagagtggacgcccgaggcgctgcagcagttaaccgccagcttgaaggacagcgacgtggccgtggtgctgcatcaccgtcagccgagtgaggcagtgaaagcggcggtgacggcgggcggcgcacagctgctggtgttgaacgtcgacggcgcggacccggtggcggagttggaaggtaatgtgggtcaggtgatcaaggcgctgacaccctagtctttatatgaaatgcagttcaagtgtgggagcggtgcagcagttgaatatcgagcatagccattcaaggtgcagtcacaccacatcaacgcccacatgaatcgcatcatgccgccagaactccaggtcgcagtcgatcaaccgctggtgctgatcataattgacccgggcaatgcgcaggcccgggctgcccaccgacacgcgcaacgcggcggcggcttccaccggcagtgacgtcggcactatttcgaaacgcacgcggccgtaatgcaagtcatacttgcgcgcgtacagctcagtcatcgactgattcaaatcacacgccagaatccccggaaaatactgcgggttcaggtagtgctccacatacagcaccagccgcccatcaattcgtcggccccggcaaatctggatcacgctggacagcgccggcaactgcaaccacgcacacaccgctgccgacgccggttgcagccgcgccgaaatcacctcagtcgacgccacccgcccctggtcgctgaccattgcgtgaaagtggctgcgctgcatcaggttataagccagccggggcggcgaaacgaaccagccccggcgctcctcgcgataaatctgcccttgggcttccagttgtaacaacgcttcccgcacggtaatacgcgtggttccaaacaactcactgagcttgcgctcggcgggcaacttactggcaggcggcaacaggccgtggtcgatctgctcttgcagcgccaggccgatggatgtcaccgccttgattgcctcatcacgcatcaacgttacctatctggactagaccagcaccgttcaggtgcacaaaccgctccgtaaatgggcttttgctactgcttgccagcctaggcactacagatgaccgacagatgacagcccctgtcgcggccctgcaccacaccctgcaatacatcggccaagtccagggcctgcgggtacttgggcatggtctacgctgagtctgcactgagcgacaaaagtgattaaaaaacgacatcgacatgaaactgtcatccatcgagcctagattggctcaggtattgctctgacctagaccaacaccacccgtcgaaaaacaacgccgcgttgaaaacgcccaaaggagcttcggatgaaaaagcttttcctggcatcactgttaggctcgaccattgccatgtgcaccgccgccatggctgctgataccgatctaaagactctggaagccgccgcgaaagcggaaggcgccgttaacagcgtcggcatgcccgatgactgggccaactggaaaggcacctgggaagacctggccaagacctacggcctcaagcacatcgacaccgacatgagctcggcccaggaaatcgccaagttcgccgccgaaaaagacaacgccagcgccgatatcggtgacgtcggcgccgccttcggcccgattgcggtgaaacagggcgtggcccaaccgtacaaaccgaccacctgggcacaagtgccggactgggcgaaagataaagacggcaactgggcgctggcctacaccggcacgatcgcctttatcgtcaacaaaaagctgctgcacggttccgaagcgccaaaaagctgggctgacctgaaaaccggcaaatacaaagtctccatcggtgacgtgagcaccgccgcccaagccgccaacggcgtgctcgcggctgccctggccaacggtggcgacgagaagaacatccagcccgcgctgctgatgtttgccgagatcgccaagcaaggtcgcctgtcgctggccaacccgaccatcgccaccatggaaaaaggcgaagtggaagtgggcgtggtctgggacttcaacggcctgagctacaaagccaagatggccaacccggatgactacgtggtgctgatcccatcggacggctcggtgatttccggctacaccaccatcatcaacaaatacgccaagcacccgaacgccgccaagctgacccgtgaatacatcttcagcgacgccggccagaccaacctggcgcgtggcaacgcgcgtccgatccgtgccgagcacctgaccttgccggccgacgtgcaggccaagctgctgccgaacgagcagtacaagaaagtcacgccaatcaaggatgccgaggcgtgggagaagacgtccaaggcgctgccgcagaagtggcaggaagaagtcattatcaatatgcagtaaggcctgagctgtaaacgcggtcagtgtgggagctgacttgtgtgggagccgggcttgcccgcgatgcagacgactcggtgcttcatgtgaaccgaggtgatgctatcgcaggcaagccagctcccacataagccagttcccacagttgatccagttcagccggggaaattgagtcaaacctaccgttgcggagccacagcccctatgaagcacaacgtcatccttgtggtgctcgacggcctgaactacgaggttgcccgacatgccatggggcatctccaggcctatatcggcgcaagacgcgcagcgctttacaaactggactgtgaactgccggccctgtcacggccgttgtacgaatgcatcctcaccggcgtgccaccgattgacagcggcatcgtccacaacaatgtctcgcgcctttccaaccagcgcagcattttccattacgccaccgacgccggtctcaccactgcggcggcggcttatcactgggtcagcgagttgtataaccgcacgccctttattgccgcgcgtgatcgtcataccgacgacaaggcgctggcgatccagcacgggcatttctactggaatgaccactacccggattcgcacctgttcgccgacgccgaaagcctgcgccgcaaacacgcgccgaatttccttgtggtgcacccgatgaacattgatgacgccggccacaagcatggcctggataccgcgcaataccgcaacagcgcacgctcggccgacatcatcctcgccgactacctgcaaggctggctcgacgccggctaccaggtgctggtgaccgccgaccacggcatgaacaacgatcgctcgcacaacggcctgctgccggaagaacgcgaagtgccgctgttcgtgctgggttcggccttcagcttcgaccctgccgctacccccaagcaaaccgagctgtgcggcagcgtctgcgaactgctcggggtgccccacgacaaacctgtatgccgggagctgttgaagtgaactccataacccgtggcaaatggctggcgatcctgtgcctggtgccgtttgcgctgttctttatcgtgttcgaaatcgccccgctggtgtgggtgctgatcaacagcctgcaatcggaagagttcggctggggcctggccaacttcaccaagatcttcagctcgaagttctacctgcaggctatccagtacagcctggagatcagcttctactccagcgtgttcggcatcatcatctcggtgctcggcagctattcgttgcgccgcgtggatgggccgctgcgcaacttcgtgaccgccttcgccaacatgaccagcaactttgccggcgtgcccctggccttcgcgttcatcatcctgctgggcttcaacggcagcatcaccatcatgctcaagcaggccgggatcattcaggatttcaacctgtactccaagaccggcctgatcattctgtacacctacttccagattccgctgggcgtgctgctgctctacccggccttcgatgcgttgcgtgaagactggcgcgaatcggcctccctgctgggcgccagtggctggcagttctggcgccacatcggcttgccggtgctcaccccggcgctgctcggtactttcgtcattctgctggccaacgccctcggcgcctacgccacggtgtacgcgctgaccaccggcaacttcaacgtgctgcccattcgtatcgcggcaatggtctccggcgacatttccctggacccgaacatggccagtgccctggccgtggtgctggtggcgctgatgaccgtggtcaccgtggtccatcaactgctgctcaagaggagctaccatgtctcgcgctgaagccggctcggcctccctctaccatcgggtagtggtgtacctgttatttgcgattctggtgttgccgctggtgggcacgtttgtctactccattgccagcagctggtcagcgactattttgccggccggcttcacgctgaaatggtacgtgcaactgtggagtgacccgcgttttctcgccgccttcggccagtcgctgctggtgtgcgtgggtgcgctgatactgtcggtggtgctgattctgccgctgctgtttgtggtgcattaccacttcccccggctcgacgcgctgatgaacatccttatcctgctgcccttcgcggtgccgccggtggtgtcgtcggtgggcctgctgcaactctacggttccgggccgctggcgatggtgggcacgccgtggatcctgatcggctgctacttcaccgtggcgctgccgttcatgtaccgcgcgatcaccaacaacctgcaagcgatcaacctgcgcgacctgatggacgcctcgcagctgctcggcgccaacacctggcaggcggcgatcctggtggtgctgccgaacctgcgcaaaggcctgatggtggcgctgctgctgtcgttctcgttcctgttcggtgagttcgtgttcgccaacattctggtcggcacccgctacgaaaccctgcaggtgtacctcaacaacatgcgcaacagcagcggccatttcaccagtgccgtcgtcatttcctatttcttctttgtgctggtgctgacctgggccgccaatattttgaacaaggacaaaagccaatgagcttcgtcagcgtccaacacctgcaaaaaggctacgccggcaccccggtgttcagtgacatcaactgcgaaatcgccaagggcgaattcgtcaccctgctcggcccgtccggttgcggcaagtcgaccttgctgcgctgcatcgccggcctgacctcggtggacagtggcaaaatcctgctggatggccaggacatcgtgccgctgagcccacagaaacgacatatcggcatggtgttccagagctatgcgctgttccccaacatgaccgtggagcagaacgtcgcctttggcctgcgcatgcaaaaggtcaacgccgacgacagtcacaagcgcgtgcaggaagtgttgcaactggtggaactcaaggagctggcgggccgctacccgcaccagatgtccggtggccagtgccagcgcgtggccctcgcccgctcgctggtgacccgaccgcgtctgttgttgctggatgagccgctgtcggcgctggatgcgcggattcgcaaacacctgcgcgaacagatccgccagattcagcgtgaactgggcctgaccacgattttcgtgacccatgaccaggaagaagcgctgaccatgtcggaccgcatcttcctgatgaaccaaggcaagatcgtacagagcggggacgccgagaccctctacaccgcgccggtggatgtgttcgccgccggttttatcggcaactacaacctgctcgacgccgacaaggccagccaattgctgcagcgcccgatcagcgggcgcatcgcgattcgcccggaagccatcgaactgagccgcagcggcgagctggacgcactggtgcgcagccacagcctgctcggcaacgtgattcgctaccgcatcgaggcgcgtggcgtggagttggtggtggatgtgctcaaccgctccgccgacgacctgcacccggatggccagcgtttggcactttccatcgacccgagcgccttgtgtgaagtagcctgacgccacgatttattgagagagcgaaacggatggcattggtaatttttgatctggacgacaccttgatccacggcgactgcgccaccctgtggagcgagcagatgggccgcctgggctgggtcgaccctgagtcgttcatgcgcaagaacaacgagctgatggacgcctacagccaaggcaagttgcgcatggaagacttcatggaattcagcctggagccgatgattggccgcacaccggaagagatcgagcacttggtcgagccgtgggtcgaggacgttatcgagccgctgatctacagcgacgccaccaagaccatcgcccgccaccgcgcaaacggcgaccggatcctggtgatttccgcctcgggcacgcatttggtcaagccgattgcggcgcgcattggtatcgacgaagtgttgggcattgacctggacgtcagccacggcgtgtacagcggccataccgtgggtgtactgacctatcgtgaaggcaagatcacgcggttgctggcgtggttggagcaggaaggtgaaagcctggacggcgcgtatttttactcggactcgcgcaatgatttgccgttgctgctgaaggtggaccatccgcaggtggtgaacccggacccggtgttgcgtgaacatgcgcagaaggctgggtggccgatccatcagtgggtgtgacgccaacctctttgaattgaaatccactccactgtgggagctggcttgcctgcgatagcgctatatcagatgaaacattcttcactgaggcaccgctatcgcaggcaagccagctcccacattgaccgtattccagtcctgggatcagctcaggccttcgtcaatcaccaacaccaatttcccggaaatctgattgctcgccaactcggcaaacgccgcttcggcatccttgatcgggaaggtcttggccagttgcgggctcaagcggccctctgcaaacaacggccacacatgctggcttagatcactgaacaggtccgccttgaactgatcgctgcggctgcgcagggtcgagccgagcaattgaatgcgtttgcccagcacttgcgccaggtcgagctgtgcgtcacgcccgcccatcaagccgatcaacacccagcgtccgtccagggccagcagcttgaggtccatcgccgcatagttgccgccgaccgggtcgaggattacatcaaacggcccgaaatcgcgcagcccttcaatgccgtcggtgcgtactacgccgccctgggcgccgagttcttcgcagtaagccaggcgctgcgccgagccgacgctgacccagcacgggctgccaaacgccttgcacagctggatcgccgccgagcccacgccactggcgccggcatgcagcagtactttttcaccgggcttgaggcccgccaactggaacagattcagccacgccgtgctgtacacctccggcagcgccgccgcttcggtcagcgacaggccttccggcaccggcaacacgtggcgcgcatctaccaccacttcttcagccataccgccaccggccagcagtgcgcagacgcggtcgccgacctgccaggacgaccccgggccgacttcgctgatcaccccggaacactcaagacccagcacttggctggcgcccggcgggggcggatagagccccgcgcgctgtaataaatcggcgcgattaaggcccgcagccgctacacgaatgcgaacttggcctacatcgcaggtaggactgggttctgtcagccactccacatgaccttcaacgccttgcaatgctttcacagtgcctccatagtgagtctggactgagcccgtagctgtagcgccgggctttttgcattatgcgaccggatcatatggaaccggctccctcaaagacggcctaatatgcgttatcaattgcccccgcgtcgaatcagcatgaagcatctgttccccagcaccgccctcgcttttttcattggtctcggcttcgcgtcgatgtcgaccaatacgttcgcagccaacagctgggacaaccttcagcctgatcgcgatgaggtgattgcaagccttaacgtcgtcgagttgctcaagcgtcatcactacagcaagccgccgttggacgacgctcgctcggtgatcatctacgacagctacctcaagctgctggatccgtcgcgcagctacttcctggccagcgatatcgctgagttcgacaagtggaagacccagttcgacgacttcctcaaaagcggcgacctgcagcccggcttcaccatctacaagcgctacctggaccgcgtcaaagcgcgtctggacttcgccttgggtgagttggacaagggcgtcgacaagctcgacttcactcagaaggaaacccttctggtggaccgcaaggacgcgccctggctgaccagcaccgccgcgcttgacgacctgtggcgcaaacgcgtcaaggacgaagtgctgcgcttgaagatcgccggcaaagagccgaaggccattcaagagctgttgaccaagcgctacaagaatcagctggcacgtctggaccagacccgtgccgaagatatcttccaggcctacatcaataccttcgcgatgtcctacgacccgcacaccaattatctgtcgccagataacgcggaaaactttgatatcaacatgagtctgtcgctggaaggcatcggtgccgtcctgcaaagcgacaacgaccaggtcaagatcgtgcgtctggtgccggcaggtcctgccgacaaaaccaagcaggtcgccccggccgacaagatcatcggtgtggcccaggccgacaaagagatggtcgacgtggtcggctggcgcctcgacgaagtggtcaagctgatccgtgggccgaaaggcagcgtggtgcgcctggaagtgattccgcacaccaacgcaccgaacgaccagaccagcaaaatcgtttcgattactcgcgaagcggtgaagctcgaagaccaggccgtgcagaagaaagtcctcaacctcaagcaggatggcaaggactacaagctgggcgtgattgaaatcccggccttctacctcgacttcaaagccttccgcgctggcgatccggactacaagtccaccacccgcgacgtgaagaaaatcctgactgagctgcagaaggaaaaagtcgacggcgtggtcatcgacctgcgcaacaacggcggcggttccctgcaggaagccaccgagctgaccagcctgtttatcgacaaaggcccgaccgtgttggtacgcaacgctgacggccgtgtcgatgtgctcgaagacgaaaacccaggtgccttctacaaagggccgatggcgttgctggtcaaccgtctctcggcctcggcttcggagattttcgccggcgccatgcaggactaccaccgcgcgttgatcatcggtggccagaccttcggcaaaggcaccgtgcagaccatccagccgctgaaccatggcgagctgaaactgacactggccaagttctaccgggtttccgggcagagcacccagcatcagggcgtactgccggatatcgacttcccgtcgatcatcgacaccaaggaaatcggcgagagcgccctgcctgaagccatgccgtgggacaccatccgtcctgcgatcaagccggcgtcggacccgttcaaaccgttcctgacgcagctgaaggctgaccatgacgctcgctccgccaaggatgccgagttcgtgttcatccgcgacaaactggccctggccaagaagttgatggaagaaaaaaccgtcagcctcaacgaagcggatcgccgtgcgcagcacaccagcatcgagaatcagcagcttgtgctggagaacgcccgccgcaaggccaaaggcgaagacccgctcaaagagctgaagaaagaagatgaagatgcgctgccggagccggaaaaaaccaagccggaagacgacgcctacctgtcggagaccggtcggatcctgctggactacctgaaaatcagcaagcaggtggccaagcagtaaatgatggcaatttaatgtgaacgctcctcggagtgtcatcatatagacatcattctgtcgtgaaatgaaggaccgcaggcgttgagcctgcggtcctttttttcgatcgagatcgccatgaccatgaccgaacagctgaatgcattgggctctatcctggctcaaggcagtttgcacagcctgttccaaccgatcatttgcctctctgaacggcgcattcttggctacgaagccctcagccgtggcccgtccaacagcccattgcactcccccgtcgccctgttcgcggtcgccagccaggccgggcgcctcagcgaattggaaatggcctgccgcgaaagcgcctgccggcgtttcagtgaacagaaactgccgggcaaactgttcctgaacatctcgccggaatccctgatggagaccgcgcatcaaccggggcgcaccctgcaactgctgcgcgacttcggcatcccgcccagccaggtggtgatcgaactcaccgagcagacccccaccgatgatttcgacctgctgcaaaccgccttgcatcattaccgcgacatgggctttgccatcgccctggacgacttgggcgccggctattccagcctgcgcctgtggtcggaactgcgtccggactacgtgaagatcgaccgacattttatcgacggcatccatcaagatgcgctcaagcgcgaattcgtcggctccatcctgcaaatcgccaaggcatcacgcgcccaggtgattgccgagggcattgagctggcggaagaactggcggtgttgacggagatgggtgtcgacctggtccagggctatctgctttgccgcccacaggaacaaccgccccaggaagcgcggctgatgctgcccaagccggacaacgccaacctcgctctcagtgaggaaggcagcgacctcagcgcgctgctcaacgaacaaccggcggtgcaccaggacaccgccaccgcccaggtgctggagtcgttccgccgccaggccaacctcaattcgttggcggtgctcgacgggcgcggccacccggttggtatcgtgcaccggcattccttgtcggacgcgctgctcaagccgttcgccaccgacctgttcgcacgcaagccgatcagccgcttgatgagtgatgactttttggccgtggagctgagtcaatcgctgcagcaggtcagccgcctgctgaccagccgtgcgcggcagcggattgaggaagacttcatcattacgctcaatggcgactacctgggcctgggccgggtgattgacgtgctcaagctgatcaccgagctgaaaatccagcaggcgcgttacgccaacccactgacattgctgccgggcaacgtgccgatccagcaatgcctgacacggctgttgcagcaacaaagagaatcagtgatttgctacgtggatatcgacagcttcaagccgttcaatgatatctacggctacgggcgcggggatgaggtgttgctgtgcctggcgcagtgcctcaatgaccgagtcgacccgagccgcgactttgtcgggcatatcggcggcgatgattttttgctggtgctgggcccgcaggattggcgcaagcggctcaatcagttactggatgatttccacacccaatgccgacgcttctaccgcgccgaacacctcgacgctggttgcttcgtggcgctgaaccgccagggtgtgcgccaagagtttgccttgctgtcactgtcgatcggcgtggtgcatttatatccacaggcctgtgcacaactggatgccagccagttggcggagctggcctcgcaggccaagcaccacgccaaggacgtggccggctacagcattcatgtgatcgacagcctggaactgctggcccaggcttaggcctcggcagattccgggtactcgtattcgaacacccgcaccacttccgacgcatgccaggacgcggcggcgacgccatcggaaggcccgctgaaccgccccaggcgctctacgcattcaaagaaaccggtacgcggcaggcgacttgcgccctggctgatcaccagcgagctgcgcaagggctgctcggctttggcgtcgagtgcggccaggtgctcaagggcggcggccagggtttgcatggccggcgtggggaattgcaggcgctccagcagcgcgcgatacgtcagcagatggcgctggcggcgcgcctggtccagttcgttgagtaacccatcccagtgttgacggctgatacgtaggctcaagattcatccctccaacctgcaacgcccaattcccaggccaggctgcggcgaatggcggcatccggctggcgttcacccctttctatcaatccgagatacgaggggctgatgcccactgtgcgggccagcgtttctatggccaggcccttggcttcacgcaggccactgaggtccgcgagcgggcgcaatgcctgatcgggagtgacctgagcagtagaagatggcgttggcgctggttgttgctgaccggctgcttttagtagcgcctggtactggtcccatggcaacaccgcgtactcgggttcgccatcgcgtgaaattatctgaatatccatgactgccccgtaggataacaacactcactaagtaagctctttccttaggagtgtaatcctaacagccacaaaggtcgcagggggatataagcgtcgtcagtttttttgcgggttttcctgggccagcaacgcaggcgtcgcaggcaagcgctcaaccaccgcgagcttctccgggcgctgcgcgtcgcgccaggcgcgaaaggcgctcagttcgccatccagggtcttcatgacccatgccagcacggcaatgtcgtcgagcatgccgaataccggaataaagtccgggatcgcgtcaattgggctcaggaaatacatcagccctgccaccaccgaaatcagcgccttggggctgattgcccggtactcaccgcgccagtaggccaggcacagggcctggagcagtttgaggtcatccttgagtttgcccaggcggttgccctggcttgagcctttggcggcgacggcaaacagcagggtcggcagccgcccacgaccgagcaagcgcgcggccatcggcaggaatcgggtgaaattgaagggtggtttcatgggtcactccagttccaggcgacataaaaggttatccacacaaattgtggataaccttgtgaacagagcctgttttatcggctgaaagccacggactacaaggcctacagtcagatcgggcgttttttgcgcacataaaaaaaacccaagatttcattgacttggcactgatgtgcggctacccgtgctcgagtcttatatcagactgtgtcaggttgcaggggttcgtttggatttccacgaccttgaagcccccccttcactgtgggagctggcttgcctgcgatgcgtgcacctcggtggttcagctcaaccgaggtgatgccatcgcaggcaagccagctcccacacgagccaagctccacagctgatttatgtgttaccacgcagagcgtgggaacaatcatttacctggcgccagatacgacaacgccccgtcgaaacggggcgttgtctgttcagttgccgattacttcttggcagctggagcagcaggtgcgtcagccttggctgggtccttgatggccagcagttccaggtcgaataccagcacggagttggccggaatcgccgggctcgggctctgagcgccgtaggccagatcggacgggatgtacaactcgaccttctcgccaacgtgcatcagttgcaggccttcgacccaacccgggatcacgccgctgaccggcaggtcaatcgggctaccgcgatccacggagctgtcaaaggtagtgccgttggtgagcttgccggtgtagtgaacagtcaccacgtcggtcggcttgggctgggcgccgtcggccttcttcacgatcttgtattgcagaccggaagcagtcgtcactacgccgtctttcttggcgttttcttcgaggaatttcttgccggcggctgccgactcttcactcattttggtcatgcgttcttctgcacgcttctgcagtgcggcaaacgcttcaaccagttcgtcgtctttcagcttctgttctttcttgccgacggcatcttcgatgccttgggctaccgctttggagtccaggtcatccatgccttcctgggcaagacttttgcccatgttcaggccgataccgtaggaagctttctgcgccggggttttcagctctacgctggtctgcgaatcacaacccgcaagtaccaggctaaccagggccaccgccgccgccaaccgatgctgtttcatgctatttccttgttcgtgcgccaaaagggcattcgagtaaagtcgcgagcttatcaggcggccacgaccaatggctaccggcatgtgagcaggaaacttctgataagttcacgtgtttaaaagcattttcattcatgatggaggcccgcgaaggatcgcgggacccgctgcaaccagactgctggccacttgccgcacctgtgacgcagtggcataacaacgctacaactcgacaaggatagttatcttgcgcattttttcccgtgttttgcttctgatattgctcgcactcggcctgcttctggccgtggtgctctactacaccgtcaaccccaagctgccggactacgtgcccgtggagcaggtccactatcaggaccaatggagtgccgccgaccgccagaccttctacttcacgccccagggcacccaggtaaaaggcctgcattacgactggttcaccgctctggaactgccgttttcagaccagcgtttcgccacgcccgagtacttggcacgctttggtttcctggtcgatcccaagcaggctcctaccgcgcaaaaccccggcaacctccccgtaggtttcgcccggcaccagaacgccggcagccaggttgaatacctggacatcacctgcgccgcctgccacaccggcgagttgcacttcaaaggccaggccctgcgcatcgacggcggttctgcccagcacgtgctgccctccagcgtgcccacgttgcgcggcggcagtttcggccaggcgctggtggccagccttgccgccacctattacaccccgtggaagttcgaccgcttcgcccgcaaggtgctcggccacgactatgacgatcacagcaagcagcaactgcgtcaggacttcaaacagtcccttaaccagttcctcaaggtcgcctggaacgacacccatcgcggcctctaccccaccgaagaaggcccgggccgcaccgacgcgttcggccgtatcgccaacgccagctttggcgacgccatttcgccggacaactaccgtgtcgccaatgcgccggtggactacccgcagctgtgggatatctggaccttcgactgggtgcaatggaacggttcggcccagcaacccatggcgcgcaatatcggcgaagccctcggtgtcggcgcgacgctggatttcttcgacagtgccggccagccacttcaaggcgctgcccgctatccctccagcgtgcgcgtgcgcgacctcaacctgatcgaagaaaccctgcaacgcctcaagccgcccacctggccgcaagacctgttcggcgccgtcgacaaccccctcgccgcccaaggccgcgcgctgtttgccgagaactgcgccggctgccatgtgcccgccgtcagccaaatcaatggccgcccggtgcaacaactgaaaatgctccccgtggagtacatcggcaccgaccccggcaccgccagcaacatcgccgaccagcgctacgacctcagcgccctgcaatgggacccggcagaactggccaagctcaacgtcgagctgcaccccacgccgaccgcagcgctggacctgcacaaaatgtccgtggcccaaggcctggcctatgtcaccgcctttgtcgaagaccacgcctatcgcgccgctggcgtgactccagccgagcggccgagcctggacgggttcggattgcccatcggcgtgcgcgagctgcgtgcctacaaggcgcgccccctggccggcgtatgggccacgccaccgttcctgcataacggctcggtgccgacgatctaccaactgctctcgccccaggatgagcgcagcactaccttctataaaggcacgttcgcctacgacccgcgccacctgggctttgagaccggcgcattcaagaacgccttcctgttcgacacctcaatcaccggcaaccacaacagcggccatgaattccgtgacggcaagcgtggcaatggcgtgatcggccgtggcctgctgccgcaggaacgctgggcgctgctggaatacctcaaagtgctgggcggcccgctggagcaacaactgccatgattatccgatcgcaatacaaggaccgttccatgctcgctcgtctgtggctacgcctcggcgcgtttctgggtaagaccctgttgtgtctggtgggtcttgggctgctgggctggctgatcgctaccgcctggttcgcctggcaacacagtggcccggtgtcaccgaacgagcaaatcccgcccggtgaagcggccatgagccagggcatcatccagacggcggtgcgcatcgtcgaccagcaccgcgaaggcacgcgctacctgcgtgatgcccatgccaaggcccacggctgcgtgaaggccgaagtcagcgtaatggcggacctcgacccggcattgcgccaaggcgtattcgccgagccgggcaagacctggcaagcgctgatgcgcctgtccaacggcaacgcttacccgcaattcgacagcatccgcgatgcgcgcggcatggccctcaaactgctggacgtaccgggcaaacagctgatggcggaccagcaggcgcgcacggaacaggatttcgtgatgttcagccatccgaacttttttgtcagcgatgtcgcggagtatgcgcagaacatcggtgcccaggccgatggcaagaaagtcctggcgttcttccccaaggcagacccgcgcagttggcaggtgcggcacttgtttatcgccctggcgaccctggcgcctgcgccggccagcccgacgcagactacatacttttcggtttcgccttacaaattcggcgcggcgaatgccaagttccgtgtggcgcccgacccgcaaagctgcccggaatatgtgttacccaagcagaaccaggacctgccgaattttctgcgcagcgcgttgaaccagcaactgtcgactgatcgcgtgccggcgtgttttgtgttgcagattcagcggcagaatccgcagaagttcatgccgattgaagacaccagcattgaatggaaggaaagtgatgcgccgtatgaaaccgtggccaaggtgcggatccctgcgcaggattttgatacaccggcgttgaatctggcgtgtgataaccagtcgtttaatccctggttcgggttggaggcgcatcggccgattggcgggatcaatcggttgcgcaaggcggtgtatgaggcggtgagcgactatcggcatagtcgaaacttataatcgggatgaagcagtttagggtccgacgtggaagagcccacctttctacagaagggtaggccgttcgctcactcaaaaaacattgtaataccctgatcgggtcgaggtcagggtattgtcggattcatatacaccttaaatacctatggcatttaagatgaggtcgctcctttgggcgccatcagcacgtagcaaaaagtctggggctttatcaggaaccggcccacttttatcagcgcccgaccaccccttcacccaggtggacccgtctgcgtttgtttcgacttcaaagcgcatgtaaggtgggtaagtccaaagattactcacatccagcttatccatccctgttttaaacccaattattttatcctggcgtgctggactgccatccgactcttgctcataaacgacggtatttgcgcctgtacccaaggtgatagtattcgccccagcgttaggatagatcctgtttgtacccgatcctgttttaacatcttcaaccaccgtcccggaagtaatagacacattacctgtatagccccttacactggaatgtgctcccggcttcagattgatatcttgatcatgagtatctttactcacgtcgatggtctcatgaccactgactccgctcgaaatagaaaacgtcgggccatacccatcagtacctaaatgatgcaactcaaaattctgctctttaatactcgtgtttgtatagagactctccaacttttccttgtcttttacttgcgctctggtgacagcgtgccccttaaaatcctggcccgtgtcggtttctggcctagggctgagtgcgctgtaaccctgagaatcatgcgtaccgccctcttccactggcgtgggaggggttacacccatggcgtatagcaccgttcgagtcagcgtgttaccgcctttattaaagtcgtcgggcgttgaaatcgttgggttctgcgcttcgttcccattaaagtaaacctcgacaggcttacttgaatccgttggcgtgtagctcaccacatcactattttgtgttgtgttttgctgaaaggatccgattttgatttttccatcagggctgtctattgaaccctgcctgtgaaacttcacatttacatcattagtcatgaggcccatctgaaaccacagccctctctgctgcgcctcattaggggcgttgaagcctgtcagacctgaactggaaaaatgctcaccttcttcgtcaccgaaatcgacttcaatatcaattttcccattgtcgtctttatcctgccagcgcgcagagctctgtacggaaaggacatcgttatcctgcgacgtgaccggatttgaagccgggatggaactagcaataacgttattagaggacgcattaatattcatataaaccaccttcagccgtttatcaaaatcgataagataacaacatatacagactatgcacccaacaacggaaacacaagacagccaacgttgagcaaatatttctcactctctactcaatagaaaaaccaataaaaatagccaacaaccaatattaaataagcaaattcctatattaccgagttcgcacctttatttgatcgttgcgtttgaacccagggtcttggccaaccatcccattgcctgccgggtgacaccgcccaatgacgcgcaaccttcatcgtggaaccctttatccgtaaagaatccgtataaatccggggttccccataacgattacgtcgtccctattgagcgattagccctacacactttaccgtcacctcctaccccaacacccgtaggaactcatcgtggaaagttcaactttaggcatggtcgtcctgtcaatgattgcgctcttcggcaccgccgcgttttgcttcgagcacctcgccacccgcggcgaaaagaaaaagaaagccaaataagctgatcactgaaatcagcagaaccccagtttttcaagggataccccggcagcgggctgtcccttgttttcgttcgcccagcaaaatctcatctatataccgtcttaataccgcgccccgtaatcagtgcccaagcttgatacccgaacacataacctccccggcttattccaaaaggggagttacaccgtgctcacactgaccttcatctatgttgccagcggcgtatgtgccgtggggctgttcgcttacttgggctacgccctcattcgcgccgaaaagttctagggagttcgccatgtacgacgtgatgtttatgggcctttccctggtgtttttcagtgcgacagccatggccattgtcgccatgggcaagatttgaacggagccacgacatgttaagcactctgctggaattcgcgctggtcctggggttgatgaccgcgctcgccgtgctgatgggcaagtggctgacccgggtctttaccgggaaccgccacgccctgccggaacgctgcacgtatcgcctgctgggcatcgacccgctggagaccatgggctgggcccgctacggttcggccttgttgctgtcgaacgcggcgatgatgctgctcggctatatcgtcctgcgcctgcaggcggtgatgccgatcaacccgctggggctggccgcacaaaccccggacctggcgttcaacaccgccgcgtcctttattaccaacaccaactggcaggcgtactcgggtgaaaccagcctgtcgaacttcagccagatggcggtgattacctttctgatgtttgtcggcgccacctccggcgtggtcgcggcggcgggttttattcgcggcttgagtcgctcaagcgcggcggatatcggcaacttctgggtcgacttcacccgcacgctttaccgggtgatgttgccgctgtgcgtcggcatggcgttggtgtatgtgtggcaaggcatgccgcaaaccttcgcttcccaagccttggcgacgacgcttgagggcgcgcagcaacagttgatcgttggcgcggtcgccagctttgaatcgatcaagcatatcggcaccaacggcggcggctttttcagcatgaacgccgcccacccgttcgaaaacccgacgccgctgaccaacattttgcacatcctcagcatgttgctgatcccgtcggcgctgacttacacctttggcagcatgctgttgcaacgccgccaaggctgggtgttcttcggcacgtttctggtgatgttcatcggcttcctcgcgctggtgtatggcgccgagcaaaccggcaacccgctgctgacccaggccggcgccaaccagacactgtcgattgagcaaagcggtggcaatatggaaggcaaggaactgcgtttcggcatcgccgacagcagcttgtttatcgccaccaccaccgctgccactaccggctcggtgaatgccatgcacgactcgctgacacccatgggcggctttgtgcccctggcgcagatgatgctcaactgcgtgttcggcggtgacggcgtgggctttatcaacctgatccagtatgcgctgctcacggtgtttctggtgggcatgatgatcggccgcagcccggaatttctcggcaaaaagatcgaagcccgggagatgaaactggtgatgctttcggtgctcgcccacccgatcagcatcctcggtttcaccgccctcgccgccctctggccgggcaccctggccagcctcaacaacctcggcccccacggttttagcgaggtgctgtacgcctacacctcgggcaccgccaacaacggttcggcgtttgccgggctgaatgccaacacgccgtttttcaacaccaccatcggcctggcgatgttgatcgggcgcttcttcacgatgttgccgatgctggccgtagccggttccctggcgatgaaaaaaaccgtgcccgccggtgccggcaccatccccaccgcgaccccgctgttcatgctgctggtggtgttcgtggtgctggtggtcggtggcttgaccttcctgccggcgctcgcgctcggcccgctggtggagcaactgcagttgctgtccggccagacgtacaactaaggacttgttgatgacgactcaatcgatattcaaagggctgctgcgcccagtgctggtgtcggcggtgtttttcatgctgctgaccgggctggcgtaccccgccttcaccaccgtggctgcgcaactgttattcccgtatcaggccagtggctcgctgattgaacgcgatggtttggtgatcggctcggcgttaatcggccagaacttcgccaaacccgagtacttccagggccgccccagcatgaccctcggcgccgacccgcaagacccgagcaaaagcatttcgcagccgtacaacgccggttccagcggcgccagcaacctcggcccgaccagccagaaactgctggaccaggtcgccgcacgcgccaaggcctatcgccaggacaacggcctggccgccgacgccccggtgccggtggacgcggtcaccgcctccgcctcgggactggacccacacatctcagtggccaacgcccggctgcaattggcgcgggtcgcacgcttgcgccatatccccgaggccgagctgctgcaactgctcaacgaccacaccgccgcgcgcaccctcggcctgctcggcgagccacgggtgaatgtgctgcaactcaacttggcgctggatacccgtcagccctctattgcggtcagtgagtaagagattaccctcatgaagaatgctcgtttacccctgtttgaccaacgcatcgtgctcactgccggcatcgacgcgctgaagaaactgctgccccaggcccaatggaaaaacccggtgatgttcgtggtgtacctgggcagcatcctcaccacgctgctgtggttccaatccctgggcggcaagggtgaagcgcccagtggttttatcctcagcatcaccttgtggctgtggttcaccgtgctgttcgccaacttcgccgaagccctggccgaaggccgcagccgcgcccaggccgcgagcctgcgcgggatgaaacgccagaccctggccaagttgctgcagcagccgcgccacggtgcggcctggctgccattggaagccagcctgctgcgcaaagacagcgtggtgttggtcgaagccggtgacctggtgccgctggacggcgtggtaattgaaggcgtggcctcggtggatgaaagcgcgatcaccggcgaatcggcgccggtgattcgcgaggccggtggcgacttttcctcggtcaccggtggcacgcgggtgttgtcggattggctggtggtgcgtatcagcgtcaaccctggcgaatcgtttctggaccgcatgatctcgatggtcgaatcggccaagcgccagaaaacgcccaacgaagtcgccctgacgattttgctggtgggcctgaccctgctgttcctgctggtgatcgccacgctgagcccctactcgatcttcgccgtggcgatgagcggcagcggcagcgtgatcagcgccacggtgctggtggcgttgctggtgtgcctgatccccaccaccatcggcggcctgctctcggccatcggcgtggcgggcatgagccggatgatgtcagcgaatgtcatcgccacctcgggccgtgcggtcgaggcggcgggtgatgtcgacgtgttgctgctggacaagaccggcaccatcactttgggcaaccgccaggccagcagctttttgccggcacctggggtcaaggaagccgagttggccgacgccgcgcaactcgcgtccctggccgacgaaaccccggaaggccgcagcatcgtggtactggccaagcagaaattcgacatccgcgcacgggacatcaacgccctgggcgccagctttgtgcacttcaccgcgcaaacccgcatgagcggcgtcgacctgcccgaaggccgggcgattcgcaagggcgcggcggatgcgattcgcagccatatcgaagccttgggtgggagttttccggcggcgttgcaggccaaagtcgatgaagtgtcacggcgcggcagcacgccactggtggtcagcgacggcgccaaggcattgggcgtggtcgagcttaaggacgtggtcaagggcggcatcaaggagcgcttcgccgaactgcggcgcatgggcatcaagaccgtgatgatcaccggcgacaaccgcctcaccgctgccgcgattgcggtggaagccggcgtggatgacttcctcgccgaggcccgcccggaagacaagctgcaactgatccgcgactaccaggcccagggcaagctggtggcgatgactggcgacggcaccaacgacgcaccggcgctggcccaggccgacgtggcggtggcgatgaacagcggcacccaggcggcgaaagaggccggcaacatggtcgacctcgacagcaacccgaccaagctgatcgaagtggtcgaggtcggcaaacagatgctgatgacccgtggggccctcaccaccttcagcgtggcgaatgacgtggcgaagtacttcgcaatcatcccggcggcgtttgtcgccacctacccgcagctcggcgcgttgaacgtgatgcacctgagcagccccaactcggcgattctcagcgcagtgatttttaacgcgctgatcattgtcgcgttgattccactggcgttacgcggcgtaacgtaccgcgccatcggagcggcggcgttgctcaatcgcaaccttttgatctatggcctgggcggtgtgctggtgccgtttgccgggatcaagctgatcgacatgctgctgagtgggttgggtctcgtgtaagccacaccatcactcaaatgtgggagctggcttgcctgcgatggcggtgggtcagcttgccctgtaccgactgacacaccgccatcgcaggcaagccagctcccacagggaacagcactgcattcaccaggaagaatatgcccgcattaaacgatgatcgccccgaccccgacgccctgctggcccgggtacagctggaagaacaggccgccttgcgcggcaaattgcgtatctacttcggctccaacgcgggcgtcggcaaaacctgcgccatgctcgcggcggcgcaacgcgaagtcgccctgggccgtgacctgctcgccggggtgatagaaacccacggccgtgccgagaccgccgaactgctcaaaggcctggaacaactgccccgcgccaccttgctgcaccgcgagttcgccctcagcgaattcgacctcgacgccgccctgcgccggcaccccgccgtggtgctggtggacgagctggcccatagcaacgtgcccggctcgcgccaccccaaacgctggcaagacatcgaagaactgctcagcgcgggcattgacgtgtggaccacgctcaacgttcagcacctggaaagcctgaatgacctggtcagcggcatcatcggcattcgcgtacgcgaaacggtgccggatcatgtgttcgataacgctcacgaagtggtggtgatcgacctgccacccgacgaccttttgcaacgtctcaaggacggcaaggtgtacctgggccctgcggcggcgcgcgcctcgcagcactttttccgcaagggcaacctgctggcgttacgcgagttggcgttgcggcgcacggcggatcgggtcgacacgcaaatgcgcgtgtaccgccgcgaacagtcgatcaaaaccctctggccggctcgcgagcggctgctggtgggcatcgccggagataccggtgatgaacgcctggtgcgtgaagccgcgcggctggcacaaaaactcgaagccgactggatcgtcgtgcatgtggccacccatcaaggccgcggcgccaggcgttacctgacggcgatgaagaccctggcgctggcgactgaattcggtgccgacgccgcgacgctgccaggcatggacgtggccgaagccctggctgcctgcgcccgcgaacacaatgccaatcgcctcgtgcttggccaccctccgcgccgggcctggcggttctggcacccgtcggtgagcgaccggatcagccggcaccatccgcaaatcgatcagatcgtgatcgcccacggcgtattgcctggccctacgcctgcgatcaaacagtcgacgccggcaccgagccgagccttggcctacctgtgggccaccctcgcctgcttcgccgccagcgccatcgcggctttgctgctgcaagtgttcgacctggccaacgtggtcatgctgtttttgctcacggtggtgctggtagccctgcgttttggccgtggccccggcgtgtgggcggcgatgcttgcggtgttgtgtttcgacttcttttttgtgcagccgcgctactcgttcaccgtcaatgacacccagtattttttcacctttgcgttgatgcttggcatcgccctgatcaccgggcaactcaccgcgcgcctgcgctacgaagcacgcaccgccgccgcgcgcgaacgccgcgcgacctcattggcgcggctggcccgtgacctgtcggcggcgttaaccgtggagcacatcagcgaagtggccctgcgcaccttcagcggcgtgttcgaagcacgggtcggcctggcactgccggacgcggccgatggcgtgcacagcgtcagtgccagcgggctgccgattgacgacagcatcgcgcaatggacctacgaccacggccaagccgccggccaaggcaccgacacgctgtcggcggccaaaggttgctatttgccgctcaaagcgccgatgcgcgtgcgcggcgtgctggtgctggaactggcgcaaagcgagcgcctgaatgacccacaggaacgtcgcctgctggaagcctgcatgagccagctggcgattgcgttggagcgcgtgcactttgtcgaagtggcgcaaagcacgctggtgcagatggaaggcgagaagatgcgcaacaccctgctcgcggcgatttcccacgacttgcgcacaccgttgaccaccctgatcggcgccaccgacaccgccctgccccacgcgccaccggggccgttgaccgagttgcttaatggcattcacgaacaggccacgtcgatgcagcgcctgatcgaaaacctgctggacatggcgcgcatgcaggagcgcggcgtgcgcctgaaccggcaatggcattcgctggaagaaatcgtcggcagtgcgttgcgccagttgcgtgagccactcgcccgtcaccgcgtgcacaccctgctggacccgacattgcccctggtggacatcgacgcactgttgatcgagcgggtgctggtcaacctgctggacaacgccgccaaatacaccccgccgggcaccgccattactgtcgccgcacgcgcagtggcagacagcatcgtgctggaagtgagcgacaccggcccgggtaaagcgccggcgaacctgttcgaacccttcgcgcgcggccagcaggaatcgtccgttgccggtatcggcctgggcctggcgttggccaaacgcattgtcgaggcccatggcgggcgcatccacgccaaccccggcgatgcctgcggcatgcacttcatcatcacgttaccggcgggcactccgccgcccatggaagccctatgagcactgcacgcattttgattgttgaagacgaagccaatattcgccgctttgtcgggatagccctgcaagatgagggttttcaggtattcgaagccgacagcgtcaagcgcgcgctgatccatgccgccagccgccagccggacctggtgatcgtcgacctcggcctgccggacggcgatggcaaacaactgatcagcgaattgcgcggctggctggcggtaccgatcctggtgctgtcggcgcgtgatcgcgaagaagaaaaagtcgccgcgctcgacgccggcgcggatgattacctgaccaagccattcggcgtgcccgagctgctcgcgcgcatccgcgcgcaattgcgccggcatgggcagaccggcgccgtggcggccaccagcaaagtggcgtttggcgagattgaagtcgacctgtcgacccatgaggtgtggcgccagggccagccggtgcacctcacgcccatcgaataccgcctgctctgcgcgatgattcgcggccagagccgagtgctgacgcatcggcaattattgctggacgtgtgggggctggattacgtcgaccgcgctcattatttgcgcgtgcacatggcgcatttgcggcaaaaactggaagcggacccggcgcagccaaagcactttattaccgagttgcaggtggggtatcggttgatggggttataggaaaatactcgctcacctggctcggggtcgatacggcacaccagggccatcaaattttgcctgggcggttataaagcctgaattggcggcaccctccgatcaggcaggagagcatccgccgctgcgccattaacaacaggctcccgccattaaaggcaattatttaataatatcgcgctgttggacgccgtccgcccgcactttaaaatcgggtgcttgactgccacgataaataaactccttccagtacaatacatacgtttcgccagccgcacctgattgaatttccaagtgagaggcattaggcacaacatagtgcgtgttaccttgaggagtagcaaaagcactgatatctagtttgtccacgccggttttaaacccgacgacagtatcaagcctgtccggggtggagtccgacagattttgaaaggcaaccgtgttgctgcctgaccctaaagtaatcgtattagacacggcattcggaaccaccctattagtccccgcccccgtcttgacatcctcaatgaccgcgtgcgacgcaatcactacgttctccttgaatccgcctacactagagcgcgccccagaatgcatatcgataacttgatcatgcgtatcacctgttgcatcgagggaatcatgaccgaacccgttcactataaccatcgtcgcgggactattatcacgccccaggttaccaatcagatattcagccccggaaatgtctgtatttaatttgtaagcagggatcaaccgctcgtaatcttttatttgcggacgcgttacagccttatctttatagtcttgacctgtagtcatttccgaatttcgactgtgaacgctgtaacctctggagtcaggttcaccctccgcaggtgtacgagcaggtacgcccaatgaatacaacaacgcgcgagcaagcaaattcccccctctgttaagcgcggtaggcgccaggaaagcctgatctttggggttatcagggttgctacgaatataaacctcggtcggtttggttgggtcagttgatggataaccaaccaccaggttggagcgtatttcattctgcttgaaagtcccaaactttaccttcccatcgggggtggcgtaagtaccctttgcgtgaaacctgacttgtaaatcgacgcccaagtcactcatctgagcgtataactcgcgcctctgcgcagcattaagcggttgatacccgcgattaccaagattttcaaagtgtgtgccaggcccactatcataatccacttcgatatctacccacccattaccatccctgtccttaaaggacgtagcggtgtccacgttattccgagaggttgtcagggtatcgtttgcttgtcccggcgctggcgaatgagtaaccggggtgaaagacggagaaggagtcgatgtggaggagccaatactcataaaaaccacctgcgcaaattaataaaggaaaatttacatcacgcacaccttacataacccataaataaaaaataaacagggataatttgagcagatatttcacgtctaaaaccgggcaaacttccgcaacaaaccagccaaaaaccagcccctctcaacagaataaccctacattaatataatcgttccgaacatttagaacactcactaaaaagtcttttacattttaagtactaacatcaatatgacccgcgcagcccctgcccttcattaccagtgcgggcggatagccgattcaaagaggtgtaaacaagcgctcggcagcaaagtctacaaacacgcggatttttggcgagaggtgccggctggaaggccacagcgcccagaattggccctgatcgtcggagtgcgcgtccaatacggtttccagctgtgcgtgagccaacgcctcgcgggcgaggaagtccggcacgtaggcgatcccatggccatcaatcgcagccctgagcatggcttccatattgttcaacgtcagcgcagtgggcaggcgcaattgggtgatcgccgggttggcggataaggtccagtccgtgatctttccggtgctggcaaagcgataacgcaggcactggtggtgttccaggtcactgagggtggtaggccgaccgtgagtgcgcaggtacgctggggctgcacacaacacaaatcggaacggcccgagtttgcgcgccatcaatgtcgagtcggccagcccgccgctgcggatcaccacgtcgaagccttcctcgatcacgtccaccaagtggtcgttgaaatccagctccaactcaatctccgggtaggcttgccggaacgcgagcatgtgcgcaaagagaaagcgataaccgatggtgggcaggctgacacgcagtttgccacgtggcgcctgcatcacatgggagagcatggcgcgggcgtcttgcaggtcatcaagaattttgcgactgcgctcgtagaacaattggccttctgcggtgaggctgactttgcgggtactgcggtgcagcagccgcacattcagttcagcctccagcctggcgacatttttgcccaccgccgacgcggaaatgcccatcgcccgcgccgcaccgataaagctgagagcttcagccgttttcacgaatgcgatgacgccgctgaggttgtccgtcacgctattacatcctttttgtccactatgatcggaatgtaggcctgtttatcgtcaattgcatcccgcttagagtctttatctttccagacctgcgggaatcccccatgaacgctacaacccactccacccatggccgctatgccatcctggccgccgtctgcctggcggccctggtattacccatgagtttcaccggtggcgcagtggctacgccctttatcggtgaggctttcgccgcccgccccacacagttggcgtggataaccaacgcgttcatgttgagtttcggcagcttgttgatggctgccggtacgctcgccgacctctatgggcgcaagcgtctgttcttgtggggcatggcgctgttcagcgcagtctccctgctgttggccatggcaccgggcattctctggctggacctgttgcgcgggatgcaaggtgtggcggcggccattgcgttgtccagtggctgtgcggcgctggcgcaggagttcgatggccatgccaggacacgtgctttcagcctgttgggcacgacctttggcgcgggcctggcgtttggcccgttgctgtcgggactgctgattgaacaatggggctggcgtgcgattttcctcgcgacggccttgctcgcggggctttcactgctgttcgccgcacccacaatgcgcgaaagccgcgacccgaacgcactgcgcctggacctggcggggatgttgacgttttcggccacgctggtggccttgaccaccgcggtgattctggcaccggaacagggttgggccactgcgaccacctattacctgctgggcgcagcagcgctgtttttactggcgtttatagtcgttgaacatcgcaccagccaaccgatgctggacttgcgcctgtttcgcttcccccgcttcatcggcgtgcagttgctgccaatcggcacctgttactgctatatcgtcctgatcgtgctgctgccactgcggtttatcggcgttgaaggcgccagcgcatttcaagccgggttgatgatgctggcgctgtcggcccccatgctggtggtgccgatcctcgccgcgacgctgacgcgctggctgtcgccgggcgtgctgtgcgccattggcctgctgatcgcggccgtgggtttgtatggactgagcctggccgacgtcggccagcccctgcagaccgtggcggcgatgctcattatcgggatcggcaccgggttgccgtggggcttgatggatggcctggcaatcagtgtggtgccaaaggaacgtgcagggatggcggcggggattttcaatacgactcgggtcgccagtgaaggtgtcgcgctggcaatcaccgtggcagtgttgagcgcgctggtcgcgcatcatctgccggccagtgctgtgcaacagggttcaaccgtcgcccagcagttggtcatgggagatacccggcacgccagcgccaatatgccattggcattgctgcgcaccgcctacatcgccgggttcaatacattgctgcaagggctggcggggcttacggtgctcacggcggcggtggtctttacgtttcttggccgacgcgatgcagcaccgatgcacacgtcacccgtcgtcgagcgattaagctgaatcgcaggcaaaaaaaagcccgctcaatgagcgggcttcttgtggcgacctggcgttcagcgttccaggtgaccgaatatggcgcagcggacgggactcgaacccgcgacccccggcgtgacaggccggtattctaaccgactgaactaccgctgcgcgtaacacttgaagcgaatggtgggtgatgacgggatcgaaccgccgaccctctgcttgtaaggcagatgctctcccagctgagctaatcacccttcgtttcggtgtgggcgcatcatacaacaaaaaatcgtaatgtgttgatttaaatgcaatttatttaaaaaaacttcatcgagcgatttttcgccatatttcggacaaaaaaaacccgctcaatgagcgggctttctgtggtgacctggcgttcagcgttccaggtaaccgaatatggcgcagcggacgggactcgaacccgcgacccccggcgtgacaggccggtattctaaccgactgaactaccgctgcgcgtaacacttgaagcgaatggtgggtgatgacgggatcgaaccgccgaccctctgcttgtaaggcagatgctctcccagctgagctaatcacccttcgtttcggtgtggcgcgcattctacggagcgaccctgggtctggcaagcactttcttaaatcttttttttcagcccttccaatggcttaggcagggttggcctcaggcgatatcaagagaataatgcccccctttgtataaaggagagactcaccccatgtggttcaagaacctgcttatctatcgcctgacccaagatctgcctgttgatgccgaggcgttggaagcggccatggccaccaaactggcacgcccgtgtgcaagccaggagttgaccacttacggtttcgtcgcgccttttggtaaaggcgaagacgctcccctggttcacgtcagcggcgacttcctgctgatcgccgcgcgcaaggaagaacgtatcctgccgggtagcgtggtgcgcgacgcactcaaggagaaagtcgaagagatcgaggccgagcaaatgcgcaaggtctataaaaaggaacgcgaccagatcaaggatgaaatcatccaggctttcctgccgcgcgcctttattcgtcgctcgtcgaccttcgccgccatcgcgccgaaacagggcctgatcctggtcaactcggccagccccaagcgcgccgaagacctgctgtcgaccctgcgtgaagtgatcggcaccctgccggttcgcccactgaccgtgaagaccgcacccaccgcaatcatgaccgactgggtcaccacccagaagccggccgatgacttcttcgtcctcgacgaatgcgaactgcgcgacacccacgaagacggcggcattgtgcgttgcaagcgccaggacctgaccggcgaagaaatccagttgcacctgaccaccggcaaagtcgtgacccaactgtcgctggcctggcaggacaagttgtccttcatgctcgacgacaagatgaccgtcaagcgcctgaagttcgaagacctgctgcaagaccaggcggaacaggacggcggcgacgaagccctgggccaactggatgccagctttaccctgatgatgctgacgttcggcgagttcctgccggcgctggttgaagcgttgggcggtgaagaaaccccacagggcatttaagccatgtgaagatcaaaatgtgggagctggcttgtgtgggagccgggcttgcccgcgatgcaggcaccttggtcttcagctagatcgagttgatgctatcgcaggcaagccagctcccacacaagcccgctcccacatttgattgcatttccgaaactaataacaaggacatccccatgcgcgcactcgccgccttgagccgcttcgtcggcaataccttcgcctactgggtgttgattttcgcggtgctcgccttccttgagcccgcttggttcattggcctcaaaggcgccatcgtgccgttgctgggactggtgatgttcggcatggggctgaccttaaaacttgaagatttcgccgaggttgcccgccatccgtggcgcgtggccctgggcgtggttgcgcactttgtgatcatgccgggcgtggcctggttgctgtgccaggccttccacctgccgccggaaatcgccgtcggcgtgatcctggtgggttgctgcccaagtggcacctcgtccaacgtgatgacctggctggcccggggcgacctggcgctgtcggtggcaattgccgccgtcaccaccctcctcgccccactgctcacgccggcgctgatctggctgctggcgtcggcctggctgccggtgtcattcatggagttgttctggtcgatcctgcaagtggtgctgctgccgatcgtactcggcgtgatcgcgcaacgcgtgctcggcgagcgcgtgcgccatgcagtggaagtattaccgctggtgtcggtggtgagcatcgtgatcatcgtcgcggcggtcgttgcggcgagccaggcgaagatcgccgaatcgggcctgttgatcatggccgtggtgatgttgcacaacagcttcggctatctgctgggctacttcaccgggcggctgttcaagctgccgttggcgcagcgcaagtcgctggcgctggaagtgggcatgcagaactccgggctgggcgccgccttggccagtgcgcatttttcgccgttggcggcggtgccgagcgcattgttcagcctctggcacaatatttccggggcgctgctgtcgacgtacttccgccgcatgagcgaaaaggaagaccgtcgcgcgttggcgaacacacccgaatcttgatcgcctgatcaattttcggcactctaccgagcttcgcggggacgacctcgcgacgctgtcgagcgcttattcaggggacgaccccacttttaaaagagaggtcatcatgtcctggatcattctgttttttgccgggttgtttgaagtcggctgggcggtcggcttgaagtacaccgacggcttcagcaagccactgccgacggccctgacgatcgccgccatggccatcagcctcggcctgttgggccttgcgatgaaagaactgccgctgggcaccgcctatgccatctggaccggcgtgggtgcggtaggcacggtgattgccgggattatcctgtttggggaatccatggcgttgtttcgtttggcgagtgtggcgttgattatttgtgggcttattggcctcaagatcagcgcctgattcaataccgccatcgcaggcaagccagctcccacatttgactgtgttcacaattcaaatgtgggagctggcttgcctgcgatgaggccttcacggctagccgaaaactacctgacactcccccgcaacacccccactcgctcctgcaactgcgcaggcgtcgccgcctccaccgtcactggctcacccgccaccagcaccacccgcgaccagatccgatgaaagaagcccttgttcggatcgcggctgaaaaagctgccccacaagccctgcaacgccatcgggatcaccggcaccggcgtctcctccagaatccgcgtcacgccaccgcgaaacgcgttcatctcaccgtccgcggtcagcttgccttccggaaagatgcagaccaactccccttccttcagatactgcgcaatccgcgtaaaggccttttcgtagatctggatatcttcgttgcgcccggcaatcggaatcgccccggcggtacggaagataaagttgagcaccggcaagcggtagattttgtagtacatcacaaagcgaatcggccgacgcactgcgccgccgatcaacagcgcatccacaaacgacacgtggttgcacaccagcaaggccgcgccttcatccggaatcaactccaggttgcggtgctccacgcggtacatggaatggctgagcagccagatcatgaaacgcatggtgaactcggggacgatcttgaagatgtaggtgttgaccgcgatattgagcagcgacaccaccaggaacaactcggggatcgacagcttggccacgctcagcagcagaatcgagacgatggccgagaccaccatgaacagcgcgttgagaatgttgttggcggcgatgacccgcgcgcgctcgttctcggcggtgcgcgactggatcagcgcatagagcggcacgatatagaagccaccgaacacgcccaaaccgaggatatcgaacaacacccaccacgcctggccgtagccgagcaccgccagccagtcgttggcctgcacattctgcgggaagccgccggagtgccaccacagcagcaggccgaacaccgtcaggccgaacgagccgaacggcaccaggccgatttcgaccttacgcccggagagtttttcgcagagcatcgagcccagggcgatgcccaccgagaatacggtgaggatcaacgtcaccacggtttcgtcgccgtacaaccattctttggcgtaggccgggatctgcgtgaggtagatcgcgccgacaaaccagaaccacgagttgccgacaatcgagcgcgacaccgccggcgtctgccccaggcccaggcgcaaggtggcccaggactcgctgaagatgttccagttcaggcgcaactgcggcgtagacgccgccgcgcgcggaatgctgcggctggccaggtaacccagcaccgccacgccgacaatcgccgtcgccacgattggcgcgtaatgggtggacgacatcatgatcccggcgccaatggtgcccgccaggatggccagaaatgtgcccatctccaccaggccgttaccgcccaccagctcatcgtcgtgcagggcctggggcatgatcgagtacttcaccgggccgaacagcgccgagtgcgtgcccatggcaaacagcgccaacagcatcagttccaggtggttgaacaaaaagccggtggcgcccacggccatgatcacgatctcgccgatcttgatcgcgcggatcaatgcgtccttgttgaacttctcgccgaattgcccggccagcgccgagaacaggaagaacggcaggataaacagcaaggcacacaggttgacccagatcgagcgatcaccgtcgatggtcagcttgtagagaatcgccaggatcagcgattgcttgaagatgttgtcgttgaaggcgcccagcaactgggtgatgaaaaacggcagaaaacgccgtgtgcgcagcaaggtgaattgtgaggggtggctcatcgtccgtgttcctgcgtggcctgtaggctattgttgatcttcaggccacgactttacctaatcccgcttacttattcgctagccccgcaatgcaaggtgaaacaaaaagctcgcctttatacgcgccctgcaccgtgcgcgaggccacgatcagccacatcaatgccaacgccaccaccagcacactgccgaatacgctgaagaaccccaggtgcagctggctggcgagcttcaacgttgccaaggcgtagacgcccagagggaaggtaaaaccccaccaacccaagttgaatggaatgccggcacgcaggtaacgcagggtgatcaacacggcgatcagcatccaccacaagccaaaaccccacagggtgatgccggccaccaagccaaggccgttggccatttcgccgacgcccggcaaaccattggcggcgaagatcgcgggggcgtcgccgcccagcaacagcatgcccagcgcaccggtgccgatgggcccgagggcaagccagctcgacgcggccatgttggcgtggggcagcttatgcagggccatgcgcagcatcaggatggtcaggatgctgaacgccaccggcagggaaaacgcccacagcacgtagctggtcaccagcatcaccagttgcgaatgcgcgtcggccaggtgcggcgccagcaggccgccactggcggcggcgacttcggccgccaccacgggcagcagccacacggcggtcatctggtcgatgctgtgctcctggcgggtgaacatcatgaacggaatcaacacgccgcacgccagggccatcgccacgtccagccaccacatggcttcggccaacggcaccacatcggcgccccagcgcggcaggccgaacagcagcaggccgttgataatcgtcgccaggcccatgggaatggtgccgaagaacatcgacacggtggaatgcccgaaaatgcgccgcgcctcgtggaaaaacatcagccaacgggccgcgtacaacacgctgaacagcacaaacaggccgacggtgaacatccacaggccttcggcaatcgcgtgcacgccgggcaggttgatcggcaattgggccagggcaagggccaacacgccggtgcccatggtcgcggcaaaccagttgggggtgaactggcgaatcacttcccgtggacgggtcaggtgactgaacggtttatagctgatggcgcttgagcaggtcatgtctgtaatcctcttcctcgcatgaggttgaggccatcatagaacctgatcgaatatctatataacgggtaatatctctaactgttatctactttaccaatatacagacactcactcgatcgcagccttggccagcgccgaacgctgcagcagcaacccggccagcgcgccgagggccagcacgatcagtacggcgccgtagccatcggtggtggcgatcaggccaaacacccggctcaggttacccgccagcagcgccggcacgcagaacgccaggtagctcagaacatagaacgccgacatcaaaccggcgcgctcatggggcagcgccacgcccacgatgctgcgcacactgcccatgaagccgccgccaaaaccaaagcctgcaatcacactggcgacaaaaaacagccacagactggcgctctctaccgcgaccaacagcaaggccacgcccaccgccaacagcaccgccgagagacgcatgactttgtctgccggatgttcgcgcaggctgtaaatcatgactgcaccgctcagggtcacgactgccaccaggccgccgccgatcaggtgcgaagtcgagccggtcgaagcccgcaccagcgaaggtgccagcgaggaaaagaacccgcccaacgcccacaccgccacgttcagcggcatcgccagccacaaggcccggcgtgcttgctcgggcacgtgcagggttggcgccaatgacttcaaggcacccggaatgcggctgacggtttccggcaagcgccacacatagagcgcttgcagcaccatcaagcccagcagcgtgaagtaaatcaactgggtcgggcgtggtgcgtattcgacgagcaagccgctgcccagagcgccactggccatgcctaaaagcggcgcgaggctgttgagcatcgggccgcgcaggcggtcggtgtccagcagcgtcgccgccagcaccgccgtcgccgtgccggtggcaaaaccttgcagcgctcgggcggcaatcaggtaggcggtgctgtcagcattgataaacagcagcatcgccacactattgagcagcagtgcagcaaaaatcaccggcctgcgccccaagtaatccgacaatgaacccacggtcagcagcgccgccagcaagctcacggcatacacaccgaagatcaccgtcagcatcgccgcggaaaaatgcaggttgtcctgataaacctgatacaacggcgtcggcgcgctggacgcagcgaggaaggtcaacatcgtgatgaccaggaacgccaggctggaacgttgagaaatgacgctaggcatgtgcacactccgctaaagctaatattttgcttttgcagagtgtgctaccgggaagcgcttaaagcaaattctttgtgttaaggttttatccatggcgattaaagaaggccttcgcccggggggccgcagtgcccgggttcaagaatcagtgcataacgccgcgcgcgaattgctggaagcccacgagcgttccaacgttaccgtgccgatgattgctgcgcgcgcgggtgttacgccgtcgaccatctaccgacgctggggcgacctttccgcgctgctcgccgacgtggcgctggaacgcctgcgcccggacagcgagcccgccaacaccggcagcctgcgcggcgacctgcgcgcgtggggcgaacagtatctggatgaaatgagttccgagctgggccgcaacatgatgcgcgacgtgcagtgcagccatcccagggactattgcagcaacattctgatgggccagatgcaggttattctcgaccgttatcagggcggcgcagatgtgctgccgagtctggaccgactgctgaatctgattgccgcgccgacggtgtatcgcagtttgttttccagtgcgccgctgccggttgaagagctgcatgaactcattgagttggcactgaaagcctaaaaaggtgggagctggcttgcctgcgatagcggtgggtaagaaaacacacctgtagctgacagaccgccatcgcaggcaagccagctcccacctttgccctgtgtcactcaacaaaaaaggcctcacatggaggcctttttctatggcggagcgacgcttacgtacgcatcccacgcccactcaccaacaaccgcgcgcaccctacatacagcaccacggtcgccaccagcatgaaggtgatcgccacgctgatcttgatatccgacacacccaaaatgccgtagcggaacgcattgaccatgtgcagcaccgggttggccagcgacacggtctgccagaacggcggcagcaaggtgatggagtagaacaccccgcccaggtaagtgagcggcgtcagcacgaaagtcgggatgatcgaaatatcatcgaaattgcgtgcaaacacggcgttgataaagcccagcagcgagaagatcgtcgccgtcagcaccaccaccacaagggtgaccccaaggtgatgcacttgcaggtgggtgaagaacagcgacagcaaggtcacgatcacgccgaccatcaagccgcgcaacacaccgcccaaggtgtagccgatcagaatcgtgtgcggcgacaccggcgagaccatcagctcttcaatggagcgctggaacttgctgccgaagaagctggagaccacgttgccgtaggagttggtgatcaccgacatcatgatcaggcccggcacgatgtactccatgtaggtgaagccacccatgtcgccgatctggcgaccgatcaggttaccgaaaatcacgaagtacaggaccatggtgatcgccggcggcagcagggtctgcggccagatccgggtaaagcgcttcacttcgcggtagacgatggtctgcagcgcgacaatgttgggttgcagttcggaactcataccgccaccttcgccagatttttctccaccagggacacgaacaactcctcaaggcgattggttttgttgcgcaggctcagcacttcgatgttctgggctgccaattgagtgaacaacgcggtaatgcccatggccttgtccacctggacttccagggtgtgcccgtcgaccagccggcttgggtagccgagcagttgcggtgccaccgacaggttgtttttcaggtcgagcaggaaggtttccacatgcagctggcccagcaggttacgcatgctggtgttctcgacgatggtgccgtggtcgatgatgccgatgttgcggcacagctgctcagcctcttccaggtaatgggtggtgaggatgatggtgatgcccttctcgttcagctcggtgaggaaggtccacatcgagcgacgcagttcgatgtccacacctgcggtcggctcatcgaggatcagcaggcgcggttcgtgcaccagggcgcgggcgatcatcaggcggcgcttcatgccaccggagagtgagcgcgacggcacgtcccgcttgtcccacaggcccaattgggtcaggtactgctcggcgcgttccttggcgattttcgccgggatgccgtagtagcccgcctgggtgacgacgatgtcgaaggttttttcgaactggttgaagttgaattcctggggcaccacgccgatcgagcgcttgagcgctgccggggatttgtccaggtcatggccaaagatattcaccgagccgctggtcttgttgaccagggtggagaggataccgatggtggtggatttgccggcaccgttggggccgagcaaggcgaagaagtcaccttcggcaacgtccagatcgataccactcagggcctggaaaccgttgccgtaggttttggttagctgccggatggacagagcggaactcatatcggaatacgcaccaaagaagggaatagaaagaatagatgagggcgcagcccaggtagttcaacggcggcgcatgacaggcatggtgcttgcccgcgccgcacaagtacagtcacccgtattaatagtgggtattaagtcaacgcggtcatcaccgctttgcggtatgccggccgctgttgcaagcgttgataccaggcctctagatggggcatcgaagggcgctcgatgggcatttcaaaccaggcgtagataaagctgcccaaagggatatcgcccatgccgatctcgttgccggacaggtaaggttgctcggccaaggctttgtccacggtgctcagtgcatcgatacaggcttggcgcccagcgttgatgctgtcccagttctgtttttccgctggggtgcgcaggatgccccagaacaccgccttgaacggttcggcgagggtcgaggtggtccaatccatccacttctcggcattcgcccgtgcttgcaggtcgctcgggtaccagctcgacgcctgcttggcgcagaggtaacgcacgatggtgttggattcccacagcacaaaatcgccatcttcgatcatcggcacccggccattggggttcaaggctcggtactgcggcgtgtcgaccacaccaaaagccccgcccgcatcaattgcctcatagtccaggccgagttcctcggcgcaccacagtgctttcctgacgtttgatgaatttttacgaccccagattttcagcatgaccgcgccttattgttggtgaacatggcttgatgaacgcagcagcatacgccggttcacgcgcggcttaaatcggtccgcatatcgcccaactgttgcggcatgtcttcggcgaacaggtgcgggtaacactgctgaatatgcgcgaagaaaaacgcttcgggcacgtcggaaaactgcccgtggtccaacacatactccatcgaacgctggccctggcgattaaacgcgtgaaacacgctgtcgtgaatgccatcgaacgccaatggcggcacatcgaacaattcgcacagttggctattgaacgccggggtggccttgacccaatggccgttcaagtacaactcggtatagccgtgcatagcgaacacatcgcttttgagcaacgcgatcaggcgcggcgtcgacagatgattgcgcacgtccgccaggccgatgcgcgccgggatcccgcagtggcgggcgcaggcggcgagcagggtggccttgggcacgcaataactctcaccggccgccaaggcgaagctggcgttcaaggtgcctgggtcgcggctgaaggtgtaggggttgtagcgaatcgtctcacgcacggcgtaataaagactgactgcctggtcacgcaaacccgcgctgggaccgcgatgtttttcagcgaactccaccaccgcagggtggtcactatcgatgaagcggctgggattcaggtacgtatccatgcgcgttatctccgaaggaaggcctgagtctaaccacaggcctaccctagcgataacgacgattcggccaaatgtcggcgcctggtgatcggtgcccgctgtacaactcgtaacaccctgatcaccgcgctttttcggatgccgactaagctccatggtggtttcgcccctggtttcacggaggattgaatatgctgttgttgtggatactggttctggtggtcggcattgcctacctggcacaccgccgcatcgcgcccctgcccgccctgggcgtggtcgccgtttacctgctggcgatgggcgcctggagccacgcaccgggttggctgctgctgatcttctgggtgttgatcgcggccgtggccctgcccttgctgctgcccgacctgcgccgccaatacttcaccaagccgctgttcagctggttccagaaagtcctgccgccgatgtccgagaccgagcgcgacgcgattgacgccggcaccgtgtggtgggatggcgaactgttcagcggtcgccctgattgggacaagttgctggcctaccccaaggcgcaactgaccgaagaggaacaggcgttcatcgacggccccaccgaagaactctgcgcgatggtcagcgactgggaaatcggccaggccatggacctgccgcccgctgcctgggaacacatcaagacgcatggcttcttcgccctgatcattccgaaggaatatggcggcaagggcttttccgcctatgcccactcccaggtcgcgatgaaactcgcgacccgcagcggcgacctggcttctaccgtgatggtccccaactccctcggcccggccgagctgctgctgcattacggcaccgacgaacaacgcaaccactacctgccgcgcctggcgcgtggcgatgacattccgtgttttgccctgactggcccgctggccggctcggacgcgggcgccatgcccgacaccggcgtgatctgcaaaggtgaatgggaaggcaaggaaacccttggcctgcgcctgaactgggaaaaacgctacatcaccctcggcccggttgcgaccttgctcggtttggccttcaaagcgcatgacccggaccacttgctgggcgaagaagaagacttgggtatcagcctggcgctgatcccgaccgataccccaggcgtagaaatcggccggcgtcacctgccactgggcgctgcgttcatgaacggccccaactccggcaaagacgtgttcatccccctggagttcctcatcggcggccaggaaatgctcggcaaaggctggatgatgctgatgaattgcctgtcggtgggtcgttcgatctcgctgcctgccgtgggcaccggcgcggccaagttcaccagcctggtgaccggccagtacgcccaggtgcgtgagcagttcaacgtgccgctgtcggccttcgaaggtattcaggaagccctggcacgtatcggcggcaacgcctggctgatggacagcgcgcgcatgctcaccgccaacgccgtcgacctgggggaaaaaccctcggtgctgtcggcgatcctcaagtaccacctcaccgagcgtggccgcgagtgcatcagccacgccatggacgtgcacggtggcaagggcatcatcatgggcccgaacaactacctgggccgtaactggcagggcgcgccgatcttcatcaccgtggaaggcgcgaacattctgtcgcgcaacctgatgatctttggccagggcgcgattcgctgccatccattcgtgctcaaggaaatggccctggtcggtcgtgaagaccgtgaccaggcgctgaaggagttcgatggcctgctgatgcaacacatcggtttcgccgtgagcaacgccgccagcaccctggtgctgaacctcggcgtgggccactttgaaaaagccccgggcaaccgcctgagccaaggttacttccgtgcattgaaccgtcaggccgcagcgttcgccctgctcgctgacctgagcatgatgctgctgggtggcgaattgaaacgccgcgaacgcctgtcggcgcgcctcggtgacgtgctgagccacatgtacctggcctcggccgcactcaagcgttatcacgacctggactcgccggaccacctggagccgctgttcgcctgggccatggaggaaagcctcggcgaatccgaacgcgcgctggatgagctgctgagcaacttcccgaacaaggtgctcggttgcctgctgcgggtgatcgtgttcccgtttgggcgtcgccataccgggccgtccgacgcactggatgccgaagtggccgcggtgatcggtcgcgccaaaggcgacccgaccctcgaagaactgctggccggctgctaccgcccgcaatcggcggaagatccggtcggcgccctgcaacatgcctacgacctgctcggtgccagccatccgctgcagaaaaaactgcatgccgcgctgaaaagcggccaggtcaagccgtctgccggcgaacatgccatcgacgccgcactgcacgccggggtgctgcaaccggccgaagcgcaaaccttgcgtgacgctgaagcggcacggcgcaaggtgatcgacgtggatgatttcagcaaggaagagctgacccaggctgagggtaaagtccgctaaccgctcatacccatacagcgaaggtcatataaatacgggcgcgtgagctatatactctcgcgcccgtttttgctttgaggacttatctcgtgtccaacgtcgttgccgatcatctcgtcttgctcgaccacttgcgcagcatcctggttgccgtcggcgaagccgaacaggtgcccgaggaaagccacaccctgttcctggagcgtttcgacgaattgcgcgccctgctgcccatcgacccgattgaaagccagtacctgggccaggacctgatgagccaggtcatcctgcgctacccgcaaatcgcccacctggtgccacgcgacctgctgtggttcttcggcggtgactgcctgcacttcatgccggatgaagaactggacctgtaccaggccctggaagaacgtcgcttcgaagccgaacagaacgatgaaccgttcgactggaaccaggaaaaacagctgctggccatgccgcaggatcagagcaagcactgatcccggctgacaccctgtttttctgtgggagctggcttgcctgcgatgctggcgactcggtctgtaggtcgaaccgaggcgatgccatcgcaggcaagccagctcccacataagccagctcccacacaagccagctctcacataagccagttcccacacaaaccagcccccacagctaccgacggctcagggtaggctcgcgcgccatacactccaccagataatcaataaacacccgcaacttcggcggcagataccgcgtcggtgaatgcagcaaccacgcctcgccgtggtacgacgcaataaagtcccactcgggcaacacctgcaccacactccccgcctccaatgcatgccgcgccgtgaaatacggcaagctgccaatgcccacatgctgcaacaccgcatccaagcgcacgccggtgtggttcgccgcgtagcgcccgcgcacgccgaccgttacggccttgccggcctgacggaatttccagcgcgaatcgccaggggtttcaccgagatagatgcagctgtgcgccagcaaatcatgtgggtggccaggcgtgccatgctcggccaggtactgcggcgtcgcacagagcaagtgttcgatgggcagcagttgtcgccccaccagccccggtggcgggctgtcggtgatgcgaatactcaggtcgacattgtcatcgatcaggtccacatgccggtcctcaaggatcaactgcacatccaccttggggtagcgccgcagaaattccggcatatgcgggtgcaccacaaatcgtcctacggccttgggtacgctgacccgcaccaggccttcggcttcgtgagtgaactggccactgatttccatcaccgaacgcgccgcattgaccatctcctggcaacgcttgaacacctcttcaccgccttcgctgaggcgcaattttcgcgtggtgcgttgcagcaaccgcgtggccagggccttttcgaggcgcgagatgctgcggctcaccgccgaaggcgaaacgctcagttgtcgcgccgcttcagagaaactgccggtttccaccactttgacgaatatcgccatctcgcccagcagcggcaaaggaagattgatgctcatgacgcacaggtccattgataattgagcggattatcacccatctgcgcactatttatactgcccgtagaaccctgatgcggatgtagatgatgaccgaacgcctgttttttacccacgaccacctgaccgccgagcttgaagtgctgagctgtacgccgcacgaggagcagtttgccgtcacgctgcagtcgacgatttttcatccgcagggcggcgggcaacccttcgacaccggctggctgggcgacagccaggtgctgcgcgtcattcaggaagccgaccgcgtggtgcactatgtcgaccggcctgtggagcccggcccgatcattgcgcgggtcgatgaacaacgccgcgccttgtacacgcgcctgcactcggccgggcatttgattggcaatgccggggaaagcctgggctggatgccgatcaaggcccaccactggccgggcgaatgcaaaatcacctttacccgtgggcacgcggcgcaagccattgatgccgaggcgattcaaacgcggatcaaccaatggatcgccgaggaccatgcgcgccatatgaccctggaagatggcacgcgcaaagtcggcttcggcgaattgcccgcctacgcgtgtggcggcacccatgtgcaagccttgagcgaactgggccacgtgacgattctggccctgtcagagaaaaagggcgcgctctcggtgcgttacagccttgactgacagcacagcgggctcgttggtggtgccacctgtgggagtgggcttgcccgcgaaggcggcggcccagcaaacatcaaggttgactgacccaccgctttcgcgggcaagcccgctcccacaagggatcttcgctgcgactagcccgcctgcccgatcaaacctgcacactccccagcagtgcatcaaaccgcaatcgcccccgccctccccggctccaccacaaacgacttgagcgtcgacaccgtcgccgccgggtcacgtggatccgtaattacccgaaagttcgtcagcatcttcgacgcctcaagctgcaccgacacatacccccgctggcgactgtcgaagaacttcacatgcgggttaagcggcaagatctggctgaacgcctcaaacggcggaccatcggaggtcaccgagctgccgacaaattcggtggcgacgatgggcgagtccgggttgttgccatcggcgtgcaggtcagtggtccagaacgaatggatatcgccgccccagaacaccggattgttgagcttgtggcgctcgatggacgccagcatccgagcacgattggccatgtagccgtcccagccatcggtccaatgcccgaccttgtggttggtcaggtcgcgctggatcagcggcgccaccagcaagtcctgagcgatcacattccactgcgcctgcgattgggcaaaaccctggtcgagccaggcttcctgttgccagccaagcatcgtgcggccagggtcgcgcaagtccttgcaggtgttggccgcaatatgcccctggtgactgccgttggcctggatacacggttgctcggagcggtactggcggccatccagcacatgaaaacgcgccagccggccataatccaggcgccggtaaatgcgcatgtccgggcctttcggcacactgctggcgcgcagtggcatatgttcgtaaaacgcctggtacgccgccgcccgttgccttagaaactgctcaaccggaatcttcgggtcctgggaccagcggttggcgtagtcattctgcacttcatggtcatcccaggtggccacgctgggtgctgccgcatgcaaggcttgcaggtccgggtcggttttatacagcgcgtagcggttgcgatagtcactcaggctcaccgcgttgccgctgccatgggggcggatgatcttgcccgagtcaggcgcgtaggaactgtcgtagatgtagtcaccgaggaaaaacaccaggtcaggttgctccgccgccaagtggcgatacgcgctgaaataaccgcgttcccaatgcgagcaggagacaaaccccacactggccgcagccatggcgtgcagcggcggcgcggtacgtgcctggcccaccgggctctgtgcgccgaggccgttgaactgataccaatacggcctgcccgcctgcaaccccgcgacctcgacatgcaccgaatgggcaaaccgctcagtcgccatgacctcgccctgctggacgatacgcgtcatcgccgcatcactggccacgcgccaacgcaccggcacggcgcggctcaacccgccgcgcccgtccgcggcattgaacagcggcgccaggcgcgtccaaatcacaaagccatccggcaacgggtcgccggaggccacgccaagggtgaacgggtaatccacaccggcgctgcgcgcaaacgggctgaggatcgaaaacgcggtggcaaccgccagcccggcgagtacgcggcgccgatcatggtccactgcgccactcacaacgcacgctcccagtcgcccagacgcaggctgaccatgccgatcagctcgccggttgctcgcacatgcactcccaggttcagcacctcaccggcacggtatttttcggcgatcccggcaataaagtcctgggcggtctgcaaggtatagggcgacggaatattggccgtgttgtcagcaattttcggcccgttggcgagcgaataaagcgcctcggcttggtccatttgcagcgcgcgcaataggagtcgcgaggtggataaatgcggcaatgcagtgggcatacgagcaggctctcgagataaattcttcaagaatgtatggccttgatgtcaattgcattacgtcataaaactgcaaggcgaattcactgtaagacgcgtcctagagcctttaaaacgtaaattaaagttaaccattcggtcatttttggttgttagcgtgtcgcccctaattcaataacggggtaacagaatgagaacctgggatgaacccaagaaacgcaaggcgcacatcgagttgatcccgatgatcgacgtgatgatgttcctcctggtgtttttcgtactggtgagtctgaacgtgattccggcactcggcatgaagacccaattgcccagcgccagcagttcgcagcagctcaaaccgcagaacaaattcatcctgaccctgggccttgaaggtcagctgcagctcgatggcaaggacctcacggtcgacgcgttggtgtcggcgctgaaggccgccgaaaagcccgataccaagtccaccatcatcgtcaacagtgacaaaggcgtggaagtttcgcgcctggtggaggtcatggacaccctgcgcctgggtggctttacctccgtgtccatcgctacgcgtaagtcctgatcatgtatgccttgtttcgtgcgcgtcagctgctgggcagtgtcccggccctgatcgccctggtgctgattgcaatgggcatccagtcacagacattgaaggtcgagccggtgtacgacgaatcggcggtcgagttggcgctggtcgagcctgaacctgaagtgattcctgagccagtggtggagcaggaaccgccgccaccggtaatcgaggacgaagaggccgagccggccccaccgccgccgccgccgccaaagccactgccaaaacctgaacccaagcccaagccggtgcccaaacccaagcccgtcgtggccgccaagccgacaccgacgcccacgccagcccctgcagtggccgccaagccggtccaggccgccgtcgctgcgccacccgcgccgcccgccccgccggcaccgcccaaggtcgacggccaggcgctggaaggcggttacctcaaaggcctgcgcaacgagctggacacctacaagcaataccccaccgggcgccaggcgtccctcgaacgcccgagtggcgaggtggtggtctggttgatggtggaccgccaaggccgcgtcctcgattccgggatccagaccccggcgccgagcatgctgctcaatcgggccgctaccaatagcctgcgccgcatcaagcaggtcaagccgttccccgaacaagccttcggtggacgtaacgagcaacgcttcaccgccaccttcaactacagcgtgcaataagcacccgacaccaggacgacagtgatgaggttcacccgtattcatctggcactcgttgccgcgacgagcatgacccatggagtggtcatggcagataacagcgacagtgacgtcggcacgatcggtgtacagggcaaggcaaccgcggggggcggttacatggtccaggaagagagcgccaagggccgctcgaccatcaccaaggaagcgttggacaaacagaccgccacaggcaacgccatcgacaagctcaagtacacgccgggcttgaacatctccagcgaggacaacaccggtctctcgggctttcgcttcaccatgcgcgggatgaactccgaccaggtcggtatgtcggtcgacggcatgccgatcaacgactccggcaactacgcgctgtattccaacctgctgggcgacccggaaaacatcgaccagatcttcgtcacccagggttcttctgaagctgatggcccgcacatcggctccagcggcggcaacatcggcatcgtgacgattcgcccgaccaaggaaaccggtgccttcgtcaaacaagtggtcggcagcaatgccacccgcaagacctttgcgcgcctcaacaccggtgaagtcaacggcctgagcaactggctgtcggcgtcccacaccgaaggccagatgtggcgtggctcgggtgccgtgcgggcggacaaggtggagtggaacagcttcttcgatgccggcaacggcaacaccgccaacctgatcctcaagtaccacgagcaggacaacaacagttacagccaactgaccaaggcgcagttccagcagtacgggcgcaaatacgacccgtacccggcgaaaccggcgctgggcgccaacggcaaggtcagcagctactacgacctggcgcagaacccgttccagaccttcaccgccgtgctcaacacccagtacaagctgagtgacaacctgtccctctcggtgatcccgtattactactacggcaacggcagcggcgtgggctcctcggcctatgcgctgaacagcggctcgaacaagggcggcgtgttcgacctcggcaacctgccgacggccgctcaatacaacgccgacggttccgccaccaccggcgtttactaccgcccttcgcgcacccagacctggcgcccgggcatcaccaccaaactgaactgggacctgggcgaccacagcctgcaatttggctactggtacgaacgcgcccgccaaagccagacccagccgttcattgccctcaagaacagcggcaagccaagcgacacctggccggacggcagctccgtggtcgacgccaacggcaacaccgtacaaggtcgcgaccgctataccgtgaccccggcgcaaaaagtctgggcccaggacacctggtacatcaactcggactggacgctgatcgccggccttgcctacatgaatgtcgagcgtgaaggcaccaaccacgggagcctcaccgagcaaccgggcaaagccaaccagacctacaacaagttgctgcccaacgccggcctgaaataccagatcgacgagcgtgaccagctgttctacagcctgtcgcgcaacatgcgtatcccacagaactacgtgctgtacgacaaaggcgtcggctcgctcgactccaagcctgaactcagctggaaccaggaactgggctggcgctacaccggcgaagacaccaccctcgccgccaccctgttctacatgcagttcaagaatcgccagctcacctcgctggacagcaacggtgattcggctgacatcaacgccggcactgtcatcaacaaaggtttggaactggagtggagcggccaactgccccaccacttcaactattacacgtcttacacctacaccagctccaagcaacaggacgacttgaccgtcttcagcgcgggcaagcccatcgtattgcccaccagcggcaagcagttcgccaacgtgcccaccaacatgctggcggccaacatcggctatgacgatgggcgtttctacggcaccttcggcggcaagttcaccagcaagctctacggcgacctgaccaacgatgaagccatctccgcgcgcaccgttttcaacctcggcgccggtatctacctgcccgtggacaaaaaagtcgtcaaggacgcgaccctgcgcctgaacgtcgacaacctgttcgacaagaagtacctggacggcgtgtacaccaccaagaccaactcggcgagctacagcggtttccgcgatggcgacccggcgtacatcgttggcctggaccgtaccgttacggtttccctggaagcgaatttctaactgcgaggctatagatcatggacatgaacctgcttcacgacatcaccttttatgtcatgtacgccgccatggcgattgcgattttcatcaccatcgagcgtggcatttacttcgcctacgtgcgccgccaggcccgcgcgttgaccgaggtgctgggcgccaacgtgcacagcgagcgcgatttgcccgagagcctgacccgccgtgacagcctgccgctgaacatggtgctgccgatcctggcgcaaaaggcttcccaaggttcgcgcaaggacctggacgatgaaatcgaaacccagtacctgaagactcgcgcgccactgtcgcgcagcctgtggatcatcgaaaccatcaccaccgccgcgccgctcctgggtttgcttggcaccatcctcggcatcatcgacaccttcaaggccctggccagtgccggcgtgtccgacccagggcagatttccggtggtatcgggacggccctgtttgcgaccggcctggggatcgccatcgcgctgttctgcgtggtgttccacaacttcttccaggacagcctggagcgcatcaacgatcaactgaagatcctgctgattcgtgccgccaccggcgcacgggttcaaggtgaagtgccgcacctggtgccgaccccgctgcacacccgcactgcatgacctgcgggcgggcgcgtgatgcgcccgccctactttttgcccggtgagacgcttatgtccctctcgatgaaattgcgtatcgcaggccttgcaggcttgttcctcagtccgctggcccaggcggacttttcaattccaggctttgaactggtgcacaccgtgccggtggacaccgccctgggcacggctgatttgcgccagccggggccggtgtggatcgagctgtttgacgctgcaaaaagccgcatcgatatcggccagttctacgcggccgaccatcccggctcagtcatggacacggtgatcgaacacctggaagcggctggtaaacgcggtgtgaagattcgctttctgctggaagaaaaaggcatcaagttgtcggaagcctccaccttggagcgcctgcgcgccattcccaacctgactttgcgcgtgctctcgtacgggcaactgagcggcggcatcatccacgccaaatacctgctggtggacggccaacaggcgtttatcggcagccagaatttcgattggcgctcactggaacatattcacgagaccgggctgcggatcacggacacggcggtggtcggccaggtccaggcgatcttcgagcaagactggcaagcccaggcggcactggcggaacacacaccggtgccattgccggcgacaggccccgagcctgcacgcaccggcaattacctggtggccagcccgcaacgctacaacccgccgggcgtgggcgattcgcagttggaattgccacgcttgctgagcgaggcgaaaaaagaagcccgcgtgcaactgctggactatgcaccgctgtcctacgggccggaccgcactcggccgtactacgcggtgatcgacaacgccgtgcgcgccgccgccgcgcgtggggtgtcggtcaagctgatggtgtccaactggaacactgacgcgctcgaactgccctacctcaagagcctggccgtgctgcccaacgtagaggtcaagatcgtcacgttgcccgaggccaagcaagggtttatcccttacgcgcgggtgattcacagcaagacgatggaaatcgacgggcaagtggcgtgggtcggcaccagcaactggctgggcgggtatctggataattcgcgcaacctggaagtggtgatgcgcagcgaggcgatggccaagcgtgtaggggaattgcatgagcaattgtgggatgggccctatgccaaggcgctggatgtaacggcgcagtacccggagccgcatccgggtaagccgtgataacccgcttcaaagatcacggtatttaccctgtgggagcgggcttgctcgcgaaggcggtgtgtcagtcagctcctacttcgactgacacaccgccttcgcgagcaagcc

SEQ ID NO: 57 - DNA, 75844 bp, Pseudomonas poae FL10F
agacggcggcactgccaatagagaggccgcccgacccaccgctttcgtagcctcgctgaagctcgacaactcccacaatggatttgtgctgccgggaagagcggtgttggcctctgaatccgccagtgacacagaacctacagacaacggcgatcaacatgtgggagctggcttgcctgcgaagacggcggcactgccaatagagaggccgcccgacccaccgctttcgtagcctcgctgaagctcgacaactcccacagtggatttgtgggctcggaaagagcggtgttggcttctgaatccgccagtgccacagatcccacaaacaacagcgatcaaatgtgggagctggcttgcctgcgatgcgggcgactcggtacgccagatgcaccgagccgatgccatcgcaggcaagccagctcccacaggtgaccgagtcggttttgaggtgtgtattccaagcaaaaaaaacggcacctgagtgccgttttttccgacccaatgcgcttacttacgcgccgcctcccacgacttgagcaaatcgccatacgccacggtttcgcccttaggcttctcgttggccagtttcggcttcggcgcgcccggctggtcgaaccagtattgggcatcacgctcggggttcattttcgggccacataccggttgcaccttggagcgttccaggcgcgtcatgatcgcgtcctgctccttggccaggttgtccagcgcctgttgcggggttttctcgccgctggcggcggcggcgatgttgctccaccacagctgcgccaaccgtgggtagtccggcacgttggtgccggtcggggtccattcgacgcgggccgggctgcggtagaattcgaccaggccaccgagtttcggcgccaggtcggtcatggcctgggagttgatgtcggactcgcgaatcggcgtcaggccgacgatggttttcttcagcgacacggtttttgaggtcacgaactgcgcgtacagccaggccgcgagtttttgcttctcaggcgtcgacttgaggaaggtccaggaacccacgtcctgataacccttcttcatgcccttttcccaatacggcccgaccggcgatggcgccatgcgccactttggcgtgccgtcggcgtttaccaccggcaggcccggcttggtcatgtcggcggtaaacgcggtgtaccagaagatctgctgggcgatgttgccctgggacggcaccgggccggattcggagaaggtcatgcccgccgcttccggtggtgcgtaggctttcatccagtccacgtatttctgcgtggcgaataccgccgccgggccattggtgtcgccgccacgggtgacgctggagcccaccgggtggcagtcctccacgcgaatgccccactcgtccaccggcaaaccgttgggcaggcccttgtcgccgccaccggccatggagaaccaggcatcggtgaagcgccagcccagggatgggtcttttttgccgtagtccatgtgcccataaatacgtttgccgtcgatttccttgacgtcttcgctgaagaatttggcgatgtcttcgtaggccgaccagttcaccggcacgccgaggtcatagccgtatttttccttgaacttggctttgaggtccgcgcgctcgaaccagtcggcgcggaaccagtaaaggttggcgaattgctggtcgggcaactggtagatcttgccgtccggcgcggtggtgaaggagatgccgataaagtccttgatatccagggtcggcgaggtgaagtccttgccttcattggccatcaggtcggtgatcgattcggtcttgccatagcgaaagtgcgtaccgatcaagtcggaatcgttaacccaaccgtcatagatgttcttgtcggactgcatctgggtttgcagcttttccaccacgtcgccttcctgcagcaggtcgtgggtcagcttgatcccggtgatttcgctgaaggccttggccagcaccttggattcgtactcgtgggtggtaagggtttccgacaccacgttgatcttcatcccacggaacggttcggccgccttgataaaccatttcaactcttcgagctgctgggcgtcggtgagggtggacggtttgaactcgctgccgatccatttttttgccgcatcttcatacgcatcggcccaggccgtggcgctcaaaccgctgagggccagtacggcggccaatgaaatgctatgtcgcagcttattgtttttattcaacatagagacctcctggtggattattcacggagcactagccccaacgcatcacacacaacagccacaccagggacagcgcggacgccacccagatgctccagtcggtaacgccgatcaccagtaaatgcaggtaggcgctgccgagaagaccgataaacaagcgatcaccacgggtggtgctgatcggcaaaaagccgcgccgagggatactcggcgagcgcagttcccaggtggtcatgcctgccaacagcaggccaatggccgcaaagaacaacgcggtgggggtggtccaggccatccattccatcatcgactcctcagacccggccgagggcaaagcccttggccacgtggttgcgaacaaaccagatcaccagcatgccgggcaggatggtcaacacccccgccgccgccagcacgccccaatcgatacccgaggccgagaccgtgcgcgtcatcaccgccgcgatgggcttggcgttgaccgaggtcagggtgcgcgccagcagcagctcgacccaggaaaacatgaagcagaaaaacgccgtcacaccgatgccggaaccgatcagcgggatgaaaatcttcacgaagaacttgggaaagctatagccgtcgatgtaggcggtttcgtcgatttccttcggcacgccggacatgaagccttccagaatccacaccgccagcggcacgttgaacaggcaatgggccagggccacggcgatgtgcgtatcgaacaggccgatggacgaatacagctggaaaaacggcagcaggaacaccgccggtggcgccatgcggttggtcagcagccagaagaacaggtgcttgtcacccaggaagcggtagcgcgagaacgcatacgccgccggcaaagccacgctcagggaaatcaccgtgttcaaactcacgtagtacagcgagttgatgtagccgctgtaccagcttgggtcggtgaagatcaccttgtagttggccagggtgaaatcctgcggaaacagcgtcagcccgccgaggatttcggtgttgctcttgaaggacatgttcagcagccagtagatcggcaccagcagaaacaggatgtagatgagtaaggggattagcttgcgcttgctcatgttggcggcctcagcggttggcgtcggagtgggtcatggcggtgtagaacagccaggacaccaacaggatgatcaggaaatacaccagggaaaacgccgccgccgggcccaggtcgaattggccgacagccatctgggtcaaggtctgactgaggaaggtagtcgcgttacccggcccgccacccgtgagcacaaagggctcggtgtaaatcatgaaactgtccataaaccgcagcatcaccgcgatcagcagcacgcttttcatcttcggcaactggatatgtcggaacaccgcccaggccgatgcccgatcaatccgcgcggcctggtagtacacgtccggaatcgcccgcagccccgagtaacacagcaacgccaccagcgaggtccagtgccatacgtccatcaccagcacggtaacccaggcgtccatggtgttggccgcgtagttgtaattgatgcccatggcgttgaggcttgaaccgagcaaaccgatgtcggcccgcccgaaaatctgccagatggtgcccaccacgttccacggaatcagcagcggaatggcgaggatgatcagcaccagcgaggaccagcggcctttggtcggcatggtcagggcgatggcgatacccagcgggatttcgatcaacagcacgcaggccgagtagatgaactggcgcagtaatgagtcgtgcaagcgcgggtcgagcagcacctgcttgtaccagtcggcgccgacgaagtagcggctggactggtcgaaaatgtcctgcaccgagtagttgaccaccgtcatcatcgggatcaccgcactgaatgccaccagcaggaacaccggcaacaccagccaccaggccttgttgttctgcaccttgttcatggcagcacctccagcaggtagtcgtcggcgtagatcatcagccattgcgcggggaagctgatcgaggcgcggccttcgggcaccggtttgtcttcggccaggcgcaccttgagcagcgcgccgtcgaggttgagggtcatgatcttgtaggtgccgaggtcttctacgtgagtgacatcggcctgcagcgcgtcggggttgtactcgtcccacacgtggataaattccgggcggatgccgacctgcagcttcttgtagtgcgtctcgcgcaagcgttgctgcaaggcctcggacaacggcagccgcgtgccggcaaaacgcacgccgcccgcctcggcctgcacctcgatcaggttcatccccgggctgccgatgaaatagccgacaaaggtatggctcggccgctcgaacaactcgcgcggggtgccgaactgcacgatctgcccgccgtacatcaccgcgatcttgtcggcaaaggtcgaggcttcgagctggtcgtgggtcacgtagaccatggtgatgttgaactgctcgtgaatctgtttgagcttgcgccgcagtttccacttcaggtgcgggtcgatgaccgtcagcggttcgtcgaagaggatcgccgacacatcgtcacgcaccaggccacggcccatggagactttctgtttttcgtcggcggtgaggttgcgcgcctttttgctcagcaggttttgcaggtcgagaacttcggcgatttcctgcaccttgctgtgaattttcgcctcggccatgccttggttacgtagcggaaaggccaggttgtcgaacaccgtcatggtgtcgtacaccaccgggaactggaacacctgggcgatgttgcggcgttccggggtgagttcgttgaccaccttgtggtcgaacaacacctgaccttccgaagggctgagcaagccggagatgatattcagcaaggtcgacttgccgcaccccgacggccccagcaaggcgtaggcgccgccctgctcccacacgtggttcattgcccggatcgcgtagtcctctggaccgctcggcgtagggctatagctgtgggcgaggttctgcaaatggatttcggccattaggcaaccctcgcgacacggcgcccaggggcctggaccaagcggccctggccatcgaacacaaacagtttatgggtggggatatacacgcggatcggcgcatcgacgtcgtactcgtgcacccccggcaggtgcagcaccagcaggaaatgctcgctgcgcacatgcaggaaggtttccgagccgctgatctcggcgacttccaccgtcacggccagctccaggtcatcgtcgttgctcggcaccaggctgatatggctggggcgcacgccaaagcggaactcgccctcgccgatggggcgcaggtcgacgttgagcgggaagtgcacaaagttggcgaaactcacttcattgccgctgatacggcccggcatcaggttgatcggcggctcggaaaacagctcggccgccagcacggtctgcggctggtggtacacctcggcggccttgccgctctggatcacccggccctcgtgcagaatcgtggtagtgccgccaagggccagggcttcgttgggttcggtggtggcgtagatggcgatggtgtggcgcgccttgaacagctcgcgcatttcctgacgcagttcttcgcgcagtttgtagtccaggttcaccaatggctcatcgaacaggatcaactcggcgtctttgaccagcgcgcgggccatggccgtgcgttgctgctggccaccggacagctccagcgggtggcgctggaggaatttctcgatgcgcagcatttttgcggtttcgagcactttgctctggatcagctcgttggacacaccggcctggcgcaacggcgaggcgatgttctcgaacacggtcatggtcgggtagttgatgaactgctggtagaccatcgacacattgcgcaggcgcaccggcttgtgggtgacatctacgccgttcatcaggatgcgcccgctgtcgggcttgtccaggccggccatcaggcgcatcaggctggtcttgccggacagcgtgcggccgagcaatacgttgaaggaaccggcttcgaaacgcaggttggcgtcgtcgatccaggtctggccttcgacgacgcgggagacatgttccagggtcaatgacatgacacgccctttttattattggaatgaaactggccattcagcagagcgagtttcgtgccaaacctgcaagggcttgatccacaaggaaacagggtcctggcgctgttcaagagtgaacactgtgcttgaacacctgaacaggtcggggttgacaatgaacagttctgaacaacaattgatgggcgacacagatcaaaggtgggagcgggcttgctcgcgaatgcgatagatcagtcgacatctgtattgactgactcaccgcattcgcgagcaagcccgctcccacatttcgaccgtgtttcttcagccagtttgtgccagccccataacaataaaaaagaaggtcgcccccatggccgaacccttggctcacgacacccttatccaggattcctggcgccgttgccgcgcctttggcctggatcaccagagcgcccccagctttgaccaactgcccgccgagggcatcagccaattgctcgaaagccagcattcactggtgcagaccacacaccaggaagtgctgccctactacgaaaacatcctgagcaattccaactgcctgatcatgctggccgacaaccagggccaggtgctgacgtcgtggggcacccagcggtttatcgaaccgaaactggcgagaggtttcagcgccggcgccagttggcgggagcgcagcagcggcaccaatgcgatcggtaccgcactggcctgtgcccaggcggtgcatattgagcacgacgaacacttcctcaaggccaaccgtttcatgaccggctcggcggcgccgatcttcgatgcccagcgtgaaatcatcgcggtgctggatgtgtccagcgacagctatttgccgccctcccacaccttgggcatggtcaagatgatgagccagaccgtggaaaaccggctgatcctcaacctgtttcgcggcgagcatttccaactgaccttcaacaccggcctgaacaacctcgacagccaatgggccggcctgctgatttttgatgagagcggccaggtgctgtcggccaaccgccgcgcagacaacctgctgggcatcagtttgtcgcgggtgctgatcgacagtttgttcaaggtgtcgttgctggagctgctgaatcaacccgaaggtttgccgttttcgctgcaggcggcgggtcgcaatcggtttcagtgtttattgaaacgcccgaagaagatgccggtgcaggcgcgggttttcagcgagcccaagcccggcaaaccggctgcggtaaaaccaacgtcgattagcctcaagaccctgcattttggtgatgcgcgtgtggaaaaagccgtgcgccaagccgagcgcctgttggaaaaggacattccgctgctgatccacggcgagaccggcgtaggcaaagaagtgtttgtcaaagccctgcaccaggccagttcgcgcagcgcgcaggcgtttatcgcggtgaactgcgcggcgattccggcagagctggtggaatcggagctgtttggctatgaaaaaggcgccttcaccggcgccaatcagaaaggcagcatcggcctgatccgcaaggccgacaaaggcacgctgtttctcgatgaaatcggcgacatgccactgccgacccaggcccgcctgctgcgcgtgctacaggaacgttgcgtgcaaccggtgggcagcagcgaagtgttcccggtggacttgcggatcatctccgccaccaaccgcgcgctgcgcgaatgggtacaggccgggcgctttcgcgaagatttgtattaccgcatcggcggcctgaccctggagctgccgccgttgcgcgaacgcaccgacaaacaggcgctgttccagcagctatggcagcagcaccgcgagccgacccaatgggccgggttgagcagcgaggtgctggcgttgttcgagcaacacccgtggccggggaatctgcgccaggtcagcagcgtattacaggtggcgctggcgatggccgaggatcagccggtgcgcccggagcatctgccggatgattttttcgtggatttacaggtggcagcgccctcgccgaaccgcgagtgcctgcaagatgacctcaatttgacgcaacgcttgaaagcggctggcgggaatatttcccacttggcgcgggaattgggcgtaagccgcaacaccctgtacaagcgcctgcgccagcacgaacgctgagctagcgcggcttgaccaccaccagcaggtcggtgaagtactccacctgaatcggcaggttgtcggcgagtgccgcgagcgcggcggcggtgtcgtcgagcttgaacacgccggacacgcgcaggtctttcagcgcttgcgcatcgaaacgcaccaggccatggcggtagccggccagggtttgcagcacgtcgctcaacggctggtcgttgaccttgagcaggccacgcgtccacgcgtcggggtcggtgttgccaatcgcttgtggcggccgggcgcggccatgctcgagaaccgagcgctgaccggcggcgaccttgacgccttctgcgccctcgcctttgaccgccacgctggactcaatcaccgtgaccacggtgctgccgttttccgcgcgcttgaccagataacgcgtgcctaatgccgtggccgtgccttggtcggtgcgcaccacgaaaggccgttgcgcgtccttggccacctcgacccacaattcgccttgcagcaactcgatctcacgttggtggccgtcgaatttcacatccaccgccgaattgctgttgagctgcaaccggctgccgtcttcgagggcgatttggcggcgctcgccgacgccggtgcgctggtcggccatccacaccggcgcgcgctccaggccaacccagccgcagagcaacacgccgagcaaaaccagcacctgtacgccgcgcgagcgttgtggggcgaaagcgcgattgagggcaatgcgcgccggttgcgcgggcaaggcatcgaaatggccccaaagcacgcgcatgcgttcgatggccacggcgtggcgcgggtcggcctggcaccaggtgttgaaggcttggcggtcggcctcgctgacgtcttcgtcgtgcagccgcgtcagccaattcgctgcttgctggatgatgtgttcggtgttcacgacagcgggtccgacacgtgcaggctgtggtagcaatgcaccagggcggtagagatatagtttttgaccgtgctggaagacacgtccaggcacgcggcgatttcgctgtaggtcagcccgtcgaggcgactcaacaagaatgcttcacgggttttcgccggcaggccggcgagcatttcggcgatgcgctccagggcttgcagcgccacaagcaccgccgccgggtcgggcatgctggcgtcttcgcattggagcgccagggcctccatgtaggccctttcgatgcgccgtcgacgcgccccatcaatcagcaggcgcccggccgtggtggcgagaaaggcgcggggttccttgatggcttgcggctcggcgagcatcaagacgcggatgaacgcgtcgtgggccaggtcggcggcgtactgggaacagccgagttttttgcgcagccagccgtgcaaccagccgtggtgctcgctgtacattgccgtgagggtctgctgacgggcgcaatcgcccggcgcggccggaatgtcatgcatgcgcaaaaacttctcaaatgggaaatgttaccaattgcgcgaacaatgccagtaaaacggtgtgggggcaagaggcgcccagacagccccggatgctgttgttgaagaaatgcaggtgtgtgggagctggcttgcctgcgatgcaggcaactcggtgggtcagttacaccgtggtgatttcatcgcaggcaagccagctcccacaaaggccagctcccacagttgagtgatggccggtttagcgccagctccacgtcacaccggtgtagacgccccgcccatctgcaggcgtagacctcaccgcatccaaacccttgtcgtcataacttggcgtcaccgtattggcatagcgccgattggtgaggttgcgcacatccacccaggcttgccagtcctgcttgggcgcgtcgtagccgaaggtggcgcccagcgttgtgtacgccgctgcgtagtaggaattggcgtagtccaccgccacgcgcgaggaatgctcggtgttgaggctggtgtagaaacctgtcggatggctgtagcgcagttgcgcctggtaataatgcttgggaatgcccggcaaggtgttgtcgccgaaacgttcgtcgtcacggtagtggaaatcgctgtaagtgtaggcctggcgcaaggcgagctggccgttgcgcccgccgtcccacaacgggctgagcaggctcagctccacaccttggtgcacggtggggctggcgttggcttcggcgacaaccgcattgctggtggcggtttgcgcttgggtttccaccgtgagcaattcgtgacgcacttcggagcggtacagcgccaggtcccattggccgaaccactgctcgcctcggccgccgacttccaaggtggtggcggtctgattgcgcaggctcacaccttcgcgttgcaaccctgtggccgggccactgtttttcggaaagtatttgttggaaccccagatcatcgaccacgcatgcggcggctcgaccgagcggctcaggttgccgtacacctgcaattgcggggtgaagtcgtaacgcaggccgatgcgcggggcgtaatcccaatcgtgctggctgagtggcgcctggccttcagggtaggtcacttgggtttcgcggcgcgtgtagatggcggcaaggccggtggtcagccacaaatccgggaccagttccaggtcgttgccgatgtgcagcacggtgtcggaacccaggtagctgtagtcgcgggttttggtgccgggggcatagcccgcggtattgccggaaggtgtgcgcacatattcagacgcgccattattcggcatcgcctgggtggtgcgcaggccaagcgtggttttgctgtcgtgaccgaacagactgtcctgacggatgtagttcagcgtgccactcacgtcggtgtaggcgactttgagacggttggtgccttcgcgcaggtccatcgggtaatcgtgatacgccaggccgacttcgacgcgggaattgtcatcgagctgcaaggtggttttgttggcgagccaggtcgagccgggttgcaggcgttttgaatcgcgggcggcgttgaggctgttggcggccgttgggtcatggcggatctggtagcgcgtcagcttgccgggggtgtcgttggtggtttcgcggtagcgcaaatagaagcgcgtctccaggttcgggttgaaacggtagccgaagttggccgccacgcccttgccggtgccggcgctctggtgctggtagccgtcggattccgagtcggtcaggctgatgtagtagtcggcatcgcccagcacctggccggagctgatctcgcgttgggcataaccacggctgcccgcttcataacgcacctgcagcttgggcgcgtcgtagccggtgtgggtcacgtagttgaccgagccgcccaaggccagcgcgccctgatcaaaaccgttggcgccgcgcagcacttcgacgcggctttgccacagcgggtccttgagctcataaggcgtgccgccggggccggtcagcggcaagccgtcgaacatttcatacaggccggaggcgtgggcgcctgggctgcggttcaggcccgaaccgcggatcgagagtttcacgccctcattgttcgccgccttggcgtaaaccccagcctggtacttgaacacatcttcgttggtgctcacgcgcccctgctgcacgctgctcatgtcgatgtaattggtgccgccgggcacgcttctgagttgcgcctgggccacctcgccggcgctggcttcagtgctggtgacctcgaccggcgccaattcgagttcctcggcgtgtaccagtgaactgagggtcagggcggcaaaaaacagcggaggttggcgcaacagcatgggcgggtccttggaattcgggggcgtagaaggcctgagccagcacgcgaacagtgatgggaaggcaagcacgccgatcaagtcacgccttattaacggaccggacccttcccacaacagcatcggacgcagtctatctgttaagtccaaaatcgaattaacacatgcaaactcagtatttaaagaaataaccgccacgcagtactgtgaagcctctgcatcacccacgccccaagagatcgcccccatgcaaacatccgccaccgttatcgacttcaccctccaccgtaagcgccgccaagcgcgtgcagcggccgagttgatgtgggcgatgtacgcggcgcgtgccgggctggcggtgtttactgcacaggcggcgccgtccagcgatacccgccgggcgtaaggccaatgaatttcctgcacgtgcttgccgaaccgcccgaaccgctgcccaagcccggccttgatgaagacgacaccagcctgtgtgttgcgcagaacctgcaacgcctgcgcagcaaacgccacctctcactcgacggcctggcgcgtgcctgcggcgtaagccgggcgatgctggcgcagatcgagtccggccgcagcgtgccgtcgatcaaggtgctgtgcaaaatcgccaagggtttgaaggtgtcagtcgcggcgtttctggaagaccgcgcctttgaaggcgtcgaggtgttgccggcgcaacagagcaaacgcctggtgagtgccgacggtgcgttcgtcagccgtgcgttgtttccctacgatacggcacgccaatccgaattctatgagatccgcctgcgcgccctcggcgaggaagtctccgaaggccacggccccggcatccaggaaaacctggtagtggcccaaggcgtgctggaggtcagcgtcaacgacgaacgctacctgctgtctaccggcgactcgattctgttttacgccgaccagccccaccgctaccgcaaccccgcggacagcgaggcggtggcgttcctggtgatcacctacccggaacgcctggactgaatgcaaaacgccccgaatgatcggggcgttttttattgcgcgggacctatcagcaggtgcagcacatcatcggcatgccgttgcagctcatcatcatcggcatggcgcagtcgttcatcagcttgttcatcagcatgcagcagttttccatcatggccatgctcatgcccggcatcggcatcattctgcacatcatgctgtcgcccatcagggtgcattccatcatgcacttcatcatcggcatcgacatgcccatggccatcatcggcatgttcatgtcagtcatcattttcatggcgtcggccgacatgcacatcatgctcatgttggcgcactgcatcatcattggcatgccgcagttcatcatcatcgccatcatttcggcgttggtcttgaactgagccatgtccataccggccgcaggcttcatggtgcacatcatggcgtcgccggccatttcgcatttcatcgtggccatcatcatcggcatgcccatcatcggcatcattggcatggaggcgttcatcggcatctgcattgcattcatcatgttcgaaactccgtaatcgacaggaaatggctaagttctggcgccgattctaagggcgccgggcaacggcgcaagacggcggcagagcagcaggaatggctgttcgggggcaagcttagttgtacagaacagccgcgcacgctgtgatgacggatggatcggcgcagtgacagcgataaaacgcgtcatctgacgataaacgccgttgtggatatgcgatccaagtcttgagaccaatcggaaggaaataaacgatctaaccggcgttaaataacccagctactcggctaatcaaccccaagttgcagcgcctgcatcaaatcatccgcctccgttcccggtgggaacctgaacccccgcatttcatagcacgccagcacatccgcgagggcttcgcgcaactgcgcctccgtcggcgcgtcacgcagcagtttgtgtgcggccaataacacctcggcagcggccccttgggcactggcgacatcgaccaccgcaaacaggataaatcgcaggcggacttcgcgatcagtcggccaaaccgttttttgcttacccaaggcaggcgctcatcgttaagaaaagtccgaggctatggccgaccgagggtacgtttcaagcagagggggtcaagataggccgtttcctacatatgaaagggaaaccccgcactgcctgatcgagccacgcatcactgcaccggcaaaaaattcatcaacagcaagctctgcgcgtaattgagcgcgacgcgccggtagcgttcgtcgagcatctgggccagcaggtcgaggcgcgcgaccactttgccgaactcaacggcaaagctgaggttgctgccctcctccgaaatctcgttggagaacagcagcaagacgccattggcgtcctggcgctggctgagtagccaggtggctttctcgatattgcgcgcggcgttgctgacaaattgcgggttgattgagtcggttatatagaactgagtgcgaccgccgtgcgcggtcacgatcatgctgccgatggcatagatgaacgccccgacccggtcgccgcgaaactccgggctcagtgaatagctcaatgcaaccaggtcgcgacggtcgcccaaggccggcaaaggttgacggttctcgatggcctggcggatttcccgcgcggcactcaccgcgtccgggtaacccgattgccgccactggttggggttgcgcaggtagagcttgttcatcagcaggtacaggcttttcaggttgtcgcgcatgcttaaggtggccatgcgatcaacgctggtctggaagaattcatcgggtttgccatcgctgaactgcctggcgatgtcgcggctctgctgctggctgcaaccgctcgcgtagagcataaacaccgctgcaaacagcagcggccatcggctgataaaagctattaacgttcgatccatcggcaccgggtctggctgctgtccacgcgcagaatgagcgcggtcgtgacagggatagatcaggagaatgaaaaaaagtgcggcgcgcaggctcagttcagcaaaggcctacaggctggaacgcctgcgcagtggtgcaatcctgtcgaatacttgcctaatcctccgagttatcgataaccggatcgataggccttgcgccgtggtctagagttcaacgatgggcgataaatcgcctggcaactataaaaaagccacaccaaccgatgataagcaggtgagtcatggagctacgcattaaccaaaaggcctatcaagtcgacgccgacgccgatacgccgctgctgtgggtaatccgcgatgacctggggatgaccggcaccaagtacggctgcgggctggcccagtgcggcgcctgttcggtgctggtggacggcaacgtggtgcgctcttgcgtcacgccggtgtccggtgtggtcgggcgcgaaattaccaccattgaagcgattgaggccgacgacgtcggcaagcgcgtggttgcggcctgggttgagcatcaggtagcgcagtgcggttactgccagtccgggcaggtgatggcggccaccgcgctgctcaagcacaccccggcgcccagcgatgcgcagatcgaagcggcaatgatcaacctgtgccgctgcggcacctataacgcgatccgcaccgccgtgcatgatttggccaaggagcgcgtctgatgaacacacccaagggattctttgacgcacccctgagcgagccggtcaacctgtcgcgtcggcactttctggccagcaccgccgtgggcgcgctggtgatcggttttggcctgccgctgggctcaccaagggtgtacgccgccacgaatgcggcggcagaacgcggcacacaagtgccggcgtttctggagattcgccccgacggcagcgtgcgcctgctcagcccctttatggagggcggccagggcacccacacggccatggcgcagattgtcggtgaagagctggacgccgaccccgccaccttcgtggtcgaggccgcgccgcctggcgacgcgtatgtggtgatggaaaacggcatgcgcatcaccggcggcagcatgtcggtgcgcatgagctacccggttatgcgccgccttggcgccctcgcgcgcaccatgctgctgcaggcaggcgccgagcaattgggtgtgcccgtggccgaactgaccacgcaacccggccgcgtggtgcacaccgcgtccggccgttcgctgggctacggcgagttggccggccgcgccctcgacatgccggtgcccgacccggccaccatcacgctgcgtgacccgagccagttccgctggatcggcaaaccggtgaaacgcctggatgcgtacgacaaatccaccggcaaggcgcaatacagcatcgacctcaaagtcgacggcatgctccacgccgccgtccagcatgcgccacgcctgggcatgaccgtgggcagcctgcgcaaccaggcacacgtggaggccatgaaaggcgtgcactcggtgcatcaattgcccggcgccgttgccgtggtggccgaacgctggtggcacgccaagcgcgccgtggaagcgatccaggtggagtggctcgaagccgccgccgattccaccgtacgcgcgatgccggcggatttttccagcgacaagtaccgcgacttcctcgccgcccagcaaggcccggcgcgtgacgacgagaacgaaggtgacgtgtccggcacgctggccaacgccaaaaccaaggtcgaagccacctaccataaccagtacctcaaccacgcccagctggagccgccgtcggccctggcccgcttcaaccctgacggctcgctggacgtctggctgcccaaccaggcgccggacatgttccgcgccgacatcgccaagcgcaccggcctcgaccccgcaaaaatcaccctgcactcgccgctgctcggcggctttttcggccgacacttcctgtatgactcggccaacccttacccgcaggccatcgcattggccaaggcggtgggccgcccggtcaagctgatctggagccgtgaagaagagttcctgcgtgatgtgctgcgcccggttgcggtggtcaagttccgcgctgcactggatgcgcaaggcttgccggtggcgattgaggcggtgagtgccaccgaaggtccgaccgaagccattgctggcaaacaaggcgacaaaatcgacccaacggcccttgaagggctgtcgggcaagtcctacgcgattcccaataaacgcatcgcgcagatctacgtcaaaggcgcgcccatgctcggctactggcgttcggtgggcaattcgctgaacgacttcttttacgaagcgttcctcgatgaactggccgacaaaggcggccacgacccgtacgaattgcgcctgcacctgctgcgcgacaacaaacggctgaccacgctgttgcaagcggtgggcgagttgtccggtggctggaaacgtggcccgtacaccgccgaagatggcagccgacgcgcgcgtggcgtggccatggcctcgccgttcggctcacaggcggcagtcgtcgccgaagtgtcgatcgagaacggccaggtcaaggtgcaccacatttgggaagccatcgacccgggcagcatcgtcaacccggcgattgttgaagcgcaggtgaatggcgcggtggctttgggcctgtcgcaaaccttgctggaggaagccgtgtacgtggacggcaaaccacgggcgcgtaactacgacctgtacccgattctgccgctgtcgcggatggcacaggtgcacgtcaaaatcgtcgagagtggtgaaaaaatgggtggcatcggcgaaccgccgctgcccgccgtggcgccggccgtggccaatgcggtggcgcacctgaccggccagcgtattcgcagcctgccattaagccgatacaccttcgcctgaccgacaaggaacgcccatgaacaaccgtcgattcgcaagaaccgcaggctggctggtgctggccggcgcggtggcagccggtgtgctggcctggtacgtcacccgcgagcccgcctcgccttttgagcaacaacccgccgccggtttcgacccggcactggtcagtcgcggcgagtacgttgcccgcgtcagcgactgcgtggcctgccacagtttgccgggcaaggcgccgttcgccggtggcctggagatggccacgccgctgggcgctattcacgccaccaatatcacccccgaccgcgacaccggcatcggcgcctacaccccggccgacttcgaccgcgcggtgcgccacggcgtcgcgccgggtgggcgcaggctttacccggccatgccctacccgtcttacgccaagctcagtgacgacgacatgcgcgcgctgtacgcgtttttcatgaagggcgtggaaccggccaagcaagccaaccttcccagcagcattccctggccgctgaatatgcgctggcccatcgcactgtggaacggcgtgttcgcgccgaacgccacctacgcggccaaacccaaccaggacgcgctctggaaccgtggcgcctacatcgtccaaggccccggccactgcggcagctgccacacgccgcgcgggctggcgtttaacgagaaggcactggacgaaaccggcgcgccctacctggcgggcggcttgctcgacggctggtatgcaccgagcctgcgccaggaccacaacaccgggctggggcgctggagcgaggacgagatcgtgcggttcctcaagaccgggcgcaaccagcatgcggtggtgtatggctcgatgaccgaggcgtttaacaactcgacgcagttcatgagcgatgaggatttgaatgccatcgcccgctacctcaagtcgctgcccggcgacccgcagcgcgacggttcgccctggcagtatcaggcggccaatgcgcgcgcggatgcgcctggcgcgcacacttacgcgacccgttgcgcgtcctgccatggattggacggcaagggccaacccgagtggatgccaccgctggcgggcgccacctcggcactcgccaaggaaaacgcctcggcgatcaacatcacgcttaatggctcacaacggatcgtgaccgcgggagtgccggatgcttaccgtatgccggcgtttagggagcaattgtcggatgaggaaattgcccaggtgctgagctatgtgcggggtacgtggggcaacaacggcggtgcggtcgatgcagcggcggtgaacaagctgcgcgggcataccgacccggcgagcagtagcccgattattctgcatatgcgttgaggccccggtcgcagatcgttcccacgctccgcgtgggaatgccgcccgtgacgctctgcgtcacccgtacgcagaactggaagcatgcgctggctggcgggacgcggagcgtcccaggaggcgttcccacgcagagcgtgggaacgatctgacggtctgaaacaatagccttctcacacacccgctaggatttgaaccgatcaggcaaataatcctgccgctccatctctctcacgacattcgtcacctcggaaagaaagaacgacagctcttgcttcgactcacacacggtcatctcggcaatctcggaatcggtgtatttctccatcacaattctcatgcagtcggcaaacaccatcagttcgccctccgatacccgcacatcaaacagcgtgacggtggcaatgcactctttactcaaaatatccatgaacactccttcgcctaatcccgccacgatctgaaactgtagatcgttcccacgctcccgcgtgggtatgcatcccgtgacgctctgcgtcacccgtgcgcaggcttcaaagtatacgctggctgccgggacgcggagcgtcccaggaggcattcccacgcggagcgtgggaacgatctgatctgattgcgccgttcaagaaacggcgccacagatttttttcgcctggacgttgcctgagataactaaaagtccataatggacaaattagtttatctgcggagataaccatgtccagcacgccccacgtgatcaaccaggcccaggcccgtgaattactcgcccaggtcgatgtgccccacatcctccacaagctgtttcgcgacctggcggccgggcaggcggtgcagccggcgcagcagttggtggagttcccgcaaggcgcgggcgactttatcaactacctgggcgtgctggcggaagatgaggtgtacggcatcaaaacctcgccttacatcgtgcgcgagcatgggccgctggtgaccgcgtggacgctgttgatgtcgatgcgcaccggccaaccgttgttgctctgcgatgccgctgagctgaccatcgcgcgcacggccgccacgacggcgttggccgtggatgccctggcaccgggagccgcccggcgcctggcgattatcggcagcggcaaggtcgcgcaggcgcacctgcgctatgtgcagaacctgcgcgactggcaaagcatccgcctttactcgccaagccttgaacgcgccagcgcggacaccctcgcccacctcaacggcctggacccacgcctgagcctggccgagacctgcgatgctgctgtgcaagacgctgacgtcatcctgctctgcacctcgtcggcaggcccggtgatcgacccgatgcgcttgagccaacccgcgctgatcacgtccatcagtaccaacgcgccgcgcgcccatgaagtgccgcccgcaagcctcaagcacatgcaggtattctgcgactatcgccagaccaccccggacgcggccggtgaaatgctgatcgccgcgcagcagcatggctgggacaagcgcgcggtggtcggcgacctgcccgaactgctcagcgacatggttcagcgcccgagctatgaccgccacgtgtttttccgctccgtcggtttaggcctggaagacattgcactggccaatgccctctatcacatccagcgctaagcattttttcaggagacgttcatgagccacgcagacttcatcatcatcggcggcgggattgccggcgcctccacgggtttctggttatcgcagcacggcaaagtgctggtgctggagcgcgaaaaccacccggcctatcactccaccgggcgctcggcggcgctgtacacggcggcttatggcaccccgcaagtgcgcgcgctgaccttggccagccgtgagtttttcgacaacccaccggtgggattctgcgaacatccgctgttgacgccacgcggcgaaatgaccgtggatttcagcggcgaccccgcggagctgcacagccaatacctgagtgccaaggccaccgtgccgcaagtcgagcggctgagcgtcgatgaggcgtgcgcgaagttaccgatcctgcgtcgcgaaaaagtccacggcgcgatcttcgacccaaccgccagcgacatcgacaccgacgccctgcaccaaggctatttgcgcggcattcggcgcaaccacagcgaagtgcgcaccgacagccacgtgctcggtttgagccgtgacgccgacggcctgtggcaggtgcgcacccaggacgcgacctacaccgcgcccgtcattatcaacgccgccggcgcctgggccgaccatatcggcgggctggcgggcgcggcgtccatcggcctgcaacccaagcgccgctcggcgtttatcttcgccgggcccgagggcgtggacacccaccattggccgatgctggtggcgctggacgaagctttctacatgaaacccgacgcgggcatgttcctcggctcgccggccaacgccgacccggtcgaaccgcaggatgtgcagccggaagagctggacatcgccatgggcatttaccagatcgaagaggccaccaccttgaccatccgccgcccgacccgaacctgggccggcctgcgcagttttgtggacgatggtgatttgctctcgggtttcgatcccaaggtgcctgggctgttctgggtcgcggcgcaaggcggttatggcattcaaacttccccggccatgggccaggcaagtgccgccctggtgcgtggcgcgccgctgccggagcaactcacgcggttcggcctggacgctggtatgctctcgcccgtccgcctggagccgcattgatgaacaccgccgaacacgacaaggtcatgcagaatttccgtgcgattgccgatgcgatcgccacgctgttcttcccccacgccgaagtggtgctgcatgacttgcgcacacagaaagtcgattacatcgccaacaacctgtccaaacgcgccatcggtgacgactcggcacttgaggacatggtcagcgatgacgtcagcgaagtgaatatcggaccgtacgaaaagctcaattgggacggccagaaaattcgcagcctgagcaccgtgctccacgaccacacaggtcgccggctggcggtgctgtgcatcaacctgaatatctcgctgttcgaaaatgccaaggcggcgctcgacctgtttctgtcgcccagcaagctgatcccgcaaccggactcgctgtttcgcgatgattggcaggaacgcatcaacacctttttgcatgcatggatgcgcgagcgccagttgagcctgaacctgctgacccgtgaccacaagcgcgagctggtgctggcgctgcatgccgaaggcgcgttcaagggcaagagtgcctcgaactatgtggcgaatgtgctggggatgggacgggcgacggtgtacaagcatctgaaggaattgaagggctgagcagataatcctcgaaacaccacagatcaactgtgggagctggcttgcctgcgatagcggtgtttcaggcaatgaatggttgactgacagatagctatcgcaggcaagccagctcccacatagacctcattcagcgtcagtcgccgtaaatgtcggacttgaagtacttctgtgaaatcttctggtactcgccactcgcccggataccatcgatggctgcattcaatttgccgaccaactcggtattgcccttgcgcaccgcgatcccggcgccctcgcccacgtatttcgggtctttgagctccgggccgacaaaggcgtagcccttgccgcgaggcatcgacaggaagtcgctcagcgggatggtgtcggcaaagatcgcgtccaggcgccctgacgccaggtccatgtagatctcttcgttattgctgtagcgcttgacgttgatgcccttgggctcgaacacctcggtggcatagcgatcggtggtggtggcccgctgcacaccaacggtcttgcctttgaggctggcgtattggtcatccacaacggcgccgtccttcatcaccaggcgcgacgaggtgaagtaatacttgtgggtgaagtccactgatttcttgcggtcttcgttgatggtcatggacgacaacgccatgtcgattttcttgaccttgagggaaggaatcaggccgtcgaactcaccttctacccacacgcacttggccttcatctgcgcgcacaaggcgttgccgatgtcgtagtcgaacccttcgatcttgccgtcctgcgtcttggaggcgaacggcggataagccgcctcgatgccgatgcgcaagggttggtcggccgccagcacgtggctggacgcaatcaggctaagagccagagcggaaatgagcgtgtgcttcttcatgatcgttgtctcgcaagttgttgttggtttggcaagaagtgaagaaaggaaacggcaaagttttttgtacttataattccatattggacttttatgtattttccgtcaatccacgcctgctctggctgaaatgatcgcgccgggccaatattttcgcccgcctccatcgtttctccataaaacctcccacgaaagcgcattgtccgtgcgcataatcactcatgcccaaggcacttggacctcgccactatgaatgacttgccagctgcatcgacgccccgactcgacaacgcccgcgacacccaggcgctcgtgctgattgcggaagacgagccagagatcgccgatattctgattgcctacctcaagcgcagcggctttcgcactgcccacgccgtcgacggccgacgcgccctggacatgcacctggcgctcaagccggacctgctgctgctggatgtgctcatgccgcacgtggatggctggcaggtgttggccgaagtgcgccatcgcggcaacacgccggtgatcatgctgacggcgcaggatcaggacatggacaagttgatgggcctgcgcatcggcgccgatgactacattgtcaaaccgttcaacccggccgaagtggtggcccgcacccaggcggtactgcgccgctccctagattacagctaccgcgccagccccacggtgttgcgcgtggatgcgtttgatatcgacctggaaagctacgaagttacggtgatgatcgctggcgaaaaagtcccgctggcgttgaccgtcaccgagttcaggttactcgcccagttggccaaggcgcccaaacgcgtgtttacccgtggcgagctgctggcccaatgttgcccggaaagcgacagcctggaacgcacggtcgacagccacatcagcaaattgcgccgcaagatcgaagagttgggcttgcagggtgtgccgaccagcattcgcggggtcggctaccggtttggaagtgcctcgtgaaaatgctcaacggcttgagccgccagatcatcctgtccatgtctgccgtggtgttgtgcgtgatcgcgctggcggtgatcggctcgtatattttttatgcgttgttgtggacgtactggccgctcaccgacgaggaagtgaatgaatggctgccggccaacattgagtggatgtggatgggcctgaccacctgtgtgagcctggcggtgggctccatcgtcgcgatgaagctgtcgcgacggatcctcatgccgctgaactcggtcgccgagaacctgcgcaaactggccgacggcgacctggatgtgcaggccgtggccggtgatcagtccatcggtgaagcggccatcctggtcgacgacttcaacagcatggccaaacgcttgcagcgcatggcgcaagaacaggcgttctggaatgcggcgatcgcccatgaactgcgcacgcccctgaccatcctgcgcgggcgtctgcaagggctcgccgaaggtgtattcgagccggacaccgcccagttctacagcctgttgggccaggtggaaggcttgacgcgggtgatcgaggatttgcgcgtggtcggcctggctgacagcggctacctggaactcaacctgcaggaagccgacttggccaccagcattgaagacgctgtgcggctgttcgaaccgagcctggtggacaccggcttcgtgctgcagctggacctgcaacggcgcacgatgcgctgcgacccggccaggatccgccaagcgttgttggcattgctggacaatatccgcaggcatgcgacaccggggaacgttgtcgtgcacctgagtacccgcgatgccatcaactacttgcgcgtgcgcgatgacggccccggtatcgacgaggttttcgccaagcatatgttcgaggccttccagcgcggtgaaaactcccgctcccgcgcccaaggtggcagcggcctgggcttggcggtggtgcgcgcgattgccctcgcccatggcggggccgtgacctgccgccgaatggacaacggcggaacgctgttcgaactcagctggcctgtgtgatttaaccagagaccgcgatgcgcatttttcctcgatggttcaagcgagccccccgctatcgacactttgctttgctggatacccagggtgtgtgcagggcgttcaagagctgtgctgaacagcctgccggcgagcactggatagaagttgaacacatcaacctgacctggctgggaagcacgctgcccaagcgcgcccgaatcgtttagcaacctacgtgggccggacctatgtcaaccgcaccaccctccttcgccaatgcctacttggccagccttgaagacgcgttgaggctgcacaccgtgcggctgaagaaactgcagcgcttctgggtgccgctgcagcaacgcgcgcccaagtgggtgctggcgttgtgggtggtgggggtctgtgtgtcggtcgtcacccagtgctactgccattggctggtgaccgcgccgctgatttgcggattgatcgtggcggaaatcatcatcgacgagcggcaaatgaccctgctattgcgtgcggatgcagcacgggacttgctcaggcaggctcgggaaagcggccggcgataacccgaaaacaacaccgggtaagcgtagaggcacaggaaaacacccacaaaagttgtcgacagttcttgcgaaccgtcctacatacgatgacttcttcaaaccatagcattgatcgctgacccaccttataagtttaaaaggcagtgattgctaccatgtcatctctcggaacattaaacgtggacggtgtactgtgcatcagtcttgaagagcgcgaagaccgccgcaacttaattctaagagaatttgcagactgcaatttgaatatcgagttttatagtgtaaagcgagatattaaccctgaacgcggatgctttacttctcatcaggcgtgtgcggcattggcgcttgagcgcgggtacaaaaacgttctgatcctggaagatgacgccacgctggtaggggttaaacactcgacggtgcaacgcatcaaccattttttgtcctcccggcagcctgaactgttttacctgggtgtcacgctgggcactatgtggctcacgtggaacttgaatatcacccgatgtcgggcaaaaggcactcacgcttatatactgtccagctcagggtgcaaaaaactgctgacattcaagtacgctgacctggccatagacagtctttactccaaatactttaaagcctattgcgccttccccatgatctgccaacaacaacctgaagaaataaacccgagcgatataagttcaggtgccactgttgacttttgggaacgtaattggaaaaaacaatatcaggaagtgttccgaaaccttggaaaaacattgattagaaagggcttctagcgacagttgtacgcccttgcgacccccttccacgcgtcgataggcttcagccgtccaagcagatcgacggctgagcctctttgtctaccgctacttgcagccgatgcggctcggcaactggccctgcttggccttcagcgcaacctgcaccgattgcggcaaattgctccagaacgtcagccccgaccgttcttcgatctgtttcaccgtcacctgatagtcacagaaattcgcgcccttgggcgtttcctgattcatcacaaacgaggcgtacacaccgttttcaggtgagctgccgacgaagatgattttccagtaaccactgggaatggtgtgcaccttgttcgtccccggaagcgtgccgacaaaatgctcatacagcggcccggtggtgacgtacacctgatcgatacctgcctgtttgctcaggttgcgttcctggtcttccaggtgcgcccaaggcccctggttgagatcggacttctgcggggtgatgttcgacaggtaattgagggtgtgccagtcaggaaccccggccatcgacgcgaggttggcctggtggccgcggtcgactttgagcgcgacattcgcgccgttgtaatccaccgggtcgagggtttcgccagcgggaatgtccgggtcggtctgccagtcgcgtgggcgaccgctggccggtgtgtccttggtgattttgtacgacacccagttggcaaacttggtcgagccattgttgttcagggtgtacgcctggcggttcagcgtcagcgggctgccgccggttgggcagcccaccgagcagttatcgaacggcagtgcctgctgcgtctggggctgagtagagacggcgggttcgcgggttctgtcgggtgtggtacaggccgccaggagcgggatcaacagataggccagcgactttaacttcatacgtccttgcatggtgtagctccttgggtcaatgacaacggcagatgccgggccgacgcttgcggttccatcgcgtgtcggtctaaacattaaaccactttaaacattgcaaaataacgttatcgcgcccaataaaaagccactcaatggagtggctttgggagcgggaatagcaccttactttcgtttgaatgccgcacgcctttctgcacgttcggcggcaaattggtcactcattgtcgcgtccaggtctttacgttcaagctgagccccgcatccagggcataccgcgctcagaccaacatcgtgaccgcattgacgatggacgaaacgtaccgcgaccgcctcgctctcgtctttggaccaggtctcgccccatccacgcaatgcatagaggacgggatagaacgccctgcccttttcagtcaggtggtattcatggcgcaaaggcttttcgctatacggatgacgctcgaccatcgcgctcgcctccagcgccttcagacgtgtcgccagcatctgcggcgtcgctctcgtctgaatctggatctcttcaaaacgcgtggcgcccatgaacagttcgcgaaggaccaggacggtccatcgatcaccgacgatatctaacgaacgcgccaccggacataccgtatcgggtgcctctgcatcgtgtgccacaacgactctccagaacagactcttaatttcatagtaacacaggaaaaatctgctgcagttgcctgcgcgcgcccccggtcgccgtacgattcagcacccggcaggccagagtatatttgacactatgattatcatagtgatagcgtttattgactgcaatcgaacggtgaggcatcaccaaacctgcgacaactacggttcaaggtcgactgcaaacgcgaaatttctcgcaaacttctgctgactggagaacgaaatggctgatctcgtataccgcgcgcagcgcactgggctgttgctggtcgacccgtataacgactttctctcagacggcggcaagctgttcccactgctcaaggaagtcgccgatgaggtccgcctgctggagaacctgcgcgccaccgtcaaaactgcccgcggcgcggatatacaagtgttctacgtaccgcaccgccgctggcagcccggtgactacgacaattgggatcacccaaacccgacccagcgccttgtgcagcaacgccataccttcgccaaggacacctggggcggtgagtggcaccccgacttcgtgccgcagcaaggcgacatcatcatccaggaacactggggccaaagtggctttgccaacaccgatctcgacttccagttgaagcagcaaggcatcacgcacgtcatcgtgatcggcctgctggccaatacctgcattgaatcaacgagccgttttgcgatggagctgggctatcacgtcacacttgttcgcgacgcgacggccgcgttcaaaaaagaaatgatgcatgccgcacatgaactgaacggcccgacctacgcccacgaaatcctgaccacagccgaacttttggctgccctcaacacaggcaccgccgcctgacgctgaagaggccccacgatgaaactcactggcaatctgctgatcggcgctcaggaagtgtccgccaccgccggcaccatgaaggcgctgaacccggcgacgaacgctgagatcgaaccgtctttcgcgttcggcggcagcgcacacgttgatcgcgccgctcaactcgccgacgacgcattcgacagctacaaccgtaccggccttaaggcgcgcgcagcgttcctggaacgcattgccgatggcctcgatgcgattacacccgaactggcgcaacgtctctcacttgaaagcggtttgccagtggcgcaacttgagggtgaagcggcgaaatcggcgattcagtttcgccagttcgcgacggtcgtccttcaggggcgctttcgacaggcgactatcgatacagcacaacctgagcgtcaaccgcgcgcacggatggatcaccgcttgcaaaagattgcgctagggccgattgcgatctttggcgccagcaactttcccatcgcctattcggtggcagggggcgatacggcgtcggcgcttgcagccggctgccctgtcattctgaaagcgcacaacgcccatcctggcgggtcggaattgatgggccgcgtgatccagcaggcggtcaaggatgctggcctgcacgagggcgtgttttcgctggttcgcggcggcggcaacgaaatcggcgaggcgctggtcgatcatccgctgataaagggcgtcacatttaccggctcggaagtcggcggcatggcgctgtttcggcgcgcgcagcaacgtcctgaaccgattcccgtcttcaccgaaatgaccagcgtcaacccgacatttgtactgccctcggcgctcgctgcacgcggcgctgtgatcggtgacgggttcgctgagcgcatgctggtcaccgtcggccaggcgtgcctgaagcccgcgatcctgctggctgttgacggccccggctatgtcgaattgaagcgtgcgatgatcgctcgcgtcgacgccatgcatgcgcgcacgatgctgacgcccggcatcagcagcgcgtatggcaggagcgtcgaacagcaagctgcggcaggcgcccagcgcatcgcggcaggcggcgaatcgcgaggcgcatgggacgcgcaatcgatgcttttcgaagtcgacggtgcgcagttgcttgacgatgcaacgctgtcgcacgaagtgttcggcccggctgcactgctggtgcgggtgaaggatgtcgagcaattgatcacgatcgcaaagcagtttcgcgggcaacttagcgcaacgatgcaaatcgatcagcccgatcacgcactggctgcgcgcctgctgccgattctcgaacgccgcacgggccgcatcgttgtcaatgcgttcgcgcatccgcaagaggtgtcgtatgcgtcgattcacggcgggccgtttcctgcgacgtctgacagccgtttcacgtcagtcggcatgacggcaatcgagcgattcctgcggccggtctgctaccagggctttccggacgacctgctgcctgaagcgttgaaacatgacaacccgagcgacctttggcgtgtggtggatggcgagttgttgaaaggctgattgaggctcaccggagcgaacggctggtcttagcagggcaagcccgcttgttgtggcgagcgggcttgccacgcgttgggctgcgcagcagccccaaacccgtcaccgcggtattccagatatatggcatcgccgggtttcagggccgcttcgcgccccaacgcggggcaagcccgctcgccacaaaagcgtgtctgtgactactgaccggcggtgatgcgcaccatgaactggcgcgtcaggctggcgatctgttcggttttttcatccagtgcgaaatggcccgcctccaggatgtggacctcggcacccggcacatcgtccttatagcgcatggcccccggcacaatgaatgacgggtcgtattgaccccacatcaccaacataggtggctggttgtctttcaaccattgctgccattttggataagacgcgacgttattgcggtagtccagcaacaaggccgactgtatcgcccgctggcccggtcgggataacgccgcaaactcgtcttcccaggcatcagggttataacgctcgggatgagggctggtgcccaagtgccgctgcttggtgccctcgtacccggtgaacgcatcgacttgctcggcatgttcggctggcgcctgccaatacttggcaatattcgcccacttggcgcccagaccttcgttatagctattggcattctggatgatgatgccgtgcaatttttgcggcgcgttgagaatcatccgaaagccgaccgggccgccgtaatcctgcatgaacaaggtgtactcatccacgcccaactgcgtcagcaaggtgctcatggtgtcagccagatggtcaaaggtgtaggcataagctgcaggggaaggcgcatcgctcctgccgaaccctgggtagtcaggtgcgatgatgtgatagcgatcggcgagcagcggaatcagcgaatcccacatgcgcgacgaggacgggtaaccatgcagcaacaccaaagtcggcgcatctttgcgcccggcctcacggtaaaaaaccttgacgccatccacgcttgcccagtgatagctggcggactcggtggtatagggaatagagggcacaggttcggcggcctgggccggctcggtcatcgaaagcgtcgtcatgagcgctcctagcaagcaaaaggtcggtatgttcaaagaggtctgcttccttcattgcgtatttcccgctgaaatacggctgagatcagagtgaacgtctctgagaatgggcaccattggcccaattagcgtttttcattagtatcgggccaatcttgatgaggcctgccgtcgtgaaaaaaacgttgagcgttgctgttatcgccttcaatcacatcagcccctttcacctgtccgtgccctgcctggtgttcggtaaagatcgcagagtgggggattcaccttggttcgaactggtggtctgcgctggcgaggatggggcgctggttaccaacgccggcttcgccatccactgcgttcggggcctggatcaggtcgctggtgcggatattgtggtcgtacccagctggcgggacgtcaccgaaacaccgccggcggcactcatagaagcgcttcaagcagcccacgcaaggggcgcgctggtggttggcttatgcctgggggcgtttgtactcgcccatgcgggcctgctgaacgacaagcgcgccaccacgcactgggcgtgggcaacgcatctggcgcgagatttcccgagtatcgacgtcgacccaaaagtgctctatgtggaagcggagcaggtgcttacctccgcgggtgtggcagcgggtctcgattgctgcattcatatcgtcaggcgtgcctatggccgtggggtcgccaacgcgttggcgcgtcaactgctggtttctccccatcgcgacggaggccaggctcagttcatcagtcagccggttcctcaaggcgccagcgaccagcgcctcggccaactattggattggcttcgagccaacttggtcgaaccgttgtcaatcgatcaagtcgcggcaaggttggcgatgagcagacgtagtttcacccggcacttcaagcaattgacgggcacaacgtttgggcaatggctgattaacgagcgcatcaaagcagcccaactgcagctggaaacaacccaccacaccgttgagcaaatcgctgacgcttgcgggtttggtacgagcctctcgttacgccagcacttttcctcgattgtgggcgtgacgcccaccacctaccgaaaggcttacggtcgccaggtttagccatatgccctcagggcttgacccaattcaggtctaccgcgccctcgattctctggacccgccctttgctgctgtgttgccaccactgccagctcttgccctgtttgcgccagaaatgggaacgaacaacgaagcgcaccgctcagaatagtgttgccgctttgcatttatccgccggcaacgcatgaggagatagtgtgtccacttcagagctgatttcgcgcgttctcagcacaccccgtcatacgacgcactatgtagagtcgggacctgtcgacgggccattgatgatgttcctgcacggctggccggagctcagtctgatctggcgcgcgcagctagaggcgttcgctgccaacggttggcactgcgtggcacccgatatgcgcggctatggtgcctcttctgcgcccgcagccatcagtgcgtacacgattgaaaatatcgtggccgacatggccgaacttcatgaccacctcggtggagcgcccgccatctgggtgggccacgattggggcagcgttgtggcgggtgaactggccgcccacgaaccccagcgcagccgcggcgtcgtgctggtttcggtgccgtacttccccaccacgaacgcgctggcgacgcttgtcccgctgattgaccgagggatctatccggcagaccagtatccggacggccaatgggactactaccgctactacaacacgcactttgcgtctgccgtggccgatcttgatgcggacaaagccgcctcactggcgtcgatctatcgacgaggtgaccctgcaagcatcaccaaggttgcatcaaatgccgaagtcacacgcaaaggcggccggtttggccacgcgcacaaagccccacccaccgatccagacctcgcgctgtggccgcaggcggacttcgctgcactggtgcgcagtttcgaaaagcatggtttccgcgcgccgtgcgcgtggtatttaaacgacgacgccaacatcgattatgcccagcgagcgcccaatggcggccgcttgtccttgcccgtactgttcgtgaacggcgattacgacccgatgaataccatcaaaggcaatcgattaggcgatcccatgcggggggcctgtgcagatctcactgtgaaaagcctggccggcgggcattggttgccggtggagtgcaagacgggacttgttgaagctataagcacgtggctacgcagtagacagttttgatgaagatcgagagcgtgatattgccagcccctcacctcacttggtccgtcaaatgaggcagagatccgaggctatggattattaatattcagcctcttcagcttgaaacatctcaatcagcttctggttgtagtcatccaaataccgttgaagcccctcacgatcgatcagacgtaccgccgccgtgccggccaattcctttgcggatcgggtgaagtacgagctggtaacaactctggaagatctcagtcgccctttatggatcgctcctacgcctctgctaagcacttccgacagcccgttccgaaaaacctaacagtcacgaaaaattacgagcccatctttctgataaacgttatgtattcagttgttctgggcaagacgcccatgcctcaattcgcctcatgaagggctcgaatcatgttaaatacttcgtttatttcctcactgcgttccgccgtcagtacatcgctgcgccccggccaactcaatcgggaggaagagcgactggtgcgctattaccgcttattgtcagaacaggatcgtgaagcggtgcgctgtctgatgtttgcggtcaaggaaaccggccggtccaaacgccctcgccgataaaaagtgacgcagttatctgccagcgaacaatgaagccccgatggggttggactcgttgccgaaacattttgccctgcttcggtggcctgaccatttaccgctgtgtgggcgccttaatccgacaggatctgctcgacctgttgggctccggcaataatccggcttcgatgccctccagttttatggactagactcggagccaaatcagccggggcacccgcagcgttcggaagttgccagcggaacgaaaaaagacgcctaagcgcctatcacgtaaatcgcaggcaaaaaaaaagccactctattgagtggctttttctttgtgtttggagcgggaaacgagactcgaactcgcgaccccgaccttggcaaggtcgtgctctaccaactgagctattcccgcgtcttggtggtgtgcattctatagaatccagaacccccgtcaaccccttgattcaaaaaagttttatttcttttcaacggtggtgcgcaggtgaggccaggcggcgcgcaaatactggagcatggaccacaaggtcaggccggcagcgatcagcagcaaggcgtagcccagcaggacccagaaggagaagtccgacgggttggccagcaggatgaccagcgcgagcatttgcgcggcggttttccatttgcccatgttggagacagccacgtgggcgcgggcgccgatttcggccatccactcgcgcagggccgagacgacgatctcgcggccgatgatcactgcggccggcagggtcagccacaggttgccgtgttcctgcaccagcaggaccaaggcgacggccaccatgagtttgtcggccaccgggtccaggaacgcaccaaaaggcgtgctttgctccaggcggcgcgccaggtagccgtcgagccagtcggtggcggccgcgaaggcaaacaccgaacttgaggccgcgtagctccattcgtaaggcaaataaaacagcaaaataaaaatcgggataagcaggacgcgtagaacggtgatcagattagggatattcatcggcacaactggctacgaggtggaaaggcattctattcgctatgcagattcgcataaatcaactcagcgagctttttactgataccgggtgctttggctatttcgtcaatgctggcacgggatagctcttgcaagccaccaaaatgtttaagcaggtcgcgacggcgtgtcggcccgacgcctgccaccccttccagggttgaggttcgtcgggttttgccacggcgggcacggtggccggtgatggcaaaacggtgggcttcgtcgcggatctgttgaatcaggtgcagtgcgggtgagtcgcccttcaaagtgaactcatgggcggcatcattcaagtacaacgtctcgaaaccggccttgcgcgtggcgcccttggccacgccgagcaggatcaggtcgggcaccgccagctcgttgagcacgtcgcgggccatggacagctggcccttgccgccgtctaccaggaggatatccggcagcttgccctcgccgtccttcaacttgctgaagcgccgcgtcagggcctggtgcatggcggcatagtcatcgccagcggtgacgccttcgatgttgtagcgccggtagtcggatttgatcggcccttccggcccgaacaccacgcaggacgccaccgtggcttcgccgctggagtggctgatgtcgtagcactcaaggcgctgcggcggctcgtccaggttgaggacttcagccagggcgtcaaaacgtgcggccacatgctgccgattggccaggcgcgcgctcaaggcctgttcggcattcgtcaccgccagctgctgccagcgcgcacgggtgccgcgtacgcggtggctgatgtccagctcgcggccgcgcagctcgtgaatcgcttcgatcagtgtgggaaagtcttcgtgcaccacgttaacgatcaactccgacggcaaatcgcgctcggggctgctcacatagtactggccaaggaaagcggccatgacttcggccacctcctcgtcgatcccggtctgtgggaaaaagttcttgctgcccagcactcgcccgccgcgcacgctgatcaggtgcacacaggcgccgcctgggttgacgaaggcggcgatcacatcgacatcgccggtgccgccctccatgctttgctggtcctggacgcggcgcagcagggagatctggtcacgcagctcggcggcgcgctcgaaatccagcgtaccggcagcctgctccatagcgccggaaagctcgtcggtgagtgcattgctgcgaccttcgagaaacatcaccgaatggcgtacatcctcggcgtattccgccggctcgaccaaccccacgcacggcgccttgcaccgtttgatctggtattgcaggcagggccgcgtgcggttcttgtagaagctgtcttcgcactggcgcacaaaaaaggttttctgcagcaggcttaaactctcgcggatcgcgccggcgctggggtacgggccgaaatacttgcccttctgcttcttcgcgcctcggtgaatactcagccgtgggaagttgccgtcggataaaaacacgtaagggtaggatttatcgtcacgcagcaggatgttgtacggcggccgccattccttgatcagcgtctgctcaagcagcagtgcttcggtttcattggcggtgatggtggtttcgacttgggcgatacgcgccaccagggcggcggtcttgggcgccagcccggtcttgcgaaagtagctcgccaggcggttcttcaggttcttggctttgcccacgtaaagcaggcgcgcctcgctgtcgaacatgcggtacacgccggggcggccactgcaggttgagagaaaggcacttggatcaaacggtgtggtcatgtcaggcgctggcgtccaccatgccgtggcgcaccgcgagcagggtcaattcaacatcactgctgatggcgagcttctcgaaaatgcgatagcggtaggtgttgacggtcttgggcgacaggcagagcttgtcggagatcgtctgcaccttctggcaaccgacgatcatcaaggcaatctggatttccctttccgacagcgcatcaaatggcgagtcactggtgggctggaacgacttgatagccaactgctgggcgatctgcgggctgatataacgctgcccggcaaacaccaggcgaatggcttgcaccatctccgccaggcctgcgcccttggtcaagtaaccggccgcgccagcctgtagcagccgcgtcggaaacgggtcttcctcgcacacagtgacgaccacgacttttatgtccggatggctgcgcaacaatttggtagtggcaccaagaccgccgatcccaggcatcttgacgtccatcaaaaccacatcgggtttcaactcccgggccttgatcagggattcctcccccgattcggcctgaccgactacttgcaggccatcgatgtcagccagcattcgtgtaatgcctgtacgaacgagatcgtgatcatcgactactagcaccctaatcaagcagacacctcgcgatatggtcttataggttgctgaacaccttagcaaaaaaccagggcgcagacctagctgcaagcgtcatatatatagagttaacgcacactatcggcgtccacccagcggcagacagccgattttactgagcaaaaggtcagctttgcgggagagacggcttgtgttttccgttcttcgacacggagtgttcagccagtgtggaggtgagtcgacggatagcgtcctgatcctccttgaacatcgcccggtagttttccaggattttctcttccagctggctcaggttttccaactggatgggcgtggggctgcccgtgagcacgtataaaacatccacaccgcgctcggcaacgcgtgacagatagtcagccttgggcgcgcggcccccgctctcgtacttgccttgggcgtttgcttcaacgccgccgatttcaccaaacattttctgcgacaggccaagacgttctctttcctgccttaaacgcgaaccgattccactcatttggatgtatgatcctatctggcacaccccaagaggtgacacactcatctcgttttacacaaacttgaacggttttgaactatgcccggtattcgcactgctgcacaagccaaggcttggttggaacatcaaggcaagtcagttcaagcgtttgcccgggaacacggcgttgatccggccacgacgtatcaagtgctcgccgggcgtaaaaaaggacggcgcggagaagcccataaggtggcggtcctgctgggcatgaaagaagggattatcgtggatgagcccgttgctcaaagccgcgatacgcaagcggtttactgacagcagtatgcgcttattcgtacagcgtgcctgttaatcgtccgatgaatctgcgtcacacacacgctccatacacaaaaagcagttctcttcctggacaatgcttagcccatgcctcaggtagaggtttctggccgggttgatcttgaacacggtcaggcgcaaaaaccccagcccctgcgcacgcgccttcagcaccatctgctccaacacccagctgccggcgccttgcccgcgactcgcttcgatcaagtgcagttcgcgaataaacagcgcatcgtcgtcgtagctcaggctgataaaaccgatgaccttatcgtcacggcagatcatccagctttctcgacccgcccaggcggtatcaaagccgtcgttggaccatatgaacccgtagtgctcgtaatagcgatccatcgactgacgggtaaggacgcgtgcaaacgaacagtcccggtccgtcgctgcgcgcaagtgaaaggtcattgcctgctgcctccgattcagattgccacttgccgtccagtccagcgcccgccctcacgctgagcgatgaccaatgcgccgccaacacccggtgccgcgctgatcaagccctgcgccccccaaatcgcgctgcgacctgcacaggtccagccgcccgatggcccaccgtggttggccatcagcacgagcattccatgttcttttgcgtagccctcgagcaatgcggcgtcagtggcgtagccaccctcgctgatcagcacaccggcggcatagacgttagcccccgactctgccgcagcccgcgggtgactggcatgggaaaagtcagcgcataccgccagagcaatgcgatcttcaccccactcgagtgcggcaccaccctgccccgggataaatgccacgtcttcgccggggtgcagatgctgcttggtatagaccgccaacgagccgtccgcccccaacacgagtgcgccgatcaacacacccgtttccggtgccaggcgaatcggcatccccaccaccgccgtcaaccgcagcgcttgcgccctctcgcgcaacggcgtcagcacggcgtcatccggcgctatcgccaaaccggccgccaacgcgggttcatacccggttaacgacagctccggaaacaccagcaactgcacaccgtgttccgctgcggcctgcatgaatgccaggtgctgctggatattggccggcacgtcgcctgcgctggagagggtttgagcggcagcaagggtcaaggcagtcatggtcgcgtccaggcaatcattgtcaaagtgttaccagcatatcggcactcgccccatagccgtaagtggctcacgcgatagaaattactgattgaatccaaccgcgcgcctctagtaagctcagcccatcatttggagacacaccatgttgcaacttacccacactcaggtttgccctgctgccagcgcctcgcgctcggtgtcggctacccgcgtgaacggttcgagcgcactggtcagcttttattttgggtattggtttagccactggcgcgcctgatacctgaaatcggcgcccactactcaaggggtcgcctaccagagaaatctaacccccggtcggctccccgaccgggggttttgttttttcaggcctccatcaacttttgaagaacacttaaaggacacacaacatgaactacgccacttattaccgctacgacacttgcactgcatggcgatttagcaagctccgttcgggacagcctgccgcctccgatcggtcacctatcggtggcaagccaacacacgtagccactacggccaattgtcgaacaccccagtagggcagagcgcgcgggaacagcccgccgcttgcccaggaagccttgaatatgaactccgccaccgccgctttgcctgttgccaacctctccagcgccaatgaagccctgactcagcgcttgcccagctcccttgagctcaagcatcagttgcccctcagcccgttcctccacgagcagatccacgcccatcgccaagccgtgcgcgccatcctcaacggtgaagattcccgtttgctggtgattgtcggcccgtgttcgatccacgaccccgagtcggccatggaatacgcgcgcaacctgaagaagctggcaattgaagtcagcgaccagatgctgctggtaatccgcgcctacgtcgaaaaaccgcgcaccaccatcggttggaaaggcctggcctacgacccgcacctggacggcagcgatgacatggccgcaggcctcaccctgtcccgcgagctgatgcgcgaaatgctgcgcctgggcctgccggtcgccaccgagctgctgcaacccatggccgccggctacttcgatgacctgctcagctgggtcgccatcggcgcacgcaccaccgaatcgcagatccaccgcgaaatggccagcggcctgggcatgcccgtcggcttcaagaatggcaccgacggcggcgtcgcgattgcctgtgacgcgatgcgctcggcctcccacccacaccgccacttcggcgtcgacagtcagggccacccggcgatcatccagaccccgggcaaccccgacacccacctggtgctgcgcggcggtcaccgtgggccgaactacgatgcgcagagcgtggcgcaggtgaagcttgacctggccaagtccaaagtggcggcgcggatcatggttgattgcagccacgccaacagcggcaaagacccgctgcgtcaaccggcggtgttcaatgacgtactggaacagcgcctgcagggcgacacttcgctggtcggcatgatgattgaaagccacttgttcgaaggttgccagccgttgagtgcgtcgatgaaatacggcgtgtcggtgaccgatggctgcctgggctgggatggcaccgaacagttgttgcgaagtgcggcagagcgccttcgggagcaacacaacgccaactgacagaagaagatcaaacctgtgggagctggcttgcctgcgatagcggtgtatcaggctacaaatctttagctgatgtaccgcaatcgcaggcaagccagctcccacacttgaacagcgctggactcaagaaagtggatacagcgcctcatcaaactgggccaatttcggaaacaccaagggctgctcctcccccagcccattgagccgccgcgcataccccaacagaaattcccgccgcgccgcatcactgatatacggcacatgccacgccacaaacggcgccaatacttcatagccgacatacgccaacgtaccgcgcagaatcggtcgcaacatgtcctccaacggcccatgaatcgcaccctcgccgaacatatgctcacgcccgcccagcgtcaccgtgaccagcgcacgcttgcccgccaagccgccctgatcgtagaaacgcttgccgccgtaacacacgcccgacaccagcacccgatcaatccagcccttgagcatcgccggcgccgagaaccagaaaatcgggaagttgagaatcagcaaatcggcccacaacagcttgtccaactcggcctggatatccgcggcgatcgactgcttcttcacccccaggcgctgctccagggcatacaccagatactcggggttctcccgcgtggaaaaatctgccgccgacgccaccgggttccactgcatggcgtacaagtcactcacctgcacctggtgcccctgggcctgcaacgtggtgaccgcctgatcgcgcagggcggcggtaaaggactgtggctcagggtgcgcgtgaacaatcaaaaccttcatgtgaattcctcaaacggtgggcgccgcccgttgggccagcaaatgatcgagccagtccgggtccatttccggttccgatgaaaacagcaggccggtgtagtcctggtacggcggggtaaaaatcgcgctgcggcggccttggtcgaccaccctgccccgctgcatcaccaccacctcatcggcaatcgcgcgcacggtggcgacgtcgtgggtgataaacaggtaggccacgcccagctgctgctgaatacgattgagcaacttcagcacaccttcggccaccagttgatcgagggccgaggtgacttcgtcgcagatgatcagttgcgggtcggccgccagtgcacgggcgatgcagatgcgctgcttctgcccgccggacagctcgcggggttggcgctccatgaacactgccgggtccagctcgatcatctccagcaattcggcgacccgcgcgcgcatcgccttgcccttgaggcccaggtaaaacgtcagcggccggccgatgatgtcgacgatacgctggcgcgggttcagcgccgtgtcggggatctggtagatcatctggatacgccgcaactgctccttgctgcgccgccggaagtccaccggcaacgcctcgccgtcatacagcacgtgccccgccgtggccggcagcagcccggtaatcaggcgcgcagtggagcttttgccgctgccggactcgccgatcaccgccagggtctggccgcgatgcagctgcatcgacacgtcatgcagcaccggttgatgcccgtaacgggcacacacctggcgcacctccagcagcggcaccgcctgagtcgggcaggccttgggctcggtgcggaaactgcgcaccgcccacagcgatttggtgtagtcctgctgcggccggctgagcatgctgcgagtgtcagcttcttccaccagctcgccgtggcgcagcaccatgatgcggtcggccatctgcgccaccaccgccaaatcatggctgatgtacagcgcggcgctgccgaaggttttcaccgcatcgcgtatcgccgccagcacttcgatctgggtggtgacgtcgagggcggtagtgggttcgtcaaagataatcaggtccgggtggcaggccatggccatcgccgtcatcacccgctgcaactgcccgcccgagacttgatgcgggtagcgttggccaatggtttcggggctgggcaggcgcagcacgcggtacaactccaccgcttcgcgctcggcctgggcgcggctgataccgccgttgatcaccgcggtttccacatgctggtcgatcagtcggtgcgccgggttgaacgacgccgccgcgctttgcgccacatacgcaatgcgcaggccgcgcaatttgcgcaaggcctcaggcttggcctgcagcaactgaatgccgtcaaaacacaccgagccgccgacaatgcggcaaccgtcgcgcgcataacccatcgctgcgaggccgagggtggacttgcccgcgcccgactcaccgatcagccccagtacctcgccgcgctgcaaggtcagatcgacgcccttgatcagcgggtgccaagcgtcttcgtaatgcccttcgacctgcaggttgcgaatttccagcaatggcgtgtccatcctcaacactccttcaagccgctggatttatgcagcatccagtcgacgacaaaattcacgctgacggtaatcaacgccacggccagggccggcagcaacgggctgatatcgccgaaggtgatcaacaccgcgttgtcgcgcaccatgctgccccagtcggcggtgggcggttgaatgcccaggcctaaaaacgacaacgcgctgataaacaggaacacaaagcagaagcgcaggccgaactcggcaatcaacggcgcagcggcgttaggcagcacttcgcgggtgaccagccaccacaggccttcgccgcgcaggcgtgcggcttcgacgaagtcttgcaccaccacggtcatcgccaccgcgcgggacaagcgaaacacccgcgtcgaatccagcagcgcaatcaccaggaccaacgaggtggcgttagtgcccaccacgctgaggatcagcaaggcaaagatcagctgcgggatcgccatcagaatatccaccacccgcgacaagccctgatcgacccagccgcccttgatcgccgcgaccaggccgctcaaaccaccgagcacaaacgccagcgtggtggtgaggaaggcgatgcccaaggtattgcgcgcgccgtagacgaggcggctgaacatgtcgcgccccaggttatcggtgcccagcaggaactggccgctccagggcgcgaagccctcgcccaccacttgggtttcgccatacggcgccagcagcggcgcaaacagcgccacggcgatgtacaaaacaatgatcagcaggccgaacttggcgctcaacggcgccctggccaggtggctcaacaggctcatggtctaccccttcggatgcatcaagcgtgggttgctggcgatggacaacacgtccgccccggtattgagcaggatgtaggtggcggcaaaaatcaggctgcaggcctgcaccaccgggatatcgcgcttggccaccgagtccaccaacaactggcccaaccctgggtagacaaacaccacctcgaccaccaccacgcccaccaccaggtacgccaggttcagcgcgaccacattgacgatgggcgccagcgcgttgggcaacgcgtgccgccagataatccgcgactggctgatgcccttgagccgggccatttcgatgtaggggctggcgagcaaattgatcagagcggcgcgggtcatgcgcatcatctgcgcgatcaccaccaggctcagcgtcgccaccggcaataccgagcgctccaggattgtgccgaacgacgcgccaggcgccaggttggacaggctgggaaaccagccgagttttaccgagaacaccaggatcagcaggtaggcgacaaagaactccgggaacgacacggcgctcaaggccgtggtgttgagcaggcgatcaaaccagctgttgcggtacagcgccgccaacatgcccagcaccagcgcggtgggcaccgagaccaccgccgccagggcggccaggctcagtgtgttgcccaagcgcgcaccgatcagctcggcaatgggccgctggttggccagtgaagcaccgaggtcgccgtgcagcaggcgcagcagccattgcgcaaagcgcgtgaacggcggcaagtccaggcccagctgcgcgcgaaacgccgcgacggtttccggcgtggcggactggccgagcatggcctgggcgatgtcgccgggcagcatgcccacggcgaggaagatgattaccgagacggcgaacagcgacagcaggccgagggcgaggcgttggaggattagtttgagcaggctattcatggacgattctcatcgagacagcgcttatctgatgtgggagctggcttgcctgcgatggcggcctggtgggctgcggtgaatggacgggcctcatcgcaggcaagccagctcccacattggatcttcattggcagggagggctctaggcttgccaccaacgctcaatcaaccgcaacccatccagctcaccataaggcgcggtcagcggcccatggctgacgcggttcgaacgtgccgcaacggagctggcgaacagcggcacaattgcgccgccatcgtcacggcacagggcctgcatttcgttgtacatctcctggcgcaacggcgcgttcatctcgccacgggcggcggtgagcagttggttgaagcgcgcattgtcccagtgggtttcgttccaggccgcgcctttggcgtagccgatgctgaacatgcggtcggcggtcaggctgctgtaccagaatgaagtggtaaacggctgcttcatccacacattggagaagtagccatcggccggttcacgcaccacgtcgatgtcgataccggcctggcgcgcctgctccttgaacagcaccgaggcgtcgaccgcgccggtgtaggcggcgtcagaggcttgcaggcgcaccttgagcgagtccacaccggccttgcgcaggtagaaacgcgacttgtccgggtcatacgcgcgctgctccagcgcggcgttgataaagcggctgcccggctggatcgggtggtcgttgccgaccaggccatagccatgcagcaccgaagccaacaaggtctcgcgattgatcgcgtgtttcatcgccatgcgaatgtcgttgttgttgaattcgttgctgtcgcacagcatcgggaaggtgtagtgctgggcgcccttggtttcttcaatcaccaagcctgggttgcgtttgagcagggccacggttttcagatcaaccttgttgatcacatccacctgcccggtgaccagcgcattgacccgcgcggcgccgtcggcgatggccagcagctcggcagtggcgaagtgcgcgcggccgggtttccagtaatcggggttgcgttccaggtccatgcgcacgccgggctcgaagcttttcaggcggtagccgctggtgcccacgccggcctgccaatcggcggcgccgtctatggcgggcatgatcaccaagtggtaatcggcgaccacataggcaaaatccgcattgcccgaatgcagctcgaacaccaccgcgtcactgcccttggcgctgacgctggcgacatcgccgagcacggtcttggccgccgaggtggagtccttgctcaagtgatggttgatcgataccaccacgtcgtcggcggtcaggcttttgccattgtggaaggtcacaccctggcgcaagtggaaggtccacacgcgcgcatccggggtggattcaaagcgctcggccagttcggggatcgcagtgccgtcgacggcgatctcagtcagcgtgttgtacaccgccgaaaagccgacgaaggtaaacgtgtcgacccacgagccagggtcgcgcgaatcggtggtgctgccaccggccaggcccaggcgcaaaacaccgccaggcttgggcgccgcgtcttcggcgaaggcgtgtaatggcaggcccatggaaaacgctgcggccaccgcgcccgctaccgcgctgtgtttgaggaagtcccgtcggtgcatcgcttgagtcattttgttgttgttttcgctcatggtcttgctcctctaaaggtcaacaggcataggcatgtttcaactcgatcaaggtcacgccattgcgtttgaagccgttgcgcaagtccgtttgcaattcatccaggttttttggctggttcacggtgcacccgaacgccttggcgaagagcgcgaaatccgggttgcgcggcagcacgccgatgggctcgatgtccaggcccagcatgtcgtcgcggatctggccgagggcgtcgttgttccacagcagcaccaccagcgggctgtccaactcttcaacagcggtggccaactcctgggcggtgtagaggaaaccgccatcgcccaccagcaccagccccggccgcaacggcgcgccgaacttggcgccgataccggcgggcaagccatagcccaaagtgccgtagccggtggggtgcagccagctacgcggcgcgcggctgcggtaggcatagttgccggtgtaggccagctgggtcatgtcactgctgatacaggcgttggcgggcagttccgcctcgatgcggtcgagaatggcttggtggatcgactgcagcgggccgtgccccagctcaacggcctggagcaatctggtgactttattgattgccgcttcagcgtctcgcggcgccgtcggcaagcgctccagcaacgccagcacggtcctgttggcatcgccttgcagcgccagcgtgcacgggtaaaaatcattgaatttgcgtgggtcgatatccacgcgcagcagctcaccattgatgggcaagcgctcgcgccagtaatcggtgtcggccatttccgtaccaaccgccagcaccacatcggcctcgctgatcagctgccagccgggttcgacgcacagggttgaaccggcattcagcgggtcattgaccggcagtaaacctttgcccgcgacactggtgaaaaacggcgccgccaattgcgtgctcaagcgctgcaaagcctcacccgccgccagcgcgccgccaccggcaatgatcatcgggcgcttggccgaggcgagtttggccgcggcctgatccagcacctcggccgctggcaggccgcgcccagtaccgcgcactacctcattgctccagtcccattcaatcggagccgccaacacatccagcggcacggaaatatgcaccggccgtggccgctcgctatcgaacaccgcgtaggcacgggcgaccagctcgggcaaatcttcggcgctcaaggccactgccgaaaacgcggtgatgggcgccgtgatcgagcgctggtcctgcgtctcatgcaggatgccccagcccattccgaggctggcaaggtgattgacgctggagatcaccaacatcgggatcgagtcggcatacgcctggccgatggcggtggcgacattggtcacgccggggccggtgatcacaaagcacacgcccggtttgccgctgacccgcgcataaccgtcggccataaacccggcgccctgttcgtggcgcgtgagcacatggcgaatgccgctgccgggcaagccgcgatacagctccagggtgtgcacgccgggaatgccgaacaccgtgtcgacgccatagttggccagcagccgcaccaacgcctggccgccggtcattgttttatcgtgcatggccatctcctaggcgaatcaatgcatcaaccgccgtggcgctgcgggcattgaccaatagtgggttcacatccagttccagcaactgcccggcatgggcacaggcgtagtcggccacggcgcggatcgctgcgaccagcgcgtccatgtcagccacttcgcgcccgcgaaagccttgcaacaaggccgcgctgcgcaggctgagcaaggcgttgcgaatcgcatcgtcggtggtcggcagcagcaggctgcgactgtccttgagcaattccacgaggatgccgccggcgccgatcaccaaggccaggccaaagtcgttttcgcgcttgatgcccacgatcagctcggccaagggtggcgcagccatggtttccagcagtaattgatcgaagactacattcggcgcgtacaccgcgatttgctggcgcatatgctcaagcgcggcagtcagggcgaagccatcctgcaggttcaaggccacggcaccggcttcggttttatgcggcaaatcggcgctgacggccttgagcaccaacgggtaacccagcagctttgcgtcggctatcgcccgccccggcgtactcaacaccgcggctggcgtattcaggccataggcacgcaaggcttgtttggacgcccactcatccagggcctggccgcggccgtcgagggcttgcgggcacagcggttcgaggatcgattcaccgcgttcgagcaacacgcgacgctggtttgtgtagtcggcaatccgcccccacgccgcgagcgcatcttccacgccttgcaacgcggcgatgccatgcgcatgcagccgctcacgggcgtgcggcggtaacagctcagggaacgccgaggtgacgaaaccggtcttgccatggcggctgagcgccgcgcagaacagctccagcagtaagtcacattccttgcgttcgccggtaaattcagccgggtaatccagcaccagcatggctgcatcggcctgggtgcgcagggccgtgtcgagcatgcggttgagcgcttcgcggttgccccagatggccgtggtgaaatccagcgggttgaccaggttggcgtagccgggcagcacctgcgccagctcagcgcgctggtcttcatccagtttcggcagggccagttggttacgctcggcgtagtcggcaatcagccctgcatcaccgcccgagcaggccagggcgatcaggcttttacccgcaggcagattgccgcaggccgcggctttcaaggtttcgacgaaactcaccgggccgctgacacggatcacccccaagcgtgcaaacaagctgtcgtagagcgcatccgagcccgagagcgaactggtgtgactcagcgccagctcggcaccgagctgcgacacgccggttttcagcgcgatgatcgggatgcctttttccagggctttgtgcgccgcgcgggcaaagcccggcacattcttcaggccctccaagtgcaggccgatggcggtaacgcgtggttcatcgagcaacacgtccatcaattcggcaacgcccagttgcgcctggttgcccaccgaagccatgtaggcaaccggcaacgagcggtcgctcatcgacaggttataggcgaagttgccgctctgggtcagcaccgccacgcccttctccaccgccttgccgccatgggccaccggccatagcgccgcgctgtgcaggtagtccagcaggccataacaattggggccgagtaacgccatgtcgccggccgccgtcagcaattgctgttgcaacgccacaccggccgcaccggtttcggcaaaccccgaggcgtagcaaatcgcgccgccggtgccgatggcggccagttcggccacgcaggtgagtgtcaattcacggttggtggcaataaataccgcatccgggccacacggcagatcggcgacgcggcgcacacacgggatgccgtcgaggctgtcatgttgcgggttgaccagccacatctgcccggcaaagccgccgtcggcgcagcgcttgagcgcgcgggccatgctgcgcccacccacgaatgccaggtgccggggcgccagcaggcgcttgaggttctcgcgaatagcctgggacataagcgttctccgcgccgatcagcgcaacagcggccgcaacagttcacgggcgatgatatggcgctggatttccgaggtgccttcccagatccgctcgatccgtgcgttgcgccagatgcgctccaccgggccttcgtccatcaagcccatgccgccgaaaatctgcacggcttcatcggcaactttgcccagggtttcgctggcaaacagtttggccatgccggcctcgccgtcggtcatgctgccctggtccatcttccaggcagtgtgcagggtcagcagctcggccgcgcgaatttgcgtggccatgtcggccagcttgaaactcacgccttggtagctgccgataggctggccgaactgcttgcggtcggccgcccattgcagcgacacatccagcgcgcgctgggcctggccgacgcagttggcggcgaccatcacgcgcccggcagtgagccaggcattggcgacgtcccaacctttacccacttcgccgagcaccttggacgcgggcacgcggcagtcgtcgaagaacatttcataggtgtgatagccgcggttgctcacgcatttggggccacggcggatggtcatgccaggcgtgccgcgatcgaccaggaatgaggtcaccgcgttgcgctggcgaccgttgtgttcgtaagtgtcggtgacggcaaacacgatggcgaaatcggcgtgccccgcatggctgataaagtgcttgctgccgttgattacaaagtcgtcgccgtcgcgcacggcgcgggtcttgatcgcattggcgtcggagccggcgccgggttcggtcagggcgaagcagtcgattttctggccctgcacgcacggcaacaaatagtcctcgatttgcgcgccggtgcaggccatgaggattttcgacggccgcgcaacgaacacatgcagcgcccacgagaccttcgacagctcccgctcgatcagcgcttgggacaggtaatccaggccgccaccgcccacctcttccggcatattgaaggcatagaaaccggcagtgatcgccttgtcacggatctgcgcggcaagctcgggcgagacctcgtcggcacggtctaccgcctcctcgtggggcagcaattccttggcgacaaaactgcgtaccgcgtccaccaacatttcttgttcttggctgagttggaaattcatggcgctacctgctcgggggtgttgttgttattggccgcagaaattcggtgagcgcttttgcatggacgcacgcaaggcttcggcgccgtcgacactgcgcccacacagcaggccagccgccagttcggcctgcagttgctcgggcaggctgcgggcggcgccttcgcggatcagggttttggtctgggcaaaggcgaaggtcggcccgttggccaggcgcgtggccagtgccgtggtgtgggcgtgcagttgctcatcggcgactacttcgcccaccaggccggcggccagtgcgcggtcggcactccacagctcatcaagaaacaacaggcgcttggcctgttcgctgccgatcaggcgcggcaagtgccagctggcgccagcgtccggcgagtaggccatgctggtgtagccagccttgaagcgtgccgactgggcggcaatgcgcaggtcgcagcacagcgtcaggtccatgccggcgccgacggcagtgccgttgatggcggcaaccgtgggtttgtcgagggtgtgcaggcgggtcatcagggcgtgggcggtttcggtccagccataggtttcgagggcgccacgcgattcggcttcagcccactcggccaggtcggcgccggcgcagaagctgcggccgctgccggtcaacaccacggcgcgcacggcggggtcgcggttgaaagcgtcgagcaaggcatgcaggtacttgagggttggaatgtccagtgcattgcgctgcggaccacggttgagggtgatccaggcaacgtctgcttgcacatcggtgagcacgggcgaatcggtagtcatggcttcctcgaattattttaattggcttgaggggtgcgacatggcgagatactaaacgagtgttcagcaaggaggcaatcggcaaactgcaaatattttcagaagggaaataccggcctgaaccttgcgttcaggcggcaagaagggctcagggtttgagcagataacgctggcgaccgccgctctgcaagccgtcgacccaggcttcgcagatctgaatgccctgctccggcgtgaaggtgccagggttaagccccgactccagccacagcccgtcaagcaaggcgctcaagccgatggcggcgaggtcggcgtcgaaccgctcccagccctcttccctggccatatcgctcagggcggaacgcatgatggtgcggtactcaccgtaggaatgttcgtgggcctggttgatcgcaggcgcggttttcaccgcgccccagaacaccagccacgcatcgagcagttgcgggtcgagcaactcagcggaaaacgaaccccggaacaacgccgacagccgctcccgaggctctggcggcgcctcggccatggtctcgcgcagcaggctcatgacttgggcggtgatcgtgcgataagcctcggccaccagctcatccttgcccgaatagtggtggctgatcagcccgaccgacaccccggcctcggcgctgatcttgcgaatcgaagcgccctggaaaccatcgcgcttgaggcacgtgagcgtggcctgcaccaggttggccttgcgcaattgcggctccatgcgggagaagcgggattcctgtgtcatggggcggtgtcctcgttgagtcggccgcacgactctacatcagtcgcggtaaccgggcgacacccgatccagcatccgcagcaacgccgcccacgccaactgcatggcgtccgggtcggccagctcgccctgctccagcgttcggcctgggttattgaattgctgttcggtgtaggcgcagacctcggccggcggcaagatcaatgggccgcaggcttgggccgcgatctggatatcgcaggctttctccaggtagtacatgcgcaggaacgcctggctgaccgtctcgcccagcgtcagcagaccgtggttgcgcagcatcagcaccggcttgtcgcccaggtcatgcaccaggcggcgctgctcagccatattcagggcgacgccttcgtaatcgtggtacgcgaccttgccgtagaactccatcgagatctggttgaccggcaacaacccgcactccagcgccgccaccgcgcagcccgcacgggtgtgggtatgaagcacgcactgggcatcttcgcgcgcagcatggatcgcgctgtggatgacaaacccggccgggttgacggcgtaaggcgaaggctccaccgcgcggccatccaagccgatcttgaccaggctggaggcggtgatttcatcgaacatcaacccgtaggggttgatcaggaagtggtgctctggcccgggaatacgcaccgaaatatgcgtgaagatcaggtcgctcatgcggtagtgcgcgatcaggcggtagcacgcggcaagctcttcgcgcaggtgtttttcttgggagggttcggcggagtaagtcatttttattctccaggcacggggtggttgagggcgacgctaatccagtcgccagtaaaaaaacaagttgattttttactggcgctcacctcctatagaaaaataacaataacagcgcctggagtatccgcaccatgtcgcacgcagcctttccccacttgttcgagccgttgcaactgcgcggcaaacgcctgaaaaaccgcatcatgtccagtgggcatgacacctcgatgcccaccgacaatcacgttaacgcacagttgatcgcctaccaccgtgcgcgggccgaaggcggtgtggggctgattgtgttgcaggtggccggggtgcatgacagtgcgcgctacacctcgcatgtgctgatggccaccgacgatacctgcatcgatggctaccgcgaattggccgaggtctgccatgcgcacggcaccgtggtgctgtcgcagatctttcatccggggcgggaaatcatggagtcggcagacggcttgctggcggtcgcgtactcggcgtcgggggtacccaacgagcgctttcgggtgatgccgcgggcgctggaacaggcgatgatcgatgagatcgtcgccggttatgcggcggcggccaagcgcttgtatcaagcgggaattgacggggtggaagtggtcgccagccatgggtatttgccggcgcagtttctcaacccacgggttaatcggcgcaccgatgggtacaacggttcgcttgagcaacggctgaggtttttgcgcgaaattatggctgcggtgcgggcggcgaccgacgagtatttcatcatcggcctgcgcatttctgccgatgagcgtgacagtgaaggcctgaccgagtccgaatccctggaggcggtgcaaagcctgcaaacgcagttggactttgtacacatcgtcgccggcacctcggcctctctgggcggcgcgatccatatcgtgccgcccatggccatcgcggcggcgtaccttgcggatgaggcggcgacgttcaaggccagcctggcggttccgctatttgtcaccgggcgaataaaccagccgcaggaggccgagctgatcctggcccgaggccaggccgacgtgtgcggcatgacccgcgcactgatttgcgacccgttgatgccggccaaaaccctggctggccgcgccgacgacgtgcgcgcgtgcatcgcctgcaatcaggcgtgtatcggccactttcacaagggcttgccgatttcctgtatccagcatcccgagaccgggcgcgagttggtattcggcaatctgcaacctgcgttaacgcgccggcgcatcatggtggtgggcggcgggcctgccggcatgaaggcggcggccgtggccgcgcaacgtgggtacgacgtaacgctgtacgaggccagcgcgcaattgggtgggcaggtgctgttggcgcaattgctgccacggcgcagcgagttcggcggcgccagcaccaacctgcaacgggagatggcgctggcgggggtgcgtgtggtgcgcaacacccgcgtcgaccgggcgctggtggagcaggagcaacccgatcacgtgatcatcgccaccggcgccgaaccctattggccagccttcgagcaaggcggtgagttgcaagtggtggacgcctggcaagtgttgcgcggtgaggtcacgctgggtcgctcggtggtggtagccgactggcgttgcgactggatcggcccgggcattgccgagcgcctgatgcgcgccggccatcaggtgcaactggcggtgaatggcacccattgcggggagaacctgccgttgtacgtacgcgaccaactggctggagagctgcaccgcctggcgattgcgatcatcccgtacgcccgcctttacggctgcgacgacagcaccgtctacctgcaacataccgccagcggcgagccgatgctgctggagaatatcgacagcctggtgttgtgccagggccaccagccggtggacactctgggcgcggagctggcggggttggtgccgtttgatcgcatcggcgactgcctggcaccgcgcaccgccgaagaggcgatttacgaaggactcaaagtggcatggaacctgtgaccgacgcaccgcagcaactgtttctcggcacgcgcattcgcggcctgcgcaaggcgctcgggctgacactgaccgagctggcgcaggcaagtgagttgaccgccggctacctcagccagttggagcgcaacctggcgtatccgtcgattccggcgctgttcaatattgcccgcagcctgggagtgaccatccagtggtttttcgccagtgaaaccattcccgccgaagcggatgaaggttatgtggtgcgccagggcaaccggcaaagcatccgctatgaagatggcatcgtcgaccaattgctcacgccgttgcccaaccatcaactggaaatgctgcagtcgagctttccgcccggcacctacagccagcagagctacagccatgaaggcgaggaagcgggctacgtgttgagtgggcagtttgagttgtgggtgggcgatcggcattttctgctggatgcgggcgacagcttcagcttcgccagcagcgagccgcatcggtatggcaacccaggcaaggtgcagacggtggtgatctgggtgattacgccgccgacgttttaggccgcctgagcaaatggagacgtttcctacaggaaccgacgacggtggcacggtatgccatcaatggtcgtgaggcaaggtcgcttgctataaaactggctacttctttgcgaggttgtcgccatgaacttattgcatttgctgtttggaaaaccgactccggatgattgggatcgagtcaacgccgtcaaatcctataaaagctggaagatccatgattgtggcattggcgtcgacgctgccgaggttgcgcaatcgcagaattacaaggacgcgatacgtcaggtccggcaaatggaggtcgacgacatatgggcctgctgataattgtaccgttgcttgtcagtggctacatggtctgcatcagacacccttttttctaccatcgtctgcaccgttttcaagggcaactgctctacctgcaagttgcaaggctgggcttggtttgcctgatcatcgctacgatcctgagtgccattattcttgcgttgtcgaagcagaaggtcgaagtcgcggggtatgcgattgcaacagactacagcagctatctaggtgccttgttggtacagctcgacattgccaatgagaaaaacggcgcactgtgggtatttctactccagatagggcttaccgccatggcaattcccttgggctgggcaaaactctatgtgcgcctgcgaaagaaagtgctgaaactggaaacggacgaacaactccattacttgctgtcgctgggtgttctggatggcaacgctttcaggcgcttattgagagagtccattgagcagcgggcaccttgcatgttcagcttgagcgatcgcaaagtgtacgtcggcattgtggtgttcgtcggcgaacccactgagtccgagggcatggatcacgccttcaccctgcttcctattctcagcggctatcgggacaaggacacactggaggtcacgttcaatacccactacacaaacacgaaccagcccctgcccatcatgctggtccaggaaaacgtcgtctctgccactcgcttcgacttcacgacctggaacactttccaatcgcgcaaaaaccgcaagacgcgacagggccagttttaccaccaccgccctgcgcgccccgtaacagcctcacgcgcctgcgcatgagatggcgtaacaccgtcagtcaaacttccagttcaacccaacacgcaacatctgcccatcgtttttgaacttggagtcataaccagtacccgccccgccgctgcccggaatcaccgccacgttcagcttgtcctggcccaggtcgtagtacaggtattcggtcttgaacgacaggtttttggtgattgactgctcgatacccgcacccacggtgtaacccattttgaagtggctttgatcgccgctgaactgggtgttgccggtagggccgaacatgtcgacgctctggctggtttcaccgtaggccaaaccggccgtgccgtagatcagggtatggtcgaaggcgtaaccgaagcgtgcgcgcagagtgcccaggtacttgatcttcgattcgaatttgttgttcagcgccaggtgcgtattgagttgcgaggtgccgatattgcggctgtcttgcaggtcggtgtgggagatatcagcctcgacgccggcgacccactgaccaaactggtagttgtagccgatctgcgcaccgccgagcaggccgttacgatccaggtctacccgccccggacgtgcaccgccgttgatattggcaatgttcggtgcggcctggcctttggtgttgacgtcaccatcgccgccaaaaccatagccggcactcaagccaccataaaaaccggtccaatcagtcgggccttcggacgaatagctatcagccgcctgaacgacagacgacgctgcaacagtgagcgcagtaacggcaagtaaacgagtgatcatgtaaagctcctatggtttttggtggtgttacaggcacagcgttgccgcacgccgatagctatcggcgcgaggcatacattcaaatcagggggtattacgaccgagccgaacggctcggcttgctgctattgagcgagaaagcggtaatcggcgctgtagggctcaaggtgcaaatcaccggcctgcgcgcagctgccgctgaacacaccacccagggtgtgcaggcgttccaccgcgaccacctgcgccaactcgcccgtgccctgatgggcgaccacatccaggcgcagtaacgctatatcttttgcactggcgcccggggcctgggcgatgaccttgcccatgaccgcactgcggtcatccaactgccacgtcggcccggcaaagtgccggcccacggtcttgccattgatcatcaaggtcgccaacggctcacggaattgccaggccaactggccactgctgtcctgggtgcaggtgtagatctgcacgccactggcctgcaccgtcatcagcaggtttttcgccgcgccagcggctggctccggcaaatcctgggcctgagcccgttgcgcatcgatcgcacacatcaccagcacaatcaggccgatgacctgcagcaccatcagtgccaggcgattgcggcgcgtcacaccatcagggtcggtgttgctcatttttcgcctgccgagaaaggggtcgagaagggtctggttaatcatcaaagcgtccgtcagtggtcgaacacggctggttatcagcgtctgcaggatgaacaaccgacccgaagtttttattcccgactattttccaggccgggtaaaaacgcctcgcctaccacacctcgactttcaactcagggcgttggctggcaggcatcgccagggccttgccgctgtgcaccacaccatggcgcggtgattcgcgtttgaggttgggcaccgggattcgcccgccgccacgcacggtttgcgcaccgttcatttggaacttgccataggcaaaattcagccccacgccgttctggcgctggaagtagatccaccaacgcccctcttcgaacttcatgaaggcaaagccacgtgggtaggcatcctcgccgtaatcgtcaaacgtcattgccgtggcgaagcccagcccgtgcccgtcaaagcggctcaggtattccttgttcaggtaatcactgccgccctgcacgtggaatacgcggtaggtggtgtcgtcgatatggtcaatcaggatcgagcaaccgctgaagtccggcgtaaacacgtagccggttgcacctgggttggcaggaatgtcacagaagccgccctggggcacccaatgccccatcaacggacgctcgaccttgccgtgctcacccggcttatccagggttgccagccgatagccgccagccttgtgatcgttgacgtcaaacacgttgaggccggccacgatccccgacggaatacgcttggcggtcatgaagttctgttgcaggaacgtcttggtggatgaaaacgcgttgatgcattttgtgctcataagggctccgggcagagggaaggtcatgcgtcttgccgatcctgcgcaaacgccgttcgaatcacgggaaaccatgagaagaacaccctcctgcgaggctttattccatgatttcgcttaatcgcattcggcgttttccatgcagataattgtcttctttccagccccgttcagccggtagccttcggccctgcgatgccttgcgcacgcacgaacaccggctgtacacacagcaccggtgcctgaccccaagtttgatagatggcgcccccgtgaagaaacgttcgatagccctattgctcgccagcctgctccagctgccgctggttcacgcagcgccggccaacaacattgccgtgatcgcctacgcggaaaaaccgctgaagctgattcgtgccaccaccctctacaccgtcggccccggcacgcgcctgcaaggtggcgatattctgcaaaccggcgccgccggcatccagatcgaaggtctcgcggcggcaaccctggcattggggccagacacgcgcatccttatcgcgaccaacagcaaagccgcgcagatcaacttgctcaatggctggctgaaactgcaaccggtcgtcggcaacagccatgcgaacctggcggtaaccaccggcggcctggcattcacccagaccaacagcgccagcgtggtgcatgtcggtaagcgccagaccgaaatatttgtcgaagacggcagccaagtggtcagcgaactcgacagccacagcaaagccgctcgcaacgtcaccctcggccacgaagacttcgcacagcgcgtcgacgacgcaccgctgaagatcgtcgcgcgccctgaacaagccttcattgacgccctgcccgcgcagtttctcgacccgctggtgcccctgggcaagaaagtacccaaggcgcccgagctgaaaaaagaacgtgaagtgacctacgaagatatcgcgccgtgggtggtcagcccgttgaacctcagccagcagatgctcgccagccgcttcgccccgcgccttaacgacccggtgtttctgcaggcggtgaaaaccaatcgcggtggggtactggcgtgggaactggaactgctgcacctggaacggcgtaaaaatgcgcgctgaccctcacctcgctgttacccgaaggtccttatgaaattgtcgctcgcggttaaattcaacgtggtgttcctggcggtgtttatcgtcggctttatcgccaccagcctgtctaccaactacatgctgcaacagagtgcacgccgcgaaaccctggaaactgcgcgcatgctgatgcgttcggcgtctgcagccagcacctacaccgccgagcagatcgtgccgctgttggagaaccgcctgaaattccagttcctggcgcaatcagtgccggacttcgcagcgatttcgcacctgcaggaactgctcaagtcctacccggactacgcctacaaggaagccacccttaacccgaccaacccacgcgacctggccaatgactgggaaaaaaacctgatcaactccctgcgcagccagccgcaaaccgccgaaatggttggcgagcgcaccgacgataagggcgcggcgctgtacatcgcccgcccgatccagatcaaggacggtgcctgcctggcttgccacagcacgccggatgcggcgccgaaaaccatggtcgacatctacggcgcggtgaacggcttcggctggaagctcaacgacaccatcggcgcgcaactggtcacggtgccgctcgacctgccactgcaacgggccaggagcctgctgcacagctacatgctgtcgatgctggggatcttcgcggtgttgttcgtggcgttgaacgtggcggtgcatctgtttgtcacccggcgcctgcggcagatgtcggcgttggccgaccgggtcagcctgggcgaaaccgacgtgccgcagatggacgtcagcggcaatgacgaactggcgcgcctgggccagtccttcggccgcatgcgcaccagtttggtcagcgccatgaaaatgcttgaggaataggtccgcaatcatgcttgaacaactgggcaaataccgcatcgacagcgtgctcggcaaaggcgccatgggcacggtatacaaggcgttcgacccgaatatcgcgcgtaccgtggccctcaagaccatccgcaaggagttgttcggcgacagccagcacgccgagttggtcagccgtttcaagaacgaagcccaggctgccggccggttgatgcaccccaacatcgtcggcgtgtacgactacggcgaagacgacggctcggcgtacatcgccatggagttcgtcgagggcacgccgctcaacactttgctggcagcgcaaacacctcgcgacctgagccacagcctcggctggatgcgtcaattgctgtcggcgctggaatacgcccactccaaaggcgtggtgcaccgcgacatcaagccggccaacctgctgatcaccgccgacgacaaggtcaaggtcactgacttcggcgtcgcgcgcctggattcctcgaccctcacccagaccggctcgatgatcggcacgcccagctacatgtcgccggaacaattctgcggcgagttgatcgacgggcgttccgacgtgttttccgccggtatcgtgctttaccaattgctcaccggcgaacgaccgttttccggctcggcaaccatggtcatgcagcagatcctcaaccagaccccggtggcgccgtcgagcctgaacctggccctcgacccggcgctggacagcgtgatcgcccgcgccctggccaagcgccccggcgaacgctacccctcggcgcaggcgtttctcgatgacctcgaagccctgctcggcagcgccaccggcacctggatcaatgccgaaatcgacgacgaccgcaccgtgctgatccgccccaatcaaccgttgagcagtggcgtcaacccactgccgacggccaccgcggccatgactgaggcggtcgagacgctgacaccgtggaagctcgcggtaatgcccgagctggaatcgctgctgtcccatcagatcgggccgctggcgcgcttcctggtgcgcaaaagcctcaatggcgcggatgatttcgatgccatctgcgcctcgctgctgccgcacattccgtctgaacgcgggcgtgaacagttcgccaatgccagccagtcactgttcctgcgccttaacccgccgacggcagcgcccgagcccatcagcgagcccgccatcgaagcaacgcccgcgcaggttgacccggacttcgcgcagatggccgaaaaacgcctggccgtgctgattggtcccatcgcccgcatcgtggtcagccgcgccttgcgcgccaccgcccagcgccaaccgttcctgcaacgtttggccgagcacatcgagagcgaggcccagcgcctggcgttcctcaacagcttcgagccccttccatgaccgactccccactcagcgcctgcgggcctcattgcctggccaacgcggtcgcttatggggtcagtgatgtgggttcagtgcgccagagtaacgaagacaactttctggtagagccagccctgggcttgctggccgtggccgacggcatgggtgggcatgaggccggtgccctggccagcgccgaggcactgggcagtttgcgccaggcgctcaaggcccacagtgtcgacgtgatcaacgacggcgccgacccggatgccacgtggtcggacccggacatgcaagccgccagcaggctgcacaacgccatcgatcaagtgaaccagtgcgtctatcagcagaatgtggcccgccatatgagcgaaggcagcggcatgggcacgacgctcaccggcctgtggcgcccgcagcccgacgggccgctgctggtgtttcacgtcggcgacagccgcctgtatcgctaccgcgacggcgaattgagcctgctgacccgcgaccagacctggtatcagcaagccctcgaagccggcaaggtcgaccgcctgccggcgcgcaacctgctgctgcaagccatcggccccgggccgaaagtggaaccccaggtgcgcgtgcaaccggtgcagccaggcgacctgctgatgctttgcagtgacggcctgcatggctgcgtgccgcaccaggagatgcaccaggtgctgagcgtggcgcgccgcgacacactggacacggcgtgccaacggctggtggaccttacccgcgaatacgccgggcgcgacaacgtgacggtgctgctggcctggttcgaccgctgaacaccttcacggccacttgaagacctcgtccaccggcacgcgtttttttgcagcgggcgacactcgtgacttctggtaaagagtccttttcggaatcgacggtttttccgaaggaacgacgggcagatactcgactccactgtttatcccctctcaggagttactgatgtctatccctaccccaaacgtccccgccttcggcctcggcactttccgcctgcaaggccaggtggtgatcgactccgtgagcaccggcctggagctgggctaccgcgtgatcgacaccgcgcagatctatgagaacgaagccgatgtcggccaagccattgccaacagcggtgtgccgcgtgacgaactgtttattaccagcaagatctggatcgccaacttcgccgaaggccagttgatccccagccttaaagagagcctgcgcaagctcaagaccgactacttggacctgaccctgatccactggccatcgccggacgaccaggtgcccgtggccgaattcatgggccaattgctggaagccaaacgcctgggcctgacccgccagatcggtatttccaacttcaccgttgagctgatcaagcaggcgattgcggcggttggcgccgagaacatcgccaccaaccaggtcgaactgcacccctacctgcaaaaccagaaagtggtggatttcgctaccgcccatggtatccagatcacctcctacatgaccctggcgtatggcgaagtgctcaaagacccggtgattcagcaaatcgccgaacgccaccaggccaccccggcacaggtgactctggcgtgggcgatgcagctgggctacgcggtgatcccatcgtcgaccaaacgcgccaacctggagagcaacctgaaggccctgcaactgagtttgagccctgccgacatggcgcagattgccggcctggaacgtggccatcgcctgaccagccccaagggcatcgcaccgaagtgggactaaaccccgctggcaggctggccggataattcccgcagccacggcaacacccgcaggcctcgcgaggcttgcggtgggtcgatgatgtccatgaagtgttcgagattgacggtgtccggcgcgccaggcaaccgtacccgcaccgtcggcgtcgcgccggcgggggcactcaggtcctgatggtcgtagaccagcacatgccgcacctgaggctgtggcccacttgcatgggccgccagcccgccattgatgatcaacacatcgaagggctcagccgggatggcggtgagaatctggacttcgtcgaaggtttgcaccggaacaatccggtagtaccccaactggttaagcattttttcgatgtacagacgttgcaggtgctgttcatcggcaatcaggatggtcagtgctttgttcggcatggcaaaccccgggcaggctgtgctcgtcagtgagcagcgcccattgtccagacatatcccgaagacaaaatcaggcttgttcccccttcacgtaggagttctcccaaaaccgcccaatggcgatcgaccgcggtcacggccgattgcaataagcattcaggccgtcacgcagattgccaatcgcctcgcccaccgcttccgccgccccacccagtgcggcgcgatcttgccgctggcaaaccccctccagcgtttcacaacaagcgatcagcacctgcgccttcaccatccgcgccccgcccttggcacggtgggcgagatcatgcagcgcgtgaaaattgaactggcgttgcagtgtcggtaaaagcgcacggtcatcttccaggctgtcgaccagcggcaccaagagttccctcagcgctgcatgatcatcacccgtcagcgaaatcaacgtgctcaaatcaaaggccatttcagcttcaactgcacccgggctggccgtgagcgaagccagggccgagcgcaagtcatcaagcccggcaggtttgaacaggcagtcgtccatgcccgcttgacgacaacgctcggtctcttccggttgcgcattggcggtgaaccccagcaacaggcacggtgccagaccttgctcacgttcttgcgcgcggatatcacgcgccagggtgtagccgtccttgaggggcatgttgcaatcggtgatcacggcgtcaggctgcctggtcttccacagctccaggccctcgatgccgtcttcggccgtaatgatgcgatgccccaggtggctcaattgccgcgccagcagcaagcggttggccgggtagtcatccaccaccagaatgtccaatgcgcgcgccggctgcacggcagggccaggtgttgcaaccgcgaccggcaacgcagccgtgcgggtcaatatcaacatcacgtctacccgtgaaccctggccgagcacgctgctcaactgcagattaccgcccatcatttcacacaggtttcggctgatcaccagccccagccccgacccgctgcgcgccgactgctcagtgttgctcccctggataaacgggttgaacaggcgttgctggtcttcagcgctgatgcctataccggtgtcttccacccataacctgaggctcagctggccggtgtcgggggccggcaaactgcgcgcgcccaggcgcacctggccctgggaggtaaacttgatggcattgctcagcaggttggacaccacctgtttgaagcgcaacgggtcggccagaacctggcaatcaatcagcggatcaagttctacttgaaacaccaggcctttggcacgcgccagcccctcgaacacacgcgccaccgacatcagcagttcatgcaggttggccgattccagcgccagggacaaatggccggattcgatccgggcgatatcaagaatatcgccaatcaactccagcatcccgtgtgacgcaactgaagccacctccagagcatcgcggtcggcgcggccctgctcggcgttggcaagggccagctcgatcatgccgatcacggcattcatgggcgtgcggatttcatgactcatggtcgccaggaaggtggtcttggcgcggttggcggcgtcggcatcttccttggcttcctgcagttggcccaacaggcgctggcgctcactcacgtccacccaaccggcaatcatgcccaccacgttctcgtcgccgtcacggtagggcaacatccaatggtagatggtcagtaccttgccattgggcaacttgagcacccggtcatgaatctgcggctcgccacgcgccatcagctgcaggtagtcctcatggaaagaccgggcctgcggagggttgccggaatcggtttgtatgaccgtcttgccgatcactgcttcgagagtaaaaccaaacacttccaggtaagcactgttgcaggccatcaacctgccttggcgatcacgcacgtaaatcgggtgcggcgtaccgtcgatcagtacgcccatgaaacgcatctggtcgctcaaggcacgttcggcctgggcacgtttgcgtatcaggctgcgcaggtaaaaagcccagcccagagtgatcaccagcaacagcgccgccaggccgaacccttggatgatcgcactgcgatggcgcaaccaatggtcttcgacgatcacgtccgtgcgccactggttgaccaactcgtccatttcctggggtgggatgctcagcaacgccttgtccagtatcgagtacaactccagctggccacggttgaccccaaatgtcatgcgagctggttcagaaccgacggtgctggtcacgcgcaaggtgtcacggtattgcaaggcgatgaggtagcgcgcattgatcaatgaattgacggccgcctcggcggcgccggaggccaccatcgccacggcttgtgtagggtttttggccgtcacgaagttgataccgggatagtcgcgattgatcaactcacgcagcgcactgccggcggttatcgcaagacgcttgcctggcatgtcgtccagggtcatcgtcgcggggtcgtcattgcgcgtgaccagcaccagcgggttggtcaggtagggccgggtaaaacgcacctggtcagagccttcgacgctcggcgtgatcaccgccatcatgtccgccctgccggtgctgaccgcgtcaatctgctggggcattgaaccacccgggacaacatcgaacttcaacccggtgcgcaggctgatccgcgataaaacgtcagcactcaagccgtctaattgcccttgtgcgctaaaggatgccaaaggcagcatctggtcggacgccaccaccctgacgcgcggatgcttgtccagccaacgctgctcgttggtgctcaagtgcagccgttcagcaccgagcaggcctagattgccgccgctccaacgacgcaatatttccatctgctcgttagccggcaccgccctcagcgctgtattgatgatgcgcagtaaccgggtgttgtcgcgcggaacagcgaaggcgaaagagttggattccagcgtggaaaaatccgccatttgcacattgttcaggtggttgcggctgatctggtagttggtgctgatggcgtcgcccaggtagacatcggcgcgaccgaacgccacggcaccgatggcctcgaaaatagacgggaataattccaaccgcgcctggggatagaaggcctgtacgacatcgggcggcatgtagtgatagagcatggccacgcgcttaccggccagatcgaccgtcaaggcctgggtgtctgcggtaggggttaccagcacgggctgatcattggcgtaggaccgagacagcaccaactgcgggtcgcccgcctcaaagccgttggcggtcccgaggaagtcaatggtgccctgcttgagcgcctcgatcacttcgtcacgggtgtcgtagcgccgaacttccacgctgacgttcagcgcctgggagagcaaccgcgcgtaatcggcggtgatcccctcaagttcgtcgttattatttgtcagttcgaaaggcgcatagtctggcgccgaaacccccatgaacaaggtacgacgctcgcgcaaccagtgccagtccgcctcgctcagcaccacggacaaaccattgccatccagcgtggcgtgccccaacaagcgcagcgggtgaggctcatccagggccggcgccgccatcggcagcaggcccatcaatagggcaatcatcaactgtcgaatgcgggttgggatcatttcaaatcagatcagatggttacgctgggcgaacttggccatgtggaccaccgacgacatgcacaatttgtctttgagccgcgtcttataagtactgatggtcttgtggctcagcagcatttgttgggcaatctggttattgcccaggcccagcgccaacatacgtaacacctccacctcgcggtccgacaggcattccaccaactgcaactccgaagcctgcaaatcatcacggcgcaccgaactggtcggtaagctggggaagcagctgtagttggacatcacggccttgatcgccttttgcagctcgtccaactccccggtcttggcgacaaaccccatggccccggcgcgcatgcagcgagcagagaaaaactccggcagggacgatgtcagcaccagcatcttgcatggcaggcccagcgccttgactcggctgatcacctccagcccgcccagcttcgggatggccaagtcaagaataatcaggtctgggcgcccttctctggccttctgcacagcatccgcgccgttacccgcctcatcaatatcggtaaacccttcttgcttgagcaggaaccgaacggtttggcgaataaacggatgatcgtcgactatcaatgctttgatcataaaaatcccatggcaggtaattagccttacacatcaagcgggacacaggtacctgtgagaaatgacagtgccgaccaacggtactgtctttactcaggacgatagccaggctgtgcctgggtcccttcgattgaaaaaagttgaacacctacagctaaaccaacaccgccggctagctgcaagtgcgcaaccttaacaacgaaatgacgcttcatccgaagggataatcccatcaaaatgtaggatttatccgagcaaagcgccccccatccagcatgtggggacgctttcgagcagccgactaatccgtggtgctcgggctccagaacgcctgcaccaccaaggtcgaggtggaaatacgcgcaaccagcgcgtccagctcgtcgccgtcaaccgaggtcgcgaccagggtggcctcgatctccacttcttcactgccaaatggccgaacatcgacgtcgctggccgggtagttgcagcgcgccaattcggcttccagcaagaccatcaccgcctgttgctggctgcgccgcgcgatgacatagaggatgttggtgacttctgccgacaccacgtccaacggctggcggttgatgttgttgacgatcgggcgcagcaaggtgttggccgccagcacaaacagtgtgcccagcagcgcttcgaggatcaggtcggcccccgcacacgcaccgactgccgccgatgcccacagcgtggcggcggtgttgagcccgcgcacgttgccttcttcgcgcatgatcacgccagcacccagaaaaccgatgcccgaaaccacatacgcgactacacgcacagcgccttcagcgccgccgaggcggttggccatgtcgacaaaaatcgccgcgcccactgccaccagcacattggtgcgcaagcccgccgtacgttggcggtactggcgctcgaaaccgatcaagccgccgaggataaacgccgcagtgaggctgacgacggtatcgaccagggaattgaggttgatgttgttgattgcttgcataggaaatctccccgtatgcgcacgaaccgtgtgggtgcgggcaagcccggcccccacatttaatcgtgatgtcgattaaagcggtgctggtcagcgtcgatgagagggattcaggcaggtgccaggacaggcgctgccgggatgccgctgctcgcttttttcaggcgagataacggcatcggaaaaatgcgcgttaccttgccaagtaggtgccgattactgaaaccggccgacaactgtcactcgaacaagtacccactgagggtctccgctattgattaaaacgcgcggagtttactccccgatgtctggggagtaaaccgtaggaaaatttaccgatggggaataaggcgatgcttcaggatgagttcaggaaccgagctccaggatttaccaacattcaaatgtgggagctggcttgcctgcgatagcggaatttcaggcgatgaatgtctggctgacagaccgccatcgcaggcaagccagctcccacacgaggattacgcaacaccgggccgatcccgctcaacagacgccaggtattcattcacccgcccacccgccaacgccttgacctgaatcgacaccctgttcagctgtcgccccatcgtaataccgtcccgtgtgcgcacctgcacatacccaagtttgggccagaagcgctcggccttggcattgccgacaaccaccgtcaatcgcaaccactgggcgcctttgctgacggcccacgtctcaagctccgcatgcagccgccgcgccagcccggtgccatgccagcgcgtatgcaccagtaacagcccgatgtgccacaccccggtggcgagcaaatctgcggcgatgttcaccacggcaaccagctgatcatccgcatcgcggtaacccagccaatacatgcggctgcagctccagcccgccggcagatcgccgcgcaactcgtcacgcgcttcggttggcgtggcgggttcgccgttgaccgcgatgaagtagtcaggcgcttgctcgaagaagtgctgcagttcggcttcatcactgtcatgcagttcaaccacccgaagagcctcggtggagcagccaggcaaccgctgtgactcaacctccatgttcaactcctttcaatcatcccgcgtcagcacttccagcaactcgatctcaaagcgcaagttgctgttgggcttgatatgcgcgcccatcgagcgctcgccgtaggccaggtgcgccggtacaaacagcctgcgtacaccaccgacctgcatgcccatcaacccctggtcccagcccttgatcacccgcccggtgccgatcacacactggaacggcttgccgcgctcccaggacgaatcgaacaccgtgccatcttccagggtgccggtgtattgggtggtgatcaacgcgcccttgaccacggctttgccggtgccggtgaggacgtcggtgatctgcagttcgtcgttgctcatgtgggtctcgttgaatgcgtaaaggctgtggttttcccagaattgggcaggtttggcaagtgtaggaacagtctgatcagcgacatttccctttaacttgcaggacgtttccgagagaatcccaaccgcctgcgccgctcaattcgcatggctagtcttcgccggtcactgccaattcagtgaccgggtttagtagcccaccgatgtgattaggcgcaaggcgcccccttctgcaaggcgctttttttcggcccggcgttatggtggccgtgcgtagggcaccttcgggtgcaccggtttcctaatcgccggtctactaacctgcgtacggtcgccaccccgtttagtagcgaaggtgttgactctctaacgcttgattaggagttgaaccatggacaaacttgtccccgcaccacccgcatcagaactgcccttcttcaccaccacccaagagctcagcttcgaagacgccctggcccacgccagcagcgtgctgcgttgtgccgccgttacggcgcagaaggcgattgatcaattggaaggtgactcacgcacattggtgatttcggtattgcaccttgtggacatggccagtgtgatggtcgatcgatcattggagtgcatgcagccgcactaggcaattgtggcgagggggggtggttcccccgggctgcggggcaggccccttttttggtgggcttctcggccccacgcgaggaaaccccctcgccccaccgacacggggggggccttactggggaggagaagggcgcgccgcacaagggaggggtggggccatatccgacgccaggacccgcccccggaaccaccccccccaccacccc

SEQ ID NO: 58 - DNA, 75654 bp, Pseudomonas poae FL10F
ttgtggagtttggggtggtgttgggggagttggctggggtgattcattggctcggcgcgccacgccaggttcaagaactggcgtaaatctcagatcaaatggagatcaacactgtgggagcgggcttgcccgcgatggcggtgtgtcaggtcatgcagacccagcaggtagaccgctatcgcaggcaagccagctcccacagtggattgcatttcaagttgagtaataaaaaaggcgaccttttggaggtcgccttttgtcattgcgcgtactgcttgctcaaccccggcggcacgccgtgcacgtcggtctcttcccatggcccgttcgggctgatggagcggctccagccgttgctccagcggtagtaagtgcgctggcggtagaaggtgtcgggctgctcttccagcacatacacctgcatcttgccgtcccagtggctggcggcgcccggtggtggggcgaacgtcggcgatgagcttggcagcggttttggcggcggggtgaccgggccggaaggcttggtgctcggctgggtcgacgggccggacggcgggatggtcgggccggtaggttgaggggggcggtggaccgcacaagcgctgagccccaataccaggctgagcaaggtgatacgtgcaaatgcggtcataggcgtttcctcgaaattacttgtccggactgtcgatggtcagctgctgcagcgcagtggtggagctggccagcggttggctgcggccgatccactcgccagtggtcggctgaccggcccgggatatgcgcgcaaccagttggacttcggggaagttggacagtttcaactgcggcatcatcgcgtccgcatcgcccagttccacggtgatcggcagttcggcgacggtcacgcgcttggccgccagcggcgcaggcgggccggagacggcgcgggcaaagatgaacacgctgtcggtgggcaggaccttggccttcacctcggcagacaagtccacacgcacgttcatcacggtcttttgcgccacggtgccgccgttttccttgagcttttcggccgcgcggtcaatcccgccttgcagcgcgacccgggaattgtcttgcgctggcagttgtgccaacaggcggttccagtagtcgatggcttcctgataacgctggccttcgaaggcggcgatacccagcaggccgaggctggtgacttccttcgggtccagcttcaaggcctcatcggtcagcgcctgcactttgggcgaccactgtttattgtcggcaaagtactgcgcctgcgcccattggccaagcagttccggctggcggccggcgagggccacggtgcgttcgaagactttcgcggcatcggccgaacggtcctgggccatgtaggcgcgccccaggaagtacaagccttccggcgaatccggctgggcggcggcggcacgctcaaggcgctgggtcatgtcttgcatggacactggcggctgggagaattcgcgggtcagttcgaccttgtcgctggcgccgtaatgcaggtacagcgcaacccccaaaaccggcaccagaaatgccgccagaaacggcagcggtttgccgaggcgcgattcgcggggtttttccacgccttcggtatcggccagcagttcgcgggcagcttcggcacggccggtgtcgagttgcgcggcgttgagcacgccttcgtcctgctgcacttgcagctcggccacgcgctcttggtaaagcgccacgttcagcgcggtgcgatcctcttcacgctgggcacggcggccgcgcaacacagggatcaacaggaaactcagggcaatcagaagcagcaaccctgctgcgagccaaaaatcaatcatcagtcttggtgtccagcaattggtcgaggcgtttgcgctcttcaggggataacgcgtcggagccatcagtaggcgcgacgcggcgacggcggacgatcacggccatcaccaccacgccggccagcaacagcccggcagggccgaaccagagcagcgcggttttgccggtgagggccggtttgtagcgcacgaaatcaccgtagcggtcgaccatgaagtcgatgatctgctggttgtccttgccctcccccagcatgcggaagatctctttgcgcaggtcggcggcgatcggcgcgttggagtcggcgatgtcctggttctggcacttggggcagcgcagttccttggtcagttcgcgaaaacgctcgcggtcaccgtcattggcgaactcgtaagtgtcgatggccgcatgcgcgacgccaaccagcccgagtgcgagaaccgcagcggctaacagacgcttcatggcttcgcctcatcgaccagcgcctggtacttggcggcgagttgctcgcgccacaccacttcgtcgatcacaccgacatatttgtcgcggatcacgcctttggcatcgatgaaaaaggtctccggggcgccgtacacgccaaggttcaaaccgaggttgccgtcttcgtcgcggatatccagctggtacgggttgtgaaactccgccagccacttcaaggccgctgcattgtcgtccttgtagttgatgccgtagatcaccacgcccttctcggccagtttgttcagcaccgggtgttcgacccggcacgagatgcaccaagtgccccacacgttgaccagcgccggtttgcccaccagatcagcctgggtcagggttttgtcgccctgcaccgtcggcaggctgaacgccgggaactgtttgccgatcatcgccgagggcagctcggccggatccaggtacaagccgcgatacagaaacaccgccaccaccagaaaggccgccagtggtaacaccatcaaccaacgcttcatgccgccgctccttgcaggccgagcgcttcacgcacgcggctttttactttgacccgataacgccggtccagcgcggccagcaaaccaccgaaaccggtgagcaaaccaccgaaccaaatccagcgcacgaacggtttcacgtgtacccgcaccgcccaggcgccatcgcccagcggttcacccagcgctacatagaggtcgcgggtgaaaccggcgtcgataccggcttcggtcatcatcgagctttgcacggtgtacaagcgtttttccgggtgcagcaccgccacttccttgccgttgcgcaccacacgcacggtgcctttgtctgaggtaaagttcgggccttcgaaatgcttggcgccctcgaagatgaagtggtaaccggccaggtccatggactcgcccggcgccaggcgcaggtcgcgctcggcgctgttctggctggacagcaccacgccgagggcgcacacggcgatgccgatatgcgcgacctgcatgccccagtaactgcgggtcagcgtcggcaaacctttgatcaggcctttgtggcgggttttgtcgaagatgtcgcggacgccggccagcaacacccaggcggcgagcaggaaggtcgcgagcacggcccagttgaagtcgccgtaggcaacgcctgcgatcactgccaaggccacgctgccgagcagcaccggcatcagcatgccggccagccatttcaccggggtgtctttccagcgcaccagcacgccgacggccatcaccaccatcaacaggcccatcagcgggataaacaacgcgttgaagtacggcgggccgaccgacagcttggcgccgctcagggcgtccagcaccagcgggtacaaggtgccgagcaggatcatcgacgcggccaccaccagcaccaggttattgcccagcaacagggtttcccgcgaccacaggttgaagccgacctggctcttgaccaccggcgcacgcagggcgaacagggtgagcgagccgccgaccacaaacagcaggaagatcaggatgaacacgccgcgcgcagggtccgaagcaaacgcgtgcaccgacgtcagcacacccgaacgcacgaggaaggtgccgagcaggctgagggaaaacgcggcgatcgccagcagcacggtccagcttttgaacacgccacgcttttcggtgacagccagcgagtgaatcagcgcggtgccgaccagccagggcatgaacgaggcgttttccaccgggtcccagaaccaccagccgccccagccgagttcgtaataggcccaccacgagcccaaggtgatgccgatcccgaggaaggcccaggccacgatggtccatggccgcgaccagcgcgcccaggccgcatcgaggcgcccgccgagcaaggcagcgatggcgaaggcgaaggccaccgagaaacccacgtaacccatgtagagcatcggcgggtgcacgatcaggccgatgtcttgcagcagcgggttgaggtcatggccgtccaccgggatctgcggcaggatgcggctgaacgggttggaggtcatgatcaggaacagcaggaaaccgatgctgatcatgcccatcaccgccagcacccgcgccagcatgacttgcggcagttggcgcgagaacaccgacacggcgaaggtccagccgccgaggatcaaggcccacagcagcaacgaaccttcgtgggcgccccacacggcgctgaatttgtaataccagggcaacgcgctgttggagttgttggcgacataggcgacggaaaagtcgtcggtcataaaggcgtaggtcaggcagccaaacgcgaacagcagaaaggcaaactggccccaggcggccggctgggccaggctcatccacaggcggtcaccgcgccaggcgccgagcaacggcaccacggcctggacgacggcaaagcacagggcgaggatcatcgccaactggcccagctccggaataaacagtgcggacgtcatggcttagccctccttggcaggctgtgcatttgagccaggggcggattggccgctgtctttgagggccttggtgacctcgggcggcatgtatttctcatcgtgcttggccagcacttcgtcggcgaccactacgccgtccgcattcagcttgcccaaggcgacgatgccctggccttcgcgaaacaggtccgggaggatgccgcgataagtgatggtcacggccttgttgaagtcggtgaccacaaaggtgacgtcgagggaatcaccggaacgtttcagcgagcccttctcgaccatgccgccggcgcggatgcgcgtgtccaccggcgcttcgccattggcgatctgggtcggggtgtagaacaggttgatgttctgctgcagggcgctcagggccagggtcaccgcgatgccgacgccagccagaatggccaggatgattaacagacgctttctacgcagcggattcacttgtcggtctcccggcgcaaacgacgcgcctcttgttgcaggtaacgcttgcgggccaggatcggcgcggcgacgttgagggccagcaccgccaggcagatgccataggcggtccagacatacaggccgtgatggcccatggcgagaaattcgctgaaagagttaaagctcatccacgcgctcccaggctgttttgcacttcggtcttgacccaactggtgcgggcttcgcgcttgagcacttccagacgcatgcgcatcagcagcacggcaccgaagaagcagtagaaccccagcaccatcagcagcagcggcgcccacatttccacgggcatggccggtttttcggtgagggtgaaggtggcgccctggtgcagggtgttccaccactgcaccgagtatttgatgatcggaatgttgatcacgccgacgatggccagcactgcgcaggccttggcggcgctgtcgcggttgctgatggcgttgcccaatgcgatcaggccgaagtacaggaacagcaggatcagcatggaggtgaggcgcgcgtcccacacccaccacgaaccccaggtcggcttgccccagatcgccccggtgaccagcgccacggcggtcatccacgcaccgatgggcgcggcgcattgcagggcgacgtcggccagtttcatcttccacaccaggccgacgacgccgcacaccgccagcatcacgtagcaggactgggccagcatcgcggcgggtacgtggatataaatgatgcgaaagctgttgccttgctggtagtccggcggcgcaaaggccaggccccagaccaggccgatgccgatcagcaacacggcggcgacactcaaccacggcagcagcctggcgctgatgccgtaaaaccatttgggcgagccgagcttgtgaaaccaggtccagttcattgctgtttccatcacggtggctgtgcgtcattgcgcaaagctcagggtctttactggccaagacataacacttggccagacctcattattcgccgacgctgatcttcaggccagccgctatagcaaagggtgtcagggttaccgccagggcggtcaggctgccaagccacaggaggtaaccgctcgccggcatgcccataagcgcggcctgcaaggcgccgctgccgaggatcaacaccgggatatacaaaggcagaatcagcagggccagtaacaggccaccgcgctttaaaccgacggtcaacgctgcgcccaccgcccccaacaggctgagcaccggcgtaccgagtaacagagacagcagcaataccggcaggcactcgacgggcaagccgagcatcatcgccagcagcggcgagagcaatactagcgccaagccggaaaaagcccagtgtgccagcaccttggccagtaccagaagtggcaaagggtgcgacgaaaggacccactgttcgagggagccgtcttcgaaatcactgcgaaacagcccatccagcgagagcaggacggataaaagcgccgctacccacaccaatcctggggacaaggtttgcaacagtttagtctcggggccgaccgccagcgggaacagggcgatgacaatcgcgaagaacaccagcgggttggccaattcagccgggcggcggcacaacagccgcgcttcgcgggcgaccagcaaggcgaacacactcataccgaccaccggcccaggtcgaggtcgcggtaaccagcgggcatgcgcgtcaatgtgtggtgcgtggtgagcataatcagcccgccctgctcgcagtgttgggccaggtgttcttcgagctgggcgacgccttgtttgtcgagggcagtgaagggctcgtcgagaatccacagtggcgggccgggcagatacaaacgcgccagggccacgcggcgctgttggccggccgacagggtgtggcacggcacgtcttcgaaccccttgaggccgacagcggccagggcctgccagatggcgtcgcgggaagccgggtgatgcagggcgctgagccagctgaggttttcttccggcgtgagcacgtccttgatgccggcggcgtggccgatccagatcaggttgcgggccagctcgctgcgttgctcggtcaggggtttgccgttgagtcgcacctcaccggctgtcggctgcatcaacccggccagcaggcgcagcaggctggtcttgccgctgccgttggggccgctgacctgcaccatgtcgccgcccgtcagccgcaggtcgaggtgctcgaacagcaggcgcaggtcgcgttcacaggagagcgctacggcttcaagaagagggctggtcaaaagatcgcgggcctttacggttcaagtcggcggtgcagcagccgttatagagaaaagcacaataacggctttagcgaccgattttagagagctggatcaaatagttgtgaggtttttaccgctctctttgcagacgggcggcattatacatgtgatgccctactctaaagagggcaatttccccagagacgacgcgcacgatgaccggtgagatcaaccttcctacgctgccgcctgccgccccggcgcccagccctgccccgctgccgccgaccggtgagctgctcaagctgctggagccgcagaccggcctgatcgatcctggaaaaaccgtcaatgccgaggtgatcgcgcttaaacaaggcggcgatgcgtttcagctcttgctcaagttgaccctcgaaggcggccgccagaccttggtgcaagccagcagcgcccagccgttgccgctgggcagcaacgtggcggtgagccagacgcccaccggcaacctgaccatttccttgcagcaagccttgagcgccaacgtggccgccctcacccgcatcgacaccacgcaaatgccggtgggcacgctgttgcaagccaaggtgctgaccacgcagatgctgccgcaaggcaccacgcaaccggcaatttatcgctcgctggtgaccgtgctcaacaacgcccttgccggtaccacgctgacgctggaaagcccacagccgctgcgggtgggcagcttgctcagcgcgctggtgcagaacgcgcagaccctgaatttcgtgccgttgagcggtctcaaggatcaattggcggtcgcgcaacagctctccacccagcaaagtcgccaaggctcgttggacgtggtgttcactgccgcgcaaaacctgccgacggatgacagcacttccaccgacctgcgtgccgctgccgcgcgtttgctggcggcgctgcccgacctggctcaagtcagcaaccccaaggtgttggcgcaactggtacagaacagcggcgcatttctggaagccaagttgctcgccgggcaaaacccgcaaataccgccgctggacatgaaaggcgcgctgctgcggttggtcgccgacttgctgccggccctgcccaatgccaccaatctcaatgcgattctcgctgccaacaccctcgcccaagtactgccgaattttgtgcgcagcccgttgaacacactgggccaggtcagcgcccgccagacacccgccggcttcccgttgcccgagcggctgatggcgaaactggaaggcgaaggcgacctggaaaacctgctgcgcctggccgcaggggcgatttcgcgcctgcagagccaccagctgtcgagcctggagcaaaccggcaccaccgccgacggccgcctgcaaaccacctggcagctggaaatccccatgcgcaccttgcaggacattgtgccgttgcaggtcaagttccagcgcgaagagccggcgccggaccaggaccagccggagcgcaaagacaagaaagaccccaagcagatgctctggcgcgtcgagctggcgttcgacatggagccgctggggccgctgcaggttcaggcgcaactgacacagggcaaactgtccagccagctgtgggcgacgcggccctataccgcgagcttgatcgaaagccatttgggcagcttgcgcgagcgcctggtgacctcgggcctcaacgtcggcgacctcgactgtcacctcggcacgccgcctcgcgggccgcgaaccggactggaacaacgctgggtggatgaaaccgcatgaaaaacccgtctccaccacgccaggcgattgcgctcaagtatgacggccagcaagccccgaccttgacggccaagggcgacgatgccctggccgaagccattttgaagttggcgcgggaaaatgaagtaccgatctatgagaacgccgagctggtgaagctgctggcacgcatggaactgggcgacagcatccccgaagagttgtaccgcacggtggcagagattatcgcgtttgcgtggacgctgaagggcaagttcccggtgggctacgacccgaatgccgagccggtggagcgggatgtgactgagcgtggggatgattactaaagactcagccgcctcgtggcgagcgggtttgtagtggcgagcgggcttgccccgcgttggggtgcgaagcagccccaaaatctgacgattacatctttctgaaaaaccgtggtgactgtattagggccgctacgcagcccaacgcggggcaagcccgctcgccacaggaagccctcccacagtggttctctattgtcagttcaggacttcactcaggggaatgaaattgacccgatccccaatagccagcgtcgtcccttccaatacctccacaaacccttccgcccacgccgcgctgcgcagcacgccggagctttggttgcggtagatgatcgccttgccctgctcgatacgcccgcgcaggtattcgcgacggttgcccggcttgggccacgtgaaccccaccggcacgtcgaaacgtagcggctcaacctcttgcacaccttggcggcgcagcagataaggccgcgccaacaacgcaaaggtcaccagggtcgaggccgggttgccgggcaggccgatcaccggcacgccgcggaaatgaccgaaggtcagcggtttgccgggtttgatcgccagcttccacaaagccagctcgccctcttcacgcagggcgatgccgaggaagtccgcctcgcccaccgacacaccgcccgtcgacagaatcaggtcgacattgcccaggtccgccaggcgtttgcgggttttttccaggtcatccggcaggatcccggcatcaaccacttcacagcccatgcgcgccagccagctgcacagcacgcggcggttgctgttgtagatctgtcccggccccagcggcaaacccggctcgatcagctcgtcgccggtggacagcacggccacacgcacgcggcgaaccacgctcaggcggtcgtggccgagggacgcggccaggcccagttcgattgggcccaggcgcgtgccggcgttcaacacccgttcgccaacggtggtttcctggccttgtgggcggatgttctggtgcgcctgcaacggctcggtaaagctcacgcgttcgtcggcgtggaccacggcgttttcctgcatctctacgcaatcggcgccttcgggcaccggtgcgccggtgaagatgcgtgcacaggtgccagccgccaacggctgcggcgcctgaccggcgaagatccgttggctgaccggcaagggcgcgcctgtccagtccgcaaggcgcagggcatagccgtccatggcgctgttcggccacggcggcaggtcaagggtggagatcaggtcttgcgccaatacccggccatcgcagtcagccagcggcagcacgtgaggctcacggatcggcgcggcttcggccatgtccagcagttggcgcagcgcgtcttccaccggcatcagcgcgccggttttgccgggcttatccacgggtttcgcagggttcggcctgcttcaagtggggcacgaagttgcacgggcggtggcggttatccagttgctcggcgaggatgccgtcccagccggtgcgcaccgcgttggtcgagcccggcaggcagcacaccagcgtgccattggccaggccggcgagcgcgcgcgattgcacggtggaggtgccgatgtcggccacggagatctggcggaacagttcgccaaaaccgtcgacgtgcttgtcgagcaggcagctcaccgcttcgggcgtgctgtcgcggccggtgaagccggtgccgccagtgatcagcaccacttgcaccacgtcttcggcgatccagtgcgcgactttcgcgcgaattttgtagaggtcgtccttgagcagcacgcgctcggccaggttatggccggcggcgctcaggcggtcgacgaagacctggcccgaggtgtcggtgtccagggtgcgggtgtcgctgacggtcagtacagcaatattcaggggtacgaagggcgcatcagccttggctttcatggctcggtccggttgtcgaaggaacagcccgatgttatatcacaggcccctatttgcctgccgcagcggaaccgccatgtctctcgattcttcgcccctgccctgttcgattctgttgctggccggtggccgtggccaacgcatgggcggccaggacaaaggcctgctgccctggcgcggccagccattgattgcgcatttgcagggcctggcccggccgctgacggatgacctgatcatctcctgcaaccgcaaccacgacctctatgcgccgtatgccgaccagttggtgagtgacgacagcccggacttccccggcccgctggccggcatccgcgccgggctggccgccgcgcgtcatgcgcatctgctgatactgccgtgtgacgtgcccaacattgatgtgagactgctgaccgacctgcgtgagactgcgcgccaccatcccgagctgccggtgatggtgcgccacggtgagttctgggaaccattgatctgcatcatccccacccacctgcaaaccgaggtagaacgggcctgggacgccggtgaacgcagcccgcgcaagatcctcctgcaactgggtggcgtgggcctggaatgcgccgcgaatgacccacgcctggccaacctgaatacgcctgagctgttgcacccaggctccggcgtgtcagaatgaacctcgcacaaggaactttgtcgacgccgcgcgcgtcacagggtcagcaatttaaaagaattctctcggagacaaactcatgactcaacggaccatcgccgctctcatgcttgcactgggcctcgctactctcgccggttgcgcctcgcctacagtgatcaccctgaatgacggtcgcgaaatccaggccgtcgacacccctaaatatgacaaagcttcgggcttctatgagttcgaacaacttgacggtaagcagacccgcatcaacaaagaccaggttcgcaccgttaaagacctgtaagtcttaagcgtttgccccaaggcccgcctcgcgcgggccttgtcgtttccgggggttaccagtcgagggtgatgcggctgcgaaaatcgcgctgttcaccggtgaccgggtcgataaaccgcacgccttgggccagcagtttaagtggcttggcgtagtcgtcttcggcgtctttgagcacctcggggtagaacgggtcattgcagatactcgcccccagcgctgtcatgtgcacacgcagctggtgcttcttgccggtcacggggaacaggccgtagcgccacaactcgccatttctttcgcgcacctccacggcagtttcagtgttgctgacacccggcccttcctgcatgcggaagaacggctcgccgtccaccagacggcttttgtgcaccaacgggaacgtcaggttcggcaaagcgggggcgatggcttcgtagaatttatcgatgcggcgtgtgggaaacagctgttgatacgccgaacggctctgcgggttggccgagaacagcaccagccctgcggtgtgccggtcgatgcggtgcaaaggcaccagcgaggggttatccaggcgacggatcaggcggcgcagcaacgtctgctcgacatactcaccggctggcgtcaccggcagaaagtgcggtttgtcggccactaccaagtgctcgtcggcgtacaggatggtttcctgcaccgggatcactttttcattcggcacttcgcgaaagtaataaatgcacaggccctctttataggccaggtccaggcggatgggcgtgccgttgatgtccagcacgcggccgcgggcgatgcggtccagccagtgctcacggctgatcgccggaaagtgctcgcacaggcaatccagcaccgtggcccaagggccgggaggcaaatacaacgtgctggcttgatgttgcgaagcggaaaaaccggttgtggacatggacatgctcgaagcctggaaaaaacaggcaggcattatcccgcatgcaacgggattgagcctaggggatctctcaagccttggccaattgcgcacgcaggatcggcgaggcactggccgcctcggtgaattccttgagccaacgcagcacgtctacggcttcccagcggccagggtcgtaaagcgcgtacatcaagccctgataacccaccacatccaactgcttgtgataaccggcgcgctggaacaacgcttcgatctcggcaaagcaggtattgaaatgcactttgttaaacggcgtcttgccttccgtgaccaggccgtcgaggcgcagctcgtttaccgcgtcgcgcacgacgtcggcggacatgcgattgacgctgcttttcagttgttcaacattcaccacgggcgttccctctattcaatcgctgtacaagcatacagtatcgtaatatttggaaacccgccatcggagaaggcttaagaaaggaaggcaacaatctgttcagtgtcgaatggccagtccagttccgccccggtgtccacccggcgaagcaccggaatccgcaggccgtaggcttctgtcaggtcgtcgggggcggtgatgtccaccagctccaccaacaaaccgtgttcgaccaacggcatgatttcgtcttcggcgatctcacagagatggcaacccagggtgccgaacaactggcattcaggaagcatggcgatgggactcgatcagaaaatagacggtcattgtatgcccgccagaatgagcccgactactcacaaaacacctgacccaggtcaccatggcctataactgattcagcgattctcgcggctttttgtccgctcaacctgcaaggaagctgctcgtgttcgccaacctgctgatcattctggcctcatccctggtggtgattgcgctgtttcgccggctgcaactgccgcccgtgctgggctacctgtgtgtgggcctggcggtggggcctactgccctcgactgggtgaacgacagcgaagacctgcccgacctcgccgaactgggtgtggtgttcctgctgttttccctggggctggaattttccctgagcaagatgctggccttgcgcagcgtggtatttggcctgggcagtttgcaggtgctcggttgcggggtgttgctgggcggcctgctgatgggcttcggcctgtcgccaggcgttgcgctgctgctcggcgcgggcctggcactgtcgtctacggccatcgtcagcaaggagttgggcagcctcggtgaaattttcagcagccatggccagaacgcgattggcgtgctgctgttccaggatgtggtggcggtgttgctgctgaccttggtgccggtgtttgccggcagcagcgagcaagcctggtattgggcgctgccgttgaccttgggcaaaaccgtggtgttgttcgtcggcctgctgttcgccagccgctggttattgccacgcctgttccatgaagtcgccgcgtcccattcggcggagctgtttgtactgttagccctggtgatcgtattgctcaccgcctggctcacacacttgctggggctctcccctgcccttggcgcgttcctggccggcatgctgctgggggaaagccactaccgtcatcagatcgaagcggacatccgcccgtttcgcgacattctgctggggctgtttttcgtcagcatcggcatgctcatcgacctgcagctgttcgtcagccatagcctgctgattctcgggctgaccctcgcgctgatgctgatcaagggctgcgtcgtggccgcgctggtcaagctgcgcggcagcgacagtgaaaccgcctggcgcagcggcctggccctggcgcaaggcggcgagttctgttttgccctgatggcgcaaatgcaacagagccggctgattccggacgcattcaacggcatgctactggccgccaccttctgttcgatgctgctgaccccattactgctgcgcgccgcaccggcgattgccctgcgcctgcaccgcaagcccaatcagcaagtgcagctggaagaaatcaccgcactcaatgccgagttacgcgaccatgcggtgatttgcggctatggccgcgtcgggcaaaccatcgggcggtttctacgccgcgaacaacaggcgtttatcgccctggatgacgaccccgaacgcgtcaaggaagccgccaccgaagaccgcaacgtgcattacggcgactgccgtcgcggcgccctgctcagtgccgtcggccttgaacgcgcgcggttggtggtgattgccgtggacaacagcgatgtcgccctgaccgtcctgaaggaggcaagaaggatcaacccgcaggtgccgatcctggtgcgcacccgggatgacagccaactggccgaactgaaagcagcgggcgccagcgaagtggtgcccgagctgttggagtcgagcctgatgctcgcttcccacgccttgatcctgttgggcctgccggaccaacaggtgcaggcgcgggtcgatgacgtgcggcgcagccgttatcgtctgctgcacggcgtttacccgccgactgaaacaccgatcaatcctgactgaccgcgccaattttgtggatcgacaggtccgcgccgtaatactcctgctcctggctcaggcgcagcccgtgcacgcgcttgatcacgccgtacaccaacaggccgccgaccagcgccaccaccacgcccagcgccgtgccgatcaattggctgatcaggctgacaccgcccaggccgcccagagcggtctggccgaagatgccacacgcaatgccgccccacacgccgcacaaaccgtgcagcggccacacacccagcacatcgtcgatcttccagcgatcctgggccgcgatgaagcaccacacaaacaagccaccggccaccgcccccgtgaccagcgcgcccaccgggtgcatcaggtcggaaccggcgcagattgccaccagcccggccagcggaccgttatgcaggaaacccgggtcattgcggccgattaacagggcggccacggtgccgccaaccatggccatcagcgagttcacggcgaccaggccgctgacgccattgagggtttgcgcgctcatcacgttaaaaccgaaccagccgacaattaaaatccacgagcccagcgccaggaacggaatgctcgacggtgcaaacgctaccagtcgcccttcgcgatatcgcccgttgcgtggccccagcaacaacaccgccgccagcgccagccagccgcccatggcatgcaccaccacggaaccggcgaagtcatggaaactggcgccgaagcgcgcaagcagccaggcttgcaggccgaagttgccgttccacaccatgccttcgaaaaacgggtagataaacgccacgatcagcgcggtggcgcacagctgcggagcgaactttgcacgttcggcaatgccgccggaaatgattgccggaatggccgccgcaaaggtcagcaggaagaagaacttcaccaggccgtaaccatgatcggcactgatcaccgccgccggttgcatgaagctcacaccgtaggagatccaatagcctataaagaaataggccagggtggagatggcgaagtcgctgaggatcttcgacagggcattgacctggtttttttggcgtacggtgccgacttccaggaatgcgaagccggcgtgcatggccaggaccatgaccgcgccgatcaggataaacagggtgttggagctgtggacgagcgtgtccactgcactttgcaggttgtccatggaggttggcaggcctgtaataaaggcaaaaagcaccaaagcggttcaagccggggttgcgcgcactaaattggcaccaccggccccgcccctcttcagagggcgtgaaccgctttagcgcagcgatcaacacaacaggccgttgccgacagggtttttccgcgagtttcggttatttagggtaaggtttttcaaggcattcgcccgaaccgcccggattcagcgcaggccccagggcctgcgcaccaaggcaaagcaaaagctgtaccagacaattgcactgaaccttcaccgaagccggtgactcgaaaacaaacgtaacgaacacaacagatgtacagatcagccaatcacggagataaccatggccagaagaactgcaaagactgctcaagaaatactgatggcggattttcaaaccctggtcagtgacaccgaaaagttgctcgacgacaccgccgtgctggccggtgaccaggccgatgagctgcgcaccaagatccatgacagcctgctcaaggcccgtgaaacactgcaactgaccgaagactccctgcgtgagcgcggccaggcggcggtgactgcgacggaagattacgtgcaggccaacccttggcagtccgtcggcattgctgccggcgtgggctttctgatcggcctgctggctacaaggcgctaactatggcaatcggcgaaaacggcccgtccacgggcgcaggctccacatcacgacgcctgggcgcggccgttctcggcctgctgcacagccatgtcgagttgtttggcatcgagttgcaagagcagaagtcgcgtacggtcagcctgctgttgtttgccggcttggcgctggtgtttgccctgctgttgctggtggggttgtcggcgttggtgatgattctggtatgggacacctaccgtcttacggggatcatcagcctctgcgtgttctacaccctggccgcagccttctgtggggtgcgtttgaaagcggcgatattcgacgaatccacgccgtttcacgccaccctcgaagaactggccaatgatcgggagcgcctgctgccatgagcctcactgaagtcccgcaaaacaccacgcgtcgggaaatgcgcaaggcgttgattcgcctgcgcatggaaatgcaccgccaggaaatccgtcacgagtcccagcaactcatggcgcccctgaacaaagtgcgcgacatgcgtcataactggcaagacagcctgggcatcaaacacgcgccgctgtggggcgtggcggcggtgacgctgatgggcttcttcaccggcaagggcgccaaaggcggcagtatcagcagcctgacgcgcctggtgcggctgggtgcggggttgatcccgttgatcaagctggccatgcaaggcgcttcgcgcaaaggctaagcccgcgctggctgcattcttgcaaacagaatcggcccggccctcgttactgagggccgggccttttttcgctgattgtttttaaggaggcctcgtgatcgacgggcaaccgctcgcctgtttccagccgtttatcgacaccgccaccgggcgcatcgccggcgtcgaagcgctcggccgcctgcgccaggcggacggccgcttgcagtcggtaggcccactgtttgccgacccacgcacgccgggcgtggccttgcgccggctcgaccggcagatccgcgacaatgccttgagccgtctgcatgaagcgcccgaagactggttcctcagcctgaacatctcaccgcgctggatcaaccggctgcgccccggccaagccttgcccagcttgaagcaggtgcatgcccatggcgtcgacccgcagcgcatcgtgttcgagatcaccgaattgggcggcgacattcagcgcctcgccgatgtggtcgcgcgttatcgcgaagccggtgcacgcatcgccatcgatgacttcggcgccggttattctcaactcgatcgggtattggcgctgcaaccggacatcctcaagctggacatgcgcctgtttcaggaagccgccaagggcggcccgagcagcgaagtggtgcgggcgctggcgcaaatggccgaaaaaaccgggtgctggatcatcgccgaaggcgtggaaaccgaagcgcaactgagtttcgccctggaatgcggcgcacgctatgtgcagggttatctgtttgcccaggcgcaactcgactggtttgccacggatgcgttcgtgtcgcgctttgcccagctgcgcagcgtttacgtgcagcacaaactggcggagcgcgggcgcatcatgcagttgcgcctgcaattgaccgagttgatgaaaatcctccaggcctgggcacaaaaccgtgcaccgctggaccacttgccgcaattgccggacttcccctggctgttgcgcttttaccagtgcgaccgccacggcacccagttgacgcccaatttcgagtggcgccaggacgcctggcaggccgacagtcgctacctgggccacaactggtcgtggcggccctacttctaccatctgctcgccgaaggctgggaggaacggcgcctgaccctttcctcaacctaccgcgatgccaccaccaaccagtactgcctgaccgccggacaattcttcgataacggtcagcgtttgctgttaatcgatatcgacgcggccggactgtagattttcgcttgccccgccagggcggaaccgcgaagctgggcagtgtcattcaccgcacggagagtacccgccttggattggcccaccctgctaacccgcgaacgtcttggaaaacccctgcatagcccggaagaattgggtcgcagcccgtttcacaaggaccatgaccgcattattttctccggcgcgttccgccgcctggggcgcaagacccaagtgcacccggtgtccagcaacgaccatatccacacccgcctgacccactcactggaagtcagttgcgtcggccgctccctcggcatgcgcgtaggcgaaaccctgcgcagcgccctgcccgactggtgcgacccgagcgacctgggcatggtggtgcaatcggcttgcctggcccacgacatcggcaacccgccgttcgggcactccggtgaagatgcgattcgtcactggttccagcaggcagccgggcgcggctggctggatgacatgagcagtgccgaacgcaatgacttccttaattttgaaggcaacgcgcaaggctttcgcgtgctcacccaacttgagtaccaccagttcgacggtggtacacgactgacctatgccaccttgggcacctacctgaaatacccctggaccgcccgccacgcggactcgctgggttataaaaagcacaagttcggctgttaccagagcgagctgccgatccttgagcagatcgcccacaagctcgggctgccacagctggaagaacaacgctgggcccgtcacccgctggtgtacttgatggaggcagccgacgatatctgctacgcgttgatcgacctcgaagacgggctggaaatggagttgctggagtacaccgaggtcgagtcattgctgctcgacctggtaggcgacgatctgccccagacgtatcggcaactgggcgcgcaggactcgcgtcgacgcaagctggcgatcctgcgcggcaaggccattgagcacctgaccaatgccgctgcacgtgccttcgtcgaacaacaggatgccttgctcgccggcacgctgccgggcgacctggtggagcacatgcacggccccgccaagcgttgcgtgctggacgccaaggacatggcgcgcaagaaaatcttccaggacaagcgcaagaccctgcatgaaatcggcgcctacaccacgctggaaatcctcttgaacgcgttttgtggtgcggcgctggagcaacatggcgggcgcacgccgtcgttcaagaaccggcgcatcctcgacttgctgggtaacaacgcacccaacccagcctggccgctgcacgcctcgttcctgcgcatgatcgactttatcgccggcatgaccgacagctatgcaaccgaaatggcgcgtgagatgacagggcgctccagcccgcagtgaagaaatgggtcaagccgcctgcctcccgcacagaatttgcctacggcgggaacagagcggcctgatcgaattcgcacattcattcgaggaataatcacgcacgcttcaggcggacgtggcgagcaattcctacgccccaccccatcgactcttgactgacccatgtgcctcctatgcccagttcccccctccgaatcctattggtggaggatcatccctttcagctgctggccactcagtgccttctcaaaagtttcggcttcgagcgcctgaccctggcagaaaatgccgaacaggccatccgcgtgatgtctgcgtcccaggcaccctttgatctgatgctatgcgaccaatgcctgccggatttaccggggctggaactggtggaaatcgccagccgccaacgctttataatgggggccatcctattgagcgggctccccgccacagaactttccaacctgatgagccaagccctggcgcgcggtttacccctcctggggtatttattgaaacctttgaacagagacgaacttgcaacgttgattgcgccaatacgccgattataaatgtaggactttaaacgctatccaccgacgaaacatcgcctgaaccctccgctaaacccttggcgccgccaataagcacaatgcctcaataattgcttacacctaccgtcacaaagacttatcgaccggtaggctattaccttttttcatgtaggaattctcttgttttatacctactccccacaaggttcatgcgcccccctcatcttctgagctaatgtgcccgctttatttgcacttgcatggaacgtgattatgaacacagtttttatcattgatgaccacccggttatacggctggcgattcggatgttgttggaacacgaaggttataaagtcgtcggtgaaacggacaacggctgtgatgcgatacagatggttcgcgaatgcctgccggacttgattattctggatatcagcatccccaaacttgatggcctcgaagtgctgtgccgattcaacgccatgaacacctcgatgaaaaccctgattctgaccgcccaatgcccgacgctgttcgccacacgctgcatgcgctcgggtgcggatggctatgtgtgcaaggaaggcgacctgagcgagctgctgagcgcgatccgtgcggtgctgtcgggctacaattacttccccagccaggccttgaacgccaacaacgcagacggcaaggacttcgaagaacttgaactgttcaagaccgtgaatgatcgagaactaatggtgttacaactttttgcacaaggccgcaccaacaaagaaatagccaaaggcatgtttcttagtaacaaaacagtaagtacttacaaaaaaaggctgatgcaaaaacttaaagccaaatccttggtagaacttatcgagatggcaaaacgaaacgcgctagtgtgagaaagcggatgcccaggtgtataaaggactatttgattatattaatcgccggcgtgtgtttcagcacgaccgcatccgcgacctctcaacccggtccggaacacttcaccttattgagccgcgcggctgccgttcaactggatgttcaactggacaaggctcagcgccagtggctgcagaacaaacgcgagctggtattaggcactgccgcacctgactacccgcccttcgatctcacctccagcggccgcgattatgagggcctgaccgccgattacgcagggttgttgagcaaagccctggccttgccggtcaaggtacttcgctacccatcgcgggaggcatccatacatgccctcgaaaccggagaaattgatctgctgggctccgccaacggttttgaggccgccaacccgaacctcgcgctgtcgcaaccctacgccgtggatcaacccgtgctggtgacccgggagagcgagacgcgcagcctgagcgacggcctggccgggcttcgcatgagcctggtctaccattacctgccgctcgatgaagtggaaaagttatacccgcaagcgcagattcgcgcttacccctcgtttcaaaacgcgttgaatgcggtggcgttcgaacaggcggacgtgtttctcggcgataccatttccacccattacatgatcaacaagggctacctgaagaatatccgcatggccaacttcggcaagcatgaggcctacggtttcagctttgccatgcgccaggaccaacacacgctcttgagtatcgtcgacacggtgctggccgccgtgcccatcaatgagcgggacagcatcgccaagcgctggagcgccggcagcgatattttgctgaccgataaaaaactgcagctgacccaacgcgaagagcgctggctcaaagacaacccggtggtgaaggtcgtggtcaacgagaccctcgcgccgctgacgttctttgatgccgacggcaactttcgcggcatcaccgcagatttgctggagctgattcgcctgcgaaccgggttgcgtttcgagatccagcgcacgcgcgaagtcaacgcgatgatcgaccagctcgtcaccggcaaggccgatatcatcggcgctatcgtccccagcgccgaacgggaaacccagctgagtttcagtcgcccctacctggaaaactcctatgtcctgctgacccgcaaggagcccaacgcgccctcgaacctggaacagatggcaggcctgcgcctggcaatcaccgagggcaacccaatggaaaaaatcctgcgccaggatttcccgctggtccaactcgtggaagtcagcgataccttcaaggcctcggaattgcttgcccagggaaatgtggaaggcgcggtgaattcgctggtgatcgccaactatttgctctcctcgctgatgttccaggacaagctgcagatcagcaccagtatcggcaccctgcctgccacgttcgccctggcgacgccgcgccgcgcggtcgaactcagttcaatcctggacaaggcgctgctgagcattgcgccggacgaaatgggcgtgatcaacagtcgctggcgaggctacagcgccgcctcggacagctattggcgcaattaccaccaactgatcgcgcaaatcatcatcggcaccgggctgttgctgctgatctcgctgacctggaacgcctacatgcgccgccagatcaaacaccgcaagatggccgagcgcgccctcaacgatcagttcgaattcatgcgggcactggtcaatgaaacgccgcaccccatttatgtgcgtgatcgcaaggggctgctgcaaacctgcaatgacagttacctgcaggtgttcgacgtcaagcgcgaagaagtgattggcaaaagtgtgatccagatggacatggcgctggagtcggaagctgcgcagtaccacgccgactaccagcgggtggtggtcgaaggtaacccgttgatccttgatcgcacgctgcatattcaaggaaaaaaactgacgatctaccattggatcctgccctatcgcgattcggtcggcgaagtgcaaggcatcatcggtggctggatcgatatcagtgagcggcgccaactgttcgacgagttgcgcaccgccaaggaacgcgccgatgaagccaaccgtgccaaaagcacctttctcgccaccatgagccatgagatccgtacgccgatgaatgcggtgatcggcatgcttgagctgacactcaagcgcgccgaccagggccatctcgatcgcccggctatcgaagtggcctacaactccgccaaggacctgctggagctgatcggcgacatcctcgacatcgcgcgcatcgagtccggccgtctgagcctggccccggagcgcgtgaacctgggcgaggtgatcgagtcggtggtgcgcgtcttcgatggcctggcccggcagaaaaccctcagcctgctgctggagtccgatcccgttatcgacgataccgccgtgctgatcgaccccttgcgcttcaaacaggtgctgtccaacctggtcagcaatgccatcaagttcaccgagcgcgggcaggtgaagatcaaggtgaacgtgcacgccaccgaacggccgcaggagatccagatgaaactggtggtcgaggacaccggcatcggcatcagccgagacgaccaattacgcctgttcgagccctttgcccaggctgacaactccgggcacctggccaggagcggagcaggcctgggcctggtgatctgtcgcagcctgtgcgcgatgatgggcgggcaactgagcctgagcagcgtgccgatggtgggtacccaggtccatgtcaccctgaacatgacgctcctgcagccgatcgaagtactggacgaactcaagtcgcaggcccccgctgccgcgccggtactcaacgtgctggtggtggacgaccacccggcgaaccgcttgttgatgtgccagcaactgggttacctggggcaccagttcactgccgcccagcacggtgccgccgggtttcaagcctggcgccaggagcgcttcgacctggtgatcgccgactgcaatatgcccgtcatgaatggctacgagttgagccgctcgatccgtgaatatgagcaacgtgagcaactggcgccttgcgtgatactcggctttaccgccaacgcccaacccgaggaaaaactacgctgcgcgcaagcgggcatgaacgattgcctgttcaaacccatcagcctcacggcactggaacagcaactggggcaaatccggccacaaccggcgggccagcagttggacctggactgtctggatgcgttgaccggtggcgacccgcacctgagccggcgcttactggaggaactgttgaccagtagccgtcaggaccgccaggaactgctggccctgctggctcggcaggcgccgccccaagccattatcgagcaggcccacaaaatcaagggcgcggcgcgcatcgtgcaggcaagcgccctggcgacgcaatgcgaagcgctcgagcaggcctgcgcccgcagcgacgatcgtgccctgatcgaaacctacgtgaagtccctggaaaagctcatgcttgaactggagaggacgctgcacgtgcagctccataagctggctagccaagaccttggctagccccttacggacagatcagcagtcggtcaagcgcaggaaaatcgccgccaaccgctcgatacccgcctggtcctcaaggctgaaacgggccagcgacgggctgtccagatcaagcacgccgatcaacacgccgtccttgaccaatggcaccaccagctcgctgttcgacgcgctgtcacaggcgatatgcccggggaacgcgtgaacatcttccacccgctgggtttgccgcgatgccgccgcggcgccgcagacgccacgaccgaacggaatacgcacacaggcgatctggccctggaacgggccaagcaccaactcttcattgcgattgaggtagaagcccgcccagttcaagtcatccagctggttgaacagaaacgccgaaaactgcgcgctgttggcgatgaagtcgcgctcatcggccagcagcgactccaactgcgcgcaaagcatggcatagccgtccaggccggtgccggcctgttgtaaatcgatcatggttgacgctccaacaacttgagtcctacccagtaacgggcgaattgatacgcgcaacggccgttgcggttgccgcgcccggtggcccagcgcacggcgagaatgtcgagggcttcatcacgctgccactgcaaacccgccttgctggccagctcgccgatccagtgctcgaccacatccaggaagtgttcctggctgaacgggtagaacgacaaccacaggccaaagcggtcggacaaggcaatcttgtcctccaccgcctcactggggtgcaactcgccatccacccgcttccaattgtcgttgtcgctctggttttccggcaccaggtgacggcggttggaggtggcgtacagcagcacgttttccggcgcctgttcgagcgagccgtccagcacactcttgagcacgcggtagtcgccctcgccggcctcgaaggacaggtcatcacagaacaggataaaacgctgcggcagcttgagcagttgctcgaccacgcgcggcaggtcggccaggtgatcgcgctcgatttcaatcaggcgcaaaccggccttggcgtgctgcgccagcaaggcgcgcaccatcgacgatttacccgtgccacgcgagccccacagcagtgcgtggttggcgggcagaccatcaagaaattgttgagtgttgcgcgccaactgctcacgttgcttgtctacgccaatgaggtcggacaggcgcatgtccaggctgacgtccagcggcagcaaaaagcctgagcggccttcacgctgccaacgggcggcgaggcattggttccagtcgatggcttggcgcggtgcaggtaacaagggctccaggcgagccagtaccgcatcggcccgctcaagaaaggcattcaatcgagaatccacgattattcctctggcaagttcttgcaaaagatggcgtattggcaaccctgcggcagaccgcacgcggctgcgtaaaaaaatgattcatgccggccaagccagagcctgtggatgttcagctatgcttgccgggcgaagggaaacgtgaagtggttcaacacccgatggatatcaagttcgcccaccgcttgtcttataaacaagctcgattgactgtgctggtcggtttcgtcttgggaaccttgctcagtctgatccaaatcggcattgattatgccagcgaagacgcatccatcaaccgtgaaatacgctcgctgatcgaaatcagccataaccccgcttcacgtattgcctacaacatcgacgccgaactcgcccaggaactgaccctgggcctgctgcattcaccggcgatcattcatgcgcaattggtcgataacaatggcgtggtcctggccgacgttgatcgcccgcgcaaggaaagtacctaccggcctctcagcgattttctgttcggcgccaaccgccagtttgaggaccggctgttcttgagccacatgcccaacgattccctcggtgtcttgcgcctggacgtcgacacttacgcctttggcagccgtttcctgcaccgcgccgagattaccctgctcaacggctttgcccgcagcctgctgctgacgggcatcctgctcggcctgttctacgtgatgctgactcagccgctggtgcgcattattcgcgcgctgagcaccagcaagcaggcccgcctggactgcccaccggggcacgaaaacgacgaaatcggcgtgctggtcagcgtggccaaccagcaatttgaaaacatggagaccgaaatccagcaacggcgccacgccgaggaccgcctcaccgaatacctgagccaactggaaactatcgtctctgcgcgcacccttgaactcaaggccagcaaccagcgcttgagccaatccaacgatgaattggaagcggcaaagttgaccgcgctggccatggcccaggcccgcgctgcgttcctggccaatatgagccacgagatccgcacaccactcaatgggctgctgggaatgatcgcgctgtcgctggacagcccgctgaacgccgaacagcgccaacagctgtccatcgcccacgattcgggcaaggtgctggtggagctgctcaacgatatcctcgacctgtcgaagttcgacgccggccagctggagctggagcgcatcccgtttgatctgggctcgctggtggaagacaccgccaacttgctgtcgcagaacgccgcgccgagtgtcgagttgacctgcttgatcgacccgctgtttccagctcaggtgatgggtgacccgacgcgggtacggcagatcgtcagcaacttgctctccaatgccttgaagttcacccgcttcgggcgcgtggacgtatgcctgagcgcccttgatggccgggtaaaaatcgaagtctgtgacaccggcatcggcattgcccaggaagcgcaggtgaagatattccagccgttcacccaggcgggcgcgggtatcactcgccagtttggcggcacgggactggggctggcactgacgcataacctgtgtgaagcaatgagcggccgcttgagtatcagctctgaagtcggttttggcagccagttctgtgccgagctgccgctgcccacgcatttacccgccgcccgtcaggcgcccctggcaggcgacgtgatggtgatcaccagcagccgtaatggcctgacggagttgctgaccaacttgctgccccactggggcctgacgccgcgcctttactctcaggacgatgacctgagcgggcaaactcccgacttactgatcaccgactgcccggagtgcctgttccgcttacgcccggcgattaccgcgccaatcctgctggtgaccgcctatggcaacttcatgcccagcgaggaagtcgcaggcctggcaccgctgcagcaacaggcacgcccattgagccgcaacgcgctgtaccagattctgcagcgcaacttgcacagtgacgcacaactgatccttgacccgatccagatggacgccgcgcccttcacgcaccgggcgcgcatcttgttggtggaggacaacccggtcaaccaactggtggccaagggcatgctcagcaagctcggctgcgaagtgatcgtggccgcccacggtggcgaagcgctcaagttcctcgaggaacagcgctttgacatggtgttgatggactgcaacatgccggtgatggacggctacgaagccagccggcagattcgtcgcagcgggcgctggccggacttgcccatcgtcgccttgaccgccaacgccctggccgaggaacgcgaacgttgccgggccgccggcatggatgactacctggccaagccgtttcgccgtgaagaactcaaggcgctgctggacctgtgggtgccacagacgacaagtctttgatctgcgccagcaactggtccaggccgtggcgcagggcgtcggcctgattcaggtcgatgccgctgtcacacaacagccgggttttcaggccgtgggtctggtcgcgtaaatgcacaccggccggggtgaggctcaagtgcacctcccgctcatcccgcgcactgcgctggcgccgaaccagggcgagctgttcaagacgcttgagcaacggcgtcaacgtgccggaatcgagcatcaaccgctgccccaatgccttgacggtcggctgcggcgcagctgccgcgtgccactcccacagcaccagcatgaccacgtattgcgggtaggtcaggcccaactggtcgagcattggcttgtaggcacgcgtcaccgcgcgggaggcggcgtagagcttgaaacacagctggtcgtccagggccagggacacggtggttgcgtcgatcatttgagcagggcttcgatctcttgggtcaagttctggggcttggtggttgggccaaaacgcttgaccaccttgccgtcacgaccaatcaggaacttggtgaaattccacttgatgcccttggaacccagcaacccaggcgcttgctttttaagctgcacgaacagcgggtgggcctcgctgccgttgacgtcgatcttcttgaacagcgggaagctgacgccgaaattcaattcgcagaattcggaaatcgccgtttcgttgcccggctcctgtttaccgaattggttgcaggggaaccccagcaccaccaatccttggtctttgtactgctgccagagctgttcgaggcctttgtactgcggggtgaagccacatttgctggcggtgttgaccaccaaaatggccttgccggcaaaatcggccaaggtcttttgctcacctttgatggtggtgcacgggatgctcagcaggttgttgctcatggcagtgcctcgattgagatgaaagacgctgaaagatagtaggcgattcaattgtgcgcaatttaattgatcgcattgatgaggcgtactcgacttaactgtggggctgggttcgcctgcatcgcaggcaagccagctcccacacagggcactgctttgacgctgacgcggagcgtcaagggctgcatgcccacgcagagcgtgggaacgatcagcgatcagtggttttagcgggggacgaggtccaggcacaccgagttgatgcagtaacgcaggcccgtcggcggcgggccgtccgggaacacgtggcccaggtgcgcatcgcatttggcgcaggtgacttcggtgcggatcatgccgtggctgacgtcacggatctcgatcatcgcgctgtcggcaatcggcgcgtagaagctcggccagccgcagccggaatcaaacttggtggtggaatcaaacagcggttcattgcagcagatgcagtgatacacgccgtcggtcttggtctcgttgtacttgccgctgaagggccgctcggtgcccttgagacgacaaacctgatactgctccgggtcgagcatggccttccattcatcaacggttttctgcaacttttccatcggtacacctcggcaactgaaaaagcctgatctgtgtcttttccatggatcaggcggcacgtatgattgcgcctcttcaaaacgccagtctggcacccgcgctatcggcattcaaacgtatttatgggtgcaggcctcgcaggattcgcagtacggtagtgtccacgccgtctggatcgttcattttcaggatcacatcgccatgcaggtcagcaaatcgaacaagctcgccaacgtctgctacgacattcgcggcccagtgctcaagcacgccaaacgcctggaagaggaaggccatcgcatcctcaagctgaacattggcaacccggcgccttttggtttcgaagcgccggacgaaatcctccaggacgtgatccgcaacctgccgaccgcccagggctacagcgactccaaaggcctgttcagcgcgcgcaaggccgtgatgcagtactaccagcagaagcaggtggaaggtgtcggcatcgaagacatctacctgggcaatggcgtgtccgagctgatcgtgatgtccatgcaggccttgctcaacaatggcgacgaagtgctggtgccggcacctgactacccgctgtggaccgccgccgtaaccctggccggtggccacccggtgcactacctgtgtgacgaaggcgccgactggttcccggacctggccgacatcaaggccaagatcaccccgaacaccaaggctttggtgatcatcaacccgaacaacccgaccggcgccgtgtactccaaggaagtcctgctgggcatgctggaactggcgcgccagcacaacctggtggtgttctccgacgagatctacgacaagatcctctacgatgacgccgtgcacgtgtgcaccgcatcgctggcgccggacctgctgtgcctgacgttcaacggcctgtccaagtcctaccgcgtggcgggtttccgctccggctggatcgccatttcgggccccaagcacaacgcccagagctacatcgaaggcatcgacatgctggccaatatgcgcctgtgcgccaacgtgccgagccagcacgcgatccagaccgcactcggcggctatcagagcatcaacgacctggtattgccccagggccgcctgctggaacaacgcaaccgcacctgggagttgctcaacgcaatcccgggcgtcagttgcgtaaaacccatgggcgcgctgtacgccttcccacggatcgacccgaaagtctgcccgattctcaacgacgagaagttcgtgctcgacctgctgctgtcggaaaaactgctggtggtgcaaggaacggcgttcaactggccgtggccggatcacttccgcgtcgtgacgttgccgcgggtggatgacctggacatggccattggtcgcatcggcaacttcctcaagtcctatcgccagtagtgcaaatgacgctgtacgaccgacaattggtcgtacagcgagtatctggcaacacttctctgcgcgacgctccccttctcttgccgctgtacaccacggaccggtcaactcccgcaattacgggagacagaggcgtgactgcagcgttcgcagctggctttaccggtcggaaaatcctttcaaggctctacattcgcgctgtaggacacagtttgaaatagtcgctcggttgaatcacccctagccgcaccttatataccccgcagtacgcgacatattaagcatgaggagaactctacaaccatgatgcgcatcctgctgttcttggccactaacctggcggtcgtgctgattgccagcattaccctgagccttttcggcttcaacgggttcatggcggccaacggggttgatctgaacctcaatcagctgctggttttctgtgcagtctttggttttgccggttcgatcttctcgctattcatctccaagtggatggcgaagatgagcaccagcacccaggtcatcacccagccccgcacccggcatgaacaatggttgctgcaaaccgttgagcaactgtcccgcgaggccggcatcaagatgcctgaggtcgggatcttcccggcctatgaagccaacgcctttgccaccggctggaacaagaacgacgcgctcgtcgcggtcagccagggcatgctggaacgcttctcctacgacgaagtgaaggcggtactggcccacgagatcggccacgtggccaacggcgacatggtcaccctggcgctggtacaaggcgtggtgaacaccttcgtgatgttctttgcgcggatcatcggcaactttgtcgacaaggtgatcttcaagaacgaaggcggccgtggcattgcctacttcgtggcgaccatcttcgccgaagtggtactgggcttcctggccagcgcaatcaccatgtggttctcgcgcaaacgcgagttccgcgcagacgaagccggtgcccgcctggccggtaccggggcaatgattgcagcgctgcaacacctgcgctccgagcaaggcctgccggtgcacatgccggacagcctgacggcgtttggtatcaacggtggcattaagcaaggctttgcacgcatgttcatgagccacccgccgctggaagagcggattgacgcactgcgtcgccggggctgatagccaggcagtaacacgagaaggggcgatttgatcgccccttttttgtgggcgcctgaatcgtcatcgcgggcaagcccggctcccacagggatcttgcgcgaacgacagggtcaacgtgggagccgggcttgcccgcgatggcgatagcagggtcaatacctggtcagttggtaaacacgctcctccaagcgcgtgacgccgtcctgcacaaacttccagctctcgcccaggatgtcttgttcctccaacacctgcgcagcccagtgtgattcgagcaataccctgacctcttcatcggttaccgcaaagggcgggccggccttctgcgtctggtcgtagtcgagggtgatcagcaaaccctggcagccagtgcgtaatacggtattgagatgcccggcatactgcgcccgcatcaacggcggcaatgcgatcaatgccgcacggtcgtagagcgcggcgcaatcggcaaccacgtcggcgcccaaggcaaagaagtcaccacaccacagttcgatctgatcggactggtacaccttgaacacgccccgccggctgaccctgggcacgagcccttgctcgctgaaaaacgcctcgaccgcctgctcagacagctccacccccagcacgcgatacccggcacttgccagccacatcaggtccaggcttttgccacacagcggcaccagcaccttcgccccgtcggccaacgccagtttcggccagtgacgtgacaggtaggggttgacctcgggcagatgaaaaccgatctggttgcgggcccagcgttcttgccaaaacttaggctccataaaatcaccctgaaaattcgatcaaaaggcgctaaaacttatattagatttagatcaatgatctgattgaagatgggcccatgttaacgctcaggaccccacttatgttccccagcctgtttatctcccacggctcgcccatgctcgccctgcaacccggcgccagcggcccggcgttgcggcgcctggcagccgaactgccacggcccaaggcgattgtggtggtgtcggcgcattgggaaagccatgagttactggtcagcggcagtgccgctccggaaacctggcacgacttcggcggcttcccccgcgagctgtttgccgtgcaataccctgcgccgggcaacccgacactggcgagtgaaattgtcgagctgctcaacgccgatggcctggctgcgcgaatcgatgagcgccgccccttcgaccacggcacctgggtgccgctgtcgctgatgtacccggcagcagatattcccgtggtccaggtgtcgttgcccagccgcatgggccctgccctgcagacccgcgtcgggcatgcgctcgccagcctgcgcgaacaaggcgtgctgttgatcggctccggcagcatcacccataacctgggggaattgaactggcaggccgggcctgaaagcatcgagccttgggcgcgggatttccgagactgggtggtggataagctcgccgccaacgatgaggcggcactgcatgactatcgccgccaggcgccgcatgccgtgcgcagtcatccgagtgatgagcacctgttaccgctgtattttgcgcggggcgcggggggtgatttcagcgtggcgcatcaggggttcaccatgggtgcgctagggatggacatctatcgcttcggctaacggagttctaaatgtgggagctggcttgcctgcgatagcggtgtctcagtaaaacatgtacttaatgatgtaccgttatcgcaggcaagccagctcccacatttttgagtgctgcaaatgccaggcaaaaaaaatccccgaaccagtcggggattttttatgtgcgatcaatcagcccaaaggcggatcaatcttcgcggtagcgacgcagcttcagctgcttaccggcaacgcgtgtgtctttcagcttggccagcagtttttccagaccgtcttccggcagctccaccagggagaagctgtcacggacctggatgcgaccgatggcttcacgtgccaggccaccctcgttgaggatagcgcccagcaggttcttggcagcgatgccatcacgcgcgcccagcgcggtacggcagcgagcacggccttcggccaatggaaccggagcacgacgctcacgatcaccacggtctggacggtcgccagtacgctctggacgatcaccgcgtggcgcgttgttcggcaccagtgggcgttctttctcgatggctgccagggtcagggcctgaccgttggtagctttgcgcagcagggctgcagccagcgcacgcggggtgcaaccgatatcggcggtcaggcggtccagcaggtcgccgtgggtcgattcagcgtcagccaccagcggcgacaggctgttggtcagtttcttgatgcgagcatcgagaacggcctgggcatccggcaggcggacttcggcgactttctgaccggttacacgctcgatcacttgcagcatgcggcgctcacgtggagtcaccagcagcagtgcacgaccttcgcgaccggcacggccggtacggccgatacggtgaacgtaggactctggatcgtaaggcatgtcaacgttgaacacgtgggtgatacgtggaacgtcaaggccacgagccgcaacgtcggtcgccacaacgatgtccagacggccatccttgagggagtcgatcacgcgctcacgctggttctgggcgatgtcaccgttcagcgcagcggctttgtagcctttggcttccagggcactggccaggtccagggtcgcttgcttggtgcgcacgaacatgatcagggcgtcgaagtcttcgacctccagcaggctcaatacagccgaggtcttctggtcagcgtgaaccaacaggtgagcctgttcgatcgcggtaacggtctgagtcttggtctggatcttcacgtgttgcggatcgcgcaggtggcgttcggcaatggcacggatcgactgtggcagggtggccgagaacagtacggtctgacgggtcggtggcagcgccttgaagatgacttccaggtcatccatgaagcccagcttcaacatttcgtcagcttcgtccagaaccaggtggttcacggtcgacagcactttctcgtcacgacgcaggtggtcgcacagacggcccggggtggcgacaacgatctgtgcgccgttacggattgctttcagttgtgggcccataggcgcgccgccgtaaacggccacaacggttacgcctggcatttgcttggcgtaggtttcaaaagcggttgctacttgcagcgccaactcacgggttggcgccaggatcagggcttgcggctcgcgcttggcaggatcgatgcagtgcaggataggcagggcgaacgcggcggttttaccggtaccggtttgcgcctggccaatcatgtcttggccggccatgatgatcgggatcgattgctgctgaatagccgaaggttcttcgtagccggtcgcgatgacggcagcaagaatattcgggttaagattaaaagcggcgaagccgccggtttcctgggtcatgggtctgcctctaagtgcatccgcaaagacccatgctccaaagctgcgcatgccgtgttgagactcaagagtcgccctggctgctttgtcggcggggatttgcgaaaacgaatgaatgaaaaagattcgtcaaggaagagtccgctgtgcggacgtgcagccgaagctgacttcggggaattgcgctacctaaacgcggcccggttaaaggccggcgcgcactataccggaaatacctgaaaaagggagctttttttatcgtaaagcactgatataccgcgctgtgtcacagtctttgcagagagccgtgccagggtctatttttcaaaggcccggccctgctggtcataacgcttaaacggttcacccaacgctcaagacctttggtctgaaacctacccacgccctgagggcacactcgatgaatcaagccagcagtagtcgcgtcagtcgtgcacttcaaggccatgtcctgctgctgggcctggaccgggtggccaagcgcaacgcctttgacctggatttgctcaatgaactgagcctggcctatggcgaatttgatcgaaatgacgacgcgcgggtggccgtggtgtttgcccacggcgaccacttcaccgccgggcttgacctggcgaatgtcagcggcgtgatgtcgggcggctggcagccaccgctgggcggctgcgatccgtggggcgtgttcgccgggcccagggtcagcaagccggtaatcgtcgcggcccagggttactgcctgaccatcggcatcgagttgatgctggcggcggatatcaatatttgcgcgagcaacacgcgctttgcgcagatggaagtccagcgcgggatctttccgtttggcggtgcgacgctgcgctttcatcaggtggccggctggggcaatgcgatgcgctggttgctcaccggcgatgagttcgatgcgcacgaggcgctgcggctggggctggtgcaggaagtgatggccagtgaagacttgctgccccgcgccatcgagctggccaaccgcattgcccgccaggcgccgcttggggtgcaggcgacgttgatgtcggcgcgcctggcgcggatggagggcgaggctgttgcggcggccgggctgcaggtggtggtggagaaattgctcaacagtgaagatgccaaagaaggcgtgcgagcaatggttgagaagcggccgggggtgttcaaggggatttgagctggcagtgcgggcctcttcgcgggcaagcccgctcccacaggggaatgcatttcaacaggtgaacacacttcaactgtgggagccgggcttgcccgcgatggcgccagaacaggcaactaagtcgccggccgtattgccttgatcaacgcctgcaacgagtaccccaaccgcggcgccaaggcttcggcccgcgccgaaagcgcatcaatgtccagctcctgatccagctccgaaggcaccagcaaaatcacattgccctccttcaccggcagttcccagtaatgccggtgatacaacccgcgtaacaacgccgcacccagcggtttgccatcgtcggtggcccactggttgatcaccagccagccgccggggttgagtttcttctggcagttttccaggaaggtccaggccaggtggccgacgcccgggccgacatccgtgtacaggtcgacgaaaatcaggtcggccgactcggcggtatccaacagttgcagcgcgtcgccaatgcggatgtacaggcgcgggtcgtcatccagccccaggtattcgatggccaggcgcggcacatccgggcgcagctcaatggcctcgacatcttccagcggcaggaacttgaggcacgcctgggtcagcgtgccggcacccaggccgaggaacagcgcgctctcaggttgctcatggcacaacgcaccaatcagcatcgcgcgggtgtagtcgtactccagccagctcgggtcggcggtaaatacgcagctttgctcgatggcatcgccaaactcgagaaagcggtaatcggccacttcgagcacgcggatcatgccgaaatcatcatggacttcggccagcaggcgctcgacacgctcctcggtcatcactactcctaaagggtttaccgcacggcaaaggcgcgattgtcggccaaccggcggcaacaggtcacgcactaattgctgataacattggcgcccgaccgtcaatcacccaatcgagttcatgatgagccaaccctggagccccgacagctggcgcgccctgccgatccagcaacaaccccagtacccggacgctgcacacttgctgcaagtggagcagaacctggccagctacccgccgctggtgtttgccggggaagcccgcgagttgcgccgtcagtttgccgaagtgacccagggccgcgcgttcctgctgcagggcggcgattgtgccgagagctttgccgagttctcggcggcaaaaatccgcgacaccttcaaggtgctgctgcagatggccatcgtgatgaccttcgctgccggctgcccggtggtgaaagtcgggcgcatggccggccagttcgccaagccacgctcggccaacgatgaaaccatcgacggcgtcaccctgcccgcctaccgcggcgacatcgtcaacggcatcggcttcgacatgaaaagccgcgtgccggacccggaccgcctgctgcagtcctatcaccagtccaccgccacgctcaatttgctgcgcgcgtttgcccagggcggttttgccgacctgcaccaagtgcacaagtggaacctggacttcattgccaactccgcgctggccgaaaaatacagccaactggccgaccgcatcgacgagaccctggcgttcatgcgtgcctgcggcatggacgattcaccccagctgcgcgaaaccagcttctttaccgcccacgaggcgctgctgctcaactacgagcaagccttcgtgcgccgcgacagcctgaccaacgactactacgattgctcggcccacatgctctggatcggcgaccgtacccgtcagctggacggcgcccacgttgaattcctgcgcggggtcaataacccgatcggcgtcaaggtcggcccgagtatgaaccccgacgatttgatccgcttgatcgacattctcaacccggacaacgaccccggccgcctcaacctgatcgcgcgcatgggcgccggcaaggttggcgaccacctgcccaacctgatccgcgcggtgcaacgcgagggcaagcaggtgctgtggagcagcgacccgatgcatggcaacaccatcaaggccagcagcggctacaagacgcgcgactttgcgcagattcttggtgaggtgaaagagttcttccaggtgcatcaggccgaaggctcgtatgccggcgggattcatatcgagatgaccgggcagaacgtcaccgagtgcatcggcggcgcaaggccgatcaccgaggacggcttgtcggaccgctaccatacccattgcgacccacggatgaatgccgatcagtcgctggagctggcgtttctgattgccgagaccttgaagcaggttaaacgctaagaagttgagtcgacgccatcgcgggcaagcccggctcccacagggtaatgcattccaactgtgggagccgggcttgcccgcgatggtgctctaaaggcctatacccaagttgagcatcgccactctcaaccgagcagcactgggccgctggcaattgagttggacccgctccagccccagccaactggccatctgcgccaggttcaaggccaacgcctgcatgccttcctcatccaaccccggttcttcttcgtgcaccgcatgcaccgccaggcagccattggcgcgttcggcgcgcaagtcgacgcgcgcagcgatgcgctcattgtgcaaaaacggcagcacgtaatagccgtacacccgcttgtcttgcggggtgtagatctccagccgataacggaagtcgaacagccgctcggtacggctgcgctcccagatcagtgagtcgaacggcgacagcaaggcgctggccggtaccttgcgcggtactttcggatcgggcaggcagaatgccggcgctttccagccctgcacctggcaggccagcaattgaccgtcctcgaccagttcggccaagcggctgcggctgtcggcggggtcaaggcggaagtagtcacgcaggtctttttccgtccccacgcccagcgccgtcgcactgtgcagcagcaaaccacgctgggcctcggcttcgcttaacgcgggttgttgaaggatctcgccgggaatcactcgctcgggtaaatcataaagccgctcaaacccacgccgccccgccacggtgaccaacccggcggcaaacagccactccagcgcgtgcttttcatcactccaatcccaccacgggcccgcgcgttcttcacgggtcgacaaactgcctgcgcccagtgcgccgcgcgcctctacgctctgcaatacgcgctcaatagtggcatgctgctcacggccaaaacgcgccatctgcgagtaaatcccctgccccagcttcgcccgttccatgcgccagcgcatcaacgggtacaacgccataggcagcagtgaagcctcatggccccaatactcaaacagcgagcgccgtcgcccctggctccaggcggcttgctcaagaatcaacggggagtaatggccaaggcgcgaaaacagcggcaggtaatgcgagcgcaccaccgcattgacggagtcgatctgcaacacccccaaacgctcaatcagccggttgaggtgcgcggccttgacctgtgccggcgcctggcgcccggagaacccctgggccgccagcgccaggcgtcgcgcttgcttgagtgaaaaagacaggtcggcgggcatgggtttctccggatgggctcgccgaccaccctactgcatcctgggtcattttcgcagcgggtcttgccagaaatgcaggtgacgatcctgctcgacatcgccgcgattaagcccgatgtccttgagcgcctcatcgctcaagctcgccagtgtctgacgctcttcatgcaacgcctgccagcgcgcaatcgtgtgaaacagcccggaaaacggacgtttcgccatcaacacaaaacctttctgacctttcatcttctcgccctccagtggggatgacgcgagtgtgtgcctggccttatgatcaatccaacgaatgtttcttatgcaatacatctcggagattgatcaattgtccggctaccccagcatcgacactgaagtgctgcgcaccttcgtcgccatcgccgatcagggcggctttacccgcgccggtgaactggtcaaccgcacgcagtcggcggtgagcatgcagatgaagcgcctggaagaagacgtgctgcaacgcaagctgttcgagcgcgacgggcgccaggtgcggctgacgccggaaggccaggtgttgctcggttatgcgcggcgcatcctgaaactgcacagcgaggtgttcaacactctgcgcgaaccgcacatggtcggattggtgcgcattggcacgccggatgactacgtgatgcgctacttgccgggcattctgaagcgattctccaaggcctatccgctgattcagctggagatgcactgcgaatcgtccctggtattgatgcagcgccgggacctggccctcacggtgatcagccgtgaaccgggcagcgaaatcggcgaactgttgcgcagtgagcggatggtctgggtggctgcgccgtgcttctgtgtggacgagcatgagtcgctgcccctggccatttccggcctggacagcttctgcacccactggacgcgctccgcgctggatgccagcgggcgcgactatcgcctggcgtatcacagctccaatggtgccgcgatccaggcagtggtcagcgccggcctggcgattaccgtgagcatggaaagcctggtgaccgaagacctgcgcgtactcggcagtgaggaaggttttccgccgctgccgtcggtcgatctgcggttactgcgcaaccctgcaatggcctcgcccatcaccgattgcctggcggagtacatcctcgaaggcttcagactttaaacgtcagcatcaccgcgcagatcgccaggaaagcgcagaacaagccgcgcaacacgcgctcgggcaaggcgtgggcgacttttacaccccagctgatactcagcaggccgccaacggccaggggcacgccgatcatccagtcgacttcgtggtgccaggcataggtcaccaatgtcacgctggtgctgggcaacgccaaggccagcgacaaaccttgcgcgaccacttgggtggtgccgaaaaggctggtcagcaccggcgtggcaaccaccgcgccgcccacgccaaacagcccgcccatagagccagacgccgcgcccaacaccccgagccatggccaggaatagcgcatctcggccgtcggcggcgcattgcgggtgaaaatgcgcaccaggttgtacgccgagagcgtcagcaaaaacgcgataaagccgacgcgcatggcgccggcgtccaggcccaccgcccagatcgaaccgagccaggcgaagctgaagcccatgacgcccaatggcaacgcgtggcgcagttcgatgcgattgcgctggtggtaacgccacagcgccagcatcacattaggcaccaccatcaccaatgccgtgccttgggcgagttgctgatcgaggccgaacaacacgcccagcaccgggattgcaatcagcccgccgccaatgccgaacaggccgccgaccgtgcccagggccgcgcccaatatcaggtacatcgctaaatccaacaccgcttctcactccaaaaccccaggccttgcatgctacccagtcggctctggcgcggaaacgcacagcaacgcacaatggctgtgccaatctcgcataagcacgcctatgaaccccaataccctgaccgaccaactgagcctgtttctggatgtgctggagaccggcagtttttccgccgccgcccgccgtcatccgctgacgccttcggcagtggcgcggcggatcgacagcctggaaagttcggtcggcagccgcctgttccagcgcagtacccacgcggtggtaccgacaccggcaggcctggccttcgccgagcgggcgcggcgcattgtcggcgagttgcaactggcccgggccgaggcggtgtcgttgagccatgcgccggagggcttgattcgcgtggacgcgccggcggcgtttggtcgacggcatctggcgccggtgatcgccgattttctgactgtgtacccggggctggacgtgcacctgcacctgatcgacagctttgtcgacatgcagggcgcgcacttgggcaaggtcgacctggtgttgcgcgccgggcatatcgtcgacacgcggttgattgccacaccgctggccagcatcgtgcgaatcgcctgcgccagcccggcctatctcaaaaaccgtggcacgccgacgcatccgcgcgagttgagcgaacacgacggcctcgactgggacggcctggcgccaatgttcgcctggcgcttcgagctggatgggcgccgcgccacctatcgcccgcagcgcattcgcatgagtgccaataacgccgaagcgctgctctcgggcgcactcgccgggctgggtatcgcgcacctgcccacctggcttgccagtgaatacctggtgcgcggcgaactgttgccgctgttttgcgaagatgggctgcccagcccggaaaccagcggcatctacgcgttgcgcctggagcaacacgccaatgcgcgtagccggttgttgctggaatacctgaagtcacgtttcagcccggtgccgccgtgggatctggcgctgcaaagcggtttggtctgacccagcggacagaattatctggcgcattaaaggtttgaccgctagattccagcccatacacgctttttcgaggcaccgtcatgagcaaaaaccccgatccttgcgaatccttgatgctggataaccagctgtgtttcgccctgcactccacttcgttgctgatgaccaaggtctacaagccactgctgcaagcactcggcctgacctatccgcagtacctggccatgatggtgttgtgggaagaggatggcttgaccgtcggcgaaatcagcagccgcctgctgaccgacccgggctcgctgacgccgctgctcaagcgcctggaagccgaaggcctgctcagccgcacccgcagccgcgaggatgaacgtgtggtggtggtggaattgacccaggcaggccgtgcgctgcaggaaaaggccatgggcattccgcaatgcatcctcggtgccagcgggctgcaactggagcagttgcgcaagttgcagggggatttgattgccttgcggggcaatctgcaaaacgcaatttgaaggcatttacgccgtaaaaatgtgggagctggcttgcctgcgatcgcggtccatcagtcatgaatagagtggctgacatgccgccatcgcaggcaagccagctcccacatttgtttgggtgagtgtcaggaaattctcgtcggaaaagatttttataaatttatcttgcgcactaaacattagcgctatacattcacctcaccaactacttagcgcacaaacatttagcgctaacaaaccaagaggaagaccccatgcaaacgctctataccgcagtagccaccgccaccggcggccgtgatggtcgtgctgtttccagcgacaacatcctcgacgtcaaactctccacccctaaagaattgggtggtgccggtggccaggccactaaccctgaacagctgtttgctgccggttactcggcctgctttatcggcgcgctgaaattcgtcgccagccagaccaaacgcaaaatcccggatgacgcttcgatcactgcccacgtcggcatcggtcaaatccccggtggtttcggcctggatatcgacctgaacatcaacttgccgggcctggatcaagacgacgcgcaaagcctggtcgacgccgcccaccaagtttgcccgtactccaacgccacccgtggcaacgtcgatgtgcgcctgcacgtgacggtctgattaacaaacgcccacaaaaaagcccgacgcaaggtcgggctttttttcgtatcggcgaggccagaattacttcttggcgcgacctttgtacgaaccaccttcgcgggtgtcgatctcgatcaggtcgtcgatttcgatgaaatcggccacttgcagttcggtaccgttagccagcttggcaggcttcatgactttgccggaagtgtcgccgcgagcggaaccttcggtgtaggcaaccttacgcacgatggtggtcggcagctctacggaaaccaggcggtcttcgaagaagatcgcttcgcagacgtcttccatgccttcttcaacgaacggcagaacggcttcgatgtcttcagcgttcagctcgtacatggtgtagtcggtggtgtccatgaacgtgtaggtgtcgccgctgatgaaggacagggtcgcttctttgcggtcgaggatcacgtcgtccagtttgtcatcggcgctgtagacgatctcggtcttgtaaccggtcagcaggttcttcagcttggtcttcatgattgcgctgttacgaccagacttggtgaactcagctttctgaaccagccaagggtcgttttcgagacggatcactgtaccgggtttcagttctttaccagttttcattgcatatatccgaaatttggatgggatttacaaaattcaaggtggcgtatcatatccaactttcataaaacttcaccagcgccgtcgcaagatccgcctgcaagccttgttccagacaccaagaatcggcgttccggcacacctctggccagtgttccagcaacattttccacggttgtgccatatcgccatcagcgttccaggcctgccagagttcaaccaccgccgttttggcggctggcgataaggcgccggtgtagagctccaggaaggcatcgagcttgtccaagtggatgtcttcgtcctggcggtagatgtgccacagcaacgggcgccccgcccattgcgcgcgcacgaacgagtcttcaccgcgcaccgcattgaattcgcagcaccacagcaggcggtcatattgttcctggcgcacgaacggcagcacctgcacggtcagggcgtcgcgctgatgcagatctcccacggccagcccgtctacaccgagccagcgctgcacatcgccgaggatgcgcccttccggcaccaatagatgagtggcacgcccgtccgtcgccagcacgtcgagccaactggcgagcccggcattttcgtaggcgaacaacgacatcaaacgcacatccgctgctggaaatacgccgagcgcctgtaggaattgttgctgtgctgccgggtcgtgctgaaacgcctgacgctgctccagcaacccgccttcacgcaaaagcccgccagtccccggacgaaagcccggaaaaaagaagtacttctgcacgcccttgaacttcaccgacggcaggcgatggcaacccaccacccagtcctcagcactgaggtaatccaggttcatccacaagggtgtgcgttcgcacgcggccatggcttccatatagtcaggcggcaactggcaggcgaatgcggcgatcaccacatcggccgagggcgtgtcgcgccactgcgccggccaatggcacacctccacgccttcctgccactgctggtccagccgcacatcaatctctgggcacatgcgttcgaaggcgcgcaggtcgtcgacccacaagcgcacctcacacgcgtgctccaccaccaattgccgggccaggcgccaggtcacgccgatgtcgccgtagttgtcgacgacgctgcaaaaaatatcccagcgggctttcattccgggctccaacgctcaaaggctcgattgtccgcataaatgcgtcgatgcagaaggcttgatcgcgattattctgcacagtggctgtgcgacaatcgccgccacgccgcaaatgcctgccaggaggccaccatgtctgatcgttcgatgtcgctgttcaagctcagtgttgctgtggcgttcggcctgtggctggggtttatcgccattgtgctgaccacctggctggcctcgcgctacctgttcccgcaaagcctggcgccggtagcccaggcggtgcagcaattgggcaaacccgccgtggccgcgccggaaccgccgaaccgcatgttcgagcaataccaagagaaccttcgcaagcaggaacagcagcagaccctggaccaggcacgcaccaacgcgcgcaacctggccaaccccaaatgccagttctggctgcaacaggaccagaacgcgcccaatgaaaagagcaaggcaaatgtcctgcaattctgcgattgatgaccatgaataaacatgccgttctccagttgatcctggaaaagctcagcgtcgacctcgatatcgcccagcgtgccgcgcagaccgcctacgaaactgcgacccacgaagaaaatatcgccgaaaacaaatacgacaccttgggcctggaggcctcctacctggcggccgggcaagccaagcgggtcgaggaaatcaagcagtcactggcgctgtgccagaacctgcagctacgcgcttacgatgatcagcgtggcatagaagtcggcgcactggtgggcctggaagacgaaaacgctcgccagcaatggctgtttctggcgccggacgcggcaggcttgaaggtggatgtggtggggcaaccggtgaccgtcatcaccccgcgctcgcccctgggcaaaagcctgctgggcaagttcgaaggtgatgaggtggagattctggtggccggcgctcggcaacactttacggttaccgaggccaaataaaccactcagtggacgggcagttctacgccgtcaaacagctcttccagttcctgcttgttgtggcactggatcgccttggccatgacttcacgggtcaggtgcggcgcaaatttctcgatgaagtcgcacatgaagccacgcaggaatgtaccgcgacggaagccgatcttggtcacgctggactcgaacaactcgctggcatcgagtaccaccaggtccttgtcgaggttggtatcgaccgccatcttggcgacgatgcccacgcccaggccgaggcgcacgtaagtcttgatcacgtcggcgtcggcggcggtgaacaccactttcggcgtgaggccacgatggctgaaggcttcgtcgagcttggaacggccggtaaaaccgaacacgtaggtcacgatcgggtattcagccagggcttccagggtcagcttcggcagcttggccaacgggtggccctggggcacgacgacgcaacggttccagcggtagcacggcatcatcaccaggtcgccgaacagctccagcgcttcggtggcgatggcaaaatcgacggtgccgtcagcggccatctcggcgatctgcatcggcgaaccctggtgcatgtgcagggcgacgtccgggtattgcttgatgaaatcgcggatcaccggcggcaaggcataacgcgcctgggtgtgggtggtggcaatcgacagggtgccttttttctcgttggagaattcctgggcgatctgcttgatgctttcgactttacgcaggatctcaccggcagtggtgatgatgcgctcgccagccggggtaacgcgggtcaggtgcttgccgctgcgcgcgaacacttcaacgcccagctcgtcttcgagcaggcggatctgcttgctgataccgggttgcgaggtgtagaggctttgagcggtagcggaaacgttgaggtcgtggtgcgccacttcccagatgtagcgcagttgttgaagcttcatatatgtccctcaaagcagatagacgccacgggtatcagcgacggtatataactatattaaaggtaagacggataaatctagaactttttatcgttttgacccatcaactgtcatcactgcgccgacgctgcagtgacggcaccatataaaccggcactgtcgccagttgcagcaccctcgcagcggtgcgcccaagcggtgtggcagccgcggtggcgtggctgtgacttcctacgatcagcaggtcgacggaaagtttacgcagttggtcgagaatcacctcgcacgggtccccctggatcacccgcaccgagcgaatcaatttcaagtcttgctccccttcccccaactcctcgcgaaaactgtccagcacgcgctgctcgatggttgccatgacggtggtcagcccctggctctgccattcgttcaaggccttctcatcaaggtagctctgcaacaccgattcggcgaacagcccaatcggctcgaccacgtgaatcacatacaaatccgccttgaacgttcgggccagcgccagcgcatgttgcatgacataaggcgcatacagaccgaggtccgtggcatacaacatcgaacgaatcatagaacctcctggactgccaggatggcgaggattgaatgagcttagcagcgcctgcgggagttcgactgattagctctcggtgtgggttttcaactcattactgatgccatggggcacatgcccggtggcgaccacctccctggctttctcacaatgaccggcctgatcatcgaaaaatacatcggcggcaaacgcctccagaaacgcagatttttccaggccgccgaggaacagcgactcgtccaggcggatgtcccattcgcgcaaggtgcgaatcacccgctcatgggacggcgccgaacgcgcggtcaccaatgccgtgcggatcgggcacgcctcgtctgcgaactcacgctgcaacacgttgagcgccgccaggaatcccttgaatgggccaccgtgcaacggctggcgcgccgactcgcgttcgttggccaggaaggcttccaacccgccggactgatagacacgctcggactcatcggaaaacagcaccgcatcgccatcgaacgcaatccgcagctcttcactcgacgcccggcgcgggccgcccgacagaatcgtcgccgcggcaaaaccggcgtccagggcactgcgcacgtcttcggcatgggtcgacaaaaacagatggcaaccaaacgcggccagataaggataaggactgcgcccgccgacaaaagcggcgcgggaaatatccaggccgtaatgctggatcgagttgaacacgcgcaaaccggtgtcggcactgttgcgcgacaccagcaccacctcgacgcgggcacggcccaggctggcgttgaggctcaagagcttcttgaccagcgggaaggcatcgccgggttcgagggtttcttcctcgtgttcaatctggtacttgcggtaagcctccaccccttcggccaggtagaccttgtggctgtcactcaggtcgaacaatgcccgcgacgaaatcgccagcaccagtttgtcgcccaatccctttgccatggtgttccccccgaaacagcgcccgtatcagcggttgcgccgatcaataaaactcaaggcctggtacagcgcctgcatgcgcggcaattcgcaccctgcggccttcgcggcggccaatggccgcgcgtagatcgccgccagctccagtgggcgtttgtgcacatggtcgtggtacatgctgggcaggtagtcgtccatggtttcggtcatggcgaacatctgctcagcgtagctggctggaatttcatggccgcaggcgtgtgcgcccttcaccacttcggccatcaatgcctggatcaactcacggctggattcatcggccatcattgccgtggtgccggtgcccagcaacacggagaggccgttgtacggcacattccacaccaatttgtgccagcgggcgaggtgaacattggccatggcctgggactcgatacccgctgtatgaaacagtgcggcgccctcttcgacgatcgcttgctggcgcgcctcatcgttggccgcggtgccactgtgatagcccaggttgactcgacccaaggcctgatgctcgaccacgcccggcgcggagcggtgcacgccgatatagcacagcccgcccagcaaatgcagcgacgccggcaagtgctcacgcaggctgtcttcgacgtcgaggccgttttgcaacagcaccaccttggcgtccggcgcggcgacctgggcaatggtcggcgccaggtccacattgccggtggacttggtgcctaccaacagccaatcgcacgcgggcatatcggcggcgcgggcataggcctgcaccgggtgcaggtgcagtttgccatgcaatgtactgttgaggtgcagcccgtgctcgctgaccgctgcgtattcgctgcgcaacagaaagtgcacatcaaaaccggcacgcgcgagcatcacgccgtagaacccaccgatagcaccggtgccgataatgcctatgcgtggcgacggggatgcaactgcggtcatggcaaatcctctggtgtacgggtgagtgcttgattcacggcctcagtcaggtcgccaagcgtaagtcgggtctgtaactgcccaaggaattgaccctcgcacacgaggaacaacgcgggcaaatgaaagatctggtagcgctcgaccgcaccgccgttgtgcccggcatccacccagcacacgcggtctacgggcaagcgccagccgggcagttgctcgcgtgcccagcggcaactggaacagccgacactggtaaacaccacaagcgaaatacctggaaatcccagcaattgctggtcaatatccaggtcggtcaattccagttccttcactatactgctgccaccgccgtcaactggacggtgctcggagtccgtgtacatgggtcgttttttacctcaccctgatgatgtcgctgtcgagttaatccaacgccccgctcctgccattccccgccaacgcctgcacactatcggcctgggcggcgtcgcctgcaattgcccgcgtgcctggcgccagggcgcagcagtcgacttgcgcatcccgtccctgggcgccagtgcccgttatccgggctatgtagcctggtgccgcaaggtcgaaacgggctatcgcatcggtatttcttttaccgatgaacacgcgctgttcggtgcgcgaatgggtgagcaagtgtgccagatcgaacgctactgccgcctgcacgaacacaccgagccgacgccggtgcaactcgaggccatggcccgcgaatgggtttcacgccatgccggcgagttctcccacgaggctgttgtggcgccagcgctggattaaagccggctttgcccattgtcgcgggcccgcattacgcgctaaggttcctcccccctgcattcaaatcatgctgtgcccgccgcacggggatggctggcggccggcacccgtgaccctggcgagtaacacgatggctgatttaccgatcaatgacctaaacgtcgaatccaacgagaccctgatcactcccgatcagctcaagcgcgaaatccccctgagtgacgctgccttgcagaccgtgaccaagggccgcgaagtcatccgtgacattctcgacggcaccgaccatcgcctcttcgtcgtcatcgggccttgctcgatccacgacctcaaggctgcccacgaatacgccgagcgcctcaaggtgctggcggctgaagtgtccgacaccctgtacctggtgatgcgcgtctatttcgaaaaaccgcgcaccaccgtcggctggaaaggcttgatcaacgacccgtacctggacgactcgttcaagattcaggacggcttgcacatcggtcgtcaattgctgctggacctggctgaaatgggtctgcccaccgccaccgaagccctcgacccgatctccccgcagtacctgcaggacctgatcagctggtcggccatcggcgcacgtaccaccgaatcccagacccaccgcgaaatggcgtccggcctgtcttcggccgtgggcttcaagaacggcaccgacggcggcctgaccgtggcgatcaacgcgctgcaatcggtgtccagcccgcaccgcttcctgggtatcaaccaggaaggtggcgtgtccatcgtcaccaccaagggcaacgcctatggccacgtggtattgcgtggcggcaacggtaagcccaactatgattcggtcagcgttgcgctgtgcgagcaggcgctgaacaaggccaatatcaagccgaacatcatggtcgactgcagccacgccaactccaacaaggacccggcgctgcagccgctggtgatggaaaacgtcgccaaccagatcctcgaaggcaaccagtcgattatcggcttgatggtcgagagtcatctgaactggggttgccaggcgattccaaaagacctggccgacttgcagtacggcgtgtcgatcaccgatgcctgcatcgattggtccgccaccgagaccacactgcgcagcatgcacgccaagctcaaggacgtattgcccaaacgcaaacgcacctgaccttaaactgcgcacacaaaaacgccgggcttagcccggcgttttttatgctgtcatttaagcttgattgttcccccgctctgcgtgggaatgcagcctgggacgctctgcgtcccgccttactcaatattcagcttggcggcgtggcgctgatggcgttccatgtagcgctctacataggagcacgatggaatcacggtgtacccggcctcttcggcgaacttcaatgcttcctcggtcaaggcagcagcaatgccgcgcccgcgcagtgcattgggcacgaaggtgcgatagatatccagggtctgcttcccgaggtccatataggtcagataggcacgatgaccgtccacattggtctcgaactgatgaccagcctggtcatggtggatggacaacgcctcgctcatcactactcctcgcgggtcttggaattcgacccctaccttaccgatgtttttccggcgaaggaacatctacgccaccccgtgccggtttcgacaacgagaaaacctatagcgctcacaaccagcccgtagagaatagtaggcaccaatcctgtgatagctcaaggcacactcgtcatcccctgccgctggaggttacagacagggcttcgatcaatcagtgatcgatagcctgaacattgccggcagttgaagcatgagacgaactgccgctcttaaagtcacctctacatgcgcaaaagatgccgggaacggtaaaggccaaatgaaaaaaagtgtcggcgtcgatatataaatctttacctgtttacccgacccgacacatgcgggccggacctctcagcttggatccagttcccaccgcactgaaaaaaactgggcagtttttatacaaacctccccaagactagccaaaatagattcggcacaagaattttttttgcttcttgcgctacgtcagtttacttactacaagtaatgagtagtatgtacgccggctatccgctcactctgagaaagtagccatttaatagaaagtccttgaaggggaacacgatgaacaacgttctgaaattctctgctctggctctggccgcagttctggctaccggttgcagcagcgtctccaaagaaaccgaagctcgtctgactgcaactgaagacgcagcagctcgctcccaggctcgtgcagacgaagcctaccgtaaagctgatgaagctctggctgctgctcaaaaagcacaacagactgctgacgaagctaacgagcgcgctctgcgcatgcttgaaaaagcaagccgcaagtaataatcctccggggttgttatcaagccgatccattcttgggtcggctttttttatgcctgggattcaggcctgaaacccaggcaataaaaaagcccgccgcagcacaaggctgtggcgggctttgatcgagcaggctactgctgcagatcgaccggcgtgctcgacgccaccggcgcattggcgcccggtacaccgatctctgtcggcaaaccatcttcggccgccaccacgtcacgcacctggtcccaattgacccgcaggttgttagccaggtcttcgcgcttgagcaaggcattgatgaccgcggtgtgtttgtcgaccatcgacggtgtgccgtcatcattcagtggcgtatgggcttcgaggtagaccttgccgccactgctgccgaacttgtaggcatcgttgatgatgcgcaccgacgtaccgaccggcaccatgtcggccatttccagcacattgttgttaaacatgcggaagcagccgtggcttgtacgcgtaccgataccaaatttcatgttggaaccgtggatcaagtaacccggcgtacccaaggtgaatttgaacggccccaatgggttgtccggcccggcaggcactacgttaggcagtggatcgccattggcggcatgctcggccttgatcgatgcgggtggcgtccaggtcgggttggggattttgccggtgatggtggtgtgcgcaaccggcgacccccagccttcacgaccaatgcccaacgggaacgtgtaaaccacgttctgccccttgggatagtagtaaagccggtattcggccaagttgatcacaatgccttcgcgggggccgggcggcaggataaaccgggtgggcagcacaatctcggtgcctgcaccgggcagccaggcatcaacacccgggttggccgcgaccatctccgaatagcccaggtcataggtggtgccgaggtcagcaaaggtgtcttcgtacttggccttgatcacctggacctggccaacgatgtcttcgcccggcggcggcaggggcaactgcaaggctgacgccgaaccggctgcacagacggcagcgagagacaggcagcaggtaacgacggagaggcgcgacaacatccggaaaatccttcgcagaacgacgggtagggaaaaactgattgtatacgtgaagcacgcttcaagcatcagtgcgccccgctgctattcgaagcgcagctccggccagatcagcggtgtgccgcgcttttgcgattcgagaatggcccggcacagtgggcacagccgctggtcctggaagatcgcgcgatccaccgacgaccagcgcggttgcgccggcagcaacgtgccgcagagcgtgcggtcgatcgagccgcccagctccagttgacgcgcaaccagatgcacccggacttcctggcaggcaaacagatccagctgctcgtcaggctcgatcagttggtaattgaacagggaccaggcagggcgcgacatcgggggctccagatcgggggggcgccaccttagccgaaagcctgccggtagaaaagcgtcatagcagcggttttagcgtcggccagacattttccagcaacttgccttgcgcgcctaccgccgggtgcagttgatctgcctgcatcaactccggatgaccgcccacgccttcaaggaaaaacggcaccagcgggatgtttttttccttggccagggccccgtagacctcggcaaacgccgtggtgtatttcggcccgtaattgggcggcaattgcatgcccaacaacagcaccttggcaccaccggccttggactggtcgatcatcgacgcaagattttgtttcaattgcgctggcggctgcccgcgcaggccatcgttaccacccaactcgaggatcacgacctcgggtttatgctctgcaagcgccgccggcaggcgcgcgagccctccggcgctggtgtcaccgctgatggacgcgttgaccactttatcgtcgaaaccttcctgcttgagccgttgttccagcaacgccacccaccctttgctggtatccaggccgaaaccggcactgatactatcgccaacgatcaggactgtacccgccgctgcgttctgggccatgcacatcaaggccaggccagcactcaaaaaccacattcgcatcggattctccatgggcgcaagcattctcaccgcgcgaaaccttagcaaagtggttcccagcgcggaaggtgaactgactatcctgcacgaactgagcctggaactgaacaagggcgatagcctggctatcgtcggcagctcaggttccggtaaatccaccctcctcggcctgctggccggcctcgacctgcccagcagcggtgaagtcacgctcgccgggcaagccttgagcaccctcgacgaagaccagcgggcgcgcatccgcgccgagcatgtgggcttcgtcttccagtcattccaactgctcgacagcctcaatgcgctggaaaacgtcatgctgccgctggagctggacggccgcaaagacgcccgcgagcgcgcccggcacctgctggagcgcgtcggcctgggccaacgcctcacccactcgccgcgccagctgtccggcggcgaacaacaacgggtcgccattgcccgcgcatttgccgccgagccggacgtgctgtttgccgacgaacccaccggcaacctcgacagccacaccggcgagcgtatcagcgacctgctgttcgaactcaataaagagagcggcacgaccctggtgctggtgacccacgacgagcgcctggcccaccgttgccgacgcctgatccgccttgaagccggcctgatggtcgcgcccctggagccttgatggcacgtttgccgctgttgcgcctgttcagccttgccatgcgtcaattgctgcgcgatgcccgcgccggcgagttgcgcgtgttgtttttcgccctcgtggtggcggtggcggccagcaccgccatcggctacttcggcgcgcgcctcaacggtgccatgctgttgcgtgccaccgagttcctcggtgccgacctggtgctcgaaggcagctcgccggcccggcccgagcaaatcaaatccggccttgagctaggcctggatcacgcacgcatcgtcgagttctccagcgtcatcgccacggacaacggcattcagctctccagtatcaaggcggtcaacgagcaatacccgctgcgtggcgagctcaaaagtgccacgcagcccttcggcgctgaaacagcgggtggcggccccacgcccggcgaggcctgggtggaagcacgcctgctgacagcactggacctgaaagtcggcgatgacattgatgtcggcaacaagaccctgcgcctgacgcacatcctgacatatgagcccgaccgcgccggcaacttctacagccttacgccacgggtgatgatcaacctggcggacctggacgctaccggcgtggtccagcccggcagccgcgtcagctaccgcgaactgtggcgcgcgcctcaaggcagtacggcgctgcagacctaccgcgacctggtcaagccagggcttgccgccaaccagcgcttgcaggattcgcgagacggtaaccagcaaatcggcggcgccctgggcaaggccgaacgctacctgaacatggccagcctcgtcgcagtgctgctggccggtgtggcggtggcgctgtcggccaaccgttttgccagccgccgtttcgacgccagtgcactgctgcgttgcctgggtttgtcacgacgcgaagcgatgttgctgttcagcctgcaactcagcgtactgggcttggcagcgagcctggccggtgccctgctcggctggctggcgcagtttggcctgttctacttcctgcacgacctgctgccggcagacgtaccgcccggcgggttgctgccggcggttgcgggcatcggcaccgggctggtcgccctcgccggcttcgccctgccgcccctggcggcgctgggtcgcgtgccaccgttgcgggtattacgccgtgacttgctgccgatcccttccagtacctggatggtgtatggcgcggcgctgttcgcgcttggcctgatcatgtggcgactgagcctcgacctggtattgaccttcgcgttactgggcggcggtgtcgtagctgcgctgatcctcggcggcttgctgctgttgttgctgcaaagcctgcggcgcttattggcacgcgccaccctgccctggcgcctgggcctgggccaattgctgcgtcatccattggcagcggccgggcaatccctggcgtttggcttgatcctgttgtccatgggcttgatcgcgttgttgcgcggcgagctgctcgacacctggcaaaaccagttgcccaaggacgcgcccaattatttcgccctgaacatcctgccggccgacaaggaggcctttggcgcgcgtctgctggaggtgcaggctcaagcggcgccgttgtatccggtgataccggggcgcttgatcagcatcaatggcgagccggtgcagcagatcgtcagcaaggactccagcggtgaccgtgccgtgcaacgtgacttgagcctgacgtgggcagccgacctgccaccgggcaacgtcttgaccgcaggttcctggtggacgcaacaaccgagtgatgaaattcccggggtgtcagtggaggccaaagtcgctgaaagcctgaagctcaagctgaacgatcttctggtgttcaccatcggtggggagaaccgcgaagcgcgtgtcaccagcctgcggacgatcaactgggacaacttccagcccaacttcttcatgatcttccagccgggcaccttgaaggacctgcccgcgacctacctgaccagcttctacctcgcgccgggtcatgaccagcagatcgtcgacctgtcccgcgcgtttccggccgttacgatcctgcaggttgaggcgttgcttgagcagttgcgcagcatcctcgcccaagtgaccctggcggtggaatacgtgctgttatttgtgttggcagcgggcatggcagtgctgttttccggcttgcaagccaccctggatgagcggattcgccaaggcgcgctgttacgtgcgctgggcgcggagcgcaagttgctggtcaaggcgcgacgtatagagttcggcttgttgggcgcggtcagcggcctgctggcagcgctgggtaccgagctggtgacctgggtactgtaccgttacgcgtttgacctggcctggcaccctcacccgtggctgatactgttgccggtgatcggcgccgtgctgatcggtggtgccggagtattcggtacacgccgcgcattgaatgcaagcccgttgacggtgttgcgcgaaggctgaaaaggccgatggccagcacgctctgctgcgtgccggccatcgtctacttcacatactcgatcgcggtaatccaccaacacacatcgccgctcggggtttgcacgatcgcttcatcgtcaacctccttacgcagcagtgcgcgggccatgggcgaatcgatggagatgtagtccatacgctcataaatttcgtcatagccgacgattcggaaccgcttggtttcgccctgctcgttttcgatatcgacccaggcaccgaagaacaccttcccttcctgctcgggcatgtactccaccacccgcatattttccagccgcttgcgcaaatagcgcacccgccgatcaatctcacgcagcagcttcttgttgtactggtaatccgcgttctcgctacgatcccccagggaagccgcccaggtcaccttgcgggtggtgtccggacgcttttcacgccacaggtaatcgagctctttttttagcgcttcatgaccttctttggttatcagcttggtactcaaacgcatgcatccccaggcaatgtccaataatgccgttacaccgcggcctcaagcgttggtgtcggctggcaggggttgatgataaatgaacccggcaaagtagccaggtcgcaaaacgcatcaatttacgcgtggccatccagggtttgatccagctcaaggagcacgccctgcaagcgctggcgcatagtcgacaagtgcgacatcgccaacgtcaactgttcggtcttctcgccaacgtctgcttgttggctcagcaactgtgcttcacgctgctccaactcacggctcttttggctaacttccacccgctggcgttgcagctgggtatcgcgttgctccagctcaccgagcttctggtcgagctcttcctgtgcctgctgcagcccagcctgccactgctcaagcgcctcctcacgttcgatgaccgcgagcttttgttgcgtcagctcctgggcgaccttggcgaggctggtcagcgtgctgtcaacctcgagcatcgctgcgtgttccatcggggccgggcgtttcgacggcgcgggttcctcaggctcaaaacgagcttgagcgggcggcgcattgaactctactgcctggggggcctgggggacctccctcacctgcgccggctgcgttattgcaatggccgggttcaacgcttcttcaacaacaggctcgagtgcaggcacctccacgagcttgggctggttcgaggctctggcagccggcgagaccatttgcgacgagaagcggatggacggcacgatcaatgaagcactttcgatggccggcaacgagggagcagacatgcccaacgtgatcaccttcatcaccaatgccttcttgatgatcattgaatgatgatcctctggcctggcaggcggcaacttgcagcctttcaaatcgatgaaatgaaagggcactcctgcatcgatatcggtagttgccttagtaccgccagcggcggccgtcgtgaggatttgcttgaagacttgcatggccacctgcaggtcttccttggactcgacaccgctgagaaaataccgatcgagctttttacgtaacgccgcgatgtagaccctggagttaccaggttcggtctcttcatccaggctataaacgagaaagttggagtcggtttgtgcaatcgcaaacccgcagagcagggcaccgttgaccggggtgtcctgaccgttgcgttcaagaacaagcgtacgtaaaagcatcatgataatcaggcctcattacaaaataacaaaccttatataaatgtcgggtttacacccgaccactaataagcctcgtaacaacgtaattgttacagcaagttatccggcctgacgtaggacttttctgatatcgccacccccacgttcccaactgcaatgattgaacgtaaccttttcggcgttcaaccaaaatggcaagcctatttcacgtcctgcaaaacttattcggtaaaaaaatgctcgagataagcagcctgacgaagcacttgggcaaaagaaacgttatcaacaacctctcgttttgcgctcaacgccaagaatgcataggcctgttcggggaacatggcgcgggtaaaaccatactgctgaacttgatatccggattggtgaaaccttccggagggcatatcaacatccaagggttcgacacccaaacccatccacttcaagcacgcaaagcactgggctaccaacttcaggatggtctcaaccatcacacaatgtcggtaaaagacatgctcaacttcattgctgccatccgaggcttcagcggcgctgaaaagcgcagccgggtagatcgggcggccatgcgtctggagttgtcacgtgtgctcaacgccccgctcgctacgctttccagcggtttgaagcgcaaagtcgctatcgcccaggcgatcctgcatacacccagcctgctcctgctggatgaacccactgaaggtatggcgacggatcaactgcttaagttcaggacacttatccactccttgaccgacgaaatgacggtcatcatcgcctctcgacattgcaatgagctctccagcatctgcacgcgtgcgctggttatcgcgggaggccgactgatggctgacgccccactgctcgatctgcaacgtaactctcggcattttcgcgccgtcaccctggccgcagaaacgcctttggacttactggcactggcggtactacccggtgtcgccggcatcgaagaagaccggcatgcaccgggcaaagtgacggttctcgccatgccggggcacaacatctacccccccatcaatgcactcattgccagccgcggctggaacataacttcgctgaatctggagccagggcgcctgaacgaagttgtgcaccatctgagccaagaggtaagcccttgaaacagctgcccgtcattttcaaacgtcagttcgccagttacgccagcacacccggcacttacctgagtgtagccgcgtttctggtgttgtgcgcaacactggggttgtacacgagcccatggctggaacaggacagtggcgacttgcaggtctttttccagctgcacccctggctctacttgctgctgattcccgctgtatcgacgcaactttggtcggacgaacgcaaccctggcttacgcgacgtgctgaacactctgcccatcacggtaaccgaacgcgtgctcgggaagtttctggccgcctggctcgtatgcggtatcgccctgacccttacatttcccatagtggtcatcgccaattacttgggcgccgcggacaatctggttatcagctcacaatttttggccagctggttgctcgccggaagctatttatctgtcggctgcttcatttgcgcactgacgcaccggcgcatggtgactttcctattgaccctcgctttgctgcttaccgccagtgcactttcgtcggtgctggatgcacttgaacgtcaggcccccatttgggtgatcgacagcctgatcgcccttaacccaatctcgcgtttcagcgctatcgacaacggcaagctgacactccatgacagtttgtacttcataagcatgatctttgcctttctgtcggcaacgattgtcactgtgaactacaaaaccagttgaaaaggaaagcaacgcatgcgatccatacttggtaccggtatgacacttacggtcatactcctgattttcctggcatttaatctaacgtgggtaaaccatctgcccaatgtgcgctgggacttttcacaacaaaaaatccacacactatcgccccctgttcgccaattactctcgacgctggaacaccctctggatctttattacttcaattcgagcaatgacccgaagaaaagccaagcgctggaacgccatggcgagcatgtggaagacctgctcaaagagttcgaaaaagcagcaaagggcatgattaacctgcacgttattgatcccgcaccttactcagaggatgcctataaagccggcttgttcggccttgacgactcgcaagggtttctcggccttataggcactcgtgcaggccaggccgctcaacgcatcaacgcattccgtcttgccgacgattcgttgcttgagtacgagatcagccacctgatctacaagttggtgcaccctgagcgccctaccgtcggccttctatccgggctttcattagatcagcctggtgcaaaggtattggagcaactgcagcggcatttcaaccttgttgaactggcagcagacaccgatcaaatccctcaatcagtcgcagcgctgatggtggtgcatccgggcgcgctgccggaggcaaccttgtatgcagttgaacagtttgtactgagcggcgccaaggcgatgctgtttattgatccgatgagcgagatggatacagacgcggccccggcaaacaacaagttggatgggctgctgtcagcctggggcctgcagatgccaacggacaaactactggtggacaacctctacgcctcatcggcctcattgggcccaggacagccgaccgtagtgcatccggcccggttaaacctgccacgccaagcaatgacagaaaatgatgccagtgcctggaaattgaactctgtgatcgtctcaagcagtggcgcactttctcgaccaagaaaaagccgcacaaacttcaccccgctactccaaagttccaggcagtcagcactgctggacaccaagcgctttgcagcagcgaccgcgttcgattcactgattgatgagacgtccacgctcgggcagcgccaggtgatcgctgctcgcctcgatgggccggcctactccacattccccgacggtataaaaggcagtgcgactggtttgcagaaggctgcaaacatccaggtagtcgtggtcgccgacacggacctgctcacggatgccgtcatcgattcggcccccaacagcaacgtgtcgttcgtgttgaataccctggacaacctggctgctcccgaagtgctcgcaagcgttagaccccgtgcaatggctggccaatcttcaaacccgctcgagcacatgcgcgaggcggccgcacagacctatgcgcaaaagtcggctgaacttgagcgacgacttgaacgaacagaacaggagtggcaacgcttgaatccaccgaactcaagcgtcggcactcaagcggtgaacagcaatacccagttgcaagcgttgaacaaggaacgcctgcgactgcccatggagctgcatgctctcaaagtcgaggcttaccaacagctgcatcaaacagaacgctacctgaagctattgatgattgcggcggtgccactgctgttatgcctgatcgcctgggccgtttttatctaccagcgccggcgtcgttcagctgctgccacctggcctcgctgaacgctcaacaccagcgcgtcaacgacgagcaatcagcccttgtcgcgcaatgcgcgtcagctgacgaatcacctcttcggcgtggtcggcactgggcgcctggataaccgcaaggtcaaagctgttgctggcaaaacgggccagggattcgccatcttccacgaattggatcaagaacgccgatggtcgccccgtgcgacgcggccagccgtccagataacgtaatagcgtcggctggtgcttgccgcccagcaggattttggggttgcgttgagtcaggtccgcggtgatcggggccaggcgtatgagggggcgtagtgcattcatcgtgtcgtgtctctgcctcaaaagtctgcgggcaggtgagaggcaacaccgaaccagcgctttagcggaatttcgaaacctgactctgtacgagtgcatgcttctgtcgggctgcattgaacccggtggcgccccgcaattagctgtttaaatcggcgcatgagcagcatcctagagaagccggtggggcagtgtcaagaatcccgagcaatgaaaaagcccgctcatggcgggctttttaccggtgttatgtgagtgtcagtgggcaatggcgcggtcgacagacaatttgccagccccttccagcagcaccgccagcgagccaccgagcaaggccagggcgaattcatacccgttgttagccataaacagaccgttatggatatgcaccgaaaagattgccaccagcgacaggaaggtcagccccagtgccgcagggcgcgccaataaaccgatgatcaaggccaggccggcgaagaactccgtaccgcccgacagcaccgccatcaaggtgccaggggtcaggccgaggctttccatatactgcgccgtccccgccaggccgtagccaccaaaccagccgaagagtttttgcgagccgtgggcggcgaagataatgccgacaaagattcgcaggatagtcaggccataaccggcgcgggtagacaggatgcggttgatcagtgggctcatggtgctaatccttttcaaagtaggggtgggttggccgctatattaatcggataaggcaatgataaaagcgcaaataatgcctaatacatatctataaacccgatcatttgcgtgaagcaatttttgccgctgccggttccagggactcccgctcccgatcaaacgccaagtagtacttgttcacgctattaacatagctgacgccgcccattcccacctgctccatggcaatgcgctcgacctggaagaaccactgattggggttcagcccccgccgacgcgcctccgcgcgcataccctgcacccgctccggccccatgttgtaggccgcaagtacgaaggccatgcgttcacgctcgttgagtttggggctggcaaagaacttgcgacggatcattgccaggtagcgggccccggcctgcacattgctgtccagactctcgatattgttgacgccgacgcgctgcgccgccgacggcgtgatctgcatcagcccggtcgggccgccactgttacgtgcgccggggtcaagggccgactccttgaacgccagcgccgccaggttcaaccagtccatgccctgctcgcgagcatgcttttgcaggaccgggcgcagtttttcaaggcgctggcggtcggcgcgggccagcgggttgcgcacttgatagaggcgacggtagatacgttggaaggccacgtcctgatcggacggggttcggtaggtcttgagaaaacggtcaatactggcccgcagcatcgaggcgtcctggcgcacgaaccagtattcatcgcccggctcgctgatagccacctgacggtcaaagcgtaacttgggcaggattttcgaccagcgctcggcaatcggcttctcgacgatggtgaggtggaagatcccggcctggaccatctccagcacgtcttccaccgccagtgtcggatcgacccactccaccttcaccggcggccgcttatgcagagccaactgctggttgacctgattgatcgcatccgccgccgcactgccggtggtcagcgccagggtgcgcccggacagctgctccaacttggtaaagcgtcgttcacccttgacgcccaccagccacaacggcacatcactggcaatagggtcactggtgctgatcttgtgcacggccttcacatcgagtaattcaccgggcgccaccaggtcgccttcgccacgcgccaatgcgccgagcagttggtccttggccttgggaataatcttgaggttgatttcctcaccgtcacgggcgtgaccattgaggtattgctcgaaagcgcgcaggcggtggtattcgacaccgatggcctggccctgcacttcaccggaactgttgcggctctggttgaccagcacgcgcagcgtgcgactggagcgaatctgcgccaggtcacgcaccttgccgggcttggtcacttccagcggcccgtccagacgtgcgaccgccgccgtgggcagcagtaacgtcaggcacaacataagcaacgccgagggtcggatcatccgctctccggaaagaatactggccagcaccttcgtgaaagacaaagggctggaggtcagaaacagagcgctttatgcgctggcaaggcgcgcaacggtggcatggaggaaggcgtacggccgaccacaatgtcacttgcgacgttcaaagacagctataactcgttgtagttcttagtttttcttataaatctacagctctgatatgctttccggccgcaggcggagatagcaccatgcaactcattgatatcggcgtcaacctgaccaaccccagtttcgacgagaggcaccaggccgttctcgaccgcgcctacgccgccggcgtgcagcaattagtgctcaccggcaccagcgtcgaaggcagcgaacaggcactggaactctgtgtaaaactcgatgaaagcggccagcgcctgttcagcaccgcgggcatccacccgcactccgccagtgactggaacggcgacagcgcacggcaactgcgcggtttactcaatgaaagccgcgtgcgtgcggtgggcgaatgcgggctggatttcaaccgcgatttttccccgcgcccacagcaggaaaaagtcctcgaagaacacctggccctggccgtcgagctgaaattgccggtgtttctccacgaacgcgacgccaaccagcgcctgctggaaatcctcaaggactaccgcgaccacctgaccgccgccgtggtgcattgcttcaccggcgaacagcaagccttgttcagctacctcgacctcgacttgcatatcggcatcaccggctggatctgcgatgaacgccgtgggacgcaccttcatccactggtcagggaaattccccggggtcgcctgatgctggaaagcgatgcgccctacttgctgccgcgcacgctgcgaccgaagccgaaaaatggccgcaatgaaccggcgtacctgccggaagtactgcgcgaagtcgccctgcaccgcaatgaaacggtgcaagacctggccgaacacagcaccgcctgctcgcgcgcgttttttggcttgcctgccgtggattaatgcggcgcattgacccacgtcaaaaccggttcccagagtagcggcacaataatggcaccttgccaatgctgtttccgctatcagagaaaaccttccatgggtgcctggcttagcaatatctcgctgaaatacaaattctgggccgtcaacgcggtcgccttcatcaccaccttgctgctggtgctgtacgccgtgcagctcgaacaacaggcacgcagcgatgcgtcccaggcctcggcgcaggcgcaggcgcgattgctcggtgcgtggccggccgataagccactgcccaaagatgagcactggctgacgtttgcgcgcggccaagtcccacagctggccgaccaggatctatcagccctaagcaccgccagtggttgggtcgagctcaatcacatgccgcttttcggcgaaaacccactgattggtgctgacgttgtcgcgcgggccgacggtcaacagatcgccgtgctggcctacgggcgcagcctgagccaagtcttcggcgaacgcttcgccaactacgccgtggcggtgctgatcctgatgctggcgatgctcggtgcctcgcaactgctgatccgcttcctgctcagccaactcaacaccctcaaagacgtgatgctgcacgtggagaagaccggcgacctgtcggcccgcgtgccgttggcctgcaaggacgaagtcggccagatggccagcgcgttcaacgccatgcaagccggctaccagcgggtggtcggcaccgtggcgcgcaccgcgcagcagctcgatgacggtgccgcgcgcctggccagcagcatgaacgaggtgcaacacggcatgctcggccaacaaagcgaaaccgatcaggccgccaccgcgatcaatgagatgaccgccaccgtctaccacatcgcccagcacgccggcgccacccgcgacctgtcccaaaccgccgacaccctcgccggcagcggccgggaagtggtcagccgggtgcagcgttcgattgccgggctgtccaccggcgtgcaacagactgccgaaatgatccagaaactcgccgaggacagccagaaaatcaacggcgtggtcggcgtaatccacagcatcgctgaacagaccaacctgctcgccctcaacgccgccatcgaagccgcccgcgccggcgaaatgggccgtggttttgccgtggtcgccgacgaagtacgcaacctggccaaacgcgtgcaaagctccaccgacgaaatcacccgcatggtctcggcgcttcaggccggcacccgcgacgcggtggacttcatgcaggaaagctccttcaaggccgacgactgcgtacagcaagcccaggaagccggcgcggccctcgccgaaatcaccggcgccgtggcgcagatgcgcgagagcaacacccagatcgccgtggcggccgaacagcaaagccacgtcgccgaagagatgaaccgcgcggtggtgagcattcgtgatgtgaccgagaacacggtgcagcaaaccgtggattcagcgacgaccagcaatgaattggcgacgctggccggggagttgagcaaggcgattgggcagttgaagctataggactttttaacctgtaatccgactcctacgatcgcccctccgtttacccgaaattttggcgaaacctcctagcctccccggcgaatagcgccgacatatttacccgacgaacctctccaaagtctctcgcctgactattcagtgcgagggaccgccgatgtatttctccatgactacctggcccgaaagggctgccttttgattccggtgattgccaggtttgtcctggcccccatggacgccaaagcgccggatgttgaaagcgtcttgcgtgatttcagagagtgcctgaacacctttgacgactgggccgaacgcttctggagtggttcgacattcgaggtcgagcagattttcaaagtgggagaagacgtcgcactggtagcgccggtctcttccaaagcgccaagtcccaccgttgcgatgtgcaaggcccagggttcgttgaccttggtgcatatgttcgaaagcacgcagttcgtgcccatcggcaatacgccggtgatgctgcaagccattgcagcggatggcagcccggttgggccgccgatccatcacaccattggcccaagcggcattcttgaagtcaacgaatgtacccgcgatcagcggtacaaaatcaccttttacccaaacgtttccagggaccacgtcaaggcgctgtatgcgtcttatcagcgggtgatagctgggctggaaacacgcctgagcgaggaatgggcgaaaaccttcaaggcacagtgggaagacttcgccaaagccacccctttcgaacgtagcgcgctgcaacgcgtggcgcttgtcagcggcatcagccaagccatctacaacctttgggacaacattacgcaactgtatgacttgctggcggacatcagaaccaatagccggaagttgctccagtacatctcccaaaccgaacttgatgaactgctgaaactgagcaaagacgccattgcacagggcctgctggtgctcagcgatgagccgctgttgttcatctatctgtcagcgatggtcagctggatacgcctgctgccgccgcctcagatgtatgaactgatgggtgagattactggcgaagtattgatcaacctggttttgatctgggcaacacgaggcatgggcgtgcagcttcgactgggtgcccaagtgttggggcatatcaagtccggacgtgttcgtggctggctgcagacgctggcggatcagttagtcgggcccaagctggatgcccatgtcgagacagttaaacccttattgctcgccgggccggcgacttcgatcaacacggtagcgggtgcgccgttgaaggctggggagaacctggttgcgaacgcggtgcctgcggttcgtaagaagacgcagcagacagcgttggtgcgccaggagcatgtcgatgatgtgcctgtcgcggcgaaaaacccccagggcgatgcggcggcgcctgcggataaaacagctaccaatggctgcccggtgtcgatggtcactggcgaggaattgctcaccctcaccgatggcgcgctggatgggattttgccgtttgagtggacgcggttgtaccgcaccagtgcggtggaagtggattgcgggttggggtttggctggagtcattcgctggcgcagaggctggtggtttcgggtgattcggtggtttggacggaccatgagaatcgctcgactgccctgcccttgccgactgctgctcggcctgcgattaccaacagcctggctgaagccgcgatctacttgggggctttgcccgatgagctggtactggctcaggcatcgcgcttttatcacttcctcgatggtcagctgacagcaatcagcgacgcgtatgacaaccggctgcgggttattcgtgatcgtttggggcggattgagcggctggataacggtgtaggccggtctttgtttttgcgctatgagcttgggcgcattgtggcggtggactatcaggttcatcgcgccaaaggccgtgagccgtatgtgtgggtgacggagcagaacgtcgtttcctacgcctatgacgacgctggacgactggtttcggcgaccaatgctgtaggcgaaagcgaggtttatcggtacgacgatcagcacgtcattcttgagcggcaattggccggtggggcgagtttcttttgggcgtgggaacgttccggcaaggcggcgcgctgtgttcggcactgggccagtttttcgcagatggacacgcggtatgcgtgggaggacggcggtcgggttacggttcacaacgctgatggcagtcaggaagtctatgtccatgaccagcgcgcgcggctggtgcagcgggttgatcctgatggtgctgagcatttcaaatcctatgacgacaaaggccggctgacggttgagcaggacccgctgggggcggtgacggcgtaccagtacgacgaagccggacgtttggtggcgttgtttccgggggagtatgagccgacttcctacgagcatgacaacgggttcgtacgggttgtgcggcacggtgaagcggtttggaagtatgagcgtaatgaacagggcgacattacgcgccagaccgatcctgacggcaacgttacggactatacgtacaacaaacacgggcaactgattggggtttggtatccggataacggttgtcatcggctggtttggaatgagcgtgggcagctccttgaagagcaactgccgaatggtggggtcaagcggtatcgctatgacgatgttgggcgacaggttgcgcgtgaggatgagcatggggcgctgacccagtatcagtgggacggtgtgggtcggttggttcgtgtcgttcttccaggcggtgccacgcgggaattcagctacaacccgtacggaaaaatca
